United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 14

SEQ ID NO: 42840 - DNA, 318 bp, Triticum aestivum
  Clone ID: PAT_TA_42840
ggggagagaaaaacctcagaccccttaaatcgggtttgcctgcggggaaaaaacccctgttttttttttttggcacttttaaacgggcgggccgggccccctagtttggttgcccccaagcaaactcacaacaatttacagaaccttctaacccatgggggcctggccccttgataacaacctttattcaagggggtggtcgctccaccccctcccgaagggttatcgggagggggggtacccaaattttaaagcttgttcacccatggggggggcccccaacccagggggggttggtgggttttttttcccaaaccc

SEQ ID NO: 42841 - DNA, 423 bp, Triticum aestivum
  Clone ID: PAT_TA_42841
cccacgcgtccgcccacgcgtccgcccacgcgtccgctcccgccgccccctcgcgccgtcaaggcctccggaaccggtcacaggcggcgtaagacccccgccgctacagagccctcgtccgtcgcacttcgccgccgcgtcggagtcatccagctcgtcgacgcctggcggggagatccccagtgcgaggggaacctccacgacgcgagtacttctctacttcctgtcacaaaaaaagatttgcaatctagcatatttatggaagcctttgctccggataaaatttgcgggtcagggagatcagcggtcaccacccaagaaagagtgatggaagcccaaagtagtacttgcttttcaaaagttgtgggacctaacctatggtatggcgatcgcacaagacttacacccaagcaagaagaagct

SEQ ID NO: 42842 - DNA, 426 bp, Triticum aestivum
  Clone ID: PAT_TA_42842
cccacgcgtccgttcctcccggtgcctcccaccgtgaccgtgttccagatccccaagacggtgagagaaggcgccgtatagctcatcaacaagtggcagctggtcgcgccggccctccccgacgacctcatgatccgcatcatcgctttcggcgacaccgccaagttcgagggcatgtacctgggcacctgcaaaaccctgacgccgctgatgagcagtaaattccccgagctcggcagaacgcctcgcactgcaacgagatgccctggatcaagtccgtccccttcatccacctcggcaagcaggccactctttttgaccttcttaaccgcaacaacaccttcaggcccttcggcgagtacaagtccgactacgtttaccatcccgtccccaagaccgtgtgggcgcaaatcttcgtctggctcg

SEQ ID NO: 42843 - DNA, 291 bp, Triticum aestivum
  unsure (1)..(291): unsure at all n locations
  Clone ID: PAT_TA_42843
acccctccggaaccggnccgtaatcccacgctcgacgccacgagtacgccagattacacattcctcttacgccactaggaaccagctagagaccccggggccacagggggaggaggaggagatgatctactacaaccagcatccaaacagaagggccccgccggcgcatgggtacggggacaagggcggttacccgccgccggggtaccctccgggacggatacccacccgcggggcaaggctacccgccaggcggctaccctcagcagggctaccctgcggagtcacgca

SEQ ID NO: 42844 - DNA, 412 bp, Triticum aestivum
  Clone ID: PAT_TA_42844
gctggacagatactcaacctgatctcaaccgtacttccgtccggcgcatctacacattggggtctgcatggctacgatcaacatcaacatcaatggtttgccccgcatcggcacgcttgtggtcagggtcagcgctccacagcccccatgtcgagctcgtgggcgataacgaccccttcatcaccaccgactacatgacctacatgttcaagtatgacactgcccacggacagggacgcaccatgaagttaaggtgaaggactccaagacccttctcttcggtgaaaaagaggttgcggtgtttggctgcaggaacccacaggagatcccatgggctgctgctggtgcctgagtacgttgatgagtccaccggtgtttacactgacaaggacaaggctgccgcttacattaa

SEQ ID NO: 42845 - DNA, 135 bp, Triticum aestivum
  Clone ID: PAT_TA_42845
gctttctactacaaaacgtatccatacacttcacttttttgccgtctccgtccgggccaggtctattctcactccggcagccaacaattttttgatcggacgtccgataatggggccagatggaatcaagtacgg

SEQ ID NO: 42846 - DNA, 345 bp, Triticum aestivum
  Clone ID: PAT_TA_42846
gccagccgtcctcctttttttttttttattcaaacaccttcttatttcattttctcaacagggcaagttgggcactgtttacaccgcatagctcgctagactagtcataggtataactgggctgaacggtgtaaatagagactgaccataccagcatccttacaaaaatttatacaaaggacgcaccgttattttagaaaaaatatcgtcggctatacacaccaatggctgggagggcatataagtagtgtggagctcctccgactgattgttgctcctacaggaagagtgggtgatgcgactagtacgggacttgctggtgcaaatagcgcatcacgttgtttt

SEQ ID NO: 42847 - DNA, 367 bp, Triticum aestivum
  Clone ID: PAT_TA_42847
ccacaccatcaaccacaactacaccgagtgatgcgtctcgacattggaccaacaaacatgacatcacggttggcatgagattggaatggagctccgcttgaagattctttcgaagaatgaatcaaacaatgatggatgatcagaccagtccctagacgaaaagtgctaccaaatgtgttgcctaagttgtgcgttttgtagagaggtttttatgtaggagtgaaggtattcctggtttgagcacggtgtggatgtaatcgtggttcgcattttacccagcgttccatacatagtccgttatcttgccgaagctataggagaaataatccctgaaattattctggccaaaaaaaagccaaaaagggcg

SEQ ID NO: 42848 - DNA, 366 bp, Triticum aestivum
  Clone ID: PAT_TA_42848
acggtttcctattcctggtggttttccaactttaacatggggtctttctgttacatccccacgtggcgctggcttcactccttcctcgcaacatgagctccttgtgtgatctctcctccggcgggtctgaatccgacgaggagtacggtccttccgtcgccacccatagcctccccactctccaaatccagagccttcggatacgggatcatgttatgtgcacccttcgactttgataaggagaactaagcctgtggcgtcgtcagttacttcaacgccctcgccaagttcgggcttactcatcatgtctatggctcgccggcacaggccctcttcagctgggtgcttgccgacttcgcgatccta

SEQ ID NO: 42849 - DNA, 244 bp, Triticum aestivum
  Clone ID: PAT_TA_42849
ccaggacccatctcggggatcagccgacctggatgctccaccttctcctcgtgctgatgtgccgggcccagctcctacacatgacacgatggcgaagattggcgtgctacttctgctgcgcgtacgctgtgccgtgcctcctttgcggcaaaacacctgactttgctttgtctggagcatgactgcatgctacccggcagtcttggcgcttgtagaccagacctatgctggcgagcatcatttt

SEQ ID NO: 42850 - DNA, 170 bp, Triticum aestivum
  Clone ID: PAT_TA_42850
ccaaggcctacgtccgcgcttacgtgtcccgggacctctagagcaaaaacgcgcgtgaggggcgcggacatggctgacgacatatgaaaggcatgtgggggcaagggatgtgctagatgggggaggcgatgtaggagctggaggtcttcttccggaccaagggcatcgtg

SEQ ID NO: 42851 - DNA, 426 bp, Triticum aestivum
  Clone ID: PAT_TA_42851
cgctgtccttcatcgcgcgcaaggtggtgagccgcgggatcaagccgtacatcccggacttccgcacggcattcgagcacttctgcatccacgcgggcgggcgagcggtgatcgacgagctgcagcgcagcctgacgctgtcggacgagcaggtggaggcgtcgcggatgacgctgcaccggttcggcaacacgtccagcagctcgctgtggtacgagctggcctacgtggaggccaagggcgcatgcgcaggggcgaccgcgtgtggatgatcggcttcggttccgggttcaagtgcaacagcgccgcctgggagtgcatccgcccgccggccgcgcccggcggcgccgacgggccctgggccgcctgcgtacaccgctaccccgtcgacatccccgacgtgctcaagcattagcctagccaacc

SEQ ID NO: 42852 - DNA, 429 bp, Triticum aestivum
  Clone ID: PAT_TA_42852
cacggctctccctcctcctcctacgacactcctccccgccttaaatctctcccacattgcaatcccccatggcctcctacaaccccgccaaccctagtaccccggccccgtcggcgccgccgctctacccgtcgctcaccatggccgacctggcgccgcccgagatcccgcggtccccggccttccccgacgcgccgccgccctcggacgacgtgctgctccgcgtccccggcgcgcagctcacctaatcgaccgccagcgcagccacccgctggcggccggcgagctctccctccaccgcatccgcgccggcgacacctccctggccgacatcgcggcgctcggcgccgtccagtggccgctcgcccgcgacgtcgccgtcgtcaagctcgacccgcgccactactcctttttcttcgccgtgcccgc

SEQ ID NO: 42853 - DNA, 430 bp, Triticum aestivum
  Clone ID: PAT_TA_42853
caatgtttatctgctgatcacaaccatggaggctgtagatgagcgaaatgggttttgaggacagtgcggcatgatgtctgcacttataaaaaaagttgcatacaacagaaggcgtgcctcctatgaccaggtctaagaaatacaagcatagttcaaagtaaactgaccagaaaactaagattatctataaataagggtagagccatggattacatgatttcttttcaaaacacaacataagatgaactgcgcaaactgcttatgcaatatattcagaagcataattttgcaaacatgtatctcagtagtgtatactatcaaggtggcattgggtttgcatagctggcaaataactcgccattgtgtacgattgaaccttgaaactgattaggtgtgttgccatcgaaggcgaaaactagatgtcatgctc

SEQ ID NO: 42854 - DNA, 281 bp, Triticum aestivum
  Clone ID: PAT_TA_42854
atcttatctgccaacactttgatcttgacaggatactgcttgaatctcttgggacctaggggtgtatcatatagatggtgacattataaatctataaaaatggtccatactgttgcgttgaactgattactccatgggattactttcaagaagctagttatattcgatagggatcggtcgcgcccattataactaagggcagtttactttgtggtgacaaaataattgtacgcatctgcttatgataagtcacttattgaattttgtgtaattactcactc

SEQ ID NO: 42855 - DNA, 369 bp, Triticum aestivum
  Clone ID: PAT_TA_42855
gcggatgtggagtcaactgaagcggttgtcataggtcacctatgactacaaagccaaggggtggtcataggttattatgacgacatccttttggtccatcttatattcactgtctagcggtctcgtcggcggcaagaagaatggggaccctgcatgtatcattttttttttctttaggtttcatttccaagacgacataggcaaggtgatggtggcttatgcaagaggaataaggctttttgttctattcctactcgatgatgtttgatcaaaaacctgggaaagtattgttggctattggtgtaacatcttatgaactcttcattcttattggtctgataaatggttagatttactacatattttatg

SEQ ID NO: 42856 - DNA, 428 bp, Triticum aestivum
  Clone ID: PAT_TA_42856
cggacgcgtgggaaaagttgtcagtgcattagcttcaccctgctgctccaataacacttatactacactatgtatatacctctaaacttgcatttatgagtatgcccccagttattctaattttcttcacaaatacagcttctgagtagaagtcggtgtagatacttggggccaccgttctcctcaccagacccttgggtgggcgaaggccctcaagcacctccacttgaacttctggtaagatgtaaggaaccaccccaggacagtatcagtcatattagtcttttcttatcagctagctttgcatcgcccgcctccttgtttttaacattttcaagatgatgaattttcggattgccttgcagcttggttaggctctccaactgttttagctcatgcccatgttccgtccttacttgaaatacagc

SEQ ID NO: 42857 - DNA, 269 bp, Triticum aestivum
  Clone ID: PAT_TA_42857
agtacgtttaggaaaagatgccttaacataatctacatgctagtgatacggttacacttatactatactgggcatatacctctaaacttgcacatatgactaggcccccagatttattaactatcttcacaggttcggtttttgagaagaagtctgcgtaaacacttagtgccacagttctacttatcagtcgcttgggagagcttgggcctttaagcacttgcgcttgagctgctggtagcatgcatggaacccccataagactgatg

SEQ ID NO: 42858 - DNA, 426 bp, Triticum aestivum
  Clone ID: PAT_TA_42858
cttgatgcctattattgattcatgaaagaaaaatagcagataaaattgtaatttatttaactgggaaaagaaattgtacactaacctgttcaatggaataaattacaattttatctgctatttttctttcttgatgcctattattgattcatgaaatgactttcggtgtggccaataatgtatttcattcagtacatatttgtgcctcctttttctcccttaatcttaaattttgttgtcaactaatagcagatcaagaaattgtaagatgtgaccattaaactgtagcattggtaggaaacagattgttgaaaatttaaagccagacatggtctgacgtagtgtggtcatattatcttcataagatatatatgattgttgtaattagtgtcattgcaatttttttgtcatgtgtagttgcaactt

SEQ ID NO: 42859 - DNA, 251 bp, Triticum aestivum
  Clone ID: PAT_TA_42859
cccactcgatctgccacgcatacggactgacggttggaggcatcgtttggtgcagatgcggctgaactatctgtgaaaaactgtgatcaagaacatgtcctacctgatggccatggcctgatgggagctggattcttacctgcaagctaagctcatagtcacggacctgacatccgactgtatcaatgagtaaagaaagtggcacgcctgccaagaggagtgacagacaccctacatgagggacacagtac

SEQ ID NO: 42860 - DNA, 419 bp, Triticum aestivum
  Clone ID: PAT_TA_42860
ccgcctccccacctccaccgtcatggatccggcgccgcaatcccaccccatcctctcctacgtgctctcccgcctccccaccctctccaagcccaggcccgccgccggggccgacttcgacatcgagcagccgccggtccacacgccgtccccgcgctcgccctccgtcggcgagttcgagctcgtcgagcggatgccgggcctccgccacgcctccgtgctccacgccatgaccccgccgtcggcgacgtctccgccgtccgctccgcgctccaggagctgggcccgcgccccgaccacgagctcatcgacttctcccgcgccgtcgtcgccggcgccgccgccggcgacgttgtcccgcggatcaccgaggaggacctcgaggcgtgccgtaccgaggtgcggttcgaggaggccca

SEQ ID NO: 42861 - DNA, 164 bp, Triticum aestivum
  Clone ID: PAT_TA_42861
gtggaaagcaaggataacattactctgaattggtatttaagcaacaaccgggcgatgcttgtagcaaattgcctgtttcggatggtcttcactatgatccttgtgtcggacaagcgcttaaacaggatggggtccttgtacaagcatgaccacactgggaggac

SEQ ID NO: 42862 - DNA, 373 bp, Triticum aestivum
  Clone ID: PAT_TA_42862
ggagcttcctgctgacagtaaaatccaccccgtgtttcacgtctcgcatttgaagtctttgaccctcaactacagtctcggtgttctctgaacttccggccaccactgatctgatcactaaggagaccataccagtggagatactggaccgcagaatgatgaatatgggcaatgcacccgtggttcaactgtaagagttctggtacacatattcctccgtctatcacctgggatgattcctcgtgctcctgttagcgttaccctgatgcaagcatttgggacgacgaagcaactgatgaagaagtacgttttctaagtggtgagaattgtttcactgtcagtacatggcatcctttgtgttactgtcttttta

SEQ ID NO: 42863 - DNA, 318 bp, Triticum aestivum
  Clone ID: PAT_TA_42863
cccacgcgtacgcccacgcgttctcggacgcgtgggggaagtaacagtataagagctctaggaggtggggcctctggtggtttctgtcttctgctgctgcactgctggtttcaatggactgctactgtgatatccagcaagtcctatcctatgggttctatatcgcttgactccttcttatgtgcatatctgtgaagaggatgactgaccctgtccctgttattttttagccacactcttgcttgtgcgcacgatacactcatgtcggataaactgaccctctatgctgtgctctttttagggggcgccttcactgaa

SEQ ID NO: 42864 - DNA, 423 bp, Triticum aestivum
  Clone ID: PAT_TA_42864
gttgagtcataccaactccattggccagggatatggggcaatgaaggttaccttgacggccttgctgatgcttatgagcaaggtcttgtaaaatccgttggagtctcaaactacagcgagaaacgtctgcgagatgctcacgagcgcctcaagaagaggggagttccacttgcttcaaaccaagtaaattacagtctgatttacaggaaccctgaggaaaatggggtgaaggcacttgtgatgagcttggtattactttgattgcatattccccaatagcccaaggtgctttgacaggaaaatacactccagctaatcccccaactggacctcgtggacggatatacacttttgactttctgtccaagctccaaccgcttattaacaaaattagggagaatggaggaagctatgacaaaaccc

SEQ ID NO: 42865 - DNA, 289 bp, Triticum aestivum
  Clone ID: PAT_TA_42865
atcacgcgtggccgcacaatttcttctttctttgcctctctcacaaacaaacaaacatacggttcttgtctcccattccaatctcgccctgtcggtacaatcacatgttagaagaataagaagaggaatctaaggaacaagaagatggtgtttgcggtgctttgtaccatcctggtgactgtctgctcgacgatcattggacagcatacggtgctgcagatgctgctccaggggttcgtgttcacgtcattgacaggctcgacttctccatcaaggaggccattcgccg

SEQ ID NO: 42866 - DNA, 266 bp, Triticum aestivum
  Clone ID: PAT_TA_42866
accgggcagaacagcctcgtgtgatcaggccttacgcatcaatagctcctattgagtctggagaaaacaacttaaggccgttatttcatttattttgggtttaaagtggatactgtcagtgctgagttttatccatttgtattccccaatgtcttgaatttcatttttctgtgctactaactctatatttttgttttattatgatattttatattttgtttggttttttgacgagttctttaatattgttgtcacttttgtgattg

SEQ ID NO: 42867 - DNA, 294 bp, Triticum aestivum
  Clone ID: PAT_TA_42867
accggtttgaatacccggctcacccacgcgttcgccacaccaggtccgcgttgagatcgagtcccttttttgcgggactgatttttcggagccactgacccgggcgcaggttcgaggagctgaacatccatttggtccgcatgaccctgggacccgtgaagaaggccaaggatgaagcttgcctcgagaagacccaaaatcacgagatggctcttgttggaggcagtaccagaatttccaaggtcctaattcttcttgaggacttactttgacggtaggagcctaataagggtg

SEQ ID NO: 42868 - DNA, 426 bp, Triticum aestivum
  Clone ID: PAT_TA_42868
cggcgcgtgggcggacgcgtgggcaaatatgtcatttgatgaactactaaaagcctttgcatctaagcatgaagggaatgatatgcctggaaatttgtcaggtggaattcttattgatcaggtttatgccgttgcacccaatgacttgaatacacttcttttctcaccaagttcagactttctgcaatcactagcgaagatgcaagggactaccggtctggatattcaacaatggagacttgaaatgatggtgagatcttgaagagggttataacctacacaaaagctgctactaaactagttaaggccgtgaaagcaacagaagacgtgacatatcttaaggcagatggagatattgatgcagttttaacagatgtcaatacttcctgaagttccctttggcaataatttttagggtggagattt

SEQ ID NO: 42869 - DNA, 414 bp, Triticum aestivum
  Clone ID: PAT_TA_42869
cgcacatccggacaaaaaccacccatgaacttgatccaattacaagctgaagcaaatggacgagccgaccgcgctggctctcgacctggccgggctcctcctacaggcggcgggggcaggggttgtgcgcgccacgccgggcgccaggccgttcgtgaccacgtgcaacgagggccacgtccccgagcactgtgtaaaggagctgaggcccagcctgcttgaccaccaaaccacacggacttgaactccacatggagcgcgaaaaacagaggtggtcatgacacacaggggatgttttagatagttgtcttgttgaggaaactgctgaatataactgtgctgggcccatccaccgtcgccctcgtaaccattggaacaatttggcgagccaggccggttttaacatattccata

SEQ ID NO: 42870 - DNA, 385 bp, Triticum aestivum
  Clone ID: PAT_TA_42870
cagcgagcgacctaaacctccgctccgtctccgtctccgagcaaaaccctagcggatccgtcgaccccgcggggaggagggagggggtcctaatatgcatatcttcgtcaagacgctgaccggtaagaccattacgctcgaggtcaagagcagcgacaccattcacaacgtcaaggccaagattcatgacaaggagggcattccttcagatcagcaatgtctaatttttgccggaaagcatttaatgatggtctaacattatctgattacaacattcataaagagtcgacgctccattttgtcctgaagcttaggtgtggaactatgatcaatgtgaaaacactttactgggaaagataatttgagattgttttttgagcccact

SEQ ID NO: 42871 - DNA, 177 bp, Triticum aestivum
  Clone ID: PAT_TA_42871
ctgacgcgcggacgagcgcactaccttttccttcttttgtaaaacaaaccgggggggctgggaaacagtacacatcctcttcgaacttcagtataggtacccttattgtgctaatggctgattatcctccactactcatgcgccgtccaacaaagataagggttacctcatcgattt

SEQ ID NO: 42872 - DNA, 427 bp, Triticum aestivum
  Clone ID: PAT_TA_42872
tcgaagatcatcaacatgagtgtgatttatactactacaagtgttcaactctgtacgatgttattaaaggtattattgttgtgttgcctatattgataggctccattgggccattagaatggtaatttacctatccggtgccattgacaagagcatgatttatactatagttgtttacctgcgtaagataacacgattttctctgaagtctcagttgtttgtctatttttgtaggcttgcgtcagcttttttcatcgctggggaatttctttcatgactaaataagtgaaaggtgaattattcaaaacaacatacagtgtgaatatgcatcttttgtagtcgagttggaggactttttatcagctgaagcaatcttcgagatatttccttcaaatatttaatccaacttgcatttgcaaattcacat

SEQ ID NO: 42873 - DNA, 223 bp, Triticum aestivum
  Clone ID: PAT_TA_42873
aagacccttagccgcactcgcatgcctactcccatactcttatatcgagcctggaactcatggactgggctctctccatccacacaggcttaccaagctacagttagcgcctccgtccatcttgtacctgattcggtggcgaacaaaaggaccagggtcgtaatgaagatcgcgtcctaccagaagctctgccagttgctcgtggaggacaccaaggtgctta

SEQ ID NO: 42874 - DNA, 418 bp, Triticum aestivum
  Clone ID: PAT_TA_42874
ggaatttctgtttatagatgtctcagactatcatttccttcctttttgctttacaaaaggcagcatatcactgaaaagccctagtgtgtcatttttcatttataaagcggtggaaaatgtacattggtgcatatgtaatatggtccttgagaaggttagctttatctttggcaacaacgggcatatatggaagcacaggctgcatgctatttaaatcttgcttcatgatattgagttggtacaaaaaaaaccctgagatttggttagtaaacaagaacaagtccaatgttgcttggacatgctatcttctccgttccgtgctttgcaaatcttatcttgtcatggtgaaatgacattcacaatccctgggttggcatatgctgctggagaattatttggtcaaataattggtatatat

SEQ ID NO: 42875 - DNA, 443 bp, Triticum aestivum
  Clone ID: PAT_TA_42875
gacgcgacggcatcaactgtaacccgtacctgagcgttgctcatcctcctccttaggtggccgagcggcgcgacggaaggacggagaggcgcctcgttccctgccgcgccgtgcttcgtccgttgccgcgggccgtgcgtccccggccgccgttgtcttcccggccccgcggcggacaccccgagcgttttgtggcagcaggttcggagcccgaccggtgtggagagtggacagcggcagaatgttggagaagaggccggcgagttcagcggcgagaaggtgatcgccgagttcgagcggctgacgcgggacgccgccattgtgcagcgggagacgctgcggcggatcctcgccgagaacggcaacaccgagtacctgcgggggctgggcctcggcggccgtaccgacgccgccagctttaagcaatgcgtgccgctcgccac

SEQ ID NO: 42876 - DNA, 429 bp, Triticum aestivum
  Clone ID: PAT_TA_42876
cccacgcgttcgcggacgcgtgggcttcgaggatgaaccctaaactcatacggcacagccgatagatatataaaacccagatcgggacctccttcctcgtaattctctgaaattagtccatacaaatcgcattcctgtacctctagatcaactaggacctgacaggcgccagccaggaggttcacgacgcagcccagcagcccgcgaactcggactccaactgcagcaaccgtgcccccgggagacgatccccgggtgcgactatgagtatgagcactggatggtcatcatggagggccccccaggagacgccagcaaccccgacatccaccgtaacgagatcatcgacggctacatcaagaccctcgctcaggtcgtcggaatgtatgctgtccccttaccttacccttgatggtgaagacaaagcaa

SEQ ID NO: 42877 - DNA, 283 bp, Triticum aestivum
  Clone ID: PAT_TA_42877
gcaatctatgctcccgcaaaactaatgcatttttttatcctggcaaatttgtgcatttttttccttttttgtgattatttgagatggcaaagtttagtgtcctagcaaattaagctctattttttcctgccactttatgcattattttattttatcataaattattttttatatcctgatggtatttttttagggatacatcttgatggtgtttaaaaaaaaggaaataacgctacatgggcctagcccgttccaccttttttcttcgcgcacttccctggct

SEQ ID NO: 42878 - DNA, 254 bp, Triticum aestivum
  Clone ID: PAT_TA_42878
cacacccgtgggcactagctgccctatcactcatatgtgacttctcctctcctcccgtccatgtgaccgggtcatggctcgttttcttcacataagtcactagcgctttaccttacacgatgtcagaggcttcgccgtgtcaagggtcagaaggcgtaacagaaacttccacccctcccgcgtcgtgcagttctagaggcaccccatagcgttattgcacaaggggtttatctaggacgcggagtgttaccaca

SEQ ID NO: 42879 - DNA, 439 bp, Triticum aestivum
  Clone ID: PAT_TA_42879
cccattcccatcagcctgaaaaggagttagcaagtgaggatgctactcttttgccaaatcaagaccttgttggttgggccgccgtggagaacatgcccagcaaggatgctgatgtcaattcatccaatagcaaagatgaagatgacacaactgaggaaacgcctgcattttctactcctacagttataattcgcagtgctgctgactgtgatgctcaagatgttgcaaatggtcctactaagaaacgttcaaaggcggcaagttctaaggttgcaaagccatcccctagagcatctaaaccaaccaaagaacagcaggaggctaggaaagctacccctaagaaagcgtcaactacgtcaactgccaagaaaagtaagaaagaaaaggctgatgattctgcaagtaatgggctcgataaagggaaggctgatgattctgc

SEQ ID NO: 42880 - DNA, 269 bp, Triticum aestivum
  Clone ID: PAT_TA_42880
cccacgcttgcgtggacccttggccggccccatggttcgcactgcttctgtcggacataggggagcagtgatcgtgtaccattcctcagagacactggttctgcaagtgtttagcattatcaacgagacagcctgagattcctactatgataaacgtcacctgttgacatcacgcgttctcgtaacaaggggaaactagttgtgagcgtacggggcggatgccaactcttgcccagccggcaccggaggagtccaatcacttgtgcaga

SEQ ID NO: 42881 - DNA, 239 bp, Triticum aestivum
  Clone ID: PAT_TA_42881
cccacgcgtgcgccgacgactagcatcaaaccaccttcgtacagtcctcatgatgcaatatgtgttaccgaaagtataccgagcccgaaccagaggggctgcggcgaggcgcatgcaatatgctactcatggaggcactaatccggcagctaccgcgacatactacgtcatgaaatacctgatgacttgcgggactactcattcaactgggaatcgtgacattgcccgtgatggcactt

SEQ ID NO: 42882 - DNA, 258 bp, Triticum aestivum
  Clone ID: PAT_TA_42882
cggtgcgtgggcggacgcgtgggcggacgcgtgggtggtgtggcttcctgttggacatagatcgttctctaatctgcaccttagatttgtgacacagattgttttattgtgatgttgctttgaacaaggaatgggcgatgctctaccactaggattgagtgatgaccacatacataattagtcccaggagaaatataaagtgttcctaggtgtgcttggtatgcagtgaccacctttgcgccaacaacagatggacat

SEQ ID NO: 42883 - DNA, 257 bp, Triticum aestivum
  Clone ID: PAT_TA_42883
atcacagggagggatgcattggcagtacaggtcaagagactttgcaggatcaggaggagtacctgtacttgtggatggggcccgctctttacaatggtggcagccgttgtgtgaagtacttgtcagtgaccactccaaagtgttgggcggtcgattctgaggctaatacgcgggagacggatggcagctacaatgcctatgtcgtggaagtcgggtcaagcgtgatttatcatcgaggtctccattggatcaaggac

SEQ ID NO: 42884 - DNA, 227 bp, Triticum aestivum
  Clone ID: PAT_TA_42884
gctctaagttgatatgtgtatgaagactctctagctagttactaaagcccagcggaaggtggggatctgcatgctctgtgcgactgtcagcaccctcactacaacaataagaagatgaataacctgcagcagaagtagaatgattagatgtcgccaagctggcgtgcgggctaaaggtaccacgtattgtccgagaataaaagaggataaggggttggtagatgagt

SEQ ID NO: 42885 - DNA, 438 bp, Triticum aestivum
  unsure (1)..(438): unsure at all n locations
  Clone ID: PAT_TA_42885
caaatttctacgatatatgttacacctgtaatctcaataatcaaagcaagatcatgttccaacatggcttctattctgtcttctgttttagaaacttcacactaaagcagcgacaagtaatatggaccggagggagtagtaatttttgtctatttaaagactgcaatcctataggaatgtttttcctatatatatgtttggaacagggaatgagtttctaggatttttacggagtgactctcaacagttcctctcgtgcattcatataggctcgcagtcatatatcattaggccctacacttgtctgatttgctctgttgtgtcttcgacacaattgagctgtaagtgtgcccttgctctctgaaggaaataaatgaatgcatgttattgattgttccccactacccaatgttntcatacatgggaagagcttcatgc

SEQ ID NO: 42886 - DNA, 436 bp, Triticum aestivum
  Clone ID: PAT_TA_42886
tctttttcgatttctagggtctgctcatcctcatccccatcccctccgccgtcgccttccccgcctccgaccaaattcgtggtttttgattgatttccggacggaagatatgatccccaactccttcgacaccttcctgtgatctcatctgtccccgaatccagccaccaaaagaagccatactatggtgcgccgccgcccgtcaccgccagatttctcctcctgctcctcctcgacgccgatgctccacaagaacctacgggcgctcggccccggcctcaatccgtgtgcccccttcggcatgggcaactactcccgctaatccctattccccccctccctcatcccctgtgctcaatttctgatttgcttttctccggacccgatttgcttctcccccccttctcgttcttgattggattggattggattggat

SEQ ID NO: 42887 - DNA, 452 bp, Triticum aestivum
  Clone ID: PAT_TA_42887
gttcttcggtacgatgctcctggcgtgtttgatgaaatgtctataacatgatatgttactcattctctctttccttctcggttggttcttgggtcctccatgtcgttagccatcaaggttgggttccttcccactcccttgctcaatttttgcctactgaaagcgatgtgtgttgatgtgttggttttgacaacatccccgtgtgatctttgttggcatatcaaacgaggatatttgatggcatacccgctggatttggacgattggtgtgatctccgttcagtttgtcatgctcctttgtatgcagtctgcagaagcagtcaagacggtgaagatctgctgcatatgagttggctacgtccgcggcccaacaatggttgtcattgccatcaagtgcccaacaattgaagtggtggttgtcgacatctccaagccccgcattcacgcctggg

SEQ ID NO: 42888 - DNA, 285 bp, Triticum aestivum
  Clone ID: PAT_TA_42888
ggcacgcgtccggtcaccatctcgtgggatcgtccaggaacatctactagcttatgaaaatgaaacccactcgaatcggtagccacatttataagatggtggcaccacgcgtgctgctacagatgacattagccaccttagcaccagcgcttgggggcgtagcatcttcggtgaggactactcggacattgttctgactgggaaggatcttgtgaacagtggtgacgacaactatctgacacactacgatgcgcacggacgcgtcgccctacatccttgattaca

SEQ ID NO: 42889 - DNA, 455 bp, Triticum aestivum
  Clone ID: PAT_TA_42889
cccacgcgttcgggtaaatgggtctagaaacttgttgaaactgtgtgattttggtagtgctttgcctgccggaataaatgatatcacaccaattcttgtgagccgcttctaccgggcacctgagataattcttggattgccgtacgaccattcattggatatgtggtcagtaggctgttgcctatatgaactttacacaggaaaaatcttatttcctggtgggaagaacaatggcatgctttggcttcacatggaattgaagggtccattccctaagaagatgcttcgaaagggagcctttacaactcaacactttgaccaggaccttaatttccatgccactgatgagaatctgatgatgaaaaaggctgtgaacaaactgtgtatgaacgttaaaccaaagggtgttggcggaaaaatatcaagcttcgcaggcgaggatccgaaaatgctgt

SEQ ID NO: 42890 - DNA, 399 bp, Triticum aestivum
  Clone ID: PAT_TA_42890
cacttccggcgtacgtttctatgctgaagtttcaagaccgtttgcatgctcatgaatactttcacaaggctgctgcaagggctatcaggtgttacatgaaattacatgattctccattaaaatcatctgctgaggagaatgatgagttgtcaaaactgccagctgcccagaggaagaagttgaggcagaaacagaagaaggcacaagctcgagctaaaagggtaacctacagaactttgttttagatgtatcactagctagtctgccttaatttgcccttaaatctccccaggaggctgaagaaaaacaagaggatgaaacaacttcaaccaacagttcgaaatctggtgagaaacaacaagcaaggccagttgatttggacccacacggtgaaaaatt

SEQ ID NO: 42891 - DNA, 452 bp, Triticum aestivum
  Clone ID: PAT_TA_42891
cgtttctgccgtacacccacttgcagttcagttggcggagggttaacggccaccaagaggctgacggcgagccagccgcagtgctcactactgctcggcggcaacgatttatgcatcattgtggacttgcagttcgccggtgatccactatttccttttttgtttgtcatttgaagtggtctcggccgaggacacagtgccttttcttttgcagtcattcacttgtattagcacaaactacgattcgctaacatggccagttttggtttagctttgttttcgtttcaattacaaagaaaatcgctaccctgttaaacacttattaggatatttagatttgcaaagtggtgctaccagataatgtgatgtacaaagtggtttacgcatttgtgatgtaaaaaaaatgagatatatgtttgttagttgattaacatggcactttcttagtatat

SEQ ID NO: 42892 - DNA, 281 bp, Triticum aestivum
  Clone ID: PAT_TA_42892
cccacgcgttcgcttaaaccaacgtgtatgcataactgagcgaatactagctagaacagagcaagccgggctatgctgaaccacgacatacatttggctgtacgtgtggtactactagtgacgatagcatcagccatagtatcagcggctgactcagtagtagtgacggagagggctactcatacctcaagggtgacctgcgactccctgttggacagctgttacaacaactacctggccgccacagcgcgcgccgactcgttcgcctacagccttgacta

SEQ ID NO: 42893 - DNA, 362 bp, Triticum aestivum
  Clone ID: PAT_TA_42893
gtggaggttccgtaggaccctaaccccttctacctggccgctgctagccgacccggatctacgcattcagatcgccgagacgcccccctatggagtagctggtgtcctcaccgccggacccaacctgtggggcctattcatccagtcagatgactctttaccgacgggaccccctctcggcggtgctacctcgtcactggtcactctcgggatcaggtggatgttcacctgttctttgattgaagacaactaactttgcttgtcctgatggcaagaagtaatgatccgaccaggctccaaagagtcacaattttatgataactatgtgcagaaagtctattctcagcccattggagtaactt

SEQ ID NO: 42894 - DNA, 432 bp, Triticum aestivum
  Clone ID: PAT_TA_42894
tccagacacatgcactcacatagagccggcaccatattcagtgcaagcgacgaatgaacgagggcactttgcgcagagcaccatgccgtgtggccgcagtgctcctcagaacaaacgggacaaaatgtggcgggcgctcttggcttcctaaacccataccaactgtgctgtgagacctgtgagcaactactactcagcttggcgcaagacattataggcgcatagtatggaatcgctgcatgttgagaacctggaatataatgacgcaaaagaaattgtgggactgagagcctgggataccatcgtactgcagtgcaagcaaattatgtgaactcggggtgccatgccatgccatgggctgtccttcaacgaggtgggtatgctaaagtttcatgagttccgaggtagaaagacggctagttctgacggaaa

SEQ ID NO: 42895 - DNA, 412 bp, Triticum aestivum
  Clone ID: PAT_TA_42895
atatgttagcagtgcattttcttttaagtcatgtaactcgctctttaaaaaaacttaaaagaaatttggctgatttgtgacgaacgaggactatcatgtattaacaagtttcttgtagtgaattatgtgtgatgttgctgattatgttgtaagggctgttctatgacaaagagttgataagaaattaaatgttatctaatatgctagtcaaactctagacattgtccaaataaattatgctactatagaaaaataatttttagcagctgtatttgtttgtgatcagttcagaccttatattgttgattctaaagtaactgtttacactgatcatgctgggattaaatatgttatggaaaagaaggatgctaacactagacttattagatggattttcttgctacaagaattt

SEQ ID NO: 42896 - DNA, 143 bp, Triticum aestivum
  Clone ID: PAT_TA_42896
gtggaggtggaggtgggcgctcacgccgtagagcgagttttgagtggccgcagtggtggtttcgtcaactcttcaagcagaggtggcgcctttggtgattcccgcttccctcgttcatgtggtgggttcggtcgttcacgctg

SEQ ID NO: 42897 - DNA, 422 bp, Triticum aestivum
  Clone ID: PAT_TA_42897
cccacgcgtccgcccacgcgtccgcccacgcgtccgttcctgccgccgcccgccgccgccgccgcccatggctctccgccgcgccatcggatcccttgtcgttcgctcccaggcctactacctccgccgcgctgcggcctcacctccgccgtccttcagccgcccgatcatcccctaccggtccttcgccgctccgcctcagcatgccaagaaggtcaccaagggcgacgacgccgacgccgggcccaggatcaacaacgacatcaccgctcccttcctcaggctcgtcaccgacgaagggcatagcgttgtccccaggcatgaggctcttcagctcgctgccaggatgggcttggacttggttgaggtccacagaaaaacagatccttctgtttgcaagatcatggactttcacaaagaga

SEQ ID NO: 42898 - DNA, 385 bp, Triticum aestivum
  Clone ID: PAT_TA_42898
ctcactcatccatcctttagtaggtccgagcaggcctcctctaattgaccatcaggggcgggctgggctcttctgcgttccaagacatcgatcataccttgttatggagctttctaggtgtgagggcacgccagccccatggctgagctgctgtcatgcatgggtccaattgctggctgcgacaggtacagtggcaccgacgagttaacgacaaatgaggtgactggcgcggacatcgtcgcgagttggtagctatgggactcgaaggaaccggtcttgtcagctgttacagatgccgttcttagagcgagccgatcgtgcctgctgctcgtccccaaaatggtcttcctttaacgcattccatctggaagagcctgggcatcag

SEQ ID NO: 42899 - DNA, 406 bp, Triticum aestivum
  Clone ID: PAT_TA_42899
cttcgagcgcctcctactgtctcgccctcgccccccgtcccctcgtcggcgcccgatctaagtcaagatgagtcgtggcgggagtgctggtggtggtcaaagttctctgggttacctgtttggagatggtgagcctgcaaagcctcgctgcagcaccagctgcgaagcccgcacctgctgagaaaccagcaccggcagctgctgatgtagccaagcagattccagctggcattccaggtagccgggcgaacaactactaccgtgcagatggccagaacacgggcaactttcttacggaccgttcttcaaccaaagttcatgctgctcctggcggtggctcctccctgggctacttgtttggcggaaagtgatgttaatgatgctgcttaatgaacgaacgatgaat

SEQ ID NO: 42900 - DNA, 464 bp, Triticum aestivum
  Clone ID: PAT_TA_42900
cccgcttcgccggagcacgccgcacccccgccggtgacctcgaccccaggcctgacctacctccgccgccctctcctttcttctccctccattctctgctcatttctcctctcccctgcagtgccctccatcgccgccatgggagttcgtcggagccggagctccctcggcgccgccctcgcctcccgccgctggatttggccggaaacggagccgccacctccagatccattgtcctccactgcctggcgtccgtccctgacctcctccgccgcccctcatcagagatcgtgccgccgccgctctctagtttgatcgggagatcctcgatccacctccagcgccgttgaccgcagcccccgcccgcgtgggccacgccttccctgcggtcctagcagcgccaagccggatactgctccaccgagccggcccatgaggcctgcttcggtttcgttccggagttg

SEQ ID NO: 42901 - DNA, 433 bp, Triticum aestivum
  unsure (1)..(433): unsure at all n locations
  Clone ID: PAT_TA_42901
gtgccggtccggattctcgntcgaccgacgacccacgccttcgaccacgcgttcgtgtgactccatcattgccagcgcgcgcagcagccactacacacagtatggatccgacgatctccgccgacgtcgtgacggaagccacaccgactcctgcttccatggccgtgctaaaccaaatggtttgctcgagcgcgccggcgccaatcatcaccgtcgtatccaagcagttggttctgccggagggcacagcgccggttgaagacctgaacctgtccagctccgacatgcccatgctgtcgtgccactacattcataagggtctcttgttcccggccacgggcatgcccaatgcccggctcatgtcttcactcgcactgtcactgtcccgcgcgctcggcgttttcccggcgctcgcgggacggctcgtcacgct

SEQ ID NO: 42902 - DNA, 299 bp, Triticum aestivum
  Clone ID: PAT_TA_42902
acgccaagatccatgacaaggaggtcatccttccatatcagctctgtagactgtttaccgacagggatcttgtgggcttcacgcaagtcgatatagtgctgatgctattaaagcacggatgtataatattggtattgctgctggcgtacagtcaatgacagggaacaaagctaatcttgtcgagaaaagcaatcccaaaggtgtgctttttgctcaaacacgtgattgccttctcccaataggccttacctgcgaaaatggtgcacaacggtttggcataacacgcattgagcaagatc

SEQ ID NO: 42903 - DNA, 367 bp, Triticum aestivum
  Clone ID: PAT_TA_42903
cccacgcgtccgcttttccatttccatgagtggatgctcagatcaccccacaccaagtgtgctccgctctgctctgctcgcacgactcatccagcattttccatccgctttcttctagccccattgccgcatgcatcactgattaggtgatggtgcactaactagctgcgtacctggggtcgattatccgtgtcactccggggcgcacacagacacaggagcaagggcatatgctcttactaggttgttgcgctggcgcctttggcaatgtatatatagggctgcacaggtctctgctgctaataccttcacagagctagccgcagaaaaacacttacaaaatcaggatgggtggtgccggcggcgc

SEQ ID NO: 42904 - DNA, 445 bp, Triticum aestivum
  Clone ID: PAT_TA_42904
cctaagagggcaactgagcaaaaccgttggccagccatgacaagtgggcgtgggcctgccaatcttatgccgaatactgaactttctgacaaatctagcaaaccagtgactttgtcaaacacttctagagggctttcaccaaagaagatttctgcttctgaagacacaggtaaaaggttgaatcaatcactggatgacgtggcaaggagactagctattcatgcaaaaagaagagatgaacagttagattctggtagtgatgtttattcacagacaacggaaagatctaaatatgtgagccgtccaagcaggacaaccactttgcctgttcctgttcttcatcgctcatcatcaccaaacaaggtcttgtcagctgcatcctctgcttctagggcttttcagagtccatcgaggacaagaccttcaacaccttgccggtcacaaa

SEQ ID NO: 42905 - DNA, 422 bp, Triticum aestivum
  Clone ID: PAT_TA_42905
ctgaagccaaaggaaaggtggggactttcttggtgaaaaacgcgtgtctgtagcgggcgtgaggacttcgcttacagacctatctgggtctatcgataaccgaagcagcggctccaagaatcgtgtgggtacacacatgccctgcgcggccgatatctacggcagtccgatcgtgggatccagccggctggcgattgcttctcgacggcagttttcttcacggccgaattcagcttctactatgagctcggagccagtaagctctaacgcagaaccaagatattggtggggtatcaaccggttcatttatttgaactgttaaggccagtccagggttttataaagcgggcctgggttcggatgagatcagcaagttttgcttttttaaagcgtataggtttgagcaccccaaacaactgggt

SEQ ID NO: 42906 - DNA, 421 bp, Triticum aestivum
  Clone ID: PAT_TA_42906
gtgcgtgcttggctcgtgtgcaggtgtctgtgtggcgcgtgtgtgctgattgaaagtacagccatgtgacactgattatttgctactgccgatgctgctgattttgcttctccttggttcctataaaagtagatagatgatgattgctgttgatgctgattgtttgctattgctgctagttgctattgctactaccgctgattgctattgccgttgctaccgattttgctgctcattggtacctatacagtagatataatataatactgcattcccaaataaaaaatatagagatctggatgttttaattttttgcatactgaaccaactacttgttatctcttctttaatctttctcttgatcagattctcttctatgctctccattgcaaaaataactcaacatgtacagtgcggtaca

SEQ ID NO: 42907 - DNA, 443 bp, Triticum aestivum
  Clone ID: PAT_TA_42907
atccatcacatcacacctgtctcttgcccgctcacctctcgatcgggacggagaaagatcgccgccgcgcgcgatggatgaggagtacgacgtgatcgtgctgggcacggggctcaaggagtgcatcctcagcggcctcctctccgtcgaccgcctcaaggtgcttcacatggacaggaatgactattatggtggagactccacatcgctcaatctcaaccagctgtggaagaggttcaagggcgacgagacaccccctgcaagtataggagctagcagagactacaatgtagacatggttccaaagtttatgatggcgaatggtgctttggtccgtgtactcattcatactggtgttaccaagtatttatcctttaaagctgtggatggaagcttcgttttccacaagggaaagatccacaaagtttcctcaactgatatgg

SEQ ID NO: 42908 - DNA, 392 bp, Triticum aestivum
  Clone ID: PAT_TA_42908
cggacgcatgggcggacgcgtgggcgccccctcgccttcggcctgttctcctatcttttcttcctcgcctgcgattggtctgcgcaatataaggaggcgaggggagagaaagagacaacccatcatcgcccgtcggtcgtccagcgtaaggccagctagcagcgcggccatggggttcttcaccaggagcacctccaagcagaccgccaagctcaagtccctcgttaagctcgccgtcgcgcgcctcgccgtcgttcgccggccccgcctcggccgccgttccattgcgcgcggcgacgtcgcgcagctcctctccattggccaccttgaccgcgctttctcccgggcggatcatgtcatggatgaggacagcgtgcttgacgcgctggaca

SEQ ID NO: 42909 - DNA, 469 bp, Triticum aestivum
  Clone ID: PAT_TA_42909
agcatttgcattatactattgtgtgtattgtttttaatgccaaaggtaaatctgaacctgctcagaccacggggaggatttctctggtggactatcgctggcaaggttggcatgggagtaggcccgtaccatgggtttgtgtggctggaggaccgtggccagtgctgcgattgcctgatgtccatgtgcagcatagctcggcatgaggtgatatccttctatgataacatagctgtacacaatttcttcaaagaaaattaacatatatatcaaagttgagatttgcaatgtatttaaattagttcttaaattgctccaaagctactgaaatttcccttattatatttttttgtagatactgattgttcaaaattaaactcactacttaaattccatagaaacgagaggctcaaggaagcaacaagtaggatgaaagagttaacgggcagaagcatagatcacagaaaaa

SEQ ID NO: 42910 - DNA, 331 bp, Triticum aestivum
  Clone ID: PAT_TA_42910
gccactcgtttccgactacctccagatccagcactgccaccgtcagaacggacacggcatccaccgtaaccggtacggttacgagcctcgatagaagccgctttcgtcagagcgtggaagaggcgcctccaacccctgatgcctccgcgctcggtgggagcaaccacgcttgttaggcgcctgtgcacgggacaaacctgcacatgatcccgaggcccaacccattgactcgatctgaaaaattccgtgtagagcggatgctgttctggaccctctcggcgctgatcgtgcatggcgtgatcttccgtgccgctgtctccaaccatgggtt

SEQ ID NO: 42911 - DNA, 349 bp, Triticum aestivum
  Clone ID: PAT_TA_42911
gtgatctgctatatgagccatggcaagtttatgatgagaatgggcttgcatttacaacgttcaatatgtattgggaaaagtgcatgaaattgcatatcgagatatcatcatctcttgccccttggaggttggtgcctgtctcaggtatagaaaacatttgcagtagttcaattgatgacctaggtcttgaatcaagtaaggatgaggaatcaagcaatgctttgctaagcagggcttggtctcctggctggcgcaatgcggagaagacacttgaggatttcgtgtctcatggtctcctagattattcaaaagacggaatgaaggttgcaggaactacaacatcgttact

SEQ ID NO: 42912 - DNA, 456 bp, Triticum aestivum
  Clone ID: PAT_TA_42912
cggcgcacgtacaaacagggcaggggcgcgcgcacacgcacccgccccctccgcataaccgacacacactcgctccgtcttcgtcttggcctgctctgccccgccgctaacacaacccataattaggcgagagaggagatcagccacacaccgagcaggaacagttccgactggaccgcgcccaccctctggtttacctttctctctccaccgacgtaccattggcgactcactctgcttcgctcccaaggccgtccggatccgccgtccgacgcgatctgggtctgggcgcgtagtgacaacacagtcgtgacatggggacggcgttcggcgacgacgaccggcacgtgatgcaccagggcggtggcgtgaacctgtaagcgcggcgccccttcttggaggcgctgcggtcgagccttgccgataccttcttcaccgacgacccgttctgaggtt

SEQ ID NO: 42913 - DNA, 428 bp, Triticum aestivum
  Clone ID: PAT_TA_42913
ggcaaatcagtgtgtcccactagttttgtcaggagagaggttggaaaatcaacatttggcaatgctgatgattctttacggactgcttcccaaatactatctatcatgaagcccccagctggattgtctcactttgctacccagctccgtacatcagtgcaatcttgcttgaagctggatactgcacatgcaaagaactcagcaatcactcataataggaatgaattatcagggaatgcttatccaacttacaatcatcaggtcatcatgaaaccaccagcttttgatgctttggacttggaattgatagatctcccaggatctgagatgtgcaatgcaaacgagcagaaactagaatcgtcaggcaatcttaacactgtaaactgtaatggtacaggttctgcgccaatttcgaatgtcactagcat

SEQ ID NO: 42914 - DNA, 426 bp, Triticum aestivum
  Clone ID: PAT_TA_42914
gcagcagctgtattgttccgccagtcttctctgtcatcgcagcatgatcacgcactcgcaaacataaacaggagagctagcccttcaggcagtggaggcagcgagatctcctaccatgctgacacaaccctgatgacaaattcacactcgatcgcatcgggagcgcagctcagtagcagcagcagtggggattcagtttacaagagcttccgaagagatagctccccagacatccccgacctgcaggcagcagtttcagaaattgcaacaaacctgaagcattctcatgaccaggatgatctgaagcttcaaattgagagtatgaaggtcaaactgcgacatctttagatgcttcacgagtgtgctcatactgaaccggtcgacttcgctcaaaaattacacaacaacttgggcattcagcgcgtc

SEQ ID NO: 42915 - DNA, 452 bp, Triticum aestivum
  Clone ID: PAT_TA_42915
cgattcccctcccccagatccaccttcttctcttccagggcgcgccgtcccatccccactgggtttcttcccacaccgacgccgccccacccccaacccgcttcttgccccgccgacgccgtcccatccccatccggctcctcccacgccagttccgccactaccaggcaacgacgttcccgcgcccaactcctcctccttcccatggtcatggcgccaccacgtcccgtccggtgcacttgatgctctgtcttcccctccccagaccggagttgcatccacgacggtcacatcgtgccaccaccaacctcggctgccagggtccctcgtccccttccatggcgagttgtgcctcacgtggaactcagaccaccccaccaccagatccatccaggggaggcaaggggctccgggctgccaccgcaggccacacgcggccaccaccttcatga

SEQ ID NO: 42916 - DNA, 372 bp, Triticum aestivum
  Clone ID: PAT_TA_42916
aataagagaaggagagaagaggccgccgcggcgccgagccctcgtgtcgtcgtgcagccccgccccccactttccccccgtgatccgcccgtgggatctctcgccctcccgcccgcccaccaggatcaagccgcggcccgagcctgccatggggatccctcgctgatcgcggcgcgtatgcaggcggtcaccgtaggaggaggaagagggaggagggtgggcagcgagttccccccttatggtcacaactgcgaggccatactatgaggagataccaattgtgttctgtgaggcggtgctttcctggaaccccaatgcgtccacctattatcaatctgctgttatcccagcaaaatggtttcttttttcttc

SEQ ID NO: 42917 - DNA, 158 bp, Triticum aestivum
  Clone ID: PAT_TA_42917
cttcaattatatctccaaatgatgagttaaatgtaatacagaagcatttaactcttcaattatatctccaaatgatggtcttcgttcaggatcagaatcccagctgcgctgaataagtgacaagagacttggtggagagccagactctggaagggccc

SEQ ID NO: 42918 - DNA, 456 bp, Triticum aestivum
  Clone ID: PAT_TA_42918
gggagtactaccctaatggctgtgactaccagtgggacggttgggtatcggtttctattggccttgaggacgacgaatatgatgacgctgacgatgatgagcaaaggcagcccgtgaaggtccggcttgccatctgtttgatcgaccaatttcagtgggatcagtcagtatacatccatgaatgtgaaacagaagatttcgttctcaatcctgtagtctgcgataaagatttcataagaagatctacgttggaaagatcttcgcatctcaaggatgacagcttcatcatccgttgtgacgtcattgtacttgacgtcaaggccgacgtcaacacggaggttggcgctaccaccatcgtttatcagttcatccaagtccctccttaggacatggcaatccactataagtatctcctcatgtccaaggagggtgctgacgtgacgtttgaggttggcg

SEQ ID NO: 42919 - DNA, 436 bp, Triticum aestivum
  Clone ID: PAT_TA_42919
tgatatgatactcaaccctttcttttttcatttaattttgatgccgcctcatcaaatttacctagttgacatgcatgatactatctatgatactcccattacgaccagcctgagggattctcacgggatggggcgaccagagtggtgtcactggcccatcaatttttaaggcccatatgtcactgactacaaaacaaaatgcatatacggcctagcatgaaaacatgacttctccttttcgttttgtttcagatttttttagtagattttgtctttcttagtatttctcaggtgtaaagtaaattttgtttgaaatctgatgacatgctagtttttgtgtgtgtgcggaagttatgacatgttagtctaacttatatatattgtaatttgttccgagatgtttcaggactatttgcacgacatttttaatatttcg

SEQ ID NO: 42920 - DNA, 320 bp, Triticum aestivum
  Clone ID: PAT_TA_42920
cccacgcgtccggccggcgagcccaacacgatggtgctgtttgaggaggccggcggcgacccgtacgagggtgaacttccacacggtggccgtaggcgcggcgtgcgcggaggccgctgaggtgggtgactaggtggcgctggcgtgcagtcacggcaggaccatctccagcgtctacgtggccagcctcggcgttgctcgcggcaagtgcggcgcctacgagggtggctgcgagtccaaggtggtgctggcggcattcactgcggtgtgcgttgtcatggagtcgtgctcggtgcggcacacggaggattttcttgctt

SEQ ID NO: 42921 - DNA, 300 bp, Triticum aestivum
  unsure (1)..(300): unsure at all n locations
  Clone ID: PAT_TA_42921
cccacgccttcgctgtatgcatgggtctatcagataggtgcactgtcaaatcgtgcatttgcttgactggtttatttacttgctgaagtatgtgcgtcatgttgctcgcggatatgcgcgacagacggagtggttcacagcctgttcccattgtcattgtggtagcacccgagttgatgccaaagctgtccactcgctatatatatacacatatatatacactccctccgttcggaaatacttgactngaaaagtgatggatacagttatagatgcatccatgttttccacaacggtttt

SEQ ID NO: 42922 - DNA, 452 bp, Triticum aestivum
  Clone ID: PAT_TA_42922
cggacgcgtgggcggacgcgtgggaaaaagacacaacagatcgattgagcggacgcaatagcggcagagaggaaaccctaaggaagaaaccctggtcgattgagcggcgcgccggagatggagctcatcgacagcgggttggcgctgatggagatctccatgggcgagtccagtacaaagacgaggatgaagagcattagagaggcggagcaaaccaatctgaggcgcatcagagagttgcaggagaggatccggaggaggcaggagcaacttgttcgcgatccacagccacctcttcgctacgagtttgagaaggctcctacagatgagcaggaggctgaagactaccgacaaatgagggagatgtgctttcgccttaaattcggctcaatcgacggggaaacttctcttggtcccatttgctgtacaaccggaaccaacccagcagatgc

SEQ ID NO: 42923 - DNA, 315 bp, Triticum aestivum
  Clone ID: PAT_TA_42923
cgccccccgcggagcttccatctcttcttcctcgatccctccctccctccctcccaatccctcctccaccccacagccatccctcccccgacgccgggcatttgctggtctcggcgagggccgctcctctgctcgtgtgggaggccgagccctcgccggcgtcgcgtctcgcctgccctcgaatctacggcgagccgctcgcgccccaagcccgagcccactataggttttactgacagacagagacgtacgtgtactggtacagaaatggagcgaagggtggagcctgcctgtcgagaggctttgctggataat

SEQ ID NO: 42924 - DNA, 427 bp, Triticum aestivum
  Clone ID: PAT_TA_42924
cccacgcgtccgcggacgcgtgggtgcaaacttgctctgcttgactctgttttggcctcaaggcgtctcacttgtcacatattgttatcaactcaggtatggtatctggaaaatcgttattctaccaagagaacatttcttactttggtttctaggcatatgaaagtaatgagtaaacataacccgctgaaacaaaaacatggtgaagtagctggctgtatattttgcttggagatgatactgttcactgaccatattttgtttgtatggtggctgtactttgtaacgctagcatggatgtctgttataaaatatacaatatctagatttttgctgggtaaagaaatttgcagctccgaatactttatatttcccggctgttcttaatttctgaagtatgcatgggaactctgggatgacgtgtttc

SEQ ID NO: 42925 - DNA, 455 bp, Triticum aestivum
  Clone ID: PAT_TA_42925
ctctttcacaaggcacttaaagaagcctttgaggtcttctgcaataagggtgtgtctggcagttccagtgctgaattacttgccaccttctgtgacaacattttgaagaaaggctgcagtgagaagctcagtgatgaggccattgaggatgcccttgagaaggtggtgcggttgctcgcgtacattagtgataaggatctctttgccgagttctacaggaagaaacttgcaaggagattgctttttgacaagagtgccaatgatgaacatgaaagaagcatcctgacaaagctcaagcagcagtgtggcgggcagtttacttcaaaaatggaaggcatggttactgaccttactgttgcaagagatcatcaaactaagtttgaagagtttgtagctgatcatccggagtcgaattctggggtagacttggctgttactgtcttgacaactgattc

SEQ ID NO: 42926 - DNA, 461 bp, Triticum aestivum
  Clone ID: PAT_TA_42926
cccacgcgtccgcccacgcgtccgcgaaccaagcctcagagatcactacgcacagcagcagcaccagcaccgccaggaagtgcagtagtcgacgcagctgagccatggcccgccgcacggccctcatcctcgccgcgctcctcctcgtcgccctggccgtcgcgccgttggccaacgccaagaaggccgccaaggacaaggaggagaaggcctccgacgccccctcggccgacgcgccggccgccgactcgcccgcggaggggccctccgatggaccggcggctgcccccgggcctgagggcatcgccggcctctcgcccgacaacgacgacaacgacgacaagtgaacccgagtgcatgcccttctggaaggatccgttcgatgctgaccagatcgtccgcatggattttagtttcgagacaataataatactactacgtataggcctgttgccctgcta

SEQ ID NO: 42927 - DNA, 185 bp, Triticum aestivum
  Clone ID: PAT_TA_42927
gccaaaccttttgggggaactcccccttgggccgtggctttcttgtttgccgttttggttccgaaaaccccgccgccgccgccgccgcacgggcaaaagctcgactcgttccctaaaggtaaggttgggagaagtcatgttcctaaacaatcctttcaaaaccttgtccaaccctaaaaaccttg

SEQ ID NO: 42928 - DNA, 453 bp, Triticum aestivum
  Clone ID: PAT_TA_42928
gcatctcctggatttgagaagcaaatgtttcaggagtggctgagatccatgttaagagaacatggaggtcccttttttgacgctttcagatcaaagcaccctgaaaggacgggagcttatacttgctttaatcaaaaagttggagctgaagaatacaattacggttctagaatagaccacattctcatttctggtgcctgttttcatgactgcaattcggtggaagatcatagcatattccattgccatgttgaggattgtgagataatgaatcatttcagaagaggggattcaggaaatatctcaaagtggaaaggatggagaagtagtaagctagatgggtctgatcatattccaagttatatgatcttgaacggaataccttgaacttcctgcccataataccccaccatcaggtggaagatatttcccagaaatccgggggcgcaacaa

SEQ ID NO: 42929 - DNA, 382 bp, Triticum aestivum
  Clone ID: PAT_TA_42929
gtagctggctgacccacctccacgaccaccccagccgtcgtcgcgtgtgtgcttgttggaggctaagagctgcaagagaggagagatcgtggccacctataccactagcagcagcttctgctgccaccaccggagtgtcatggccgacacaggttgccggcgtcgtcatacacgtgcgggtcggcatcacctgatgcgccagttcagctgcaaaaaaagagcagtatacgttggtgtctactccactcacttggtgaaataaaaaatccagccggatcttgctacacacagggaagacatagagaagacgcctagcatagatcgaccgctgttgtgccacgccgtgcgcgccatccatgccgactgctgcctactgcaacac

SEQ ID NO: 42930 - DNA, 377 bp, Triticum aestivum
  Clone ID: PAT_TA_42930
cccacgcgttcgcggacacgtggggcaggatgtgaaggtcatggtcttcttttcatcatgtagctcagccaaattccatgcagaatttctaaatttccttgggatagagcgttatgatatccacgggcaactaaagcagcagaaacgcactagtacattctttcaattttccaagatgaataagggcatcttattatgcactaacgtggcagcacgtgggcttgatatttctaatgtggactatattgtgcaggatgatccttcagatgacctaaatgacttcattcatagagttggtcgtactgcccgaggtgattaaggcataggacgccctgtattgttcttacttcccaaagaaatgaagctgcttatttacc

SEQ ID NO: 42931 - DNA, 446 bp, Triticum aestivum
  Clone ID: PAT_TA_42931
ctcagattataggcgaaggccttgggtcgcttggcatcaaagagctcgagctgcttgaaaaacaacttgattcatcctcaaggtacataagatccacaagactaattgattgctttccatataatcatgatttagaagataggagcactagctctttcattatgtacagaaaacaatacaaattgttcctttgtactgcatgtttctactctgttaaataatcataggcaatattatgctgctagatggtcatgatcacttttgaccagtgttgtaggtagattacacctatttttgtcttgctttgtttttaagtaaagttgattagggtgtgtgccatgatcaagcaataagcaaaatggagtctctttaagctgcaaatttagcccagttaagttcaatggacataacacatcttacggtaatgagcctttctgtacactaca

SEQ ID NO: 42932 - DNA, 409 bp, Triticum aestivum
  Clone ID: PAT_TA_42932
tagcaaccaactgattgccatacggcgccaccgcgaatcaaaaggttaagacgcctattaccgcgcgcgccactgccgatcgatcgacagcagagtagcagacccacgcgcgccatgtcgtcgccggagcctggaagcatcgccagccggtggcgcgagctgcatggcgcggggtcgtgggagggcctgctggacccgctggaccaggacctgcgcgccttcatcatcgcctacggcgagctggcggaggccacctacgatgggttcaactcgcagcgccgctcgccgcacgccggcgcgtgcttctacggccatgccgacctgctcgccgccgccggggtgtcccgcgcgggctactactccgtcaccaagttcatctacgccaccagcgggttcttcctggcgccca

SEQ ID NO: 42933 - DNA, 445 bp, Triticum aestivum
  Clone ID: PAT_TA_42933
cggacgcgtgggcggacgcgtgggcggtaagtaagaaactctctaaccaccgatcctaaagaagggcaaagggactcgaaggccgtctaccaccgccggccacctccatagcagtgccggcggcaccctgtacgtctacaccgaccagctgctgcgttacccatctgctgcctttcttctccggcaatctcctcgctgttggagacgctaatttaggtggagacgtggagccatgggctacacaaggggtgcacaagcaggcagcaagtttctctcggtactcaacaaccttatgttgatgactatcccacgtggagagtggagatcattttctcatctaagaaatctctcaacgtctatgccgctaatgctaaaggatgtaaattatgatgtttaggcgggcattaggagtgggctcaaaatgcatgtactatcatgcacatta

SEQ ID NO: 42934 - DNA, 248 bp, Triticum aestivum
  Clone ID: PAT_TA_42934
cccacgcgtgcgtgagtgtaatgaaatgattggagacaactgctgcctaccacttgtaacaaggcgtaaacgaactcttgtgacgagtaccactaaccatcacctccatatcggttgccgacacagcttcgacctttgcatgagcaacatgttccttgcctacattgaaaggtatgttatagcatactgtcttcgatcgcggagacgctgcatgaggtggggataatgacccttttgcatcgcagggg

SEQ ID NO: 42935 - DNA, 410 bp, Triticum aestivum
  Clone ID: PAT_TA_42935
cagaccacagctgcggcggcgcgcgcataggaggcgaagcagtagcggagccaagccaccgacgccaccatgggtatgtggcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgactggacactggtaacttctcatggggtggcgaggctgtgacccggaagacccgtttgctgaatgtggcttacaattcgtcaaacactgagcttgtgaggactcagaccctggtcaagaatgccattgtgcaagatgatgcagcccctacaaagcgggggta

SEQ ID NO: 42936 - DNA, 240 bp, Triticum aestivum
  Clone ID: PAT_TA_42936
ccgacaccgactgcgtgatccatcgcctccagcttctacgcgagccttcatttagcggatcatggagctgaccaatgcccaagagcaagcccaccggcgtgaagagagatctgatcgggcatattatcaagcaagggcactacaaaggaggctacaagaatgcgattgagggcaacaatgtggagcagtacttctctcgacatctctgtgccgagccctttgcgccacctttgtggacaa

SEQ ID NO: 42937 - DNA, 364 bp, Triticum aestivum
  Clone ID: PAT_TA_42937
tcgccttccagttttggaaggaagcctcttttggaagtcgccgaggaggccatggcccgtacgaagcagaccgcccgcaagtccaccggtggcaaggccccccgcaaacagctcgtcaccaaggcggcgaggaagtcggcgccgacgaccggcggagtgaagaagccccaccgttacaggcccggtaccgtggcgctccgggagatccgcaagtaccagaagagcacggagctgctgatccgcaagctgccgttccagcgcctggtgagggagatcgcgcaggacttcaagacggaccttcgctttcagttccacgccgtgctggcccttcaggaggcggtcgaggcgtaccttggtggggctt

SEQ ID NO: 42938 - DNA, 343 bp, Triticum aestivum
  Clone ID: PAT_TA_42938
gctccagccgcccggacccgccgccgctgcagggcctagggtccagctgccgctggtacaggggagccaccgcggcggtcggcccgctgtcgacccctgtgaacctgggcgtgagcatcgtgccggagaggaaggtgttcgtggtggagcgcttaggcatgtaccacaagtctttctcctcggggattcacttcctcgtgcccggcattgaccgcatcgcctacgaccactcgctcgaggaggaggccattcaaattcccgtacaaccctgccatcacaaaggttggcaccttgatctagattggaggagtgctcacatgttaagtatgccgttcctttcctt

SEQ ID NO: 42939 - DNA, 380 bp, Triticum aestivum
  Clone ID: PAT_TA_42939
gcgggtttggtgtctgtgtctgtgttcgatcaccaggtccgatccagagcgatttggcctgttggaggttgtgattgctgtctctccgaggaaagaggaagttctcttctgaacttcggatttagcttgtggatgggcggacctttggtagactgcagtgctgaaggtgtgagcagcagctcatgtctcagccgcagcacctgtggaaaagcaggttttgagcacagctcttgtgctctccctgaagatgaaaagtttgaagctggaatagcatgtgtgaaagatgatttggttgtcaaggaaatcagtttggctcttgttgaggtgattgcttgtctataatgactatgatgatgaaaagactgttcttagttaatact

SEQ ID NO: 42940 - DNA, 401 bp, Triticum aestivum
  Clone ID: PAT_TA_42940
cggacgcgtggggtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttacttgttggattttcttagatgttgcggccatgtcatgtttgcagac

SEQ ID NO: 42941 - DNA, 377 bp, Triticum aestivum
  Clone ID: PAT_TA_42941
agacgagatgtagcaaaattacttgggtgtgtttcccataaaaaggttggacaagagtgagattgttcttgtcaacattatccaaccaatcaaaatccttttgacaaacaaaacatatcctcgacatgaaataatcaattacatgctcatttgggaggccgaccgggatatgaatatgatccatgtatatgatcgctaacatgggaaggcatgaagcgatctgaaactttactgctttttctgtatttgcttgcatcatcttcttctcttgaaagattgcaacctccttcatcgctcatgccaacaaatgcacatcccaaacgaattcaggaccgatctcccttcccctatgactaatggatcctttggcagatgtt

SEQ ID NO: 42942 - DNA, 275 bp, Triticum aestivum
  Clone ID: PAT_TA_42942
ctattcagctgaaatcatggcagagaaaacacacaagttcacagtctgttacacatcatcacttgactgatcatccacacagaggggcccaaaaaaaaatagtgtaaccagcctacacaacgcaagagctcacagcctgttacagacaccatcacttgactgatcatcatccacaagaccaatgttaaaagagaggcttaccaagtggtacggccgaaagatggagttagagatcgtgattatttcacggatatgatgtggtagaggtttcttta

SEQ ID NO: 42943 - DNA, 408 bp, Triticum aestivum
  Clone ID: PAT_TA_42943
ctcgacctctcacctagcgcacatccatggcgcgcttcctcgtcgccctcctcgctgccaccctggtcgcggttcaggctggagggcagctgggccacgcagcgccggcgacggcggaggtgttctggcgcgccgtgctgccgcactcgccattgcccgacgccgttctccgcctcctcaaacaacctgcagcagaagccaccagcttcgtaagagaccccgaggacaggccccccttcgactaccgtgattacagccgctcgtcgtccgatgatgaaccaagcaagcgcaccggcgccgcctccggagcggggggcttcgactacgacaactacagcggcgccgacgaacgccgtggcgccaccgatgaatacaaggcgccgagcagcagccccgctggaagcgggg

SEQ ID NO: 42944 - DNA, 382 bp, Triticum aestivum
  unsure (1)..(382): unsure at all n locations
  Clone ID: PAT_TA_42944
cccacgcgtccgggcttctgatactgaggccaccgaggaggccgtcagttttgccctggattatgccaagaagctcggcctttgcaagtcaggagattcagttgttgcggtgcatcgtctcagcgcatcatctctcgtcaggatcttgacagtgaattagtgtcaggtgaggttggctcatggggacaaattttgttaggttgttatcggatcctcgctatcattttgttggctcatcccacgtcgtgagtcctatattacgtcttgtgttcagctacgcatagtaaagagttggtgtcgcccattctgaatatcctttgctaaataatacatactctccctactcaatatatatgccagttcgttcattanatatatatat

SEQ ID NO: 42945 - DNA, 400 bp, Triticum aestivum
  Clone ID: PAT_TA_42945
gaaaaacgcagccacgctctgcctcgccgtgctccgccccgccccaccacctcgcgcgacgccccgcgcgtcgtgcgccgccggcacgcccccaccttcttcctccccggctcattccccaccccacccctcgacccccaccaaccactgccctgtccaccatcgttgggcgcctccaccgaccacccacccaccggcgccgaccccgacgacccaatcgtacccgagacccggcgcccccatccatctaccttctcatcgcgtcgcgcccccgggcccccaaaagcaccgcccgacatgggacccgagcgggcaaccgcccaagggcgcctcccggcggtgcttccgggccaacaactactcacatccttccccacgattggttgcctccattaccctc

SEQ ID NO: 42946 - DNA, 363 bp, Triticum aestivum
  Clone ID: PAT_TA_42946
cttctgcgccgtccaacgatattgcggcgtattcgtcgcaccgagacagagaccacgtctagaccgagcccaaggggttcgaacgggctcgccgggactaccaggctggcgacatgtacacgcacacatatatcaacgcagcacatatcaacaatctcagcctagcagagaaaaagcccacccgtgccgacaatggatacacaaaggcacacaactaagacatgggtgacggaacacacagacaaacttgcatgctaacacagtgtgagggactacacatgagatacatagacggacaatcaaaccatcgagacttagttcgctcttcatgcatgctcatgatgggcctggagagcatgctac

SEQ ID NO: 42947 - DNA, 403 bp, Triticum aestivum
  Clone ID: PAT_TA_42947
gtgatctcaaacaggcacacgagcaggtatgtgcaagtatatcatctgattcgacaaatatgaacgagcttgttcagtggaacgagctttacggtgaaggcggatctagaaagaagacacctctaagctacttcatgtagcttatgtctagtctgtacatagagcagaagcattatagtgaaacgactgagaagataggcaatgaatagctctgttggttttcatttataggcaatttttttgagtcaattgttttgtaatgtcagtttggagttcctacagatagcgtaggacctggttggtccaccattctccttgaacggtcaaacctgtatgtagactgagcatcagaatacagttcagttaattgatgttccagccagtgcgaatccagttaggtctt

SEQ ID NO: 42948 - DNA, 406 bp, Triticum aestivum
  Clone ID: PAT_TA_42948
gctgcagaaggaggtcgacaggctgaccgagctcgccgagagggctctcctggacgcctccaaggccgaggaggacgtttccaacataatggtgttggctgagcaggccgtggctcttgagatggaagcggccaagcgcgtgaacgacgcggagctggcgttacagaaggcggagaaggcggtcgagtccgttgtggagctggtgccggctgctgatgggcacatgagtgacgaagaggacgatctttctgatgtttatgactatagcggtgacggcatggctgacatttctgaagggatgaggtgtcaaatgtcgagcgtttgatgcagattagcgacttggctgctgaaggcatcgagccgcttgaaccgtctaatgaaatgcctgttgaagaacgcagtgaca

SEQ ID NO: 42949 - DNA, 372 bp, Triticum aestivum
  Clone ID: PAT_TA_42949
agccatgtagccactgtaaagaagaaaaggattgggacgttcgtgcgccggccggaaaaccttgtgtccactgttcttcttcttccacctccattcaagtgagaggagaggtagctagagggctgcggttccaacaaagatggggtctgagcgtccaattcccacagtacccgaggaatcccaaatatgattcaatcggccatgtgtcatatggaatgtcgaggaggacaggggagggagttgggatggcaggcggccacctgtatgaaggacgatgggaataaaatgagataagggggagcacccaatttaaatgggaattcatcagtttcttgtggaggtcatggggagaggaagtgatgcgcgtataat

SEQ ID NO: 42950 - DNA, 229 bp, Triticum aestivum
  Clone ID: PAT_TA_42950
cgctacattgcacggtcgcttcgatgccacttggtaatcttgattagagaactcggaatcaatgcgtctggtagtactactcgcgtgtctcatgtcaaacctgattgagtgatcctcatgagggaccaacaagaacagacgccacttttgtcattgtgttgtgaaggccttatctgatactagtatttcctgtgtgctgctttattgattgttacatgtatgtgctgcc

SEQ ID NO: 42951 - DNA, 400 bp, Triticum aestivum
  Clone ID: PAT_TA_42951
gccccagtgagtgcgggcaagaaaggcaggaagtagtaatcccttctgttaggacaaactgggtattctggtgacattaaacttttgcagacggttaatgtggatagacggtcttttatcaaaatgcatgtactagcgattcccctgcttgcgcttgggctcctaggcacttaccgccaaatcatttggttgcttctgggcgacgatggttgctatgaagaccatctcgctttccatccggactatcgggctatgtagatagagactggcatttagtcagaggtgcgcaccttataagtgcatgtccttgacttggcggaaggaggtgaaacaagttcatccaatgatgtgcaacatcctttggagtgctttgggccctcgcgtttcagtttcacggaga

SEQ ID NO: 42952 - DNA, 406 bp, Triticum aestivum
  Clone ID: PAT_TA_42952
gctgcgcactgatcgcggcggcgagttcacctccatcgagtttggcgagtactgcgccgatcgaggtgtgcagcggcagctcaccgccccatactcaccccagcaggacggggtggtcgagcggcgcaaccagacggtggtgtcaatggcgcggagcatgatgaaggcgacggcgatgcccgccaagttctggggggaagcggtgaccacggccgttttcctcctcaaccgcgcgcccacgaagagcgtgcgcggcatgactccctacgaggcctggcatgggacgcgtcctgcggtgcacttcctccgcaccttcgggtgtgtggcacatgtcaagaacgtgcgcccgcacctgaagaaactcgacgacagatcgacgccgatggtgttcatcggctacgaggaa

SEQ ID NO: 42953 - DNA, 391 bp, Triticum aestivum
  Clone ID: PAT_TA_42953
gtccctcgctgcagccgcgacctttctccacctcccggactgcaccgcctgctgctaccacttcgtcgccattccccgctccctcgccggccgccgggccctcctccttcgcgcgcgcgcgccccgacgcggcatacgtcgtgtgcagcgccgcggcggcggtcgacgcctcggaggcggagcccgtggagaagttccggatggacaacctgagccgggacaagggggcgcggcggaagcccaagcggaaggggcgcgggatcttggcggcgcagggcgccagctgcgggatctgaatgcgcgagcagaacgggcggcttcagcccggcgtccgacgaggtgtcgcgggcgagcaaatgcctgtttatcgtctactcgctgagcaagaccg

SEQ ID NO: 42954 - DNA, 405 bp, Triticum aestivum
  Clone ID: PAT_TA_42954
ttatactgcagacatgggcattggtggtggacctgatgaagccaaacttctgtgtaatgcaatgcataaggtgactgtattgtgatacattggttgagcaggtatctgagctctcattcgggttgctgagcagctgcggaattgctttacctgcgcaggttctgtcggtgcggaagttgatcttctacggagcatgttctggtcaactgcgaagtagatttgtcggattcataacctgcaaaaataaaaagatttgtgctacctccgacccatagaaggtgtcgcagttttgaacgacacttattttggatcagagggagtagggtttatttgtccagtttggtagctccttacctaaatataattgtaggcatcatccaacaggcatgatgacaagcagcgact

SEQ ID NO: 42955 - DNA, 409 bp, Triticum aestivum
  Clone ID: PAT_TA_42955
caaaatcatcggcacactttaggataccagttgtattttgtatctttgagtggctaatttcaaattgaaactgagattgcttactgcttacaggctgcttactgcttacaagattgaaatttgaacatttgtagcttctaaatgtattgtagcacatttggattaattcctgaacataaacaaacatgatgatccagatctaatgaaaattctgaatgcaactggaaaacatttgtttgtgcaatgaccgtataaataaaaccaaagtgcggctgagttgacgttgatagacttgtgcgtgctctgccactcgtaaccttttttttctcccatcgatcatgttctatctccagtgctcatgtctgatggtcattcctaatagtatgcttattctttcaggtttaagctg

SEQ ID NO: 42956 - DNA, 406 bp, Triticum aestivum
  Clone ID: PAT_TA_42956
aaaggattggggcgttcgtgcgcccgtggcggcgttcgtgcgccggccggaaaatcttgtgtccattcttcttcttccacctccattcgattgcgaggagaggtagctagagggccgcggttccaacaattggtatcagagcttggtgtcttgggcgtgcttgccgtgccggaggcgtggcagcgatggcggcgcttgccgggagctgcgcgttggagctccgggtcgtgtgtcggcctatggaggtgggcggcgctgtggctgccatggcgcgtggcggaggcggcgggcggtgacgtcgtacgtgcggcaaccgcggaggccgccgaggcgctgcgtggtggcgcggtggcgcgtcacgacatggcggcatggaagccgcggcggtgcagggcaataagacgcg

SEQ ID NO: 42957 - DNA, 405 bp, Triticum aestivum
  Clone ID: PAT_TA_42957
cccacgcgtccgcccacgcgtccgtttatggcgaaggagacaccggtgtacatgttttgcatcacgcttttggaggagacggcgaggcggaaccgaagctcgctgatgacgcagcctgagaccctccttccccttcatggcatacagatccttgacggaaccagtgtccgcaacgacgcgactcacgaccggctactccttcatgaggtgcacgtccgtgacggataggttaatgaagaacagattacagacgtacaggctttgcaccacgtttcttagaggagacggtgtggcggaatcggagctcggcgacgacacagcccgggactcgcctcccccttcatggcgtacaaatttttgttcgaaccagtgtttgcagcgacacactacaagaccgatcccttc

SEQ ID NO: 42958 - DNA, 366 bp, Triticum aestivum
  Clone ID: PAT_TA_42958
atttaattatggttggttggattattatttactgtaaaaaaaaaaaaaaaaaaaaaaaaaagaaaataaaaaaaaaaataaacaaaataaaaaaaaaataaaaaaaaaaaataaaaaaaccaaaaatatctaacaaaagaaataaagggcctgccgttttggggtgtccatgccttcccccccgcgcatgcgcctacatttgcttttttcgggagcccctaaatttaatctcctgcccgtttttataccccttgtggtcttgggaaacccttgttgtcacccaatttaaccttcttgccacctcttcctccttttttcctgtctgcttatattgcaagaaggccctgccccttttttcccttttcc

SEQ ID NO: 42959 - DNA, 399 bp, Triticum aestivum
  Clone ID: PAT_TA_42959
gcttttcccaaggacaatagtgtctattcatacttaccgtgataggatctatgttggtgatatgcaagaggtatgctctcatcgcctatgtatatgtgtagccaagaagagaagccgccgatttcacttgtgcacaatataaaacggtttttatcttaactattgacctaattataatgttaatagtgagggaaaagctcatgatataccatttacagattggattgattcatgtctgggttagagagaggatagggatggattacttggaatacttttgaacttgatagatatgcatcgtctatctctcataggcctttttttgtctgtttcattgaacaatgttttttgagctatattatagctagttttttttgattcaaaacaaagatttcagtt

SEQ ID NO: 42960 - DNA, 399 bp, Triticum aestivum
  Clone ID: PAT_TA_42960
gccgcccgaacacaagcccactcgaacaaaacccaacccatctcctcctccctccgtattctattcctcatcgtcgtcgtctctctccagcactgactttctccgaatccctcgcccccctctgctctgttaaccccgtgctgccatccattgcggggctgcgatcctgcgccggtgctggcacctggtaatcagcacgagcaccgccgtccggcgcatcgggttagggtgtcccagatttgaaaggctgaggttaccctttgttggaaaaggctttgccatagagctgggacatggacatggcattgccgattgtgaatgccaccacggcagcgcttgctcgtgtctcagctgcattcaacgctcctcttgcccgtgctgtcgtcttcggggttcata

SEQ ID NO: 42961 - DNA, 438 bp, Triticum aestivum
  Clone ID: PAT_TA_42961
ccctgccgtactcgcccgtaagacccacgcgtacgcacacgcgtgcgcccacgcgtccgcccacgcgtccgtacttatttctcaatttatgctgaccaagaggatggcactccactttttgggggctctttgccacctcctttcccatctccctgtactgtgagggttgcacttgccagatatgccgatctgttgaattcacctaaaaagagtgttttacttgctttggctgctcatgcatctgaccccaaagaggccgagcggctcagacatctagcatcttctgctggaaagaaggagtattctcagtggataatcgctagtcaaagaagtctcttggaagttatttcggagtttccatcggcaaagcctccgcttggtgtcttctttgcagctattgctcctcgccttcagccgagatactactcaatatctttc

SEQ ID NO: 42962 - DNA, 405 bp, Triticum aestivum
  Clone ID: PAT_TA_42962
tcgcccacgcgtacgattaaagtgtggttttcttacttaaatttaataatattaatctaatatgcccattggtgttccaaaagtaccttaccggattcctggagatgaagaagcgacttgggttgacttatacaatgttatgtatcgagaaaggacactttttttaggtcaagagattcgttgcgagatcacgaatcatattacaggtctcatggtatatctgagtatagaagatggaattagtgatatttttttgtttataaactccccaggcgggtggctaatctcaggaatggctatttttgatacgatgcaaacggtgacaccagatatatatacaatatgcctcggaatagccgccttcatggcgtccttcattctgcttggaggagaacccaccaagcg

SEQ ID NO: 42963 - DNA, 447 bp, Triticum aestivum
  unsure (1)..(447): unsure at all n locations
  Clone ID: PAT_TA_42963
gccaccgcgagagagagagctagcagtagcaggcggggcgatcgatgatggcggcgctctcctccctggtcctcgtccttttgctcgccgtcgcgtctcaggaggccgcggcgaccatcaccaggggcgacttccccccggggttcatcttcggcaccggctcctcctcttaccaggttgaaggtgcggtcgcagaggacggaagaaaacccagcatctgggacacgttcacacactcagggcacttcgtcgacggtgccactgctgatgtgactgcnnatcagtatcacaagtacaangnnnatgtaaagcttttgagcgacatgggcgtcgacgcctacagattttcaattgcctggcctcgccttattcctgatggccgtggagctgtcaatccaaagggactggagtactacaacaatcttatcgatgaactcctggctcatg

SEQ ID NO: 42964 - DNA, 434 bp, Triticum aestivum
  unsure (1)..(434): unsure at all n locations
  Clone ID: PAT_TA_42964
cgaccaaagacagcagccagcaagcctcaaacctcgcatcaccacctccatccccgtggcagcagcagcaagccaccagccgccgccgccgcagcagcagcaccagcagcagcgtgcctctctaaccttcctgccgccgcgagaggagctcgtcccagcggcagcacgtctcagcagcggcgccgggagaccagctggagatcggtttctgcagcacctgcctcctctcctcctccgcgccagggggagcgcgcgcgtgcgccagccaagtaattttnnntgagtgggctgcatacgtagatnagcaggactggaggaagagtacaatattctctggatatccagttgtagataaatacattctgagtcagctgtatttacatggaatcttttttctgagagatgccaacatctaagccaccatcggtgccacc

SEQ ID NO: 42965 - DNA, 266 bp, Triticum aestivum
  Clone ID: PAT_TA_42965
tcgcggacgcgtggggcaaggtcatatgtttagccaaaatttgttcccttcaaaatctactcaatctggcggaagtttactcagctcttcggttgcccatttagcaccagctccatcgccaaacggtcactccactactataaatattgatcaagctgagaaaactgtggagttgttactaccagttgacattactactgtgaggattagattttctccaaagaatgatgatactggcagtcgtgctacagtggtatggcattaaa

SEQ ID NO: 42966 - DNA, 449 bp, Triticum aestivum
  unsure (1)..(449): unsure at all n locations
  Clone ID: PAT_TA_42966
gaaaaatcttatctctttctcccacgccacactcccacctaaacctaggtcacctgccgccgccgccgccgccgccgttgcttgacctgcgtgccgatttggtcgcgttgcctcctctcccatcaacggcggcacctcccgcagcttcctgctacaatgtggtccttccccatggtcgaagcccaaggtgccgcctcatcgtccacaaaagaggagcccgtccgccgcatgcagccaaggggtcgagtcgaccgcggccgaggagccgcgccgcccaccgccagtgtggagtcnacccccgccgagcaataccgctgtacttcctcaagatccaggccgctgtagggtgatgctgtccgcaaccgaggagccaccttgccctctgcatccagaggttctgccccgccatccctcttccaccaccggcgacggctctcccctcccctgct

SEQ ID NO: 42967 - DNA, 444 bp, Triticum aestivum
  Clone ID: PAT_TA_42967
cggacgcgtgggttttttttgaaggtctctccctagtctttgggaaggagaagaacatacagtagatacattcatctgatctgcttagttaccgtgctttgtactcgtgatcactgatcaggatggcagaagggctcttctccatggctcacccgtgggcctccgcctttggcatcctaggcaacatcatatccttcctggtgttcctcgcaccgacgccgacgttcctgcgggtgtaccggaagaagtcgacggaggggttcagcgcggtgccgtacgtggtggcgctcttcagctgcatgctgtggatcttctacgcgctggtcaagaccaactccagcccgctgctgaccatcaacgccttcggctgcgtcgtcgagtccttctacatcctgctctacgtggtgtacgcgcccaggaacgccaggcaccgcgccctcgtct

SEQ ID NO: 42968 - DNA, 401 bp, Triticum aestivum
  unsure (1)..(401): unsure at all n locations
  Clone ID: PAT_TA_42968
agcacccacagtggagcctaaatccaataaagctaaggagaccgatgatccaattcctctggtggataagagtgcgttcaacgacacaaaagttccgtcaagttctaccaaagattcagttgctccagaaaataatgcaaatggatgtggtttgtcagcttctcaagaggttgttgcaggaagtactacatgtgcaactaatcctgtgctgttaaaggacaaaccaagttctgaagtggagccagatgatgatttaccttcacatggcaagatggagtttcacatgactgaagatgcagttgcnntccctactgctgttcaagaagatttgaaaacccttacattgaggatatgttggcttgtatgtactttatttacatttagtttatacataatgaatc

SEQ ID NO: 42969 - DNA, 454 bp, Triticum aestivum
  unsure (1)..(454): unsure at all n locations
  Clone ID: PAT_TA_42969
cccacgcgtccggccggtgcggcgggccgccaggggtttaagagcagaggccgcctcccgctagggtttttcggatctcacctctgccccttttctccatcctccgactcgccgccgccgccgggagccgacccaacaagcccgagcgccagccatggccatcggatctctcctcgcctcgcggctggccaggtccggccacgccctcgccacgcgcgccatcgctcaggctccccggacccacaatcatcatcacgcgacgtctcccctgctctccaggctcggagccgtggcccgcgctttcanctcaaggcccgccgccgccgatgtcatcgggatcgatttgggcacgacgaactcatgtgtctccgtcatggaaggaaagacaccacgggtgattgagaatgctgaaggtgcgaggacaacgccctccattgttgccacaaacagcaaa

SEQ ID NO: 42970 - DNA, 454 bp, Triticum aestivum
  unsure (1)..(454): unsure at all n locations
  Clone ID: PAT_TA_42970
gaaggtcattaaatttttaatattttcattaaatttggaaaaagttcatagaaattcaaaaaaagttaatctacttttagaaaaagttcattgaacttaaaagaagttcatacatgttcagaaaatgttcatcaaatttcaaaatatttcatagataataaaagttcatcaatctgaaaaaaaccgttggaatttttaaaaggtttgtagatattcaaaaaagttcacataattcgtaaaaaagaaaatgttaaccggcgcctagatgggccggaccattcncggacgccacaggcgccngttnntgaaaatgcattgtctcagaaaaaaattaacgaaaatgcacgttaactggtacctttggcgccaaataggaaatgcccaaataggcttccaatgagttctgctttggttgtgaaatgttcaagccggctgcagtgttcggttttagcat

SEQ ID NO: 42971 - DNA, 448 bp, Triticum aestivum
  unsure (1)..(448): unsure at all n locations
  Clone ID: PAT_TA_42971
gacctctctcttatcgcaccacctccctcaaaaaaaggaaaaactcggtagaaatttccggggtgttgctctagagattgccggccgagcctcgcgtcaggatggcacccacggcggcggagcagagccagcagcacacgaggaaggcggtgggcctggcggcgcgcgacgtctccggccacctcgccccgctcgccattacccgaaggagcactggagacgacgatgtcgtcataaagatcctgtactgcgggatctgtcactctgacctgcacnncnnctagaacgactggaattacccctacttacccggtgatccccgggcacgagatcgccggcgaggtcaccgaggccggcttgaacgtgaccaggttcaaggccggcgaccgtgtgggcgtggggtgcatggtgaactcgtgccagtgctgcgagagctgctacaagggct

SEQ ID NO: 42972 - DNA, 379 bp, Triticum aestivum
  unsure (1)..(379): unsure at all n locations
  Clone ID: PAT_TA_42972
aatattgttcgtgctactaagcctgtttttagtgtattgacaaacccaattatggggccactgttggaggttcttgaatataccctgccactatggaacctttgtgccgaaacggttgaatatcttaattcagctgcaatggtagcgatggaaacatcattcagtgcggttgtcagtccagatcagatgatcatgtggccatcttggtttatcttcagtacgacgtttaatatatccaattcaatcttataccccgcaattcggttcgtcggagtgcncctagccgtaccttttcgacttattgttgcgctagcaagttttgctgcgaacttctgccatgatattttggacgtttaagaggctacctgatcaacattaa

SEQ ID NO: 42973 - DNA, 268 bp, Triticum aestivum
  unsure (1)..(268): unsure at all n locations
  Clone ID: PAT_TA_42973
ntagatattgtgtcgggaaggacgtggagcaggagcattggttcagattttctctgtcaggcttgtgtatgtttaccgattattggcttgacatgaagattgatcaggtgtacggaacagtaggcgaaaagtatggggtgaagtactctgaggatgagatcttgattaggacctctaggcctcggtgagcccctcccaacaagatgcgcacaggatctatgtcttgacggggaaagcttctgagttggtgcatagtcaaatgtgggcg

SEQ ID NO: 42974 - DNA, 261 bp, Triticum aestivum
  Clone ID: PAT_TA_42974
gagatattcattcctaaaataaaacccataggaatgccttacaaataccgccgtgccagcttggaaactgcattgagcagattgggctccatacgcgcgactctccacactacatcttcgtaggctgggatgggtcaggctgggataggtgaggaagcagggcgatgaggtccagctgcgccgatgcagatggtgctgaacgggaagcacccgtcgtcgctgtccagctgcagtaaggaggcgtacggagggggaggggtc

SEQ ID NO: 42975 - DNA, 452 bp, Triticum aestivum
  unsure (1)..(452): unsure at all n locations
  Clone ID: PAT_TA_42975
tgattgggaagaataagcggcagaagtgagatagcaattgctgctttatgctctcaagcggctgattttgtaccgcggactctaaagctgcatatattgagtccctctgtaccagctgggaggagagcaagcggcgtcgtggtggcctcgacggtgactaacaggaggagcacggcgagctgagccggaggaggacgagccgtccacgtgcaggaggctccccggcggatctgggagacggcgggaggcatctccgacggcgtgggccgggccttcttgcttcctcagatccgcgtttctatcnnacatccagtttgtcgcttcccttgacgttgatggctctatgattagccgtgttctcttcctgctgtgtggctacaccgtctcatcctgcaagtactaagccacgatgagatttatttggctcatcctcgcgcctcaagttttcgaca

SEQ ID NO: 42976 - DNA, 444 bp, Triticum aestivum
  unsure (1)..(444): unsure at all n locations
  Clone ID: PAT_TA_42976
ggcaagtccattcctgttccggccagacctttccaggattacttgaagcactgttgtgcctggagaaggccacgccgccgcgatgaagagcagggcggcaagagctgagacttagcccgaggactaggagcaatttttggagaagctgcaaacggggccaaaattcaggcttcttctcgactggagcttcagagaggggcaaagagcagcccctgtagaattgggcgcagatgcgcccatagggaatgagagagaggggagctttttttggggaaggaagggtagatatcactcagttgtagtannagtctacaaaataagtacggtagtactgtacggggttagggttaaactcccatccaaatggctgtgaattcggaacaagttgttgtgctgctagagaacaggcttcttttgctgcaagttgtcaactgttctactgat

SEQ ID NO: 42977 - DNA, 360 bp, Triticum aestivum
  unsure (1)..(360): unsure at all n locations
  Clone ID: PAT_TA_42977
cccacgcgtccgcccacgcgtgcgcggacgcgtgggcccgacctctctatctgtcccaacccaaacacctaaccctcgaatcgaagcaaccacgccggcggcgatgggtgcaaggttctccaggcggtatgggcaagcagggcggactccccggagaccgcaagccgggcgactgtgccgccggcgacacgaaggacaggaagttcgagccccctgccgcacacgtggcgcgtggggcgcaagcagcggaaacagaggggccccgaggcggctgcgcggctgttccccgtggcgccgttctccaagnncccgctccgccttctcaagccggaccgtgtgaaggactaccttcttatggag

SEQ ID NO: 42978 - DNA, 244 bp, Triticum aestivum
  unsure (1)..(244): unsure at all n locations
  Clone ID: PAT_TA_42978
cncgcatatctggagactcggtggtggggggaggggatctctgtgggctccgggtccatgggggcccgctgatggggccgacggacgatatcttctagatcctgattaccttagctgggccggctcgtcatcctggcacgggtatgatgtgaaatgcttgctgtaatatccaggtttggaaatatgctagctcgtctcaatccatccctttgaaaatgaatcttatacaggaggcttgtattca

SEQ ID NO: 42979 - DNA, 453 bp, Triticum aestivum
  unsure (1)..(453): unsure at all n locations
  Clone ID: PAT_TA_42979
ggtgctctctgcagcgctaacccaagtgccgacgccacggacaaggtgccctctccatcacttccctctctgtatttttgatttggagttggtgctctgttcctgttcgtgaagcgccctctcttctctgctgcaaggttcgtcaagcatctttgctcgtggaaaccgagcaggcaggaggtaccaatatctcctctcgtctggttttcttcacccccctatgtgatgggtgccatctgtttttgtgcatgcttcatggagaggagaagctgctccgatcccatctgctgaaggaggatgcccnccatccaaggtgctcgacatcaccgccatctgttgcctgccaagaaggatttgaatgctggaagtaagagggtgagatggatagatagagaaccttatgcttactggatagggaatccagagatcgcaactataaggcaagagcttatc

SEQ ID NO: 42980 - DNA, 455 bp, Triticum aestivum
  Clone ID: PAT_TA_42980
cttagctgcacccgtgctcacctaatcacctcccgccgggccggcgaaggccagccggttctccaactcgacccggcgacggcggccgacatgcggcgccagggcctcgatccgcacgagctggaccggagcaccgagcagctcatgtcgctcatccacgagaacctcccggacccacccgtctccaccaccgctcgcttcgtcgccctccgcgccctctcctccgacggcgtggaccgcttcagcggcctctccgatgcgctcctccgcaacatcgtctcccgcctccccgtcaaggacgccccccgaaccgccgtgctcgccgtgcgctggagcggggtctggcgctcgacgccgctcgttctgatcgacacccagctgatcttcaacggccgcaccccggcgcgcgccagcacgccggacgttaccggtggcgtcttccgcatactcgtcac

SEQ ID NO: 42981 - DNA, 345 bp, Triticum aestivum
  unsure (1)..(345): unsure at all n locations
  Clone ID: PAT_TA_42981
gccaaccattgtcttctggtacatcaatgcagcatggaacacatgttgctagggcgcgcaattccaccaatcgaactgggccagcgcgtctgtgagcttgccgaacatcaaatgctgtgtgatcctgcgtgacggataggtgtcatacgggggggggtactaaatccggcagaccgtggactgactgctccgcctgacctgtctgctacagggactgtacttctggcacgagcagacctgatggcatgaaacactaatgaacgatttggacaaggtcccncntgttcacaaagaggcctctgtggttccaagtgcactggttattggggatgtactaacagggca

SEQ ID NO: 42982 - DNA, 422 bp, Triticum aestivum
  unsure (1)..(422): unsure at all n locations
  Clone ID: PAT_TA_42982
atcggaacatcggatcacttgaaccgattggacgatggatctgcagtgtgagttggcccaagtgagttcattcatcaatccccgtctgttgggtaagaggggaagtgggtgcatgagggggacacaacatgatggttttgtgttcagaaatggtattgtaatttgattacttgaatcgattacacgatggttttatggtgtggctttgtccaagtagaggaatgggcaagttagtgcattgattcaagtctctggctttactggttaggtcactctgacctcttggctgccgctgtnattctatcgaatgtgttcttttgttgctcaaatatagtgtattggattcccaacgtgtgttatcattcttgctgtacacttccatcaataccccataatcttagttatgtggttgcagacctgct

SEQ ID NO: 42983 - DNA, 450 bp, Triticum aestivum
  unsure (1)..(450): unsure at all n locations
  Clone ID: PAT_TA_42983
tgcatgtccaacaacgcagaggcatgtgagcacgaaatatttaggactcgtagcagacatctctcggataaggatggtcaactttgcactacttagtcttaaccatctgatggctagcattgtgaagtttaaagatggcagctccaatttggagggtaacctcccattgctccagctgtggttttgggagaaggtgcgcgttcataaattcgacacctcaattgattacagtcaacgttcgaagccactgatgcagcactggacagaggagaaggctctttnnnntagcagtggtcatcgaannccatggcttcggagttggagaggttgttgtcgacccgaaagagcctttcaagtcccaaaaagagccatcttgctctgaaagtctaccttcagatctgaaggagcccaaccaacaagtattgaacatgtttggtacactcattggcc

SEQ ID NO: 42984 - DNA, 452 bp, Triticum aestivum
  unsure (1)..(452): unsure at all n locations
  Clone ID: PAT_TA_42984
aacccatccaccatacatctacagcccatactgctttcttatacacaaaactctgggaagatgcgacatatctggcccgcgctagcttgattgcggtggcgatccccatcctccttgccgatgatgcggatcgggcggggccaataggctgccagaacaacgttatggcgctcaacgaggcctgctaccacagcctgcagaacgactcgccgaccgtgccggcgatcaagaagaacgtgcacgccctgacccggctctacgacgcccagcttgtcatcatacctgnccactccaccggcgagggccaccatttctacagcaacggcgccgtccttaaggcaatattgcaccgttaccatcagtccaatctgaccaggctgtaaatcgagcagcatgaacatatgcagcgcacgctgagccatcttaacgacatcaatccaaacctgcccacc

SEQ ID NO: 42985 - DNA, 121 bp, Triticum aestivum
  Clone ID: PAT_TA_42985
accacgcgtgcgcggacgcatgggtagacaattatttatactacggatcatgtaatgccaggatcagagacaacagaatatgccacacatcatgtgggtggttaataagatagataaacga

SEQ ID NO: 42986 - DNA, 256 bp, Triticum aestivum
  Clone ID: PAT_TA_42986
cgccgtactcgctcccctgatctcatctccaccgagaagccaaccaacagtccaaaaagggtcagacgcccaagccaccatggcgaacccatccacgagctcgaggccgtcgttcgcggctcctagtggcaccaagctcagctgcctctgctcgcccacgaaccacccgggctccttccgctgcacccgccaccgcaacccgcgagggcgaccgcagacgtcgttgccgtcgttcttcggccgcgcctagcagcct

SEQ ID NO: 42987 - DNA, 267 bp, Triticum aestivum
  Clone ID: PAT_TA_42987
ctcctgtccactaaggcctaggtacccggcccggttcggttcgttagggtttagtagcggggaagaggaggaagaatggcggacgtccatgtaccgctgcttcgtcggcggcctctcctgggccaccgacgaccagtccctccagaacgccttatgcaagcacggcgacgttatcgactccatgatcatcactggcaggcagacggacctttcccgccgttttggattccacaccttgttgtaggacgaggctacgcgcctggacat

SEQ ID NO: 42988 - DNA, 450 bp, Triticum aestivum
  Clone ID: PAT_TA_42988
cccacgcgtccggctggtattaccatcttgccacttctcacaggcaactccttcaactaatgcattgtctgctgaagaaatcaaggctctcaccaagaggacacaggagggtggcacagaagtcgttgaggcaaaggctggaaagggatctgcaaccttgtccatggcgtatgctggtgcagtttttggagatgcatgcttgaagggtctgaacggagttcctgacattgttgaatgctcctacgtgcaatcaactgtgaccgagctgccattctttgcttccaaggtgaggcttggaaagaatggagtcgaggaagtgctcgggttgggtcagctgacgcagtttgagaaggatgggttggaagctctcaagggcgagctcaaatcttcaattgagaagggtgtcgcgttcacaaatgcaagttagttaggccattttgcagattatag

SEQ ID NO: 42989 - DNA, 448 bp, Triticum aestivum
  unsure (1)..(448): unsure at all n locations
  Clone ID: PAT_TA_42989
caaatttcatcttacgacgtcagtgcgaagatactaattgaagcaggtattctcccacctctcatagcagacctctttacagttggcagtaatcagcttccaatgaggttgaagaaggtatcagcaacaattcttgcaaatgttgtggcatcaggtgcaaattttcagtccattccacttgaccacaacaggcacacactggtatctgaagaaattgttcacaatctgcttcatctcatcagcaatacaggacctgcaactgagtgtaagttactccangngcatgttggtttaactagnncntctacaactgtccaaggcatagttgatgccatcaaaagctcaggggctactgtcagtttaattcagtttattgaagcacctcaaagagaggttcgcatggcttccatcaagcttttgaattacatatcaccatgtatgggtcaag

SEQ ID NO: 42990 - DNA, 445 bp, Triticum aestivum
  unsure (1)..(445): unsure at all n locations
  Clone ID: PAT_TA_42990
ctgctgctggtccgaccgcggctccggtcatcggatcagccgctccctgtctccctgtgtcgtcccaagatggtgcgggtgggcgctgtcctgacggccgagcgtgtgctatccacggaacacagctgcttcacccaggccctcctgcgcaacgccggcgaggacactacttcgtccgaaccgattatcacaaccacgcacaggtcttggacatgatggccggacgcgatgaggaggacatactggatccccatggatgccaaggattcgagggccttggcagatgtagaggaggcaantacgaccgagatgattgcgggacacaatttaaataaaccagaatatcctgaaaattatatttggtgtatagaattcagctttagtctttgagtacatttacatcattcactaactccagtggtgagtaaatatatataaaactacg

SEQ ID NO: 42991 - DNA, 411 bp, Triticum aestivum
  Clone ID: PAT_TA_42991
atttctctcctccttctactgccaccgatcccgcaccagggaggaaccctgctcgatgagggcaaaggaagagaagaggagatcacccagcccagttcgcgcacaggacagcaggcgccgcgatctggtgcatgagcggagatggggctcacgttcacgaatgctgttgacccggctcttcgccaagaaggagatgaggatcctgatggtcgctatcgatgcgggtggtaagaccaccatattctccccgctgaagcttgcacggctcccaaccaccatccctacaatcgggtttaatgtcgaaactgtatagtacaagaacattagttctaccgtttggtatgtatgctgtcacgacaagatcaggcccctgtgtaggcactacttacataacacccagggtctcatttt

SEQ ID NO: 42992 - DNA, 389 bp, Triticum aestivum
  unsure (1)..(389): unsure at all n locations
  Clone ID: PAT_TA_42992
gccacgcatccgatcgtagaaggggttagcgaacccgtcaattatgacttgccgcctctagtgtagcgtatccttctttgatctggagacgtgcacactaggtggggcacataggatacatgtgcgtcacaaacgagcacacgatagaggccactgcgaaatagagcacgaacgtggaaggagctcaccattacgacactagaaaacggcatcccaatcatgcaggctatagggagacacatggtagcgatcccagccgctgcacacacaccactcacgcncnngctacctcatggatacanncntgcatccatccttagaacttattctagcgcgtaaattgcttagcgctagagctctagcggatgcaggagacgaatgaggagaga

SEQ ID NO: 42993 - DNA, 355 bp, Triticum aestivum
  Clone ID: PAT_TA_42993
gacattctcgccaccgcctcacggcacgccgcacccgcgccaccttccacttggagcctcgccgccgacggtgccgggggcagtggcgccgatcagcggcggccatggcccgctcccgttcgggcaggggcaggggcagcatgggcaagggcagggggtgttcgggcagcagcagaaccagctgctgaacggcggggggcagcggctggaggacagcgccggcgggtggtcaggcagggagcgcggcggagcggccgtgagtttggctttggctgctctggtggctctggttttcgagtagtttctcattctcggtcggaaagttgtatcacaccacatcctgtaattttggttt

SEQ ID NO: 42994 - DNA, 489 bp, Triticum aestivum
  Clone ID: PAT_TA_42994
gtcgacccacgcgtccgcccacgcgtccggtgctaaagagtatggtcgtgagctaggtaggcatgagttatttatgaagacccatactaaaaaaagatgggaatgctctagctaaagctcaaccaaaaattgatgaacttaagaaacctgcaatccttcatcctgaattgcttgaaagacccatagagaaatgcgatctattttcccatgtatttggtcgtgaaccaaggggatatgtacgtggagttggtttaggaccaactcctgctactctgggcattgatgggtaccgctcatgtgcatccacaagtgtatagatggcaatccgtgctagccagaaaacagaagagcaaaacatattgttgaagggcgctctacatcgactattcgatgaggccagagaacttaaggaaatagtgaaaggtggcaaaggacaggaagagatacttgttgtatgtgcaacagatcgttcgttcttttttacacttg

SEQ ID NO: 42995 - DNA, 214 bp, Triticum aestivum
  Clone ID: PAT_TA_42995
cgtcctctcacgcgtgcgtttgattttgcttagtctcgccgcagagaccgttccggctcaccaccctgagttacagaagtggcgcgagcacttaaggggcctggcgctctcttatgtcgaggagcggtcatacctttggttctcattcatggtaactacgcgcacgcatgcactgctcatcgttcgttccattgagctttgtctgtttgtatat

SEQ ID NO: 42996 - DNA, 466 bp, Triticum aestivum
  Clone ID: PAT_TA_42996
cgtccgcccacgcgtccgcggacgcgtgggttttggttttgtaattttacttatctgattagtaaataaacaagatggtgacagatgtttacttgaaaattgaattctgagacgccttgagcaaaaaatttagcagtattggttgcttatagggttcaaatgattctccttgctcaggcaactctactctcaggctgggttgatagttgaaaaacctgaaatcatcataaggcatattctatgatttttttatattaatattctatgattttgttctagctcatggcttctatttaaacctagttgtggtggaacagtaactttcataagtttacccaatagagtccgagtctgcataaaaacgtatgcttgatatggtcagttatgttggtttcagtccaagatggacttttgcactaattttactttatctcatctcagttcagcttacatggagctagtacgc

SEQ ID NO: 42997 - DNA, 455 bp, Triticum aestivum
  Clone ID: PAT_TA_42997
cgtccgctcctcctcctgattcctaaaccttccgccgccgccgctgccttacgcttggctgcgccgctgtagccgccgatagagcgcgcaccccagccaccgccgacgccatgggcggaacgaagcccaacccgaaggcgagaaccaataccctggcccccaggggatcacgcggcaccgggaggggccgtggcaggggcaggggcaggggcggggcggggaggcccggggagaagcgcagccacgggcctcatcttcccaacaagctgcgccgggagctcgagtcgctgggacctgcccgcgaccggggctccgacgacgacgacgacgacgaggatgacgtggtgggcgaggacgtgtacgagtacgaggagggggtgcccgaggaggaggcgcgcaagaacgaccgctacgacgccgtcgccaagtacgagtacgacttcgacagcgacgac

SEQ ID NO: 42998 - DNA, 486 bp, Triticum aestivum
  Clone ID: PAT_TA_42998
cgtccgcagtacagtagaccacggtcacggacagcggcgacctccttcacagcgtcgctttgccgccggccgtagaaccctgcacagccgccgtttggtttcgcttgcgcgctccgcctcacctcgctggcggtactagccttggtcgcggttaccggccctgtcttgcctcatccgggatccccaaatccaaagtgctgagtgttagctgcgcgatgaagtcctataagctgtctgatctcagtgatgccgaggttagcggcctcaaggcccgccctcgcattgacttcacctccattttcagcacggtgaatccgattgttgaagatgtgcgcgtcagaggtgatgctgcggttaaggattatacagaaaagtttgacaaggtcactctcgataatgccgtggtgcgtgttagcgatctcccagatgcagagcttgatccagctgttaaggaagcctttgatgtggcgtatgacaatatttatg

SEQ ID NO: 42999 - DNA, 398 bp, Triticum aestivum
  Clone ID: PAT_TA_42999
cgtccgctgaattctatattggttccttgttgacctctcaccctgctgatgtagttctgtattgtacaggtgattgtacttgtggaaggattagcccaccagtgctcagacggaacgtgcattctaagccagattcaggtgctctgctccagccttcaacaagtcaatcttgtttagtactatggagtgcaaactatgcagatgatgtttgtgtttagaagtttctactaggacacatataactctttgggtgggtcaggtgccccctttctcatacaattgagtcgtattcactttgagtgtaacttgtagccttgtaaattaaagagaacatgtgttgattccctagtttatagtgaccttgcacgccaaagttggacaagattttattgagctaa

SEQ ID NO: 43000 - DNA, 445 bp, Triticum aestivum
  Clone ID: PAT_TA_43000
cgtccgcccacgcgtccggttgcacaagaattcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatttgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaagatttttatgcaattttattctgactcttttcttcca

SEQ ID NO: 43001 - DNA, 398 bp, Triticum aestivum
  Clone ID: PAT_TA_43001
cttccgtacatacgtaactccctccttccatacgcatatccagagaccgacattcgtcggatcctgtgcggcacccccggctgagggggggagccttcaccatcttaccgtcagaccagatcttccaaactctacaagctccttgctgcacgctctaatgatgctaccatgctttcgagccggagttccgaccagatccgctctcctcctatgcgtcggtgtgagtggccctccgcgttcagagccagttcgtctctgaggagcgcgatcttttccacgacgcactcgtcgcaccccggaatgaccacctcggcttccccgaggagaacgatgaggaggaggtggcctcgctccggtgggatagcttccaaatggacgaggaggaggagccagatctg

SEQ ID NO: 43002 - DNA, 465 bp, Triticum aestivum
  Clone ID: PAT_TA_43002
cgtccgattccccttcgcgcagccgcccccgtgtctcccgtgcgcaccttctcgaagcctcccccatggcggaccagctcaccgacgagcagatcgccgagttcaaggaggccttcagcctcttcgacaaggatggcgacggttgcatcaccaccaaggagcttggaaccgtgatgcggtccctcgggcagaaccccacggaggcggagctgcaggacatgatcaacgaggttgacgcggacggcaacggcaccatcgacttccccgagttcctgaacctgatggcgaggaagatgaaggacacgaaataagcttaaaattcaagtggattggaatgccagacagactcgcgtggttggattttgtgctttgttttttaaggatactggtacctgttgggttattggtcggttatatatcttggagcggtgcatcatgggggacctcattctaattactacctgg

SEQ ID NO: 43003 - DNA, 301 bp, Triticum aestivum
  Clone ID: PAT_TA_43003
cgttcgctcatccttggcatcacccctgccgttcttccctggtcctcttcctctagcgtggccggcggcccaacgccacgagctgtagggtccatcgatatcattgaccgggctctctcattttatcagctataagagcatgggcaggttaaagctatggccggagtgaccttgatggcttgccacatcctgaagccccaattgggtgtgttcgcgccgcgttgatctggattgggcgagcgatagcaatggctcatgcccaaccaggttcaagggagttgtgaactattccaagtcaggc

SEQ ID NO: 43004 - DNA, 340 bp, Triticum aestivum
  Clone ID: PAT_TA_43004
tctctcgggaacagattagtatctggctcgaatactcagttgtggacagaaaagcatcgctagattcggtcaactctgggggcggtggtgtcttggattaagagtcatggtaatccccaacttgagcgacatggtgttcgagtagagctagggtggtttcacgccactgtttctggttattaccaactaggaattgtcgtagcagtgaatgaaaacttctacaagaattaccaccatcatgagcatgccccaaattttggtgatcgctcagagatgaatcttgcagtctccacttctgggttccaaagcaagcaatttaggattcagccttgtacaagct

SEQ ID NO: 43005 - DNA, 304 bp, Triticum aestivum
  Clone ID: PAT_TA_43005
cgtccgcggacgcgtgagagatatttatacctaataattatagaattactaccctgccttgatataaaagcgactggtagtctctattacaggagaacttattatggaatgcttggtctgtactacctaaggcttgcgagagctgtccagtcgagagagaatgaaggcagaccgatagtcctactataagagatgcatctcgacgcactatgatctgcaatgagaagcacaggacttaatcgcataccgtcgactttatcgaaggagtgcagaggcgttactacacttgctgtgacatgggacg

SEQ ID NO: 43006 - DNA, 495 bp, Triticum aestivum
  Clone ID: PAT_TA_43006
cgtccgcggacgcgtgggcggacgcgtgggcagaggagaggaaagtgaggccaccagtcccttgtacttccattaaaaccccactcccctgcttcgcacctccggctccggtaccccgacgagcgccgaggaagccattgtgagaggaggagagaagaggaaggggcagatctatgggcaactgcaagagttcatctcgtgcacgcctaggaaaggcccatgtcgttccggattcagaatggaggatgcaggactttggaaagacccatgttcctgatttagaatggaggattaatgacttctcatcgctgcttgagacaggagctaagtcagcaaaatctgacgcttttcactgctctgggtataactggtacctgcaagtgagtccaatgcataaggaaactggttctgaaacgccatatgttgctcttttgtcttaagacatcccaaccaagcatggtgccaggtcacacggtgcatgttgtttttgaggtg

SEQ ID NO: 43007 - DNA, 452 bp, Triticum aestivum
  Clone ID: PAT_TA_43007
cgtccgctaaacccctttaccctccctcccccccttcccttcttcggccggcgccgcccgccaccgtagggatggcctggaggcttgcgcccctggccgtcctcctactcctcgttgccgtggtgctctcactggtcttgtgagtggttagcccggtctgacgacgcgcacagatccgttttcgtcgagctcttcgccgcctcccccgacgacttggagacgacggggagaagaccacggactcagcacactccgttggcgagaacggacaggggccttcgttggctaggcctgtaagctcgccgcccatacgcctgtccttgttctcgtcgcccgccaaggatctgttccacgcggtccaaatcgctggcgttttcggatgcagcgtttatgccggtgtttaacgatgacgttgcgttgagggtttaaggcctgtgatcaaggacacccaa

SEQ ID NO: 43008 - DNA, 396 bp, Triticum aestivum
  unsure (1)..(396): unsure at all n locations
  Clone ID: PAT_TA_43008
cgtccgcggacgcgtgggtttttttattttcatttttttttttttttttttttttttttggttttttttttttttttttttttaaaaaagagacaaatttttattgaaataggctggccccccttaaaatgggggggcccaacagaaagcccaaagttaagagttttgtgggaattttaacaagcccagcccacatgttttggaattcccccaaggttgggtgatgggatcccgnngggccaaataagtttttttgaatgttctagtaaaagaacttggtctttcgccgttttttaatttccccagtaatttgttcggatcttataatcaaatttttttttgagttcatggggctttgcaaagccctcgtctggttgaatggggccgatttttttt

SEQ ID NO: 43009 - DNA, 485 bp, Triticum aestivum
  Clone ID: PAT_TA_43009
cgtccgtgtagctgcagttgaagatggaaagttgatggctgacgctgatgctggtgaattctggggtctctttgggggatttgctcctcttccccgaaagaccttttctgagcctaatggaaaagataccgctttccctccaaagctgctctgggtcaacaagggccaaacagtttctgtggattatgaagttctaacaaaagcgctgctagattcaacaaaatgctaccttctagattgcggatctgaaatttatgtctggatgggtagagaaacagcgctcgaagatcggaaacaagcaggattggcagctgaggaattacttcgtgaaggagatcgaccaaaatctcacattattcgtcttatggaaggatttgagacggttatattccgaacaaagtttaataaaatggcccaagaaagctcgatgcatttgtttagattatagcagagggaaagttgcatcccttcttaaacgcccagga

SEQ ID NO: 43010 - DNA, 404 bp, Triticum aestivum
  Clone ID: PAT_TA_43010
cgatctgccttggacacgccggagcggagtaacccccccccccccccccccccccggtcgggctcctttggcgacacggggggcgaaaccctagccgccgccgccgcctccctcccctcccctttcccgtctcgccgccgccagaggcgccgccggcaaagccggactggctccagtgacggcggcggcggggcatttcccctgctcgctacttttgcgcgcgcccgccttggccttggggctcgccgtcaaaggatgctcgggccagggctgcttcggtccttggtgtgcgaccgtcgcgccggtgctactttgtattattgcggcgcggtgggcaggaggaggtggtcgtggccggtttgggccatatctgggcttcagcgccccagtcatgggggcggcct

SEQ ID NO: 43011 - DNA, 278 bp, Triticum aestivum
  Clone ID: PAT_TA_43011
cgtccggttacctcaaactgtgatcacctacctccagctcacgaatgttactagatgaacctgaacgcacgcggctctttatgagtacaggcgaccgtcaaatgaatcttcacacgtcttatccagcatttgctgatcgcactcaagcgagcgcttagtgtgcagatactcaagagcgggatagtacatatggagcttcaacctgacatgttcctaatcacagtccagaattgctcgacacaaacacccagcggatggatgaggcgtcctatgactcc

SEQ ID NO: 43012 - DNA, 361 bp, Triticum aestivum
  Clone ID: PAT_TA_43012
gataccacctaccacctatagctcccgagctcaccactgtgaccccattcctccggttcttcctctcaatggggcagatcgggcacgcgtgtcctcaagtggccaagcgcgacctccgatttaggcgaaaacctctcccgtgcccgcgcgccaccacccgctccttctcgcctctattgctgcagccgccgacccacctgatccctggtgccttactcggagctttccatcgcagggtcgtcgcgctcgtaacaccctcggcgccgcaccttcacccgtaccctccgttggcttccttgccgacgcccccgccttgtgcacgagccggccagagcatgcccgtccatccccgtgcacgcgg

SEQ ID NO: 43013 - DNA, 447 bp, Triticum aestivum
  unsure (1)..(447): unsure at all n locations
  Clone ID: PAT_TA_43013
cgtccggtcttttttaacccattagagcaaacaagggatgagattgttatgattgtggtaagcaatcctgatgtatctgttctcaattcaactgggtcctgtttgaaatgtcaaatttcccctgagtggcagtatgtcagtggtgagaagatttctactggccggcaccgtctgtattggagagcttctgttcctgcactgggtttggagacttactatgtggccgtgggccaggactgtgaaaaggctactcctgctgtggtaaaagcattcaccgcttcccaagaattttcttgccctgaaccatatcattgttcaaatcttgaaggtaaaactgtggagatgaagaattcttatcatactctttcttttgatgtaagtcatggcctnctccagacagtcactcgtcacaaacatggggagaaaactgagataggcgaagaaaat

SEQ ID NO: 43014 - DNA, 489 bp, Triticum aestivum
  Clone ID: PAT_TA_43014
cgtccgcccacgcgtccgcgcttcctcccctccacctccaggggagtcactgacctcaaagatgttctctggagcagttcattgacattcaagcatgcgctttcgacttcagctgcaaatgttgatgagagtacatctgctagaaagtttgcgagctacactgtgttcaagggaaaggctgcactttccataagtcctattcttcctttattcaccaaactcgaatctggaggatctcgagtgaacagaaatggatcggtaatgttgaccttcttcccggcagttggacaaaggaagtatgactatacaaagaaacagctctttgctctgtcacctactgaagttggaagcttgataagtcttgggcctgctgaatcttgtgaatttttccatgatccttccatgaaatcaagtcatgaaggccaagtgaaaaaatcattgtcgatcactcctcttggcagtgacaatggatacttcgttaacataact

SEQ ID NO: 43015 - DNA, 413 bp, Triticum aestivum
  Clone ID: PAT_TA_43015
cgttcgggtgatccatgtgccgtaccgtctgcgcaagcccttcaggaagatccatgtcaggctcgtcagggagctggagaagaagtttagcggcaaggatgtggtctttgttgcaacaagaaggattgtgaggccacccaagaagggttttgctgttcagcgccctcacaccaggaccctgacagcttgtcatgatggtatcttggaggatgtcgtgtcccaattgtaattggggggaagcgtgtcatataccggttggatggtgccaaggtcattaagatctacttggacccaaaagagcgctacaacactgaatacaagctgggtaccttttttgcagtctaccgtaggttttttggtaagacattttctttgagtcccctgttgactgtaaccccctgaagatccattct

SEQ ID NO: 43016 - DNA, 476 bp, Triticum aestivum
  Clone ID: PAT_TA_43016
cgtccgggagattgtcatgaaaagatatgagaaggaatcaatgcatccaattcagaatctgttcagtggagaattagcacgtgccatgcttattcaggttcagaagctaaaactggatcttcaagaggcaatgctggaactggatcagattctcaaggcaaatgagataaactttgctattcttgcagctctgcctgcatttggtcttctgcttctcctgctgtttttagtgcgagcatgggctatgcatgaccaaggtgcagagggaagaggaaggattgcacgtcatcagcggtggcagctactcatagaagtagagcgaaggcttaaagagttcaagaaatgcatgattaatgagatggatgaggaggcgagctgtaaattcggattgactctgtacacccttgatagattatacaaagctgttgaggtgcatgccaaagaaacaggcgagtggtcaagtttgagagatgaca

SEQ ID NO: 43017 - DNA, 219 bp, Triticum aestivum
  Clone ID: PAT_TA_43017
cgtccggaacccggaagccttccattcttcccagttctattacactgccgtcggaaggagacgaaccataaaaccttgacctggccgtgcccgtcgacctcatccgtcgtcgccgccgtcggaagaggaggagatggacttccatgtcgtagttcttgccggaggcaccttcgagaagctttttgctccttgtcttcaaggacgtttccaaggtctttc

SEQ ID NO: 43018 - DNA, 260 bp, Triticum aestivum
  Clone ID: PAT_TA_43018
cgtccgcccacgcgtgcgcccacacgttcgtgtgctggctatggaaagacgttctaaccttaaagctgtagcataccaactacgagctgggtcaaaagttaccatgtgagatgactacaaatataactttacacagatgcctccatctgaatttacatgacgtgtcatgcacatggcccgcaaagaatgaacggcatactgggctggtgggagcagcatgatctcgcaatgagaactttggcggagtgcacggtgacata

SEQ ID NO: 43019 - DNA, 163 bp, Triticum aestivum
  Clone ID: PAT_TA_43019
cgtccgaaagaaataccttataacgcaagcttattctgtacctgaagagaagagtacacgaactggtatatttattggaccaacacagaagtcagtcattggctctaaactggagacgccttcaagattctgatgcgagcgccatcccagtcgtataacgagg

SEQ ID NO: 43020 - DNA, 226 bp, Triticum aestivum
  Clone ID: PAT_TA_43020
cgtccggttgactgtgatagaatacaaacccacattgttattatattacacacactacaatactttgcttgggggatcatacaactagggtccggggctaaaatccatctcttactataatgcgatacagtatggtcacctgaaaaaaaatttaagaactcgattaattctatgaatactgtactcatcattacttcccataaattaaatgatggatttcctacct

SEQ ID NO: 43021 - DNA, 448 bp, Triticum aestivum
  Clone ID: PAT_TA_43021
cgtccggttcacaccacgatccgcgtcaggaggattattgccggtgttggagttgaaattacattccccatgtaagtcgagtttacttaatttaccgagtttttcatttaatgtggataccatcgcatgtatcaaatggtgacagtgagtttgtattgaatctatatcgcaaaacatttatgtgtatcttttgttcgctttaacaagaaatttggactatgtacacgtctttctaccggcatactaaccttagttatatcaacatgtgtatatgagacttttgaggtcgttggccttcacatacttgatctcaggtacttaagttttctaaggtccaccttaaaatggttgaatggctatttgtatcaaatttacaatgaattcagcacccaagatacttttgtcatgatctgcgtaggttagtttggaatttccctttgaatgtttg

SEQ ID NO: 43022 - DNA, 413 bp, Triticum aestivum
  Clone ID: PAT_TA_43022
cgtccggctgactgtgatagagttcgaaaccaagctgctagagatagaggacacatcacaagaggctgtttgttggatcagacgcctacctcctcgcctctgggccaccgcttactttgaggggatacggtatggtcacctgacagcaaatatcatggagtcgatgaattcttggatactggacgcgtctgtccttcccataaatcagatgatggaggtcctccgtcggcagctcatgacgtggttcaacgagcggcgtgaagcgagcatgcagtgggcaaccatcctcgtgcccacggccgagcgccgcgtgcaagaagccatcgagcgcgcacgggtgcttcaagtggcccgcgccaacgaggcggagttcgaggtcatctcgccccacgaggggacgaacggggtggaca

SEQ ID NO: 43023 - DNA, 413 bp, Triticum aestivum
  Clone ID: PAT_TA_43023
cgtccgcccacgcgtccgcgccgactacatcagaatccaaatcgattaatccaaacccctactactcgtgcgctcgataagagggaaggcatcgaccctgttaggcccgggcttccgggcattgacgaggagcacgcacgcgacccggactataaccagatccaggcatggaggcgtactggtttggcttccagatggcgccggcgttcaagttcgatccgacggacgcggacctcatgacccactacctcctgccgcgcgcgctcggcattcccgacccgaccttcgtccacgccgtgatcgacgacgacccggacgggctcctgccgggcgaactgttcttgaagcacggccacggcaacaggcagaacgctttgttcctgtacaccgacgacaccgacgcgctggagagc

SEQ ID NO: 43024 - DNA, 439 bp, Triticum aestivum
  Clone ID: PAT_TA_43024
ccgtggtacgcgtgggttctgagtccggccggcgcagtttctttcagattgcctgaagatggaaaggaagataaggcagtaggaaagccataggaaaggggaggaggtcgtagcggcagagatccctgccggctttgaataaataaagaccaggatgaatttcaaaaaaaaaaaaactcggttgctttatctcgatagccgccggcacctattcacagatccatccctggccggcgcatcccgttcccgttgggcataggcgcgcggaaccaattatacgcgcctggctgcaaagatgcatagagagaggaggaagaggggccttgaagccagtcatggtgacacttgtgaagaacgcattatagagcgaaagaagctaagagggcccaagaagctagtcgctacttattggtttcaagtattatttctaaataaaatg

SEQ ID NO: 43025 - DNA, 445 bp, Triticum aestivum
  Clone ID: PAT_TA_43025
tcgtactttatatccacagctacaaatctgtgagttctcaatggttggcacttcttatagtgaggcacagacaacaactgctgtcaacagtgaagaacatctcttaattgcccagcagcgcatgaagaaatatgcagatcgcaagagagtcggaaggactttcgcagtagttgacatggtttacttgaagctccagccatatgctttcgggcttcgctctcacatcaagctgcaaaggaagttctacggaccatttcgagtactgtatcatgtgggcaatgtgccatatcacctgcagctgcaaacgtgggtatccgcccagtgttccacattggccagctgaattttcctctggatgacgcaactagggaagagtggattttatgaagcattcattcccagcctttttcaagaagacagtcaaagcatggcggcgtcaaccttt

SEQ ID NO: 43026 - DNA, 253 bp, Triticum aestivum
  Clone ID: PAT_TA_43026
tcgtccggtaacaggtcgtaaaccgaatacaaagatcctttttctggaggaggttgggattagaatggacaataagggggctgtggggggcgtttggtattctcgaaccttggtggattcaatttgggctgctggagatgttactgatagggatcaacttcgcactcctggttcgcacttgatgtgaacggtgcgagtcatctctactcaaatatctttctattctggtgcattgatacctactctaaaccag

SEQ ID NO: 43027 - DNA, 453 bp, Triticum aestivum
  Clone ID: PAT_TA_43027
cgtccgcccacgcgtccgcccacgcgtccgcggacgcgtggggaaaccctaaaccctagccccctctccccactcccatggcgccgccgtcgcaactggtgctcgcggcctcctccaccgacgccggcgtggccgcgtgggacctccgcacgggggccgaggccatccgccaccgcccctgcgcctcccggccacgtgccatcgctgccgtcgccggccgcttcctcgccgccgcccaggtcgccgccggcaactccgcccccatccactactaccactgggacaagccccaggtggctgtgaagagcttccccgccgagccaatccgcgcgctcattgctgacccggaggggaactatctcatcggcggcggtgtgtctggtgacatattcttttgggaggtggctagtggagagctgcttgtccgatggcatgctcactattgtgatgtta

SEQ ID NO: 43028 - DNA, 441 bp, Triticum aestivum
  Clone ID: PAT_TA_43028
cgtccgcccacgcgtccgcccacgcgtccggccggagttgcaatggagctacgtcggacgccgtcggtgctgcactggagctgtggcggagtttcaatggagcttcgccggagcgtctttgctgcgctggagctccgtcgggttgcaatggagctcaccggaggccgtcagtgctggcattgaagcttcgccggagcgtcgttgctgcgctggagctccgtcgggttgcaatggagctcaccggaggccgtcagtgctggcattgaagctttgccggggttgcatcaaagcgccgccgaggctgcaatggagcgccgcgggggcgccatcggtgatgcgcggtgctgccgtgggctagcgctgtgtgtgtgctggcatgggagctgtcggatcctgcggctgggtgcgactgaatcggacgattctagggacggtttaagt

SEQ ID NO: 43029 - DNA, 434 bp, Triticum aestivum
  unsure (1)..(434): unsure at all n locations
  Clone ID: PAT_TA_43029
cgtacgcnacgcgcgacagaataggcgagcggcggaaggggagggagggaatgctctccactctccagcttgctggactcaggccggggtgttcggcgcccaggtctcaggccctctgattagaggaaaggaaaggttgggttataatgggtatttcagccaagtggattaaatcactggttcgcataagaaagcaggaaaagggacggaattcataaacttaagaaaacgcacaaaatgccgagagcagtgaagcttgctcttctgctcgacagctacacaaaagaaagcattctgtggatcccgtattagaagaacttgcaatacctattgaagcattaacggatggcaccaacacccagttcggttcgaattctattttattagaaagtgcattacgtgatgtgcatgcttttcagaccgaataacttcct

SEQ ID NO: 43030 - DNA, 454 bp, Triticum aestivum
  Clone ID: PAT_TA_43030
cgtccgatctgatccaatccagtccccctccgatctcaccgggaaacctccgatcgaagcagagccaaggctctctcgggctgctgctgaagatgcagatctttgtgaagaccctcactggcaaaaccatcacccttgaggtcgagtcttctgacaccatcgacaatgttaaggccaagatccaggataaggagggtatccctccggaccagcagcgactcatcttcgccggcaagcagctcgaggatggccgtaccttggctgactacaacatccagaaggagtccaccctccacctggtgctcaggctccgtggtggcatgcacattttcgtcaagaccctcactggcaagaccattaccctcgaggtcgagtcttctgacacgatcgacaacgtcaaggcgaagatacaggacatggagggcattccctcggaccagcagcgcctcatctt

SEQ ID NO: 43031 - DNA, 425 bp, Triticum aestivum
  Clone ID: PAT_TA_43031
cgtccgccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaagcctatgttgcttcaatcaaggagtaccgtaccaggattgaaactgaactcaacaagaactgggatggcattcttaagcttttggactcccacctt

SEQ ID NO: 43032 - DNA, 458 bp, Triticum aestivum
  Clone ID: PAT_TA_43032
cgttcgcacgactccttcgtctataccaaatcgccgccaccaatgcctcgtctccctccttcgacccgcctcgtcttccttgcgtcgagggtgggccctcccctaatcccaccttacagctccggaggctgccagatccgtcacattctcacccaaccgttcctgtcgcgtcccatcccggtctcttcacgcagctcctcgctgcgctacctgcggcggctgcatcaagtgatgtccggcgaatcccgccaacgccaagcacagcccgaggtccctttgctccatggagcctttccatccagctagatcgagtgcttgctgccaccaaagcccacccgcgacccatcccgcatggctagggtttcgggcgtcggatctggtgtcagtggccatgtcgtcctcgtttcctccgatgtgcggagaggaacgggcagtggacaaccttgctggggctcggg

SEQ ID NO: 43033 - DNA, 454 bp, Triticum aestivum
  Clone ID: PAT_TA_43033
cgtccggccgtctcttatattgagctacatttatctgcctttccgtttaaagaggtgtttctcactgtgtgcaatgtacccaagagaccatgtctttcatatggaagttgctgttcacatatggggtgcccaaggtttcgtggaacctcaaggtcaaattcctctttcagatattgcgcgttcctattttcaagaacttatagaccgctcactctttcaagaagctgcgggggcacctgatacatacgtcattcatgatttgatccatgatatgctccagttagtctcagcaaatgaaagttcgtcgtaagaaatgaatatgaccttctaaatgttcctcaaaatggcccgcatttgtcactgttcacagaaaataattttgattccaaaagatttatgattctatctcagcacaagaagctgcggacaatttttatcaatgtatcattgaacc

SEQ ID NO: 43034 - DNA, 290 bp, Triticum aestivum
  Clone ID: PAT_TA_43034
cgtccgctcttccaatcctatcccctttgcttctcgcgtgggagttgggattcctctcttcggcggccatcttatttagggcgagcatggtgccgacccggatccgcttcgcccgccaaatccccctcccctgctgctctgacaccgaggaggaggaggaggaggaggaggaggaggaaggggaagaggaggaggtggagccatacgagggggaggaagaggagccggtcgcgtctccgctgatactgccggcggcgaggggaggggtttctgcgatggatatggtcggc

SEQ ID NO: 43035 - DNA, 453 bp, Triticum aestivum
  Clone ID: PAT_TA_43035
cgtccgcccacgcgtccggcgaagcagctcagcggcgacaaagggggccctttccgttggtcgccaccgccaccgccacctcgcgtcggcccaccccccgttcctctgcacgcccacgcgggatctcgctctcgccccgaggagggctctcccgcagggtttgcggcgggcgatggcgagccgggtgaaggaggacgagaagaacgagcgggtcatacgcggtctgctcaagctgcccgccaacaagaggtgcatcaactgcaacaatttgggaccacaatatgtgtgcacaaatttctggaccttcgtttgtaccaattgcagtggagcacaccgagagttcactcaccgggtgaaatctgtttccatggctaaatttactgcacaagaagtcactgctctacaaggaggaggaaatgagcgtgctagagaaatatttttcaaggagtggga

SEQ ID NO: 43036 - DNA, 454 bp, Triticum aestivum
  Clone ID: PAT_TA_43036
cgtccggttggcggctccttgtgcagattggatcggcgagtggcagagccccggcggcggccgtcggatctgtggatggcggcgcgtgcagcggctggagcggagccttggcggtggccgttggatttgcagacgacagtggttgcggcgtgctctagtcagccatagcatacggatccaacctgggcggtttgcatgtccaggatgtgtgctcagatgttggatccaagccgtgctgtttgcatgtccaaatcgtgcttagatggtggatccaagccgtgttgtttgcatgtccaaatcgtgctcagatggatgcaatcggctattgcgtctgccggcgactcgcacaaggacgctctcagccgccgagacgagcaccaggacgcgccagcctctcgcttggatccagcctgaccgtgccggcatctgttgatgtgaccatcgtaggttcttc

SEQ ID NO: 43037 - DNA, 452 bp, Triticum aestivum
  Clone ID: PAT_TA_43037
cgtccgcccacgcgtccggcgcagcccaactcctctatctctagccactcttccccacgcaattcctcgccgccgccgcccgattccggcgatttctggcggctattgcaggcgcgcagcacacccgcatcttcccctcgctccgctgcttcctccccttcggctagattcaacgctgccagccaccaacgctcgcttgcaatacctcccaatggctagggtttcggtgacggtacggctccggcggatcctctccgtcgcctaccacctgctggatggtgctcctggcataggacgtcgcaaaggcctcctcccgcaggatgtgctgacatagcgcaccctgcatcggcttgctcgagatgagcacgggcgtgacggcctagtcccgcttgaagatggcggcggcgagcgtcggtgctcttctcgtcctctatctccaagaggcgcgcgcc

SEQ ID NO: 43038 - DNA, 190 bp, Triticum aestivum
  Clone ID: PAT_TA_43038
cgtccgcccacgcgtgcgcggccgcctagctttcgtatttctagcacgtggtgcttaggcatgacatgggactcgcagcctatacctacatggacatccaagaattgctgtaggggaaaggacatcaaagattgaaaatgctgcgttacatgcagccctgtgttagaggatcattcaagaaccatcgctc

SEQ ID NO: 43039 - DNA, 401 bp, Triticum aestivum
  unsure (1)..(401): unsure at all n locations
  Clone ID: PAT_TA_43039
cgtccgcggacgcgtggtctacccacgcgtnctatctctttttttccaactgcatcttgttcttctgggatcggacttagaaagacggggacgagctcgaccgccacgcagttgaatcggttatatgtctcgtctgtgacaccgagcagccggttagcatctgacggcgattccccactttcttctttcttgtgctgctaatagtctagtttcagagttggggtataacactaacagtttggcactggtggtgaacaatcaggcacgcaggtgtgcagcaactgcagcgtgtgcatgggggagtacttctgtcggccgtgcaaattcttcgactacgatctctacaaggagcaattccactgcaaagactgcggcttctgcatagttggaggcaaggtcaa

SEQ ID NO: 43040 - DNA, 450 bp, Triticum aestivum
  Clone ID: PAT_TA_43040
cgttcgtgatagaccaagtggacccacacatttgcatggttttttagaaaaatatatgcgaattcgggtacgttttctaaaggggtagtgtggttatccatgcttctatatatagcaggctcaacaaaaatgaatgtctgatggtgttcaaatttcagggaagtgggtttaacgtttttctttttgcaatattttcaagagtatatgattaaattttcttactttcccagtaccaatatgggctacttaatcctaagtttggtttgggaaaaaatgggtttgcaggtattgaaaggttcaattttccccattatataaaatcatttagctttgggaacggagggtgggtgtcacatttgggatggtgcctgtgaaagttatatacaggcatgagtccctgacaaaattatcgcaagttatgttactaggatcagggaaccttgaccattt

SEQ ID NO: 43041 - DNA, 459 bp, Triticum aestivum
  Clone ID: PAT_TA_43041
cgtccggcggctgctgctggcggcggcggaagtcctcccccggatcggctcgacgtgccacatgatgtgtgcagatcggatgaagaatacaagaggaaggaccttgaggaagactgaagaacaatgtatggatcttcaattataatgatgatcatagcagggagatataccatactaagagcatgcaaagataagcactgatgtagaaatatcaagttcggaagagcacaaaacaataaaacagttgattaaggcttcacttggtaatgacaactccatgtggtcaaaggtttgcaacctgatttccttacaaaatgtagttactaggggaacccaaagtacttaattttataatagttcagtttgttttttctgaagcataatcttctaatttctgtgctaaacaataatgagtatttgaaaaatagggttcaaactatttgcattctaattccagcc

SEQ ID NO: 43042 - DNA, 320 bp, Triticum aestivum
  Clone ID: PAT_TA_43042
ggcgtacccttcatcattgacagataagttcaaccaatacgctctcattatcaggcaggtgacctttgacatggggaggttgtaggatgagaggggcgctcaactgctggcacttgagaccatcagatccgaatatgccaatgctccaactaaggatgcagttgctgcaaaatgatgaggggtcaaactactccgctggagaaggtattctattggaagatgcggctcttaaaattggggatatgagttgactcttgaacaggaagtggagggtttaaatccagagaccttttcctacaaacgcaaaggttctagttttg

SEQ ID NO: 43043 - DNA, 366 bp, Triticum aestivum
  Clone ID: PAT_TA_43043
tcgttcgatattatttgactcccttttctaacattgcacatattttttttgttcttggtgctggggtgggtgcctaaacgggggaggaggatcatgtctacaaatcgacctgacgttcttgaccctgcgctcctgctgtcctgggcgtcttgacagaatgtttgagatcccgctaccaaacgtgctatcaagaacagatttacttaaaatttatgcttctggtgtcgctaagcttggagaaatatgatatggagcggttgtgaaattgtctgaaggatttaacggtgctggatctttttaatgtttgcacctgagctggcatgtatgtaattcgtgcagagcggtactacttagtctcacgaggtc

SEQ ID NO: 43044 - DNA, 318 bp, Triticum aestivum
  Clone ID: PAT_TA_43044
cgtccgattacttaaaggcctgtgtaatcatactaactctaaacacactctcagggtgcgacttatcgagtggattctagagcgtagggtgactcaaacactaatagcattgtaacagtttgcactgaagatcctaccaaaaagaatgcaagattgatcgtattttctgaaaggagtctgtaccaacatagcttgaatttataggcatgtgagagaaacttttaatgctcaatgactgtacagatcttgtaaagggatactgaacagattactgatgagtggcttaaaaaggacagatacacatgcccagtctttgag

SEQ ID NO: 43045 - DNA, 442 bp, Triticum aestivum
  Clone ID: PAT_TA_43045
cgtccgcaagtggcaagatgtaccactagtgttcaccaaggatcataccctcttggcaaagcagcggctgggttctctttggtgtaggcgggtgtgtgtgtgtggagtttcaccatgaccgtgtagtgtgtgttgttgagagagacaaagagagatggagattgatctgtgagaggcatctcatgaggaagaagaagtggcgctgcgaggtgaaggcgccccaacaattggcatcagagcctttgcgatccgaggcgacgacggcagtgcggcctacttcatgtgaggtggaaggacgcggcacatggtggaagctgttcgtggcgtgatgcctgtgggggccggttgcggtgcgatgccacaagatgttgacggagtggcgaacggcgtccccatccacgtcaagaaatggttgctgcatgtggcaagagggtcgtggttc

SEQ ID NO: 43046 - DNA, 438 bp, Triticum aestivum
  unsure (1)..(438): unsure at all n locations
  Clone ID: PAT_TA_43046
attatctnatgtttgattcttccnnnnnggnnnnnnnaagttctctgtccattaccactgcagtaccgaaccccatttccgcccgacctcccttctcatcctacttctccagacgctactgcccaattcattgcttctggaaaagcctaccaagacgggactgaagtgaccaagtttggggctaataataatgcacacgtgtactcgtgaagagatcattgaaggcattgagggcattgtcaaaaagctgctactttccgtcgaatagcaatccaaacatatgccgttgcagatgatatactatagcgatggtgtaagtgagggtcatttaaaaaagcgtactggtggatgagatcccactcataaaaatggcttggaccgctttatataatgagaagccctctattacctttatagtgctgcagaagagccaccata

SEQ ID NO: 43047 - DNA, 451 bp, Triticum aestivum
  Clone ID: PAT_TA_43047
gtaccgtaccgaatcccctgctcgacccacgcgtcccgtcgcaagccgtccgtctcgctcttctcccgagcttgtttctcatcctatcacctatctccgccgagacaggcttagcaaggggcgggagtaccttcgtccatctcgtaactgctttgatggcgatcaagaagaccaaggccgagaacaagatcgcgtacgaccagaagctctgccagctgctcgaggagtacaccaaggtgctcattgacgtcctcgacaatgtccgctccaagcagctccaggagatcctgaagggtctccgcggccactccatcgtgctcatgggcaagaacacctcttatccgccgctgcatcaaggtgcacttcggagaagaccggcaacatagactttccttgagctcatcaacctcctggtccgtaacgttggcctcatctttaccaacggtgacct

SEQ ID NO: 43048 - DNA, 457 bp, Triticum aestivum
  Clone ID: PAT_TA_43048
cgtccgcccacgcgtccgctggccacgaacttcatggataactgagaggcgagataggcaagatctcactgccattcgatatctaggtgcttgagtagtaactttgtttacatgaagataacaaatactgtaggttaaggacctacttgcagctaaagttgaccatctgaaggtccgatcaattacacagatacttgcatttacgattctaatttcagcggcagtagttagcataccaatatatcacacaccagaattcagaccgcattcgttccatgtaacttatattgtaattttcttgtacatgatgtgcttcttactgatattgaagtcttctcctcttgttttttttttcccaaaaaggaggatagacccccgccctctgccttgatcgatgcaccgttcacacagccatgaaactgtgttaatatacgtttgtttatctcaccctgatttt

SEQ ID NO: 43049 - DNA, 224 bp, Triticum aestivum
  Clone ID: PAT_TA_43049
cccacgcgtacgcggtacgcgtggggtgagtatcaccgtttagttttttataatctatagattgatttatatggatagggcagatgcatctattactttcactaatgtgactgtagcaacattcactccattcatttttttggggaaactacaattgattttggttacctgaacattgtattaaggaatgcacctttgttctaggcttatgcttattattgaaa

SEQ ID NO: 43050 - DNA, 310 bp, Triticum aestivum
  Clone ID: PAT_TA_43050
tttttcgccccacgcgttccgtctactctgggctcgtcttcctcctgctttccttcctggtcggctgcaacggcacttgcgtctagcagtgccatggacatcgcgattgacatagtgattgtcaggcttgatgctaggactattgaggtcaatttcctggtcatagtcagcatcagcccaatcttcactgtagtacgaggacctgcacttggctctgtataccatggtgcataccataacccttatcttccgccacatgtcagagaccaggcccgacactaagctcaagtgggcgcttgtagtgtggtga

SEQ ID NO: 43051 - DNA, 233 bp, Triticum aestivum
  Clone ID: PAT_TA_43051
gcgtacgtccagcgtacgtagagcaagaagagaagagagatgcaaagcttgagatggggcaaccatggcgtcggaccggcctgtgcatggcttgcgtattcaagcccggtcgtaggcgcgccagcaggttcatcggagggcgttgtcagtgaggcggaggccgcgccgtcgccggccttggtctatgccagcggattcttgcagcgcttttgctaagtggagcacgccggcac

SEQ ID NO: 43052 - DNA, 223 bp, Triticum aestivum
  Clone ID: PAT_TA_43052
ggtccggatatccctatatcccactcctttggtttccacaaattgtgtggggccacaccatgtccaaggaccttattcactggcgccaccttccgccgggctttgtgccccaccaatggtaccacattaaaggcgttcttatcggcttcattaacgttctttcctacgggaatggtaatcttcttttaacccgacacaacgtatcatttgtacaagttaacca

SEQ ID NO: 43053 - DNA, 342 bp, Triticum aestivum
  Clone ID: PAT_TA_43053
cgtccggccaaagtctctgtctttctctgtgtccgtccagtagatgagcatggcggcgacggcggccacggccacggtctggccctccacctcctcctccgtcctcgcccctcgcacccgacaccacgccacccgtagcccccgcgccctccgctccggctttcttggccgcgcccttaccctcgccgaccccacagaccgcccctcccccgtctccgtctccgtgcgcgcggcctggggacgggccccttctcttggggcgccttatcatgcaggggccgaacgtcaagctgacggagaagctcaaggagcacatcgtggacaaggggggggcgcggtgca

SEQ ID NO: 43054 - DNA, 398 bp, Triticum aestivum
  Clone ID: PAT_TA_43054
cgtccgcccaatcctcgatctgttctcagaccctcctccgtccgtcgcagctccagatttccttccgcatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatccatgggctgctgctggtgctgagtacgttgttgagtccaccggtgttttcaccgacaaggacaaggctg

SEQ ID NO: 43055 - DNA, 228 bp, Triticum aestivum
  Clone ID: PAT_TA_43055
cttccgatcacgatctataacgagcagatatgctcgtgtgggaattgaatgagagtgagatggtcacagcagatgcttctacgagggcgaaccaagtgatgaagagcggcttggtgtgcttcaagccgaagtgcatgaacggcgctttagctcaccagaaggcccagcctagtcgtgatagccgtcaagtatgacaagccgacgtaccagagggtccagcccaataac

SEQ ID NO: 43056 - DNA, 285 bp, Triticum aestivum
  Clone ID: PAT_TA_43056
cgcgtccggcgaccccttccgcgagatcttccgccgcgacctcggcccctcccctcccgccgcgcccggggaagaggccgcccaggccatccaccagccccccgccgccgtgagcggtggcgggggcggcatcggcgtcgtcgagatgctcttccgctgcaacatactggcgctcgtcgggggcggagacgcgccgtactacccggccaacaaggtcatgatctgggactaccaccaaagccggtgcattggtgagctctccttcaagtcccccgcgcggggtgt

SEQ ID NO: 43057 - DNA, 412 bp, Triticum aestivum
  Clone ID: PAT_TA_43057
cgtccgattttgttgacctgcttgagggttttcctttcatagtcggagccacttgctgacaaagttttccagtgcaattgcttaggattgcatatactctaggtgaactcttgcacttctgtgcaattgaacttttgtagtgcagcgacctaaggttgcatattctggaaaggatatgttgcgttttctaggtgagctcttgcgcttttgtgcaagttccatcttgttaactgctgttgcttccctatgaagagctgttaacctttcactttgtaaagaaaaagaactcctcgttaagtcattgtagtgttctttcggtggtagtctcaacggtttgcatggttcagaagttcagatggtattctacaattaatctctttccaatttgaagtagtatatggtaactgttctg

SEQ ID NO: 43058 - DNA, 269 bp, Triticum aestivum
  Clone ID: PAT_TA_43058
cgtccggccgctgctcgccacctgccgtgagcactggctgaacctctgcccaccgctgggcgaatagaggcatgaagcgagagagagagagagagcccaccccacccatggagagttcccaccgcctgctcctcgtggccggcctcctcgccgcggtgctcccggcggtggccgccgtgttcgggccgcagttgggggctccatgcgagcccaccctgctggcgacgcagatcgcgctctcctgcgtgctcgacatgcccaccgcgcac

SEQ ID NO: 43059 - DNA, 367 bp, Triticum aestivum
  Clone ID: PAT_TA_43059
cgtccgcccacgcgtccgcctccctctcccccccacccaaatcgccgccatttcgctaatcccggctactctcgcggcgcacgcgctcccctcccctcctctttcctcccccctggcgtcgacgcggcggcggctcccggcggtggccaggcgggcgcggctacgaggaggtgggcgtgcgcacgacagggccgagctcaggctagggttcgaggcagcggcattggcggcgtggatgaggagctaggaggtgctcggacggcggggaacggcggcagcggcggtttgcatgcaggcaggccggcagccatatatttttgtcaggctcgatgactccccatgttcccggcgcagataccatcacttg

SEQ ID NO: 43060 - DNA, 368 bp, Triticum aestivum
  Clone ID: PAT_TA_43060
cgtccggtggccaccgagctaaccctatcctaaattatattaccatccccaatctagcggaggaggacgaggacgacgccgacgagatgcttagggttgcggggaggaggctctcgtcttctctctcctggcgccccgtggcgaccgtcgtatccaggggccctctcgccggcgccggcggccctgggagagacaacgacgacgtgttcggcctaccagcggcggtttctcatctagtcccccttcttaaccgccgaaagaggctttttttcggctgaaacacttgttcctcggtaccaatatgctgggttggcatgatctcccagcactgatgcttgcactgaaaaaccccaacttaaaaatccttt

SEQ ID NO: 43061 - DNA, 198 bp, Triticum aestivum
  Clone ID: PAT_TA_43061
cgtccgccacgcgtacgaggactcgtggtcagacactgagcacagagagtttgggggtatggccagacagggaaggggattaagtttttttatactattctcaaagggaaacattggtaaggctgaagtagcagaggaatctcatagatctcaaatgtttgataccagatgatgttaaggttttaataaaaaacacac

SEQ ID NO: 43062 - DNA, 354 bp, Triticum aestivum
  Clone ID: PAT_TA_43062
cgtccgcggacgcgtgggcaaaaccccaccaacacgaacgcccagtccaactccaaattcgccgccggccgcccgctgcccgctgcgaccgcaaccctcccgccccgccggcctcccctccccccctctccgatctcatttctcccatcgcaggtgaaagtctagatggctcctttggtgctgggaatgtgaattgcagaaaacaacaactgtttacattttggtactgcatgatggacggttcaacgggttccctaggggatcatgtgaacggaaagcaagtgcaaagtgttgaccctcctgggcttcaagtttcaacaatggacaagacaccgtcccgtgaatgcattgaga

SEQ ID NO: 43063 - DNA, 213 bp, Triticum aestivum
  Clone ID: PAT_TA_43063
cgtccgcccacgcgttcgcgccttctcctctccgatccttctccttccttcgagtttcaaccatgggtaatgagaagactcacatcaacatcgtggtcattggccatgtcaactttggcaagtcgaccaccactggtcatctgatctacaagcttggaggttttgacaaggcgttgatcgagaggttcgagatggatcctctaaatgaacaag

SEQ ID NO: 43064 - DNA, 153 bp, Triticum aestivum
  Clone ID: PAT_TA_43064
cgtccgcacactcacacagaacgctcaagctagcagcgcgcgcaccgagccggcgactactacgacgatggcggtgaccacggcccagctgccgcagccgcgcgccctggcggccctactcgtcctggtgctgctcatcacgctgggcggcgc

SEQ ID NO: 43065 - DNA, 298 bp, Triticum aestivum
  Clone ID: PAT_TA_43065
cgtccgatgatgattggcctgaggacgaggatgatgatgatgatgaggaggaggatcaaggactgggtgatgatgattatgaggattggcctgaagatgagggttgggaggttatgcaagaggatgaggttgaattaccagattaggagaaattctacatttcattgcttactagcgctcaaaataagaatttgccgcatgatcttgttcgtcatgactctatgcctctcatcataatagaatgttattcgttgtgtaaaaattgtaatcatctgctggttagcaatataacatactc

SEQ ID NO: 43066 - DNA, 202 bp, Triticum aestivum
  Clone ID: PAT_TA_43066
tattttttgtttttgtgatgggttttttaccgggacaggcaaaatgctaaccaggttcttttttcaacccaataggaagaacaaagttatcattataaatttactagtcctacatagggtattaacttttagaggggtagccctatccaattgtttaaaattgggggggaccatacattaaggcttcaaatatattttgctt

SEQ ID NO: 43067 - DNA, 300 bp, Triticum aestivum
  Clone ID: PAT_TA_43067
ccgctcgacccacgcgtccgaaaaaaaatctctctcggctccccgctccgagtcgcgtcgcgtgaggagaaaggaagggaagccggaaagggttctcgccgacgcggaaggaggagatggccgggaagggaggcaagggcctgctcgcggccaatacgacggccgccatgaccgccgagaaggacaaggtgaagaaggcccccatcttccgctcgttccgggcggggctccagttccctgtgggccgtaatcatcgtcagctgaagcaaagggctcaggccattggccgggttggtgcta

SEQ ID NO: 43068 - DNA, 404 bp, Triticum aestivum
  unsure (1)..(404): unsure at all n locations
  Clone ID: PAT_TA_43068
cgtccgcttttcttcatttacatgtactcactgaaacctgacatggcatgtgtagcggangttgcgagccaggggagtgtgtttcacgaatagatgacatcacaagtgatcttgattggtaacatgtttggaattgtcgcgcatgcatggatcgaacatgtgcaacactaacaaaacgaaaacaaaagtgagcttgcggttcgcggtgctttccctctgaattttctcattagtatgttcagaaaggcatatttttggaagagcatacatgaaaaccttaacatgttaagaactttttcatgtactagaaggtagttatacaaaatttttttctgaaaccatgtcataattttatatgttccattaattgtgtgtttggtcaggtttaaataactatttattca

SEQ ID NO: 43069 - DNA, 318 bp, Triticum aestivum
  Clone ID: PAT_TA_43069
cgtccgctcgtcccacgagccgagcctcctcgccgtgcgcgcccgcaccgcacactccgaaccgaaccgagaaagacaaggcccgatcgatcaatgaaggcgatgatactacgccgccgcggcgccggtggcgggctgcgcatcaagaggaagggccgcggcttcatgtgcggctgcggcggatccaaggccgtctccgtcttcgacggcttcgacatgcattcccccatgggcacgccgcccaccaacacatcgtccgccaccactggcaccaccatgtccacggtcaccaccacggcgacgaggagggcagggaac

SEQ ID NO: 43070 - DNA, 359 bp, Triticum aestivum
  Clone ID: PAT_TA_43070
cgtccgcccacgcgtccgcccacgcgtccgcacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggctgcgcgttcgctcaggtggtgcacgccggcaccgtcgcggccattaaggttggcccgtcggcgacgttctttggtggactcaccggaacggcaatttttacgagggtagggactttgacctgcccct

SEQ ID NO: 43071 - DNA, 302 bp, Triticum aestivum
  Clone ID: PAT_TA_43071
ttttggtcaagcaggatcttatgtggctattaaaaaggctggaatgcatttgaaacacgatcgacactccgaccgcctacaaagaggcatgttcaggctgaattggttatcataaagacatacttgagcatctaatcataagactttgtgagcataatgagccaccatttgccacaccgagcttatcaaatgctccaaattaccgatcggatctaaaccatgcgagtcgggatctattcttcgccaactttattattggcagattctatactcatgaagcagtttatccaggtcctcctatt

SEQ ID NO: 43072 - DNA, 209 bp, Triticum aestivum
  Clone ID: PAT_TA_43072
ttttggtcaagcaggatttaatgtagtgagtaaaaaggcgagagtgtatttgaaacaaccattttgacttagaccgaaaacaaatagacatgtttaagcttaaatggatatctttaatacatacgtgtgaattgaattataagattattgagcttattgagcctactttcgacacattgtgcatgtcaaaagcgctattatcaatgtat

SEQ ID NO: 43073 - DNA, 189 bp, Triticum aestivum
  Clone ID: PAT_TA_43073
tcttttaatcaccaaaacacttaggccccgtctgtctcttgtgattgtcaggaattagcctcttactgtttgaacatgcgcgtttatagattggggcctgcccctactgtacctagtcctttacacctgttcatagtcccatgtgctctggcccacgctctcccgtgcactgttgatgggtgtgcgggc

SEQ ID NO: 43074 - DNA, 301 bp, Triticum aestivum
  Clone ID: PAT_TA_43074
aatcaccaaaacacttaggccccgtttgctccttttcattttgaggaattagaatcttactattagaataggctattttttcagaatgtgacattccactacttcccaaagtcttctacaactattaatacttacatgtagactgcccccgctctcccctgacttccgtggctaccgcgcgctcaaccggcgaggatcccatagtcgctaacaaccgccgtcagctcgtgtgctcccgttcacacaacctcccgctattccctcgctcccgaggcttccacgctcacaaccgcctaggatt

SEQ ID NO: 43075 - DNA, 117 bp, Triticum aestivum
  Clone ID: PAT_TA_43075
tttctcaataaccaaatcacttaggccccgtctgatactttttattgtgaggaaagagtatctttctactaaaataggctattttgttatatcgggactatgcaaaatctagcctaa

SEQ ID NO: 43076 - DNA, 242 bp, Triticum aestivum
  Clone ID: PAT_TA_43076
ggttgttcttgttcttgtcttcagcttctttttagggcaacactttagagcttttgattaaggaagcggggctccccccccgtcctacttaaaagccacggcccttttgactataccaccggggctgcgcagactcactatcttttcttccccagcttttccgacagcagaaagcatttacacgcctattctggacttgagcttgtgttccttacgtccacaacgctccccgtccagctgta

SEQ ID NO: 43077 - DNA, 409 bp, Triticum aestivum
  Clone ID: PAT_TA_43077
cgtccgcgtctctggtgtttcactaaccattgggctgagtcaactgtccagttcttcacaaagcctaagaatcgcaaggccatatacatgtaatattgaattaggtactttttctatcactggactacacaagtcaatagagctaatgttcatcattatttttggatcgtccatctttcagttggattaaggttttttctattgtctgcaaatgaaacttaattgatatacctttggtatgataaaagaagtgattacccttttcttttgtaaatatttctgcacacaatgttagtggaggttgatatgacaatttatgtgctcattagtttaatgacttctctctccattaactgatattagacagtgatgtttatatgttgcacctgattctattttccaaggattt

SEQ ID NO: 43078 - DNA, 272 bp, Triticum aestivum
  Clone ID: PAT_TA_43078
atggacgtcttggttgcttttttttttgttttttgtctatttagggccaaaacctcacagctttaaattaaagaagcgggtttcccccccccctaatccaaaaatcaagtcccttttttttttttctcggggggaatcctacccttactttgtttttatccccaatggttccggttttgcacactacctaaactttctcggctgattggtccttgatcccctttacgtttttataagggctacccaactggcgggccttgcgttctctctct

SEQ ID NO: 43079 - DNA, 302 bp, Triticum aestivum
  Clone ID: PAT_TA_43079
ttttctctgtaacgaaaactagtgagcatatatggttcaccagatgttcggctatttattaagtgaccctccgggtttaacacacataacagttctacatcgaccggtcatacgtgcgcacagcatagttcagacaacgacgtgaacaagacgcgatattttacgtacacaatcagcatccctacagataactcatgaaccatgccacacacataatttgttctatgcgggagacttggtcacctcagggtccagtcaagaggctgtgttatacacactcattgatgaccttcgacatggca

SEQ ID NO: 43080 - DNA, 343 bp, Triticum aestivum
  Clone ID: PAT_TA_43080
cgtccgcggacgcgtgggcggacgcgtgggcggtcgcgtggggataatgaagaggcatggaggagaggcggtagagcgggaagggctgaggcgtctcccacgacgccgatgcttgacggcggccttgcgatggcgctttcggcgaggacctgtctgatctggcccgatctggtgggaaattgcacgcaagcggcggatctggaatggaagacggtcgtagcttctagcacattggctggtggacgcgccatggtccacgccggcgagagaagagtgatgatgatggggagagatttgagaggtctggtaggatgttgagaggcctgatggtgagagaagggag

SEQ ID NO: 43081 - DNA, 378 bp, Triticum aestivum
  Clone ID: PAT_TA_43081
gtaacaaaactagtaagcatatatggctcaccagatgttcggataattcttaaataacactctggttttaacgaagataacagttataaatcgaccggccaaacgtggcgagcatagttcaaacattgacgtgaacaagacgagatattttacgttgccactaggtgttccttaagcaaactcagagccaggctgacacatcatttcttctttgcagcagcctagatcaccttggctccagttggatccttgttcatgccactatagatgactctgacaggcaccggttgccttatgacatggacagcaaaagttccattagggggatttttagataaggtctgtactaccatagggcttagtggtaaccatcttcat

SEQ ID NO: 43082 - DNA, 349 bp, Triticum aestivum
  Clone ID: PAT_TA_43082
gtgcgacgcgctcgtaagcttgcaccctctaaagcatacgtcgtttgatggttcgtgctactggaataaccgtagtaagcatagagctaatacgtgcagcaaacctcgacttctgggaggggcgcatttataacataaaaggctgacgcgagctctgctcgctgatccgatcttcttatcgcgggccagccctttttacatgacgtgattttgtacgttttcattatgtttcttttttgtttattcgtttgtgggaggaacctaaagggcaaacaaatgcaatgtgggagacctggctataaattgatgaacaggaattgaaatactttggacacaaaaagcaaactgt

SEQ ID NO: 43083 - DNA, 332 bp, Triticum aestivum
  Clone ID: PAT_TA_43083
cacgcgaccgcccacgcttacacaagactaccttcttcgccccagcatacatctcccggctctgctgctactgtagccaggcgtgctgcccataccctccccacctctcccccttctcgccccgtgcttctctcgctcgctcgctctcctaatactggtctgtctccccccaccgcgcctgcgagatggatctgcagcccttcttgtcggtccttgtgaccggcggagccttcggcataatatatatcgctctgcatcactattgcactaaagggtctattagttaccttagacaatttctctaaacaaaatggaatagaaatcacttcgct

SEQ ID NO: 43084 - DNA, 297 bp, Triticum aestivum
  Clone ID: PAT_TA_43084
agctcggatcctctagagcggacggccccaccgtctaccgactcgttatccttttcctcctcgtacgcgggctacccaccagaaacagcgagcatggtctctcatgatccggtgatgctgtcaacgtcaaattcggccggttccggctaatcgggcggggcccggatgacatagaccaccggtggtggcaaagacacgacctctcctgtcgccggctacaccgacgggagcggccatgggcacgcctttcctggcctagagcatgtattccccacagccacgacgctcccgttcggc

SEQ ID NO: 43085 - DNA, 215 bp, Triticum aestivum
  Clone ID: PAT_TA_43085
ttttccgataaccaccttgcattgggtagcccgggccacatcaaggcactgctccttcgacactaaaactagcggcgacatgtgcacgggtacttggactcaaaccgcacatcgatgggcaacaccttttcgttttcaacaggtaaggagacgcccaatgaacacctagtgttcatgtcccgtccgggatataggttggatggtcacactttttt

SEQ ID NO: 43086 - DNA, 440 bp, Triticum aestivum
  Clone ID: PAT_TA_43086
acgcccgctgtaccgatccgtgatccccgatgcgacgcacagcgtaagcaaacatgcaactagagcaggcggccttttttttttttttttttttttttttaacttttttggcaggtgtttattcttttttggcctctatttcctgttttttttttgcacttttttatatttttttgcgtctttcatatattgtttctttgctagctttcctttagtaaaccaaaaaatattgagtcaaggggggcacaaaataaaaataactaagcacattgtgagcgggaaaacacccaaaaaagagtggtcctgattggtttaggacattttataaaaacaataaagtggcccttttcgctaaaatctggaagcctaaaaaaaaatgatgatttgtgaccccttatcaaacccttctgataaaaaaggcagggatttaccaccccccc

SEQ ID NO: 43087 - DNA, 253 bp, Triticum aestivum
  Clone ID: PAT_TA_43087
ttttacacctttttcaacgtcaggggcaagatccagttcttggagggcattctcccttaccagcatctcctcttctttgtctgcctagcatttgaggacagtcacaccctttctaactacaacattcataaagagtccacccttcacctggtgctctgactgcgtgatgacatgcaaatctttgtgaagaccctcacctgctagaccatcacgctggatgtctagtcctttagtacaccatcgactatgtgaa

SEQ ID NO: 43088 - DNA, 487 bp, Triticum aestivum
  unsure (1)..(487): unsure at all n locations
  Clone ID: PAT_TA_43088
tnctctatccactcctccgcgcctctcaccccctgccacgcttcgccccgcaaatctaggcctttcgctggccctcctgggcccggcccctccccagccagccaacggaggcgacgtgcgcccggcccgcggcggctctcccccgcctgccgccgccgccgcgcacgggatccgcgacgatccgtgcgcccaacagaacttggattttttgtggcccttcatgaatcttgaggacagtctatactaggggggcagtagggttctactactgctaggatctggtatgctccgtattgagggtgagatatggtcggggggctaagcaagtgggcccgtgggctcttctgcgtcatgggcgtgtgcctatgtcttctttttctttatttctcgggctccaaagggcaggctgggatcgcgggactatagtctggcacctttgtttctccctcgcttgggtggggctcgtatggagatggctgacggatgg

SEQ ID NO: 43089 - DNA, 322 bp, Triticum aestivum
  Clone ID: PAT_TA_43089
ctccttttccctctatttattctaactgtcctatgacttccaattgagctgttcgttcgaagcctgtgcgagatgcattggctactactggaagaaagatgagacggtgcacaccatcgtcgccaagggctgactgctcaccggtgtcatcggtttcatctacaactacggcgacgtcttcatcgttgaccggatcaaggagctcatcaagtacaagggttttcagggtagctcctacgtagctgtatgccatactcctgttccatcctttcgtagaagatgcatccgttttctgactgccgtacgatggaggctggtgaga

SEQ ID NO: 43090 - DNA, 217 bp, Triticum aestivum
  Clone ID: PAT_TA_43090
cgttcgcccacgcgttctgcgagagacagtggcgaacacctttcccgccgggctgccgtcgacgtaggatccgttacttcggagagaggagaggcccgaccgcagcgatgggcatcgagatgactcccctgcatatgcaccgagcggtataccgttcggagctcccgacctgggtccatggcaccttggtggtggtggagttcggctacgccgggat

SEQ ID NO: 43091 - DNA, 291 bp, Triticum aestivum
  Clone ID: PAT_TA_43091
ctaccaagagcatcttcatttttagctggttgcaagttaaacagaaatcaaaacggcgggtcttcagaaaaaacatacaggacaacaggtagcctaaacctgctgtttaaaccacccaagtgatttgcacaaaacaaaatttctcctgggcgaccaaggtgtgccacagttatttgagaaataatagttacttatgggcttgctggattgataaattgctcaaacccggcacaattttattgttacctattttgcttaagggtttgggtgctttttctggaggaagagttg

SEQ ID NO: 43092 - DNA, 133 bp, Triticum aestivum
  Clone ID: PAT_TA_43092
cgtccgcccacgcgtacgcccaggcgttcaattatcacatcgtgtaactaagaagagcattgacaaactccagccgcatatcaacggtagaagaggctaccaggccactggtcatacatggcggtcttgcttc

SEQ ID NO: 43093 - DNA, 460 bp, Triticum aestivum
  Clone ID: PAT_TA_43093
cgtccgcatccggggtctccccatcatcttctccgtcacacctaccagcagaggagaggagagggatctctccctccgcctccccatccatggcggcgccgagctggatccggctgccgcgcgccaccgtaatcctgctcctgctcgccctccacctctccctctccctcgccgcccagttcgaggggttcgactccgacgagctcccctccgccgccgccgtcgacgccgcgtcctccgacgatgacgacgaggggctcgacctcgacctgccgccccctccgcccatcaccgtctccgtctccgccccttcccctcccgtgaccaccaccaccacggtcacgcccccgaatcgcactccctcgctcgacttctgggacgaggacgagttcgagggcatccccgttccggaagcggcggcctccggcgactcctccgcgccggcagagtccgccccgtc

SEQ ID NO: 43094 - DNA, 325 bp, Triticum aestivum
  Clone ID: PAT_TA_43094
cgtcacgcagctgattcagatcattctaagcaagaagaggtgagactttccacccgagagcagcgggaatggcgccctcggtttatggggggggccctctgggtgtccccaatgttgttgcaaccctcctgggcccaaagggggttccagcccctgggccaggacctcccctttccatggaagtccccaaggggggccttcttttccggcccaattgccataaacctggttgggaacgggaattttccccgccccaaagcgcccttggcacccaaattttattcctggttggcctccggttccggttccccgggccccaaaccga

SEQ ID NO: 43095 - DNA, 404 bp, Triticum aestivum
  Clone ID: PAT_TA_43095
cgtccgcacagtcccactcgtagagagcacgcgcaccgtttattctctaatttttctttaccagcgagcaatggctaccactgtgatggcgctctccccctcgttcttcgacgggaaggcggtgaaggacctgccgtcgtcggcgctctttggggaggcgcgcgttaccatgcgcaagaccgtggtcaaggccaatccggtgttgtccggcattccgtggtacggattctaccgtgtgctttacctcggcccgctctccggcgaccccccgagctacctcaccggtgagttcctcggcgactacgggtgggacaccgcggtgctgtcagccgacccctagaccttctccatgaaccgggagctggatgtgatccactgccggtgggccattgcttggcgctctt

SEQ ID NO: 43096 - DNA, 312 bp, Triticum aestivum
  Clone ID: PAT_TA_43096
cgtccgcggcaatgctggactgctggagagcacttttttttcgccggacgtcgcacttttgcctgcactgatcgaggcttacgctgacggcggctagcagcagcagcagcatcatgcagcggggaggagcagcggccagcagcatcagcagaagcacgcagcggggaggagttgctgacaggagcataaccacgcagttggggagaagcaacagcaggcacaggcggcagccagcagcagtagcagcacacagcggggaggagcagcggcgagcaggctgcagcagcaggccatagtggccatacccgttgt

SEQ ID NO: 43097 - DNA, 348 bp, Triticum aestivum
  Clone ID: PAT_TA_43097
cgtccgacgccatccaggccagggttccctcgccaccggttctttgctcctctacatgccgcgagacccccgcgcccgacctcctccttgctgcccttggtgccgcgccaccagaccttcctgtcgccctcgtcatcgaccagtgcgcccctgccttcctccctcctccttcggttcagggagccaggccggagcccgtcggcctcctcgccgccgttcaccttcgcctcgagctgccagagagcgccaccgcgccttctgccatggccttcttcttatcttcctcgcgcgcgcgcgaccagtgcccctcgtcattaagttcggctgtgtgctatctcctggctcttc

SEQ ID NO: 43098 - DNA, 442 bp, Triticum aestivum
  Clone ID: PAT_TA_43098
cgtccgagaagctctttgggaaagcaaatctgaagccattggagttggaacttcgcccgccatggctgcttcttcttcttcctcctcctcgtcctcctcctcgtcctctccgtcctccccctccgacccggactacaaggtcaccacctctgacatcgaggacgacgccgccggggtcgagcccccatcgtcggacgaggaattcccctccgtcttccgcacgcagggccacgtggacgcggtgtgcatgaagtacggcatccccaaggaccagtacaccgccctccccgccggcgacctgcgcgcgagctcgtccccaccgcacggcgccgtctgcgtgtacgcgcacgcgctggaggccgggatgcgcgtccctcttcaccccttcttcgtcgacgcgctcaaccacttcggcctcgcgccgacgcagctcgcgcccaac

SEQ ID NO: 43099 - DNA, 229 bp, Triticum aestivum
  Clone ID: PAT_TA_43099
cgtccggagcccttcttatccaccccctccctcccagcctttgttgttcgttccgttcaccccatctgtttctgctccttcatggatggggccgcccccaatctgcagcagctggacgatgcgatttcccaggccgtttcggccgtgagctgcttcccgttcgtcggccggttgcggcacggttgcacatggccgttgtggaggccgagcttgcgcgcgggggaggggg

SEQ ID NO: 43100 - DNA, 415 bp, Triticum aestivum
  Clone ID: PAT_TA_43100
cgtccgcggacgcgtgggtttttttttttttttttttttgttcgttcatgctgttgttccagcctagttattctgtgtctttttcttcagttgcaaaggttacagtaacacatcttcactctagtcttacaactcaactaaactgcagtacagttagatatagcacatgacacttgcaggacagttggatatcatgacactgatgtaaaagaatgaatagaaagaaagaaagcagaaattgtcccagtagtggcctttacactttagcttgccatacgcaaaggatcctcttgaacttgggtctctagctgtagattccggcaatggagtccagcatcaggcttgtgataagctggtttgttgattttgtcggatggacagcgtcccagtacaagtacttgctcgggtctgggca

SEQ ID NO: 43101 - DNA, 369 bp, Triticum aestivum
  Clone ID: PAT_TA_43101
cttccgtggacgcgtggtgtcgaagtcaacaccgctggttcttttaattccccacccatggcttccgccaccgcgtcctcctccgtcggggccctcaacgtgggcggtgagctctttcagaccaccacagcgaccctttcccgcgcaggcgcttcctaccctctggcctcccttggcccatggaccgacgacgcgccacacttactcgaccgcgaccctgtggtgtgcgccgccattctctcctttctacggaatggccgcctcgcgtgcccttctacctgccccgttcttctagccgaggctcggcactttttactcgacggactcctactttgcttccttttccccgcgtccgacttatccccaatg

SEQ ID NO: 43102 - DNA, 397 bp, Triticum aestivum
  Clone ID: PAT_TA_43102
cgttcgggcttcctacctacctaccctgccaaccccatatttcccctcgcccgtcgcagatctcgaatgccccccgagcatcgaccatgtgggcctactgcggaaagtacaaggatgagctcatcaagaacgctggctacatcggcacccccggcaagggtattctcgctgctgatgagtccaccggcaccatcggcaagcgctgtgccagcatcaatgttgagaacgttgaggacaaccgtcgtgccctccgtgagctccttttctgcacccctggtgccctccagtacctcagcggcgtgatcctgtttgaggagacccttgtccagagcaccaaggggggcaagcccttcgtcgacattcctaaagggggccaaggtcctcctggcattaaagg

SEQ ID NO: 43103 - DNA, 212 bp, Triticum aestivum
  unsure (1)..(212): unsure at all n locations
  Clone ID: PAT_TA_43103
cgtacgtggactcttggttccgctcctgtccctcatcgtttcttggcggacgagaaggcgatcgatggcgtcatcgttggtgtgggcgaggcgcgcgctggtcgtgatggtggtggcgtctgcnatggtggaggcgacgcagtcttcggatgcagcggcgaggagcggcggtgccgactaagacaatcttctgttcccggggttcccgggcg

SEQ ID NO: 43104 - DNA, 408 bp, Triticum aestivum
  Clone ID: PAT_TA_43104
cgtccgatttattgcttatttcggggaattatcagtgctttaccgcaaaatgcaagaaatatggagcactgtgatatatctgcgctggagcaagttctcatgcttactgcttcacatgttggtgataatcaatgttggtgcccagctgtggatccaagagggagtttttccttgcagcttctatccattccttttttctggcatcgtttgccacacttaaagaaggttttctctgctaatgggctcagcaaatattatattcatcaaatagcttgctatttgtccaggcgtgctgatgttcttcctaatgattatatcagctaacagccaggatatgcgggtgttcttgcaaatgtacaactaaactgccacttggatttttttcgaaccaaaatcccttttgataaa

SEQ ID NO: 43105 - DNA, 405 bp, Triticum aestivum
  Clone ID: PAT_TA_43105
aaacggtaggagggttttttgtgcggcagcaagaggtggagtgaaatgcgagaaaggggaggggcgggaggcgacactgcttgcattggtagtgcccacggacttcggcagccattcaatgctccaccaaacgctcatcccttattgccttgccttctacgactccgcttcccccgaccctctacccttcgcctaaaacgccaccgtcgccgcccccgccgtcgggacccaccttcgctcctcagccatgccgttctacgcgcaccaccacagctctctggtaaggagggagggagattaccggggcgaaagagatagagagaaagagagaatcttttggtgattttcaatataagtcctcctccgacaagacggaagaaaacgagcgctccttctctttctctc

SEQ ID NO: 43106 - DNA, 219 bp, Triticum aestivum
  unsure (1)..(219): unsure at all n locations
  Clone ID: PAT_TA_43106
aaatcgtacggggagggagaggcgttctccaatcctagcggcttttttggctatcggactagcgtggcattgcgcgcttcaccatgctgcgggagcggtcgtgacgctgttgacggcgttgcggtgggtcntggactaggccgaggaccgcgtgaagctggcgtgcgtgaactggtcgtcttaccaggagccgatnactggcggaggggctgggcaagc

SEQ ID NO: 43107 - DNA, 215 bp, Triticum aestivum
  Clone ID: PAT_TA_43107
tcgatcggcaaacagacagagcttgagagagcgcgctctattttgtagcctacatgatcacctcggcgagtgtggtgccgacgagcgtgggggccctcacccgacggggctcctactgggagggtggctgcaacggtggcaataagatcaaggtcgacaagcccctcggactcggaagcggtttgacagtctacaccaacgccaacggcaggaag

SEQ ID NO: 43108 - DNA, 132 bp, Triticum aestivum
  Clone ID: PAT_TA_43108
ggtgcgcgtttctctgtttggaagcgggcagaatccatcgccggaggatgatcgccgcgtgcgggaggcagttagggaggaataggcggtggttagaacttccggaaggggagtaggaggagaggccgtcgg

SEQ ID NO: 43109 - DNA, 321 bp, Triticum aestivum
  unsure (1)..(321): unsure at all n locations
  Clone ID: PAT_TA_43109
cgttcgctcacgcttacagtttccccaaacgcttttttttagcacacctaaacccacaccgcgagctcagcagattgatacggggtgggcagcccgctagggagcccgtacgtcaaacgcctccnncngccccccaagaccaaggccaagcctgtctctgaaccataccgggaaccatacccagccccaggcgcagccacaggggacgctagaagagcctgctaaaaggcaggcggcccggtggcctgccgggctccctcaagggcctccgaaacgatattcaaaacgccaaccaccatgcccatgctatgcacaatgcct

SEQ ID NO: 43110 - DNA, 434 bp, Triticum aestivum
  unsure (1)..(434): unsure at all n locations
  Clone ID: PAT_TA_43110
ggtacngattcccggttccgcccacgcgtccgcgcagacagacagagcttgagagagcgcgcgcttttgttatcctccatgatcacctctccgattgtggcgccgacgagccgggcgtgcctctcccgccggggctcctacttcgccgtcgtctgcagcggtggcaagaagatcaaggtcgacaagcccctctgactcggaggcggattgacagtccacatcgacgccaacggcaggaaggtgggtaagaagggcgtgtaccagttagatgacaagtacggcgccaacgttgacggctacaggccaatctacacgccggaggaatggtctgaatctggtgaccgctacgccggcgggacgaccgggctttttatctgggccggcaccctcgccggccttctcggcggcggcggtctcctcgactacaacaccag

SEQ ID NO: 43111 - DNA, 276 bp, Triticum aestivum
  Clone ID: PAT_TA_43111
cgttcgtccacgcgtacgcttatccgtctagtgtttgtcttcctacgtcaagccctttgacggcgcggccaccttcaggtacatgacgggcggcaacgacgtcatccagggcgacctcgaaacgcacgttctccccgtcattaggaacatcaagaccgtgctcaaggcggcgggcgtaatcggagtcccggacaccaggacgaggccacgtcagtgctaggagtgaaatacccgtcagtgtaggccgtgttcttcgaggcgttcgcgccggtgatg

SEQ ID NO: 43112 - DNA, 439 bp, Triticum aestivum
  Clone ID: PAT_TA_43112
cgtccgcgccctttttttttttttttttttttttttttttttccgatgaaaatttgagttttttgcagaaaaaagttccccaagcggggggcgaataaaacacctttcacatgtcctgacagttgttacaaaaccaacctttccctgggaccctacattcccacttggttttttgttacctatgacacggggggtcccacccctaaacattctctacacccaaagaagatggggcgccttcttgcaccatgactgaaaagtttgctcttttcagacaacggccattcttccaatataatgggacgtcccatcgggggggcccactttaacaggacccctaccagccccacggttggcaacaaactcctttgaatagcgtttcttacccacttgggactgctaaacgttgggctgtttttcctaagtttacattttttgc

SEQ ID NO: 43113 - DNA, 213 bp, Triticum aestivum
  Clone ID: PAT_TA_43113
cgtccgtccacgcgttcgctactagccagtgtagctcgtttttccgctcctgtcccttcatcggtacttggcggtcgagaaggagattgatggcgtcattattggtgtggtctaggagcgctgctggtcgagatggtggtggaggctgctacggtggaggcaacgcagacgtgggaggcaggggaaagggagcgcggggccaacgaagacaag

SEQ ID NO: 43114 - DNA, 397 bp, Triticum aestivum
  Clone ID: PAT_TA_43114
cgtacgcggacgcgtgggctcaaaatccccaacgaaacaggtgttgcagcgcgagatcgggcaaagagagcgcgacagatggggatcgggggcgttggcacttggggcggggctgggggcgccgaggcgcaggggaggagcgtgctggtgacgggcggcgcggggttcatcggcacccacaccgtgctgcaactgttggagaagggctacgccggcacggagggggataactatcacaacttcgtccccgaggcgctcgaccgcgtccgacacatggtctgccgcgctcttttcgcccgcctacaattcatcttgggggacctgacgatcaaggatgacctccagaaggtgtttcgccgacaagaggtacgacgccgtgatacacttttgcggtctc

SEQ ID NO: 43115 - DNA, 158 bp, Triticum aestivum
  Clone ID: PAT_TA_43115
ccacgcgtcacgccacgcgttcgcgcatttttccctgagccttatcctatctagccccactctctacctgtgtagtttcttctgcggcgctcggtcccggaaaagtaccccgtcgactccgaggtgcttctttctttgcttaatcttctgcggcctac

SEQ ID NO: 43116 - DNA, 418 bp, Triticum aestivum
  unsure (1)..(418): unsure at all n locations
  Clone ID: PAT_TA_43116
cgtccggaaattgcaaggagatgttcggttgatgttcagatatgttcgccgggagatggtctagcaatcgcaagggagtccgatgttcctatgaaaatcagaaaaatggataaaggctccgtgggttcaagtgtggctgtagatgtaatctcacttacaagatgtgcaacatgcanatatcaattttcaagagattcaagcatgactgattttccggctggatcagaagttgaaaacgaagatgaatattatgaagggaatacaactnctggatggttgggtgtgaagctagcttaaacctncaaagtatagacgaatgctcagcagacactgacagcgaaactgataaaacatctgacagttgcgagtttcttggtgatttgaacccctcatctcttcagaagtactccctacttat

SEQ ID NO: 43117 - DNA, 201 bp, Triticum aestivum
  Clone ID: PAT_TA_43117
cgttcgatctctctgtgaccaacacgctatctgtttccgcctcggcgactgcgtcggcgctgcctcggcaggtagtgtgccttctgtgagaccgacatgctacgctcgctaatgctcatgcggtacaataggaagcgcaggtcctgtgctgcagcccccgccctcgtcgagaacatcggcgactctgaccgggagcggtcc

SEQ ID NO: 43118 - DNA, 399 bp, Triticum aestivum
  Clone ID: PAT_TA_43118
cgtccgcccacgcgtacgctctgatctatccgtaatattattcgagttatcaagattggatccatgacatggggaatatacgttgaattaaatctaagtctacacgtgatatctatatctctgtttatcccatttgttgagcagtgatatcattttttaatgctgcttgatgagcaaccccatcgaacacccctgttcactgaacatcgtattcatatgctaccatgtattaaattgtatatttgcgtgggttcatgcaagccttcttgttacctgaatgctgttcattctgcactactagtcttacgtacaatccaagcttcgacttagagtcatatgttggtggctatgccaacccctaccctgttgtacatataggcttagattgggattaaaatc

SEQ ID NO: 43119 - DNA, 354 bp, Triticum aestivum
  unsure (1)..(354): unsure at all n locations
  Clone ID: PAT_TA_43119
gtccgaattccnctttcgacgccacgcgttcgcccacgcgtccgcctaaccctatccgcctcccgcacgcttctcctccgacttgagcagcggagggacgctcgcaggcatggcgacggagaccgataccttcgccttccaggccgagatcaaccagatcctctcgctcatcatcaacaccttctactccaacaaggagatcttcctccgcgagctcatctccaactcctccgatgccttggacaagatcaggttcgagagcctcacggacaagagcaagctcnatgcacatcccgagctcttcatccacattatccccgacaaggcgaccagcacgctcacgatcgtcgacag

SEQ ID NO: 43120 - DNA, 330 bp, Triticum aestivum
  Clone ID: PAT_TA_43120
cgtccgctgacgcgtgggcggacgcgtgggtttttttttttttttttaaaggtgaaccaattataaaaggggttattaaagtgacgagcggtgtgacaacaaaatcaattctatccaagttgtcatgcataataatggaaccttcactactcgctttacaaagggcataatatttataaattaaagcctgtgttgcattcacttatcattctgtgctcacagcattttacactaatatctaccattctcaatgctttgatgcgattaccaatcactcacatatactctcgggttcactgttccaatcagctttcctcaaaccctgaatat

SEQ ID NO: 43121 - DNA, 418 bp, Triticum aestivum
  unsure (1)..(418): unsure at all n locations
  Clone ID: PAT_TA_43121
cttccaatcccaagcccacgcctctcgccccattcacagtggctagcagtcnccgcgcggctcatttatccctgacccggcggctcgctcggcctcttcggtagatagaatgcgagtgagctcggcttgcaacggaaagcacgcatgcgccaatcgaatcaatccccggcccgtcctcctccgcttatccgcgctgtgggccgtcaggttgaccacgctgaggtgacactgtgattttcagagatggcttgccccaacgtttcttggggatgccttcttctactgctctgttttgcttggacgggagatgcatgagtacattaagtacaaggattcaaatctgcctgtcaacaccagtatcaagggccttattggtagaatgactcttgctgaaaaaattggccttatgacccatatt

SEQ ID NO: 43122 - DNA, 311 bp, Triticum aestivum
  Clone ID: PAT_TA_43122
cgtccggccagagctgcgaagtggtgttcggagagctcgtctgatgtccagcaggcttgaagacatccaggctgcagatcaggtagccgctcccgtgttgccagctcccagggggaggggtgggaggcgtggtggtggagcatctggcataggcttcaagaaagcagttgccacgggaagaggaatgccagctccaaaggctataggaaagagggactgggctattgacttgactgaccagccttttgaggacattcctgatgctattagtttagatggctgttcattcaccgctcaccttgaccttgctt

SEQ ID NO: 43123 - DNA, 259 bp, Triticum aestivum
  Clone ID: PAT_TA_43123
cgtacgaatgatggtgtctggttggctcatctcctgtttgattactctttgccaatgggcgctggggctcatgtaaatggagggagtgctggtgaggtttgtgtgatgtggatagcattccatcatagtttagttttaagccactatggcaggatttcctggtggtaaagttatagctcatcttgatcataataccttcaaggtctgtctaaagatcgcctttacaagctattcgcatgagcaaaaaatcaggatagga

SEQ ID NO: 43124 - DNA, 443 bp, Triticum aestivum
  Clone ID: PAT_TA_43124
cgtccggaacagagaagcttagcttcgcgaggagattgatgtccatcgtcagcgtcgcgggggactcctcccctccctctgccccgcggcgccggagctgtggccggagagtatgggagaggagtttgatctggatatggcggctagggctttggaacgtgagcacggtgcggccggagtttaattgtgccccggccttgcatgagaggctgaatcctgactgatattgagtccccgccatcagccacataccgtcagaccttcgtgcaagagcagcgccaccgccccatggcggaggtcgccgcatttctagccaccacatttttgcaatgcttgtttacccccttcgattttcccatgtctcttctgctttagttcccatgtgttcttgtcagtctcttagccctaagtgatggaatgtggattgattttgttgcgcctgc

SEQ ID NO: 43125 - DNA, 249 bp, Triticum aestivum
  Clone ID: PAT_TA_43125
cgtccggaccttgcatactacacagatccaatcagcataaccatattgctcagcaagcggggagagctgcttcaagtgaggagcgggttcaacaccgtatcctagcacctcttcaagtttggacagtgacttgatagagagcactttaatgataccctgtacaggtttagatgacagaccaattgatatcattttcttctcaattgcttccctactcaagttccacagtttgtcaacaataatacaaac

SEQ ID NO: 43126 - DNA, 369 bp, Triticum aestivum
  Clone ID: PAT_TA_43126
cgtccggaaaatttcatcactataattaatgatgttcacggtacgaagaagggccatctggaagctcgtcggttatccctccaagtcaggaattctgaatatagtcaggtgctggcagacatggacctggcaaaagctcggtcatgtaacttctgggggccttgtgaattggtgcctcctctctcgaggtttcagcttttgcgagttctatatctatatattgatcatcgcgatcattattgttccaggggcaaccagcaacagtgtgatttgtctccgttacgcggtcttttccaactgagatatctgagcttgatgagcagccaccattttatgctagatgctggtgacttaccctcaacgctgtgg

SEQ ID NO: 43127 - DNA, 436 bp, Triticum aestivum
  Clone ID: PAT_TA_43127
cgtccgcggacgcgtgggatgggtttatatggcctcagctactgctgctatagtacttggagttctgtgatgtgtgtttcgtcactttgtcatttgacacacttttctttggcttaattttaagcaacctcatgtttactcttgttttatagtagatacaatgttattctcatttgtaggcactataagatttaagaattctggacatgtaattcatttttatatttgttggaattttcttatttctactatctattcatatgtgcaaatatctaatattcttgttaatatgctaggtaagattggatactgtgctacttggtgctggccatcacaattagctacggcatgatcgttgccatcaagaacgtccatggcaagagcttgaataacagcctcgatagtttatatgttctggtgatgtaaaatggattgg

SEQ ID NO: 43128 - DNA, 253 bp, Triticum aestivum
  Clone ID: PAT_TA_43128
ctgcagttccgttccccaatacccgggggggccctatcgttcgatcgttcccactctccataggaggaggagaatgtatgtgacacgtgtagcacatgtggggctgtggctcagagggtgtgggggcggtagcgatggccttagaggcgtacctggctggtcgacactgagagggtggcgcgaaagctggtggcggagctctgacgacactattacctgcaggggtgtgacaccggcaccggtggcagtatca

SEQ ID NO: 43129 - DNA, 427 bp, Triticum aestivum
  Clone ID: PAT_TA_43129
cgtccgctcatcacttctcctgctgcccagcgacccggtgagagacgccgaaacctagcgacgcgggcgactacccccggatgcgtccgccatggcgacccccaacccgtcgccgccccagtaggacgagccctcctcctccgccgatcccaaggcgaagaaggactactcgacggcgatccttgagaggaagaagtcccccaaccgcctctgggtcgtcgaggccaccaatgactacaacttctttgtagtcctccacccggacaccatggagaggcttcagctcttccgtggcgacaccgtcctcctcaagggtaaaaagaggaaggacaccatctgaatggttcttgctgaagacacatggtgagagccgaaggtccaaatgaacaaaacttgtatgaagaacttggagtggagcttggggatg

SEQ ID NO: 43130 - DNA, 309 bp, Triticum aestivum
  Clone ID: PAT_TA_43130
cgtccgcccactcgtccggtaagaactcagaaaacagccgagacaatttccaagagtgttggaggtgttatgactgaagctgaggcggcattcaaaaaggttactgcaaatgttaaagaaaaaatgtctgttgctacagaataggtgaaggaaagctttggactaggaaaggaagaaacttcaagctttagagatggttcacatggaacttcaaatcacggtaaaactgaggcgtcctcacattcaaatgacaagtcccaagatgccacaagtgcctatatgttgtttgataaattaaggtcaacattt

SEQ ID NO: 43131 - DNA, 327 bp, Triticum aestivum
  Clone ID: PAT_TA_43131
cgtccgcccacgcgtccggcttttcgccttttctgtttgtaaatcttctaccctggttgaattctctccgtatccaagcacactcctgtgacactcagttgccactgcgagcacgaattgtatcttgtatcctgtgtatgatctgtgctctaccttggagttgcacatttctgagcccttcgaggactcacagttctcacatgggggttttgtggcttgctctccctgtacataaaatctgatttaggagctctgcaaatctcactacaaggaaatggatcataattcacaacaacaacatgaagtgaagtctcacaaattcatcat

SEQ ID NO: 43132 - DNA, 246 bp, Triticum aestivum
  unsure (1)..(246): unsure at all n locations
  Clone ID: PAT_TA_43132
cgtccgacaaatcttcctctttatcactttctcgcgcaagctaattccttccatatcttaattggccatggtagaactcacgatcggatgccgccaagcccccaacgaaaccctaactcgcgcccctcctacgtgtagggacgccgccatgggcatcgngttcacgcatctcttatccttagtattccgaaaccgcgaggcccgcatcctctgtctctgcctcgacaatgccatcaagactactat

SEQ ID NO: 43133 - DNA, 314 bp, Triticum aestivum
  Clone ID: PAT_TA_43133
cgttcgcccactcgtccgcccacgcgtccgaaggcatttgttgagaggaagaagaggagctgtaagatggggaaatagtggaaggcattcggcaagaggaagaagaggaagaggaactggaagagggggaaatagtagaaggcattcgccaagagggagaggaggaggaggaactggaagatgggaaaatagtagaaggcacccggtctggttacaccatcctaagtactccagctggcgttgatacaccatatgttatcgaccttcggaagccgtggtggaaggatccctagaagcaggcagaagagccatca

SEQ ID NO: 43134 - DNA, 130 bp, Triticum aestivum
  Clone ID: PAT_TA_43134
cgtccgtccattcgtccgtccgccggcttaaaccctatacgactagacctaaggctcctccttaccgccgggcgacttttgccatggaggtctggatcacttatgataaacctaaccattccgtcaaggt

SEQ ID NO: 43135 - DNA, 141 bp, Triticum aestivum
  Clone ID: PAT_TA_43135
tcattcgtttactcttgtacggactcaaggtttcgagactctcagggacttcgatcacctgcgtgcacgcaccaacacgataggcgcagttgctcggataaggcaccaacttgcctatgcgacacacagtatttttcgatg

SEQ ID NO: 43136 - DNA, 282 bp, Triticum aestivum
  Clone ID: PAT_TA_43136
cgtccgctgtaactggcgcaagctgcatggagtcggccgcgcagcccgacgtctatggattcctggttggtggagcttccttgaaggctgagttcatcgacatcatcaacgccgtcaccgtgaagtctggctaagcaagatctcgacggggctcctttcggcgtggagtaagacagcggatatgaacagactcctttttttctcttctgtggttattatgtgtactatgctagtaattgtggggggggagcgcttgctactgggatgtcttccccctgactt

SEQ ID NO: 43137 - DNA, 254 bp, Triticum aestivum
  Clone ID: PAT_TA_43137
cgttcggagagatcatttctcgatttcgattccgggctcagagaatttcccaggcgagcgatatggcgacggccggtaaggtgatcatgtgcaaatccgctgtggcatggtaggctgtgaatccgctgttcattgaggaggtggaggtggtgcctccccatgccatggaggtgcgcgtttacttccatttcaacttccttgtgccacacctgacgttacttttgggtggccatggggcagaccgccatgtttcc

SEQ ID NO: 43138 - DNA, 329 bp, Triticum aestivum
  Clone ID: PAT_TA_43138
ccggcccggtattccctgttcgacgcacgcgttcgtacatcccaccttagttgtcgctgcgtcttatcttcaccactccacttgcatacaggactgagggggatcgtttggggtgggggacacctgtgagcaccacttcgagtccaaggccgactcctgcgccttcaagacctacccgtagcaggctggcgccattcgtaagggtggacacattgctatcaaggccctgccctgcaagggtggtgaggtctccacctgcaagactgggaagcatggtcacgcataggatcacttagtatgcattgacaatatttaatgggaaggaagct

SEQ ID NO: 43139 - DNA, 372 bp, Triticum aestivum
  unsure (1)..(372): unsure at all n locations
  Clone ID: PAT_TA_43139
tcctcccnnnccccgaccggacttccctgctcgaggcaagccacacgtccacgcctctcgaaagactgtttcctgttgctgatgctaccaccttctttactgatatgcatgatatccttcgngtatgggctgcgtggggatatccgaacagtctgtcatcaccgtttaaatcttctagagcaaaaatttaatcttcatttgatggacaatgccgatagagagctgcttgcccagaaagctgcaccacacagggacttctacaatgtcaggaaggttgatactcatgttcatcactctgcatgcatgaaccataagcttcttttgtggtttattaagtcaaacatgtaacaagatccatatgaggttcttatt

SEQ ID NO: 43140 - DNA, 122 bp, Triticum aestivum
  Clone ID: PAT_TA_43140
cgttcgtggacgcttgggctgacgcttggtccgacctaccgtccgctcccgcaagccatggacgccacggtcaccgtcgccaaggggaagatgggctctgtctggcgcatggccggctgtcc

SEQ ID NO: 43141 - DNA, 145 bp, Triticum aestivum
  Clone ID: PAT_TA_43141
cgttcacacagcataatttgtacttgctgctatcagctctcacaatgtacattatgataataggtgttcggcttatccttaatgagctctaggggcaccttttatcttaatattttcatcattcatcttacattgtatgtaactt

SEQ ID NO: 43142 - DNA, 242 bp, Triticum aestivum
  unsure (1)..(242): unsure at all n locations
  Clone ID: PAT_TA_43142
cccgcagtaccgtccggattcccggtcgaccaccatccttcaacacccagacanacctcctcttcttacacgggagccctacaagcgggggaaagataccagagatggggggtggcaactgcaaccccaaggacttttgcgccgtcgtctactggaactcccgctactcctattcctccactggcggcaagggcggctgaggccgccgcttctactactggtaccattcgtactcggcgctc

SEQ ID NO: 43143 - DNA, 361 bp, Triticum aestivum
  Clone ID: PAT_TA_43143
cgttcgattccccaacagacgaccatgaagcttcggctgcgttccatggacgcgcgcggcggcggggctgagacgcaccgcgtgcagctgccggacacggccgtgctcgccgatgtgaagtccttcctcgccgccaagctctccgccgcgcagcccgtccccgccgagtccgtccgcctctccctcaaccgctcgcaggagctctgttcaccggacccctcagccaccctcgccgccctcggcctcgcatccggtgacctcctctatttcacgctctccgcagaattattatcgcagccaccggctccttaaacactttcccggaaccctaacccggatacaggctttatcgggcaaaatt

SEQ ID NO: 43144 - DNA, 425 bp, Triticum aestivum
  Clone ID: PAT_TA_43144
cgtccgctttgcgtttgcctgcattgaagcatgctatcctcattggtgatgagtgtcaactaccagcaacagttgttagtaaggttggcaaggatgcattatttgggagaagtctctttgcgaggttgagttcactggggcatgaaaagtatctgcttaacatgcaatacataatgcatccatccattagcatttttccaaacagcagcttctatggcgggcaactcttggatgcttctagtgtcatgcaaaaagaacaccaaatgatgtatctttcaggtactatgtttggtacttactctttcttaatattgaagattgttgtgaggatgtcgatgaacttgatcatatcaggaagaacgtggtttgaagtttaccattattcaggaaatcttgcataatcttcgaagagcttgttctaagac

SEQ ID NO: 43145 - DNA, 312 bp, Triticum aestivum
  Clone ID: PAT_TA_43145
cctcttccgcctaccctccgctcccgtataaaaaccctagcgcaaaacccctgattgggggaccattcccaccacccggccgccttctccgcgcgatcccgctcaaaccaaaatcaaccccgttcaaccaaaaggcgaccgtgccgagctccgacccaaccctaggcccaggcgaggtcgtcgtcggcggctgcggtcgttcgggttgcaatggcggcggctggtgcggtggacggggaccagtggtggctcttgaagtgcctgaccgcgaccctcgacaccgcccgcgaggtccgctccttcgccgaggag

SEQ ID NO: 43146 - DNA, 338 bp, Triticum aestivum
  unsure (1)..(338): unsure at all n locations
  Clone ID: PAT_TA_43146
tcttacgatttttgaatattatgaattanagatttttacttgctttctcattccattcacgaggagcttgatgagaagaaactgtcgtgtccagttattcattttagatggaactaagaaagagaaccatctattataaccccaatagaaccttatttctcatatcaacatataggtagtatgaatgtgttattctgccctggcaatcgtattcgttttggtagatatgctcttcaagcactagaacccgcttggatcactgcnacacatatattatcccgactaatagcaataacactatttgcactttctggtggaaaaatttgggtacatatatt

SEQ ID NO: 43147 - DNA, 363 bp, Triticum aestivum
  Clone ID: PAT_TA_43147
attcccgggccacacccacccgtatcgttccgtgcctctctcgtcgtccgccaccgttcgttctcccttctcccgcgcccgacttagcggcggcgtcgtatcactccctcgcgcgctggtctccgcggagcccacaacatccgcgccggcgccttcgtgctccttgttctccccaactccctcgccttccccgtcgcctttcttgtcgttctcgccgccggcggcgtctccaccaccatgaaccccttcagctcccgcgccgagaacgtcgaccgcctgcgggacaccgtcccgtccctcgtgctcgcgtcgcccgacatcgccggcaagctcccgcccttcgtccgcccggtcgtcctcgtg

SEQ ID NO: 43148 - DNA, 374 bp, Triticum aestivum
  Clone ID: PAT_TA_43148
ctccggttcctgtccccaattcccgagtcacctacgcgttctgtatattatccccatcagtcaccaccaactctcttctactagcaccccgcctacggtttggaccagggaaagcagcgccggcggcggtaacggcggaaatctggtgccgggtcatcaccgtcgggtgggtgggtaataccgtcttggtggccctcgcgctccggactgacgagactccattttgaaataccgggggatctcagtaaccctctcttccatggagacctgtgcaccgccgtcgccttcgccggctagctcggccggacaggtcgctaagccgtggatgttcatacaggagatggttctccgcaactttaagtcctacgccgggg

SEQ ID NO: 43149 - DNA, 243 bp, Triticum aestivum
  Clone ID: PAT_TA_43149
tcgtacgcctcgctcttcccaccgcatgaaagagctcctatcccctccccacccccaccgccttcggcgacgaaccgatcgaatccgggaccccgatctcggtttcgctcggcagatcagcgagcaccagcccccaatctcccggatcgcactttgttctccccacctcgcgctttagtcatggcaggaatggcaccagagggttcgcattttgttgctagcagtatgacagccagatgaccg

SEQ ID NO: 43150 - DNA, 213 bp, Triticum aestivum
  Clone ID: PAT_TA_43150
cgttcgatagggggctggtgctaggacaacaactctcctgcaggcatacaggaagccagcgatggggaatttggggtaccagtgacagaccatcatcttaataagctgcaccttggtctggtccacgggggaggtgttaaccggctcgaccctccaaccggggaattgtccgatatctaagcgttttgtgctcaacatggtaccagcccatga

SEQ ID NO: 43151 - DNA, 179 bp, Triticum aestivum
  Clone ID: PAT_TA_43151
cgtccggacgcccacctctgcctacattcattcccattcccctctgccacgcccgcctgacgtgcggcactccactgcaaccggcaccacaatgcatcccctcctcgggctcgccctcctcgccctgctgctcctggcctctccggcgccggcgctctggcggcaccgcgcgcccagcg

SEQ ID NO: 43152 - DNA, 261 bp, Triticum aestivum
  Clone ID: PAT_TA_43152
ggggcgcacgcgtccgcccacgcgtccggcaccagtcagtccaactccaacgcgccgcacccgagtgagatccgaaacccctcttccagtggcggcgccagtgccggggccggaggtgttcgacgtcgtcatcttcggggcctcgggcttcaccggcaagtacgtcatccgcgaggcgctcaagttcctgccccccaacgcctacccggtgcgttccttcgcgctcgcggcccatagtcgggaccgcttatactccttgct

SEQ ID NO: 43153 - DNA, 202 bp, Triticum aestivum
  unsure (1)..(202): unsure at all n locations
  Clone ID: PAT_TA_43153
cgtccgagaaactcatcccgaccgacaccttcttccccacccgcagcaccgccgccgcgacctccggtgtggctctcaggcgccggcgcgccttcccctctccaccacgcgccggcacgctctcccactctcccccagtgcgccgncgcgccctcccctgtcccttagtgcgccggcgcgcccttccctttccccagcgcgc

SEQ ID NO: 43154 - DNA, 162 bp, Triticum aestivum
  unsure (1)..(162): unsure at all n locations
  Clone ID: PAT_TA_43154
cgtccggcacaaacaaaagaataatggagttagccatggccgccgcctacacctcgcgcctgggcctgccccccgccgcgcacccgtacgacgacncatccctggcctgcgccctcggccagctctactccaccaaggatccgttcgccctgccggtcagct

SEQ ID NO: 43155 - DNA, 392 bp, Triticum aestivum
  Clone ID: PAT_TA_43155
cgtccgcccacgcgtccgtggactcatgggcagacgcttcccctaaactctaaaacacctacctaggcagacgactaaccatgcgtggatccaaatcatccatattctaacccttcacaattatttaacccaacccctgttcttcccaccttgggtgataagaattcactcacagatctcaacgaccactatattatccttagtgcaaaaaaactattttctactaaatttttttttccctaacacaaatcactccacaattttcttctctttccatgagtaattctccacccaaaatccttttaattttttctaagttaactctagattcctaacaaatctttaaatctttaattccaattcttttatttcattttaacaatattaatttt

SEQ ID NO: 43156 - DNA, 393 bp, Triticum aestivum
  unsure (1)..(393): unsure at all n locations
  Clone ID: PAT_TA_43156
gcctgcngtaccgntccttaattccggtgggaggggcgcccttcttttttttttttttttttttctttttgtttttttttgacagcgtcctaaatttttcgtgggccctccaatggggtgcggggggattttctggcaaaaccatgacgagttggaacatatagtagtactaacacaaaacacactggttgtctaaattgggcactggctacatattgcacccaaacattttatttttctgagccgacagactccatttacatttttcagagaccatatggctttgggaatggctcatgcagaccccatgaaacgacccatccaattggggaagccgtaccattccatgttaatggcccccttatttttattaattaaacccatgccctttct

SEQ ID NO: 43157 - DNA, 305 bp, Triticum aestivum
  Clone ID: PAT_TA_43157
cgtccggcctccctcctacctcgctcgcgccttcgccccgcgcccagctcctcccgcctcggcgccgccttcactcccctcccgcgcgcctcctctcccctcacctcccctcccgcgcgcctactctcctcccacccacatcgccgctgccgcctcgaacggcgcctccgcggccagatccccgaacaaacgccccccaacacacagcacaaagaggagacaggacatacgccgcgcgcggaacacatacagcaaggctacaccccacctccccttgcatcaaaggaaggaggatcaaaggagag

SEQ ID NO: 43158 - DNA, 189 bp, Triticum aestivum
  Clone ID: PAT_TA_43158
gcgacgcgtccgcggacgcgtggggtcttcccaaagtttttcctggggaaacagctacaacgaaagatatcgtgaagcttcatggtaaagagaaacttcctgtaaattacctgccacagaggaaaagaaaagttgaaaaggagaagaaagcaaagcccacagaagcttcagatgctgaatattattttg

SEQ ID NO: 43159 - DNA, 286 bp, Triticum aestivum
  unsure (1)..(286): unsure at all n locations
  Clone ID: PAT_TA_43159
cgtccgcggacgcgtgggcggacgcgtgggcggacgcgtgggggaggagcagcagatggcngaggtggtcatggcncantgcggcggcggtggncangggtggcaggagacggaggcgcangggtttgcgtgggacgcggcagcggcggcagctgaccagggcggcttacgcgcggcgtcgctaacctattcacgccaggggaagcgtccgcagcattctggcgagtcagagacgccggccgctcggtgcataccggcaaagcacagcggctcgagggccagacat

SEQ ID NO: 43160 - DNA, 337 bp, Triticum aestivum
  unsure (1)..(337): unsure at all n locations
  Clone ID: PAT_TA_43160
ggggcgcacgcgtccggagagggcgcaagcggttctcttattgcttgtaggaagggagctctntcccaatgtgggcgcatctccttcgtctggagcatcatacagtatgaggctgaattcacatcggatggcatctctgatgacgatccgcgaaaagcgcaaggaaaggaactatcgatacagaagatccgctattctgctaggaaggaagttccacacactatgcatcgccctaaaggtgagcctacatcatcaaaagcaaatgccgaatacacctcagctgctgctaatacacacagatgtgcagtggaaggaccacctctttctcctcctgtat

SEQ ID NO: 43161 - DNA, 266 bp, Triticum aestivum
  unsure (1)..(266): unsure at all n locations
  Clone ID: PAT_TA_43161
gggcgcaggcgtccgcggacgcgtgggcacacgactcctctccctctctctcccccaccgcacggacggatacaggcgggcatgcnagcagctctgcggcgactcggcgaggatggaaatgctcttcagcagcctgttctgtgactcagcatcatcggagaacttttctggccatccgggtggtgaaaaatggccattcctggaggaccataatggggctaccaccctttcaatttcttttggtttggccggaacctgccaagggg

SEQ ID NO: 43162 - DNA, 283 bp, Triticum aestivum
  Clone ID: PAT_TA_43162
gggcgcacgcgtccgggcgccgccgctgcgcacagaacacatcctcgccagcgtagcttctccggcgtccggggagcgcgctcactaggctgcgggccttcctccacatctcctcgcctccaccccatccagttcgtgccattcgctgctccaagacaagggcatggcgctcggcggctgcggcaacgaagctgatggtgcacgagccaaccatggaggcagtagcacggggcaacgacaacaacatggagggccgcctcttggttgggaagggaatggaact

SEQ ID NO: 43163 - DNA, 279 bp, Triticum aestivum
  Clone ID: PAT_TA_43163
ctgcacctaccttcccggaatgaccgacgcgtccgaggacgcgtgggctttgggcttgggagctcactgcgcgctgccgcagcttcacccacaccctggggctccagtacgatcaatcaaccaaagaaaagaatcacaccttcgggtccgtcggcgacgcaagcggcggcggcggccatccatggacacgggcgagatcttcaacccaagctgcggcgggccgggcggcgccggctgcgactgcgaggaccgcgaagagtgggggcggctactgctact

SEQ ID NO: 43164 - DNA, 240 bp, Triticum aestivum
  unsure (1)..(240): unsure at all n locations
  Clone ID: PAT_TA_43164
cgtccggccgccgcgtgcgccgccggcggaggcggccactccgcccgtcccgctcgccgctgccgatggccgcacgacctgagaccgcgggcacccggcaaaaacggcggcgatgaggaggcccggcccttggcgcanacccgcgctcccgagcggcggcagcgtcggatccctccgcgccgcggggccagccctcccgtccgcgccgcgccgtgactccaccggattggatgcccgtgc

SEQ ID NO: 43165 - DNA, 288 bp, Triticum aestivum
  Clone ID: PAT_TA_43165
cgtccggcgacacatacggcctcaggaatcttctcatctttcaccatgggactttacttcacatactacattttcgggggacaaatagcgctggtttgatctgcagaacatactgttctccacatattggacgcctcaaatgagctgggactcgttcactacaagagggacaccgatcgattatgagcttgctcctgtgaacttagacgacatgggcagcctcacttgcaccacatcgcactgactatgaaacattgaacatgctacgctcacttggcttggttcgcc

SEQ ID NO: 43166 - DNA, 447 bp, Triticum aestivum
  unsure (1)..(447): unsure at all n locations
  Clone ID: PAT_TA_43166
cctccgtggactcttgggtcgggccacgtggcgttccggtggcccggcgaccacgtgaaaaccgtcgtgccgaggctcgggaaggctgaggacgcncatgcgtccgacctcgccgtcgatgtgtccgccggctccgtgcactgccacgcctacgccgccaccgacgcgtgcaaggtgaagaaggtggattcgatcaggcaggcgctgcggatgcgcgggttccggtgcaacctcgtctacacgcgcgcctgcacgcgcctcaacgtcatccctctctccgcttcccgcccacgcgccttgaggtgaagaagacgaggattcggatcaatcaaactctcatctcatatggttcggtgtctgaacatttcagatcaatcaaatttctggatggatgtgcaagtacctgtcgatacaagggggcatcgatctcgccaggtggcggggctt

SEQ ID NO: 43167 - DNA, 393 bp, Triticum aestivum
  Clone ID: PAT_TA_43167
cgtccgaccatgcctgctctgacattatccctgagatttcacagggaacgcttatccctagggtctcggggggggaggtacaagacaactaatttacctattactagtcttggttcaagcacaggctctcatctgttggctggctcatacaacgggaatcatgatatgatctcaaacaacacactgcaaaacattgctggagttcaaacgggatcaacttggctcgacacagatgctacgggtagtgttcttgaattatgatacatgtttttcttcttgaacctgtggcagcacggatgcctagttgcctcattggttgaattttcttatgacagctaacatgtttttggagaaggatgaaattcaatatttttgcaagtctaagacatgcac

SEQ ID NO: 43168 - DNA, 448 bp, Triticum aestivum
  unsure (1)..(448): unsure at all n locations
  Clone ID: PAT_TA_43168
cgtccgcggacgcgtgggcttggccttgtcatcaaacacttcctttgtgcacaagaaaaataggctcggtggattgctccttctcaactcctgcccatantcccataaagtggtggattgatcatcatcttctcccctgatttctttaatggctgctcttcttgcccttcccaacttactcctgtgagcaactaagttaaattcttggtccaccttctctgaaaatttcagtaagggcattttctcattgcctctgaactcttttctgaactgtgtagtaagaaagggagcagtaagcactttcagatcccaagctttggtgcaagtatgtttgtcagtatacttcttgatctgaatgctgctggatctggtgtccttgcctgccttcaagtaccaagtacaatcatgcttgcatactgcctctaatgacctggtagtattcctgagc

SEQ ID NO: 43169 - DNA, 338 bp, Triticum aestivum
  unsure (1)..(338): unsure at all n locations
  Clone ID: PAT_TA_43169
cgtccgtgagatgccaccaagtcccgaatatgaatatgaagcacttgatgagcaagaatatcccaatggggatgatcttgttgatattgaagatattatgtcaggagtacactacgacgttgaaataaatctgtgttcaaacaagcctacggtgagcaattgctcttggacaccaaatcgtggaaaagatttggcattgagcaattcacaacatacaagcaggaaaatgaaacacatagggcgtcttaagacagagcaccttgcgtatgtgctcccagacggtcatccattgttggaagagtttgaagagcgagttccagaagatccatctncttatc

SEQ ID NO: 43170 - DNA, 324 bp, Triticum aestivum
  Clone ID: PAT_TA_43170
cgtccggctacttctaccctacctaaccaaacactaccacctgcgcttctcccttctacactctcggcggtgtccacgatattctgcttccgctcatctataatccccccacctattcactctccccccctatgcaggaaccgtcctattacacgccccgccttgaccaagctgcatacatacactctttcaaatgcaattacaacactcattaatcactgaccccagaagaaccccacaaccactgcacccttttatctacaaactcctctataaacctattaaacacaatattacatccgcttcaccccttctactaacatt

SEQ ID NO: 43171 - DNA, 353 bp, Triticum aestivum
  Clone ID: PAT_TA_43171
acgcggcgagccggcgccagcagctgcgcaaaggctcctcaaaccctaaccctagtcctagcttagcttccttcttctcgggctagctggagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgtctcatcggcgatgccgccaagaaccaggtcgccatgaaccccatcaacaccgtcttcgatgcgaagcgtcttatcggcaaaagggttgctgatgcccctg

SEQ ID NO: 43172 - DNA, 480 bp, Triticum aestivum
  unsure (1)..(480): unsure at all n locations
  Clone ID: PAT_TA_43172
tgtaccctcagaccgtccaaatggcgggtcgcggacgcgtccgcccacgcgtccgcccacgcgtccgggatctacttcgccggcgccgtcaccacctgggacgcgggcttctacggcaagggcgacgacnacntgcacgtcaacctagggatgctgacgaacaggctcgccaggtaccggacgacgccgagggtgtacgtggggtgcatgaagtccggcccggtgctgtcgcagaagggcgtcaagtaccacgagccggagtcgtggaagttcggggacgaggggaacaagtacttccgccacgccacggggcagatctacgccatctccagggacctcgcctcctacatctctatcaaccagccgatactgcaccggttcgcgaacgaggacgtgtcgctgggcgcgtggctcatcgggctcgaggtggagcacgtcgacgaccggagtctctgctgcgccacgccgccagactgcgag

SEQ ID NO: 43173 - DNA, 294 bp, Triticum aestivum
  Clone ID: PAT_TA_43173
ggtacccctgcggtaccgcgccgcattcccggtcgcgcggcgcgtgcggatctccaaaccctgacccccccgcatgccatcgcactagcccgcccctcccccccatggcgcggcgtgtgcttctcctcgccctcgtcgcggcggccgtggccgtgccgccggcgagcgccgcggtggcgagcatcgacctgggctccgagtggctcaaggtcgcggccgtgcacctcgccccgggccgcgcgccgatcgccggcgccatcaacgagatgtccaagcgcaagtgccccgcgctcg

SEQ ID NO: 43174 - DNA, 450 bp, Triticum aestivum
  Clone ID: PAT_TA_43174
gcgcgcgtccgcgaagcaactgctgagataactgatgcaaacccatgtgtatctcttactgtccggcttcttgcacttcagtcaaagacatcagtgcatattgaagagatctacatatttgctgatcttgttgaatccagcagtgatgattcagtagcaggtcctggaaacatgggaggtagttctttgttggctatgcttgttcctggccttatgcaaatttccaaatctagggactgcaaaatagatgacaaatattttgctgagggcttgaaagcccaacttcctgaaggctgcgcgttgaaagatagcatcccatgtggaaacatagcgaaagaagcagggctctatggtacaaatgattccaaatttaggccagctggagtgcagagcagactaccacctgcgcagagtggtacgatatgtgatgatgatggcaaccaacatgag

SEQ ID NO: 43175 - DNA, 448 bp, Triticum aestivum
  Clone ID: PAT_TA_43175
ggggggcgcgtccgcccacgcgtccgcggacgcgtggggtgcaactgtcacatttggcgcaacaaaagatggtcttgcttgtcatttcaacaaggttggggctgtgctaaaaactcttattggatctgatggtgccactggtcagccaacaggctcagcgtacatcgaattcttggaaaaagaatcagcagagaaggcactaacgctgaatggaacatcttttatgtcacgcattttgaaggttgttcgaaaaagctctgttgaagtgcctcaacagcctggctggtcacgtggtgttcgtgcatcaccatttgcttccaggctcattagaaccgcatacccaagggcgacattccctggggctatgcgtggacgtttagctatcagaggtgatgctcggagttttcaatggaagcgtggcgctgctgattccgtagatgccggaaaa

SEQ ID NO: 43176 - DNA, 400 bp, Triticum aestivum
  Clone ID: PAT_TA_43176
cgtccgcggacgcgtgggctttcgtgtcgtcgtctgctaatctgagggcgcacgccggcggggacctgcttgtgaccgtggccgatttcctcacctcttgctcggccgaccagatacgcatggcgcccgacaaatttttgaatgtctgtagggtgctcaagaacgaggtcatgcagctcaatgcgccgatccgagggattgctccgcttcgggctgctgtccgcaagatccagacatcgtcagagcagcttaccccactccacgctgaatacctgatgctgtgcctgctggccaagcagtacaaggctggcctgagcgtgctggaagacgatatatttgaaggtgatcagcccaaagacttggtcctttactggtactacggggcgatgatatacattgg

SEQ ID NO: 43177 - DNA, 438 bp, Triticum aestivum
  unsure (1)..(438): unsure at all n locations
  Clone ID: PAT_TA_43177
gaagcgggggatcaggcttctctcgcagatcaatgagagagagctgttacggaatgctaagggtctggtctctcgcatgtggtattactgaggtgggactgatgaaggtgatattatgcatactgatattggggtgcttgacaaagagggcacccacatgcatggccggattcctactgacctgtccgcacgggtgaacgatatcttaaaggagggcaatggttatctaatgaagagattcgcgtgcaaacaatccaagcccacttacagggctggtgacaggccatatatgatgcagttcactcgctttagtactattgatcctgtggtgggtgatgaagaggatttcccatactggacttacaggctcacatnctttttggatatcccgatgccaggcccgcacactcctcggtttatcgatgtgattgggcgaat

SEQ ID NO: 43178 - DNA, 426 bp, Triticum aestivum
  Clone ID: PAT_TA_43178
cgtccgtccccacgcccgaggcttcctcccgcgccgaaaccctagcgaccggagcgctcgggggcgggggccatggcggacgacgattacaatgaagttgacatggggtatgaggatgagcctccaaaagctgatattgaggtgcaaatctgacactattacatatactgctggtattctttagaggaagagcttgtagctacatataagtattactggcgcattactgaaaaataggaaggggttgaagaagatcctgaaaacaatgaggatgccccttaatatgtgatagggtgtgggggtaaaaaaagaacaacgggaagacgactgcctcctcccaacaatacaacaatattatatcaccaattatgagcggccactcattcttacaacacgtgctttgataatcatcattaatgcaccaat

SEQ ID NO: 43179 - DNA, 364 bp, Triticum aestivum
  Clone ID: PAT_TA_43179
tttgatggtggtagcaagccagtctttgacaaagggctggtatacaccaacgtgttcgacgcgcaactgggacacccttgtttggtcgctaaggaaggccggcgtgcccgacatgaagatcatagtcggcgagatcggctggccaacagacggcgacaaacgcgccaacgtcaagtatgcacagaagttctacgatggttttctgaagaagatggccaaaaatgtcgggacacctctgagggcctggtcacatggacgcctacctgttcgcgctgattgacgagaaccagaagagcgtgctgcccgggcgcttcgagcgccactggggactcttcacctacgacgggaagccaaaattccccat

SEQ ID NO: 43180 - DNA, 418 bp, Triticum aestivum
  Clone ID: PAT_TA_43180
gggcggggagatgcaccacgagtccctcctggaggcgcttcctggtgacaatgtcggcttcaacgtgaagaacgttgggtggaaggatctgaagcgtgggtttgttgcatccaactctaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtattgtgaagatgattcccaccaagcccatggttgtggagaccttcgccacctaaccaccttttgggccggttcgctgtgcgtgacat

SEQ ID NO: 43181 - DNA, 288 bp, Triticum aestivum
  Clone ID: PAT_TA_43181
cgtccgcctcctcccaccctgcctcgtcgcggtaagccacctccgcctctcccttctcctctcttggtgcttcggggtgactcggctggtccttccgtctgacccgccattcttcttcctctccgtcgctgcgcaggaacagtgctcccaccgccggcgccatgagtaagctgcagagcgacgccctgagggaggcaatcacaaacattatcaatgactgccgtgagaagaatcgcaagttcgttgaaaccattgagctgcagattggtctgaagaactatgacccac

SEQ ID NO: 43182 - DNA, 412 bp, Triticum aestivum
  unsure (1)..(412): unsure at all n locations
  Clone ID: PAT_TA_43182
cgtccgggaagatcttcaacttttagctgccgtccaaacttttggttgtaactggcaacttgtatcaggtaatctggttggtcgcattggcaaccantgctctaacaggtacaggaaaactctaatccctgaaaggaaaagggtggggagatggtctgaggacgaggacaagcgcctcatggtatctgtcaagctttttaggtctggcagctggaataagattgctcagtttgttcctggccgcacacaaagtcaatgcagcgagaggtggcgtaatgttcttgatccggatatagagcatgggngaatggcgccctgaagaggattcgaagttattggcttccgtccatgaggttggtccctgctggtccaagattgctggggctatgattcctcaccgtactgataatat

SEQ ID NO: 43183 - DNA, 415 bp, Triticum aestivum
  unsure (1)..(415): unsure at all n locations
  Clone ID: PAT_TA_43183
gcgcgtccgcccacgcgtccgcggacgcgtgggcggcgccgtctcgagctttcgcaccgcctaattcccaaggccggcgcggccgtgttaccccttcccctacncccacggtcgcgcctccaggcctcgtcctaaagcgcgccacgccgaattcttctccccctcccacccccctctgcccgattggcctggcgtggagatccacccccgcggattttctcttcttggtaacgaagacctgacttgctttgtatattcaattttttttctaacgttttcttttgatgcgagcagccgaatcttaacacggggttatgaaattgatgtggtgaattataggactattggggaactgctctagaaagtctctggtgatggtggtcccgttatgtttcatgtgctggtgattaccggt

SEQ ID NO: 43184 - DNA, 365 bp, Triticum aestivum
  unsure (1)..(365): unsure at all n locations
  Clone ID: PAT_TA_43184
atcagccgcaccttctccacctttcacaccctctaattcccaaacccntcggccaactcataaccacagctggtatcccttattcctcatccctcagacatagatcaactccaagactcgcaacattcttttccttcctcccacccgactagtatctacattgttcccttccttagtagaaccaccaccacatatttatctcttctatcataacaaaacaccttacttactttgaatattcaattttctttctaacttcttcttttcatccactcaatcaaatcttaacactagattatcaaatctatgttgttaattatatcactattgtcatacttctctaaaaattctctccttataatatt

SEQ ID NO: 43185 - DNA, 434 bp, Triticum aestivum
  Clone ID: PAT_TA_43185
gcacgcgtccgagcattgcaacatcttcagtttctcactcaacagcagcaacagcagcaacaactgctgcttggggcacagcgaaaatattacatcttcatctggagagatggatgcccgaaggcttcgggtgcttttgagcagtcgaaaggatggtcagtcaaacgcattcacagatattattcctagtgtggggccttcactgcagaacatgtattcacatgtgcagccaatggagacagatatgctgatgaagaagatagctgctttacaacagcaacggcaaagcagcaatcagcaacagctccttcaacaatcattactgagtcagctaccacaaagctcaaatcacttctcaggccatcatgaaaaaatggtgcctgggagtgtttctatggatggaagcttgtgctattcctttcgtggaaatgaac

SEQ ID NO: 43186 - DNA, 408 bp, Triticum aestivum
  unsure (1)..(408): unsure at all n locations
  Clone ID: PAT_TA_43186
gcgacgcgtccgcccacgcgtccgcgtttgctgataacgaaacagcgaagctcgtcaggcgacgatgcgctggggaaaaaagttcggtccgtgcgacaacaagtgtccatatgtgccagtacaaactgttctttgagcggttaatgaagttggacttggatatacttcttgataaaaaagaagttcaacgtacttttctctactcaaacaaaattaagattgggcgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggggggcgttttaaaggatccaagtttacttacccgtgcttgcaacgtaataatttttttttaggggcacctaaattaaat

SEQ ID NO: 43187 - DNA, 329 bp, Triticum aestivum
  Clone ID: PAT_TA_43187
cgtccggccgtacccgcacctttaactagtgggtttcttttatgatatacacatgcccttatttttaactgtctggtctcatattttgatgtgtaacactcaacatgatctaaacacgcaggaattgtcaattcagcaagggaggaagaagggcttagtggcatcccagcatttcaaagtgtgggccgtacgacgaaagatggggctcttggtactgctggtgcaccaattcacatggttgcatcagagactggccaattcaaggagcagctttggcgtaccttccgaagcattgcactcactttcctagtaatctccggcatcggggc

SEQ ID NO: 43188 - DNA, 482 bp, Triticum aestivum
  Clone ID: PAT_TA_43188
aaaaattgggtcgaccgcacgcgtacggttcctgtaaattcagtgaatcatgcatgggtggccctcttccggtggcagtccggaagggtgtacaaaaaaaaaaaaaaaaaaaaaaaaaaaaaaaaaaaaaaaaaaaaaaaaaaaaaaggaaaaaaaaaaaaaaaaaaaaaaaaataaaaaaaaaaaaaaaaaaaaaaaaaaaaaaaaaggggggccgtttaaaaaaatcaaattttacacccccgtttatcaaaatgaaaaatttttaaaaaggggaacaaaaataaaaaaaatggccgggggttaaaaaaccgttggaattggaaaaaccttgggtaaaccaaattaaaaggctttgaaaaaaaaaacctttttaccacttggcgaaaaaagaaaaaggccctaaacaatcgcctttaaaaaaatttgccaaacctaaatggaaaatggaaccccccctttagcgggcaataaaacggggg

SEQ ID NO: 43189 - DNA, 388 bp, Triticum aestivum
  Clone ID: PAT_TA_43189
cgtccggcaagggctgcctagacggaaggtccgggtagctggggcatcatcgtacggtagagcgaaagagagcgtgggccatgaataacgagaagagtcgttgaccatctcatcctacgcatggccggcgtgcatgatcaataggcaatcacctcggcatatgatctaataagcagagcctcctttccctcattgcagaaaatgaacgctgctagatcagtacctaacaacagcgtgcgctcgtcaaatgttgctagtttctaccttaccagctgtgtttggcccgaggtgctgctagtattcctgatactagtggcatcctcctagcagtgcgccggccaaacactgctagtaggcacttacacatgttcctaattaagggggtcat

SEQ ID NO: 43190 - DNA, 368 bp, Triticum aestivum
  Clone ID: PAT_TA_43190
gggggggttggtgtacgcagaacaagtatcactcactatgcattccaaaagtacattacacagataacaacaacaacaacaacaacaacaacaacaacaacaacagtatcactccatttgaaggtaaactgtcaagaagaagagaattaacccaatctagttatccaccgaagaccgatcgatcgatttttacaaaagaattgggacctcacaggccgagttccaagccatatatctacaaccccaacattccattttcagcctttctgatgatcatcagccagagccctttcgcgttcggtgatgcttcaaatggcacattccacgcgctcattcaaatgaaaaaaagagaaaacccccgttttact

SEQ ID NO: 43191 - DNA, 421 bp, Triticum aestivum
  Clone ID: PAT_TA_43191
cgtccggccagagcagcgactccgccggtggagtctggcacattgcctccgtcgacgttctggacattgtgcaaggggtgctcccatattcaccagtatgatcgcctctacgaggcgcgcaaactgaagtgctccagctgccaccagccatttgtagccgaggcaatggccgagccgccgcccattgtgccgggcactgacatgtattactgtacctggggcttcttccccattgggttccccgggtgccctggctacgcggatctggtcaattcccagccacaggggtcaggccagctgaatgtgccatggcttggagccaatggtagggttgctgctgagaatgggactcccattaccataggtgctgcaagggaggggccagtggcatctgaaccttcgccggaacctttgatgcgca

SEQ ID NO: 43192 - DNA, 407 bp, Triticum aestivum
  Clone ID: PAT_TA_43192
cgtccgggatcacatgcaagtggttaatttcaacgttgtatcactccacgcagttgcacatgaggtgagctatggacttgattagctcaacgagactctcaagaatcacacatggcgtgacagtcgagcatgttgtgtcatctgatgctgctaggagagaacgaaggataaaaatgctcatttggagagatcattggcagctgctaccaacaaggttgcaggttagatacagaataaggccacactggaagaactttgccaacagcttagctccacgatttaatgtctacctgtctgagcgagccatgtgcattgcgcggtttgagggacattctcatacgatggagaaccgataagataagaacgggactctggaaaattgatcatctggaaactctactgagctt

SEQ ID NO: 43193 - DNA, 417 bp, Triticum aestivum
  Clone ID: PAT_TA_43193
cgtccgcaacgctgttggtcactgaggcaccaactcgccggtggatcgccgaccatctgagccgggggcctacccgccctgccgcgccaccggacatgaaggccaacctcggggtcgtcgcctcggatccaagtccctccgccctagatcgggaggagcagcgccagccctgccaccgccgtcgataggacgccggccaaccgccacaccggcgtagtttagatctgggttgtcatgaaccagatcggcgccgccgcagcccagatcggagtcacactctcgagccagggagccccgcgtcaccctttgacccgtgagaaggaggagtgcctccgacgctgccggcgcacgcacaggctaagcccggcgcctaccaccggcggtgacagaggggagggagagaaaggagcggtgacc

SEQ ID NO: 43194 - DNA, 420 bp, Triticum aestivum
  Clone ID: PAT_TA_43194
cgtccgccgaggcggtggtggcaccgtggcggactccatgtgaggtgggggacggcggtgcgaggtggaggccggagacggtgcgatgccgtgggcgaccggttgcggtgcgatgccgcaagatggagatggcggtgtgaagctgccacaagaagacgacggtgtgacgccgttgggaggtacggcggcgcgaagccgtcatgaggatcggcgtcgcgaggacgtcatccacgacaagatggtccatggtaaccagcgctgcgacggcgtcggtggcggcgagtggccggttgcggtgcgatgccgcaagaagatgatgatggtgactggcgctgcgacggcgtcgtctacgacaagatggtgcgtggtgatcggcgctgcgatggtgtcgtccacggcaaggtgctgcgggtgatccgc

SEQ ID NO: 43195 - DNA, 428 bp, Triticum aestivum
  Clone ID: PAT_TA_43195
cgtccgcccacgcgtccgcggacgcgtgggataaaacgtgaaaacagaggtgctgtcgatgtgttgaccctgcaatgagtttgcctcacctcacctcctcacagaaagacagacctccctataaaatcatcggtagaaccctagcgccccccaccctcctctctccattccgcctccgccgccaccctccaaaaccccacctcgcccgccaccagatcccgccgccaccaccacccaccatggctacacccacacccttcaagttcttcgcgtccgacgaccgtcaggtggggcacctgctcgccgccgtcgatgcggcggcgtcccggtgcacggcggcggcgcagcgcctcgaggccgcggcgaccaacgaggccaaactgaaggggaagggggaggcggtcgatgccgacgccgcgcgcgccacc

SEQ ID NO: 43196 - DNA, 428 bp, Triticum aestivum
  Clone ID: PAT_TA_43196
cgtccgcccacgcgtccggcctgagaccttgttactaaatagcagttcacagatgggcacaccattttatcaattatgcagggttgagggtttatcatgaatattttggctggtacagctctcaaacacccagcagagttgatttaggcccagttactcttaaattattgaacgtgaaagcatttgaaaatcaccctatccatgaagtagtaccaagcgtgtttactgaaataggagtgcatgtgatttcttgtgttcttatctgcagcagaagtggtaatggtgtgattttcctctatgtcttgacagaatattagtactctacactatttgttatgcagatattcttattttttcatggcgaatgggcaaatgaagtctgaatctaacatatatacagacaatcgctactgtctggatgttcttgg

SEQ ID NO: 43197 - DNA, 427 bp, Triticum aestivum
  Clone ID: PAT_TA_43197
cgtccgtgtgccatgttcatccatcccgcggcgcagcaaacctcgcagagtagatttgtattactcaagctggtgcagccgtgcaggtaaccactttgcttcactaccttgcttgcacatgagtggtaagaggtgaaacagagctgtttgaatagtgaggttgaaggaactaactttttaatgctggacatgacaaatgaatgaaaaggagacaacatattttctagaaactattggaaagaataccactttctttccttcattcattcttcgatgactcaaaatttctgttgttttgattttggaacagtggagtcaagacgagggaacggtggatcgactgcctgcgagatcctcttgttccaccatgaggatatgggcatcccctatgagcttgcaagattggcattcgcaaggcatgtgggga

SEQ ID NO: 43198 - DNA, 314 bp, Triticum aestivum
  Clone ID: PAT_TA_43198
aaaatcagcggttaataatttggggactttttatataactgtggacttataaacaattctaaacaccctactaatattataaataaattttttactttttatattttgaaaaaaccccccgcaacgtcaaaaaagaaaaaaaaccaccccccccgggcttaagcccttcatgctcaccttatgggaaaaaaaaataaaataaccgggcccatacttaaaatgggaaacatgtaaaaaaccactacggcaccaatctattgctccaggaaaaaacccacttccaccacactaacaaaaaaaaaaaaagcccagcc

SEQ ID NO: 43199 - DNA, 427 bp, Triticum aestivum
  Clone ID: PAT_TA_43199
cgtccgcggacgcgtggggacggagcctcgcaaagactggggctttaattcgaacgcgctcgccggcgtcctccccgtctctccccccatccatctcgagccctccgccacagtaccagcatcacgccaaacccccatcccctatctatcccagggaagtgaaggtcaaaccagccgccgcccctcctcttctccggccgcccgctccgatcgccgcccccctccgtcgccttccctcccgaggattctgtatctataggtttggtcatggcgtcagctgcctatcttgacgacattgatgctgaagttatcgaccctccaaagattgagatgttagatgtcacggaactcgtcggtgatcttattgagcactcaccgaaaccaaatgtcatagtttctagcaatgggcgtgagctattggaatgcc

SEQ ID NO: 43200 - DNA, 418 bp, Triticum aestivum
  Clone ID: PAT_TA_43200
cgtccgcggacgcgtgggaaagatctaaaataccttagccaccggttggaactatacaatttgataaaagtagagagtgtggtggatgcaaaagaagccaagctctatcagaaaaagaatctaagtgaactgtcgctatgctggggtcgtcgaaaatatcatgggcctcaagatgatgttggtaacatggaagaagtattggaggctcttgcacctcatagtgagatcaaggtattggagatacatggttatggtggcactaaattctcgtcatggatgatgcactctcagatgtgccagtgcctaagaaaactcataatcttcaactgcccaaaatgcaaacatctcccatcggctccgctgttggtctccctcgagtatttgtccttaggctacatggatagcctgaccataatat

SEQ ID NO: 43201 - DNA, 416 bp, Triticum aestivum
  Clone ID: PAT_TA_43201
cgtccgggcaagtggagcaagctaggtgactggatcctgccatttagtggccctgcccagtatatcgcagagcatggcctctggttcggcttttctcgaaaagatgagcacctctgtgtagccaacctggtgcaggagccaccggcgccactgcttcatgaatttccctttcagcaagtgtgggaagaaccgcatctgtcagaggcgtggacaccgatggcggctagtctcctgccgcttggctctggcaagctttgcacagccagggtcttccggacaagcaagggcaacaaggacaggaaagctgagagcattgtggtgttagctggcatggagtttgtcaacgatgccagcacgggaaggctaatgataatcaagcacaagtccgtgagctacatcgttggtggatacgtctt

SEQ ID NO: 43202 - DNA, 366 bp, Triticum aestivum
  unsure (1)..(366): unsure at all n locations
  Clone ID: PAT_TA_43202
cgtccgcccacgcgtccgcggacgcgtgggggagaagctacgaccgtcgatccgtgatctgacgacccggaggagaacttaccgcttcgccgattcaagtgtgcccacagccgtcgatctccatctggacggccagcatcgtcgcgacctactttttaaaagttaccgcgctgtcttttacctgtcgaacatgtcactatctacttttactctgaattttgctttataaacccctctccggcttgtggagagggcattcaggattaatctgggcttggccctcgcagccgccgtgttccggctggcgaaaaccctagctaccttgcatcggatctgagtgaatcaaacctcaaatctcccaccgna

SEQ ID NO: 43203 - DNA, 417 bp, Triticum aestivum
  Clone ID: PAT_TA_43203
cgtccgctccttctcctttgcaaccccagcgccgccgttcccgccgccacgcggggcagcccccggcgcccggcagcccccgtcgccggccaaatcggcccctctgactacagatccggccgccccggtctatttcccgccggatcccatcttcgccgccgtccgacgcgcctgctgcaaggagctgcgaccccatgtctcagaggagctagccccgacgccattgacgcccgagcgacgctcccaaggtaggagcggcaccaggaagaccacgcccccgaagcctaagctgcaagatactaagcggggagcgaccgccatggcgcagcgtcaggagggttcggcggaggagggggaggagcatcgcctgcgggcggcgctgcgccacctgcaggcggaggccggagtgctcgagcg

SEQ ID NO: 43204 - DNA, 421 bp, Triticum aestivum
  Clone ID: PAT_TA_43204
cgtccggcaggagccctacacatacaaggctgaagaagatagcaccccgagcggcatctttgcgaggggctcctattctgctagattaaagtttgtcgacgatgatgggaaggtgtacctagacatgaggtacagctttgagatcaggaaggactggcctgcctaattaacagacagtcagtcagtggtactgagaccacctacgtagggtagggtccgtcgcaaagatgagatgagtgttagtttaggttgtggggagtgcggatgttgatagctgctgttaggtgattgatgtttattgtgtggtatctatcagggatgttgattcactcactcgctttgcttgcaatgaagaaggtgagtgagtgcctgaactggactgaaagtgtatgtctgaatttgcatgcatgttattgttatt

SEQ ID NO: 43205 - DNA, 418 bp, Triticum aestivum
  Clone ID: PAT_TA_43205
cgtccgcggacgcgtgggcggacgcgtggggcggagcacattgtttcctaactttggcagcatgctcagtgtggcagatcagcacccaaaaactgagcactgggatgaggagaacgttcatagggacgatgaagaatatgcatctgatgctggaggcgactacgaagataatgtccatagcccgctgctgtcacgacagaccacaaacacggatgggaaggaccatggtcaccatggaagcactttgggcatgagaaggagaagtctcttggaagagggtggggaggcagtcagcagcactggtattggtggggggtggcaactcgcatggaaatggtcggagcgacaaggcgaggatggcaagaaggaaggaggcttcaaaagaatctacttgcaccaagagggggtggccgactca

SEQ ID NO: 43206 - DNA, 418 bp, Triticum aestivum
  Clone ID: PAT_TA_43206
cgtccgaggtagtgagacatctctcttccgcgtgcacatctgcactttcgtcaattccttgatcaagccgagcgcgtatggcgttggaggccgtggtgttctcgaaagggttcttcgggcgctgcgccatggctgccgaaggagttggaggaggcggtgggttttggggcgggaatggccacgggcacggcggtggcatggacttggacggaagcaacgcccattgcggcgccgccgttgcgagcaccgaagccccggaaggaagttcctccttgccggcgctgccgccgccggggcacggaggtgaccgtggagacgcggacgacggtgccgtgggcgcggcgtcggcatcaggtgcggcagggaggaggaagcggcgaatagcgaggagcgtgaagaacattgaggaggcggagag

SEQ ID NO: 43207 - DNA, 394 bp, Triticum aestivum
  Clone ID: PAT_TA_43207
cgtgcggccacgcgtgcggccacgcgttcgtcgcccgtcgtcgtcgtctcttcctgtccgatccttgtgcttcgtgagagcttcaaccatgggtaaggagatgactcacatcaacatcgtggacattggccatgttgactatggcaagtacaccaccactggccatgtcatctacaagctcggagggattgacaagcgtgtgatcgagaggaacgagaaggaagccaatgacatgaacaagatggccttgaagtacgcctggctgcttgacaagctgaacgccgatcgtgagatgggtatcaccattgatatcgacctgtggtagatcgagaccaccaagtactactgcaccgacattgatgcccacggtcaccgtgacttcatcaagaacatg

SEQ ID NO: 43208 - DNA, 429 bp, Triticum aestivum
  Clone ID: PAT_TA_43208
cggacgcgtgggcggacgcgtgggcggacgcgtgggttttgtagtaattactaaacttgcttgaagtacaaaaaattgaacataggaatttgaaggaaagagggctgtacacagggctatataaaatagtccacacataaaaattgcaaaccataaaaaaatacaactaaagttgaatttgaaggaacgtcattaattttcatggtagtgctacaactaaagctgtatacagaagaccattataccatgctcattcttgtcttctcttataacaatttttcgttcatcataaaccggaggacgtacaggagattgaatgaaggttccgagtttatatacacacgtttcaatagctctccatcattgcaagttgttggtactggaggttcagagaaatccaaacagcttgataacgtagaatagtccatc

SEQ ID NO: 43209 - DNA, 423 bp, Triticum aestivum
  Clone ID: PAT_TA_43209
cgtccgcggacgcgtgggcggacgcgtgggctgttgtatgcctgcattctgtctgtagtaagttgtttagttaatgagttttgaatcagtctatatgagcatgtgggttttcaacaataggtgtatttttagatgattgtaataccccatgtattttttcatcccattttcgcatacaagtgctctgctgtatgtatgtgtggtggtgtaattggtttattccttccatgttggtgttgtaacttataggcgtgttgccaatattttatcagggaactacaaagtgttgtcagttatctaatttgccttctatgtagctcttggattattgtgtaatattaatgttcagttatgcaatatatttttcagcaatgtccaccccttgatctttgtgtaaaatttctttgtccactgcaaattacc

SEQ ID NO: 43210 - DNA, 393 bp, Triticum aestivum
  Clone ID: PAT_TA_43210
cgtccgcggacgcgtgggcggacgcgtgggctcagcgctgcgcccacgcgcacttcacctccacgacctacacacggggctcgctcaatcctccggctgccgccaacgccgccgttctgcacgagcgaagacgatggctagcggggagaaggtggactatgtgtttaaagtggtgctgatcggcgactcggccgtcgtcaagtcgcagatcctggcgcggttcgcgcgcaacgagttcagcctcgactacaaggccaccatcggagtcgagttccagactcgcacgctcgttatcgaccacaattccgttaaggctccatatctgggactaccgtctgtcatgaaaggtacaaaatctgtcacaaagcgcatattacaaaggcgcttttggga

SEQ ID NO: 43211 - DNA, 416 bp, Triticum aestivum
  Clone ID: PAT_TA_43211
cgtccgcggacgcgtgggtcaatgtagaacttctcagaactacaagagcttgctgtcttgttcatgttttatggtgcaattcagagatgattctccccttgaagccttgtctgactaccacagtactagcacttgtttgatggacaagcacatggttcttcctccaggaaatgatacaggttatggcgactacaaaattatcactcattgttgccctcgatttcaacctgagcaacatgaagctaattgttactctactaccagtcctgaccttacgttgcatacaactgggccctgtactgatcttcagtcacaaattcttcatgagatgagtttttggtacttggggcttcccagggtgaggatgtattggaggcatgtgaagctaattagtgccattgaaagatgggttcctt

SEQ ID NO: 43212 - DNA, 270 bp, Triticum aestivum
  Clone ID: PAT_TA_43212
cgtccgcccacgcgtccgggaaaacttttctttctctgtttgttctttgtaccgaaaatcttagcctagcatggctctgaaaccatttttagatcctctgggtcggataggctagagactcccggtaaacctaccttctgctggtgctgacgagctcgatccagcgccgaccatggtgatgacggagtgtgggcgaggtggcggcggtggagcttcccgtcggcctagcgcaaaccctagatcggtagggagtgtcggtggggagtgtgt

SEQ ID NO: 43213 - DNA, 379 bp, Triticum aestivum
  Clone ID: PAT_TA_43213
cgtccgcttatcctccccttccggctcgggttcgggttctggttcggttcgggtccgagagtagctagcctagtctagggtttccgtagagaggaggaggagaggaagagagagatccatggcggagacggagtaccgctgcttcgtgggcggcctcgcctgggccaccgacgacaacaacctccagcaggccttcagccagtacggcgagatcctcgacgccaaggtaaccctaaccccccttcccctcccagatccgttcgaatttcgtgtcgtcggcgctagatctggcccgatctggtggtttctgtggcggatctgaccgcatctggccggttttgttctgtgcgtgcgtgcgtgcagatcatcaacgaccgcg

SEQ ID NO: 43214 - DNA, 419 bp, Triticum aestivum
  Clone ID: PAT_TA_43214
cgtccggtttacatggctggttagcattcttttttaaacatggatgcctagctgtgttctaaagagtataaggccatgcttggaatggatgtatcttgatatggaggtgtataacttacacgtgtaacttactagccactgtgcaaattccagccggaaatgaaacgacgcgctcaggcgtgtatttttttacaagggtatttaaaagagaaaagatgatccaaacagggcctaaaatgcattgctattgggagtagtttcggtcaaatgctactctggtattgcttaggagtatttgtagggttctagagcaaccagtagatggcctatttctttctattgatatggacaatatcttatctagccaaagttccctccttacaaaatcaccttgtaactcagacgactagaaatatgaa

SEQ ID NO: 43215 - DNA, 174 bp, Triticum aestivum
  Clone ID: PAT_TA_43215
cgtccgcttaccgtttgaatgagatgaactccgctatgaattatccgtaaaatagcagcagacgcgggacgatacccgaggacgacggacgcagatgcagcgggcaaaagagtgcacgtgaaaggctcctaaaccataccatggatatctcctggaccggaccatggaaagaca

SEQ ID NO: 43216 - DNA, 229 bp, Triticum aestivum
  Clone ID: PAT_TA_43216
cgtccgcccacgcgtccggattgattcatctgatggacattttgtcaggcaaataaacaataacatttctctatttggtgaattgcacagggggggatggatggatcttgatatggaggtgtataacttacacgtgtaacttactagccactgtgcaaattccagccggaaatgaaacgacgcgctcaggcgtgtattttttaaccaggggttttaaaaggggaacggt

SEQ ID NO: 43217 - DNA, 389 bp, Triticum aestivum
  Clone ID: PAT_TA_43217
cgtccggggtcgaggtcgtgtgggttcctattactttctagccagtcagtcaaatgtagttcccttttctctcttggtttgctttgtgctgctgattccaagaaagaagaagaagaaaaggcttgcacaaatctcaaatgtccacaattctgcatcaagatggaggatgagcaagcatggccttcagtaagtttcgctcctctgctctgcttcttaggtcttcttttttcagttttttttcttcatttcttttgtgctctggattgaattagtgcttggtgagaataataataagtgactgttgttagctcagatagccagctcctgtatgtatctatcttctgattgtttgatgggtgtgtcaccatgaatggaattgatcaatggac

SEQ ID NO: 43218 - DNA, 422 bp, Triticum aestivum
  Clone ID: PAT_TA_43218
cgtccgcccctctcacgccgccaccatcgcaccctctccggcgaactctcccttgtcccagtcttgaatccaacaaacggaacctgtgtccaccatttgtagatgaagaagaagcaggtgcacgagcagcaggcgagccttccccatgaccatgactgcacggagcaggaccactcgccgacgaccggcaaccaaggccgcgacggcaaggcgccgccattcccctccaccgaggaagagtctgagcagcagcagcccggggtggatcttcctgaaggcgccatcgtcgagatcctgtccagggtgccctacaggtcgctctgccgcttcaagtgcgtgtccaagccatggctggccctctgctcagacccgaacgtccgcaagaagtcgacgcagaccctgtcgggcttcttcttcaagga

SEQ ID NO: 43219 - DNA, 421 bp, Triticum aestivum
  Clone ID: PAT_TA_43219
cgttcgcgccgagatacctcgagccatcgtctcggcgatcacctgatctcactcgtgcgatactcaacaaccccccttgtttctccttcctgccatgcttaaaatgaccactggccctatcaacaccacgccaccctatccggcttgagttcatcgatgatccgaacctggtccaggccatcgtccagatggacaacgaggcgctggtgccaaatccactggagaacctcgctgcctaccacggccccttgccccagatccagtatcacgctccactgccaccgctccaggtccagcatcaaggccccctgctccctcctccccaggtccagcatcaagcccccctcctcgaagacgacgacgaccccatcagggacgtctcgaagctcttcaaagaagatgatgattccccggctcttga

SEQ ID NO: 43220 - DNA, 387 bp, Triticum aestivum
  Clone ID: PAT_TA_43220
cgtccgaacgaacttaccaaggtactgtgcaaaatggttactcacacccaaatggtgactatataagatggcttcagaccggtacctatcactactgtgcgaagctatcacataatctctatgcgccataaactcatgaaactatataagggcaaccccacccaacacaggacttgatcagaaacaaggatggagatgatgaaagcttccatactaaacaccaaaggcatgaattgcaggtcaagattaacgctggcgaaccataaaaaccatggaatattgaccatgaccgtgtcatgcgatacacgaataaggatattataaacacacatatatgaacacgccacggaataaaaacagtttgtgtggacaatggaccatacaaca

SEQ ID NO: 43221 - DNA, 217 bp, Triticum aestivum
  Clone ID: PAT_TA_43221
gcaaagacgaacagaagaacaccatcaacttccacgcctgcctcgacataaacggccgcctgctccgccacgttaacgccgagcgccgcctttaggagtggagggccgatgccgcggatcgccagctcaagaagcttgcctaggactttcttaagaagaaggccaaatagtcatgccgcggcggcgcccgatctgtcaaaggccacaagttccttta

SEQ ID NO: 43222 - DNA, 427 bp, Triticum aestivum
  Clone ID: PAT_TA_43222
cgtgcgaccacgcgtgcgtaccgtgaagggacgtcttaaggcgctggcaatgcctctgggaatgggtctggtgggcatgtgcggctgataacgctgctggacacttgacatgcgtctagaactactaatactgattatgtgtagtaatatctcatgtagcatactctgtgcaatactatggaagaggagctcgatcatcggtttaaagcatgtactaaatcatgcacctgactgacgcctgaataaagctaggattatatgtgtgaaaatgaccgattttgcgaacccttcttgtaccttgagaagtaccgcaaggatgccgagagctgcgtcaacgccgaggaggagtcggtacgtgcctcccttgggaagaagaaagctgtccccaagccgcgtgatgcgaataagcttaaaatttgtatgggca

SEQ ID NO: 43223 - DNA, 436 bp, Triticum aestivum
  Clone ID: PAT_TA_43223
acccctgcacccaccgggtccgaatcaccgcgtcgacccacgcgtccgagcttagcttacgaattatcggtggaagtattggcatgaatgctggggacgaggctgagggtcatggcattgatgtttctgggcaaacaacctacagtgcagaggctgatgcataacctattactgaccttactgacacaatgggccatacacttaaatcacttccaggacactcatttatggatagagtttgtacctgaagaaggtcatcgataagaacctcattgcgacagtcaagatattgggatgcgtacaggaacccgccctgacagtggaacaataatatcctggattaataaagctcactctggggagaccggaaaaatgatcagacattccattggtcatgaaagcattattcttcctttctttctcttgcaatgctgcg

SEQ ID NO: 43224 - DNA, 329 bp, Triticum aestivum
  Clone ID: PAT_TA_43224
gacccacgcattctgccttcactcaaacacttaatagcaactttccattatcttcctgttgggggtttctgtaagaggtatgacgcacacggctactctctatggttctgtgactacaagtaccaagaagagaacacctcgtctgacgttaccctgaacaaagtcgccgggttcctgcagcggatggatctgtgccgcaagtatgcttttgtcaaagatactcttgattggctctgaggctcccttcaaagtcaaggggctgtggctcttccgtgggcaggacatccttgagttcatcatgaaagaggtctattacattgagctctacg

SEQ ID NO: 43225 - DNA, 437 bp, Triticum aestivum
  Clone ID: PAT_TA_43225
cgtccgtggtcttcccccactccactattcctctagcctcgtcgtgagaggaagagcgaataccggcggtggtggctggccaagccgattggcggcggcggcggcgcgtgccggcttcttcctacccgcatccatggcgagatggtagtcggggtctggcgatgtgcgcggtggccatgtgagatggcctcgccggctggtggacagtaccgctatgttttcagtgctggagcagcagcgatggacggcatacacgacggctgccgggagtggcggtcggtgatggggccgagccgccgttgtttggcatttcttggtcaccgacctgagcacctcttgctctcctggcatcaatgatcaagtgatgaacccgctgccgcaaggattgacgccgggcaccaccagattggacctgcgccacccccatctcgcgccag

SEQ ID NO: 43226 - DNA, 310 bp, Triticum aestivum
  Clone ID: PAT_TA_43226
cgtccgctcctccccactcagtcctcggttcccggtccggttcggttgcggtcgattcgttaggggtgaatatcggtgaagaggaaggcatggcggacgtaaagtacctatgctttttgggctgcctggatctgaggccaccgacgaccagtggctccagaacacgttctcgaaggacagctacgatatccactccaacttcatgactgacagggtgacgggccagtgccgcagcttcagctacggaaccttatcataagacgatgcgatactccatgcgattgatgccatcaaccgccacgacctggac

SEQ ID NO: 43227 - DNA, 349 bp, Triticum aestivum
  Clone ID: PAT_TA_43227
cgtccggcccgccgcgccgggcccggcctcgccgccgggaaaccgaacagcgccgcccccggcctgcgcgccgcccggtaccaactcgacgcccccttcgccgcctgcgccaccgccctcttctccactccgaccgccgtcgacgcccgccgcgacgcccccgtcgccgggtgccacccccgcgacgccctccctcccgcctcccacggggcccggggtgcccgccgagccgtctgccccgtcgaccacgccttatacggcgaccgatctgccgacgccgtccgaccaagcctcgacgccgacgtcgacgagctcagcgctcaacacggccaccgtggcggggatcgcg

SEQ ID NO: 43228 - DNA, 346 bp, Triticum aestivum
  Clone ID: PAT_TA_43228
cgtacgggacgcgtgggcggacgcatgggccgggtccctcgctccgactgacagagagcacagacgtgctcataccctggggacggcatcacgctcctagccttaatcggacggtttgtgttctaggcatattcactttgaaaaaattagagggctcaaaccacgtcatcgatgtccatacattatggccaaataacctgatggactgtgcgatcctattgtcacaaactaaggcatcggaataataagcaatacaaaaaacatgtctaattcaacttttactgaaggttaaccagacctttgagctttaacaatcattatgattacacggctgggctttataaat

SEQ ID NO: 43229 - DNA, 353 bp, Triticum aestivum
  Clone ID: PAT_TA_43229
cgtccggaataggaaggtggaactcaaaatgcactcatttaaatcaaacatgtgcaaaaattcctggggaacttggttattcacaaaggcacaattaaacatgggtcattctaggttttaaagaaaatctactctctactttattgaaaactgaggcaaggagcctaggcttattatactgatacacatctactacagtccgctcttaaaaaagttattgggtcataaacattacaagcctgatcccttgttgatgttgaccgtcttctatttgactttattttccatcggccccttacataaaaagaatttctgttaattgaatcatttgtgaaccaaatgattaacgaccc

SEQ ID NO: 43230 - DNA, 396 bp, Triticum aestivum
  unsure (1)..(396): unsure at all n locations
  Clone ID: PAT_TA_43230
acatcctatccattgcttntttttcttttctctctacaattataaaaaacagcgcaggatttaatagagagatgggaattttatataaccaccactaataataatcatttcatcaatgtaattactcccacttcacataaccataccgaccaataatttttttcccaattcatcacattttcccttaaacaccaatcaatgtaactttttaaaacccttatcctttattaatatatcaacatcattacttgttttatcacatttactatcattattcttttccctatatcaatcatcatatcatctcaatacaattaaatccctttaactactacaacatatttcctaacccatcactatgaatattcatttttcatattaaaaattcaatattca

SEQ ID NO: 43231 - DNA, 425 bp, Triticum aestivum
  Clone ID: PAT_TA_43231
cgtccgggagagtgcattaatggacatgtatgcgaaatgcggtaaacttggcgttagccattataggttctctgagatgtctgctaaggatgaggtgacatggaactcgatgatttcaagctttgcacagaatggggaacctgaagaagctcttgagttgtttcgtcaaatgagtatggaaggagtgaagtacagtaatgtgaccatatcttccatcctatcagcatgtgcaggcttaccagctatatattatggaaaggagatccatggtatcattataaagggtcccataagagcaaatgtgtttgctgagagtgctctcatagatatgtatggcaaatgtgggaacttagaattggcttttcgtgtttttgaattcatgcctgagaagaatgaagtgtcatggaatagtataatctctgcct

SEQ ID NO: 43232 - DNA, 384 bp, Triticum aestivum
  Clone ID: PAT_TA_43232
cgtccggcgaagcgtggtggtgtataccaccatggtctctggctatacacgcgatgggcgttaccgggacgccgtgggagcctttgatgatatgctcaattaggggttcgagcctggtgcagtggtgcttgcatcggtgctgtcggcctgcgcacggtcagagtctggtgggctcgtgatggggcggcgtgtgcatgatatcatggagaggagggggatggcggcccctgcgggggtgatccttggcacattattagttgacatgtatggaaagaatggggcgatcgaggaggctgtaacggtgtttaatgggatgccgtatcttaatacatctacctggaacgccctgatctcagtgtttgtgcaccatgtgcattgcaagga

SEQ ID NO: 43233 - DNA, 324 bp, Triticum aestivum
  Clone ID: PAT_TA_43233
cgtccggggacacattggggctaacaagcacgttctaaaggatgctgcgaacacaactgggactatgtgacttgcactagaggctgtagccggagcccagcgaacaaacaaattacggatactaacggggcactccaaggagctgggttatggatatcggatccgtgctctaactatggcgatcgcacacacactcggaggctgaactatacggactacatattgacatcggcaccctgtcaaaagcaagctgaatgggttcccccgacccggttgattgtgccgacaacaagtctccgaaaggtggagagacctggacatgct

SEQ ID NO: 43234 - DNA, 260 bp, Triticum aestivum
  Clone ID: PAT_TA_43234
cgtccggggacgcgtggggcctaacaagaaagtacacaaaaggggatcgccgtcaaacgggactacgccgctcaagatgaggtcgatactggccgcgttctcatcaaggtatcgtgaacccacaccggaaccccttgaacggcattcacatgctcaccatgtgcaaccgtctaattaacttgatggtgagggacgacgatctgtacaatcgatacttataacttggcattaaggaagcgctcaccaggctgccccatgag

SEQ ID NO: 43235 - DNA, 373 bp, Triticum aestivum
  Clone ID: PAT_TA_43235
cgtccgcggacgcgtgggcactcacatccctctctcactcgcgactcacccacatctctccctcacgcatcgccaacgggggcgcgctcttcctcgccctctatcacccgcaccacctatactcgagctcctccctaactcgcattgccggcgccctctccccgcgcgcgtaactggcgctctcttactctcacatgtccgtctgcatatttaaaaatgggattgtttccctctggctctccgatcttgaccggaggtgctcgatctgcggagctgctgctgatggacacctgcccggagctgctgatgaccggatctggtaactgcaccggcagatgttctttttgaactgggaccgattgttggtttcggc

SEQ ID NO: 43236 - DNA, 103 bp, Triticum aestivum
  Clone ID: PAT_TA_43236
cgtccggtcagagtttcatgccatctattatcacgtctgttctacctaaaggtgtcttatgaaataaaacgaggtgcttcattaaatttattccctaaaatat

SEQ ID NO: 43237 - DNA, 407 bp, Triticum aestivum
  Clone ID: PAT_TA_43237
cgtccggtaagaatggacactaatttttgcatgcttcatgtatcacatattgggcaattacaggacggagtggggtcaggttctctttgttcttttactctgtaacatgagtctacctctactaaaacttcaacattcgagatacacaattacttgattcacaatgtatatgtgtgtgagtccactagtctaagcatgatttgtgctaacgaacttcctctcctcatttaatgaatgatcactgagcacagctcttgcatccgtgcttaaaaagggaaattgttatggtgatttgttctaacaaacttctttcctctattccttctttgtgcttgcttgcttgttgtcgcaagccatgcaacaaacttcttttcctactataatggcacagctatcgcatccttgct

SEQ ID NO: 43238 - DNA, 368 bp, Triticum aestivum
  Clone ID: PAT_TA_43238
cgtccgcacacgcccgcccgcactcttcgatcgattttttttacacccaccgggcgacgacaaaggagcgatatgtgatattctacaatctaacaaaatagaaatctacaataaaccttcttttatctctaaacaagcatcagtctattacatatcaaatacattgcctagaaaatactctcgtgcaactaaaaatatgcacaagtttgtactccactatattcatcaagatcccattaaaaacgttatcttaatatttcgctgcaaaacattaatgcttaaaacaaagattatgccttctacacgtacaagattcccataatgcttaccaaaattgaatgccattgaaatgactttaaaaccaatat

SEQ ID NO: 43239 - DNA, 417 bp, Triticum aestivum
  Clone ID: PAT_TA_43239
cgtccgcgcacacttgggcgacggaatcattcgctctgaggactatgtgctgatgaaagcgcctggcacatcatagcctgcgtatgtggctaccattgaggaaatcgaggcactaagacctggacgctcaaatggcacggataaagggcactggttctacctaccggatgagtctattgacgggcgcacgccattgcatggtgaaatggaggtgcacatttgtgaccaccacaacgagcagagtgctgacaccatagaagacactggcactgaatgcaactaccatgatacaccaatctgtctgctgaaaatgctgacgattctatttgacagttcgagtacaactcaaccacaaaacgctgtaagactgatcgcattgctaggtatggtacatgtgagaaagcatacaaacctggt

SEQ ID NO: 43240 - DNA, 423 bp, Triticum aestivum
  Clone ID: PAT_TA_43240
cgtccgctcctctcggatacttcttcttcctcggagcttcaaccatgggtagggggaatactcacgtgaacatcggggtcattggccatgtccactctggcaagtcgaccaccactggccatctgatctacaagcttggatgtattgacaagcgcgtgatcgataggttcgagaaggaagccgtcgagatcaacaacaggtctttcaagtacacctgggtgcttgacaagctgaaggccgagcgcgagaagggtatcaccattgatattgccctgtggaagttcgagaccaccaactactactggaccgtcattgatgctcctggtcaccatcacttcatcaagaacatgattactggtacctcccatgctgactgtgctgtgctcatcattgactccaccactggtggttttgaggctggta

SEQ ID NO: 43241 - DNA, 426 bp, Triticum aestivum
  Clone ID: PAT_TA_43241
cgtccggagcaatgctagtcatttgttttagttaacctctgtcaatgcagcattttacaatctttggttatgctcgtagcaaaatgagcgatgaagagctcaggaacatgattagcatgaccctaacctgccggattgatcagagggcgaactgcagtgagaagatggatcaatttctgaagagatgcttctatcagtccggacagtacaactcagaggaaggattttgcgaattggatagaaagcttacagaaaaagaggtaatcccgaattcatagtagtttttctagccctttactatgagataccaagtagctattcgcaaagtaaaagagataccaagtaattgcactgcagaattcatggcaaatattgcatagaaaaaaggagttgaggccaaatgtttgtcatcaatcaggctggaaa

SEQ ID NO: 43242 - DNA, 393 bp, Triticum aestivum
  Clone ID: PAT_TA_43242
cacgcgtccgttttttttttttttattttgtttttttttttttgggttttttttttttttttttttttttaccaccacacttttttatttttttggaaactcaaaatttttttttaaacggttcacgagtttaaaaaattttttacatgttaaaaacaatttttcacggcccaaatttaacccaaggcccatacaaaaatactttcaaaatatactttttaatcctgctgtgttcccaacaccattttttgttccataaagtgattcaacatcttaaaatacacaaggattttttttctccctgggctcgtctatttccaaattttgtatcttaataaaccacttggggtagtttgggtacaaacaacataaattaggtaggggaggaaccaa

SEQ ID NO: 43243 - DNA, 291 bp, Triticum aestivum
  Clone ID: PAT_TA_43243
cgtccgggataaggacaccatgaagttggaaagacatactgacgctggaaagattgatgaaaaggggattgcttcgactgctgcagaattggaaacaaaatcatgaactttgctggcaccaccatatcctgctggcgttactacagctcctactgctgggagcaaatcagtaccaatgtgaccagatgattctcttacacctgcaaaattacacagaagagccccgtgataatgaatttgaaaagcgcattacaccaaaagtggtacccgcgaatgaaattggggttttat

SEQ ID NO: 43244 - DNA, 429 bp, Triticum aestivum
  Clone ID: PAT_TA_43244
gcgacgcgttcggggaggcaatcacaaacattatcaatgactggcgtgagacgaaccgacagttccctgaaaggattcagctgggggtcggtctcaagaactatgacccggaaaaggacaggcgacgtagtcattgtcctaagctacctgatattcatccgcacaagataagggtttctatacatggggatccccagcacgttgaagaggcacggcaaatgcgcctacacttgattgatatggaatgccttgaaaagatgaacagagacaacactctggtcaatatgcttggaaagaacttttatgctttccttgcatgtgaggctattattaatcaaattccccgacttattggacctggtcttaacaaggcaggaaagtttacaactttggtgtctcaccaggaatcccttgagtccaaggtttatg

SEQ ID NO: 43245 - DNA, 394 bp, Triticum aestivum
  Clone ID: PAT_TA_43245
ttcccgatctaggaaaagctccaaatgggcacacttcagagggggctagatgctgagttccttcttgctcatatgtgttctctcaagtttaaggaatggattgccgtgctagcaactttattgaggcgtgcagaggttttggtggatctctttccacatgatctgagattgtggaaagcatatagcatcactctacaggcacacgatgtattcagcgaggaccttgatcttcttagcgccttggaggaggagctttcgtctgtttccgatcgcacattgcaaaacaactgaccgatgtcgtgatactgaaaggatagccattttgggtggccaacaattttatcctggtgtaaactaacacatactgttatgaggagagaaaggcgcggggaat

SEQ ID NO: 43246 - DNA, 367 bp, Triticum aestivum
  Clone ID: PAT_TA_43246
cgttcgatctcccttacaccgtccttaccctatgccctcgcccgccagtcgggggcgccttcattgggccagggcattctcccgatgtgaaagaatcttccagagaggaagggcgtcgccgggtgtgcatgtgcctccgaagattcttgccacggttgcctgaagcgtgggcgccgcgattcacctttccagatcggtggaggccaagggcaagggcaaggaggaggggataagaaaaccttcggccagctgaaggaagcctgggctggcgtccttcgcggcatatacacgcgccggtggcgggcagaaacgccagtgccacaaccacacacactccaagaacgtagcccgcggaaagtacggttcc

SEQ ID NO: 43247 - DNA, 432 bp, Triticum aestivum
  Clone ID: PAT_TA_43247
cgtccggaggtggtttgggggagagacgcaagttgccgtgagatcttgtctgcgcccccgccctcaggttcggctctcggcccctcccactccggtcccgtcctcatcgctgttcgtcaagtgctatgtttttcttcactaccaaagccaatcaactgaagagcagctttgtatagcctgatggctgtggagagagacatctttggtatctcagggccgacatatcttaatcctgttagttggaactgcgagaataataggagatctgtggctgcatgtttagttcaggctgtgtatgttttggagagagaccggcaactaaaccgtcaatctgttgacgccgcagcacctccttggtgggagttcttccattttgagatgatccggaagcttggcgatgatgttgacttgtctatattcggtgcaatattt

SEQ ID NO: 43248 - DNA, 438 bp, Triticum aestivum
  Clone ID: PAT_TA_43248
cgtccgcccacgcgtccgcccacgcgtccgcggacgcgtggggcaactttggcatgccaatgggaccgtttcaactccaagatttagctggatatggagtagccttagcagtaaaggatatctatgcagctgcctttggaacacggaattttaactccgttctagtggatttgatggtggagactgggcggcagggaaagagcaatggaaaaggttactacctttatgagaagggtgcgaagccaaagcctgaccctaatgttcaacatgtgattgacgagtacagaaaacaggcaaagacaatgccgggtggaaagcctgttactttatcggatcaagatatattggagatggttttcttcccagtcgttaatgaggcatgcaaggtcatggatgaaaatgtggtgatcagggctgctgatcttgatatcgcatctg

SEQ ID NO: 43249 - DNA, 445 bp, Triticum aestivum
  Clone ID: PAT_TA_43249
cgtccgcggacgcgtgggcacaaaaccaatcctactctgtcccccgatccccaatagcattacctggggcaatggacgggtcgggcaccgaaactggcgccaagggcaagaagggcgcggccgggcgcaaggccggcggacccaggaagaagtcggtgacgcggtccgtcaaggccgggctccagttccccgtcggacggatcgggcgctacctcaagaagggccgatacgcccagcgcgtgggcaccggcgcccccgtatacctagcacgcgtcctcgaatacctcgccgccgagctgctggagctcgccggaaacgccggcaaggacaacaagaagagccgcattatcccgcgccacctgctgctcgccgtcaggaacgacgaggagctcggaaagctgctggcgggcgtcaccatcgcgcacggcggtgtgatccccaagat

SEQ ID NO: 43250 - DNA, 386 bp, Triticum aestivum
  Clone ID: PAT_TA_43250
cgtccgcccacgcgtccgcccacacgtacgcccacgcgtccgcccactcgtccgtccacgcgtccgggccaccttactgggatcgtgcacgtgattgtaccgctggattggaatttgatgccccgacacgggagtacaaggcactgaggttgatcaatgggcttgcccactaggacatcctcaagtgtgaagtgtacacaccacgggctgattgctggaagcctgcatatggaggagtacccttcacgtggtccaagtttgaacattctgcagttggtcatgctatgatgagcaaaatacaacctgtgtttggcaacggattcctgcactggttgatcagtccatcttttctcatcaaaatgccaagagctgccatcatattgatt

SEQ ID NO: 43251 - DNA, 335 bp, Triticum aestivum
  Clone ID: PAT_TA_43251
ggttcactacgcttacggcgacgtttgatactacaagtgatctgactcttgtaccctgcgattgtatcaactgcggtgcaatatcattgtgccgtgaaactttgtatagacatctctccattaacaaacgcacctgactcaacaactcgtggcaatgtgccctatcgccatgatctttgatcatgcggttcagactgttcaagcccaaaacatccttgcccatacagcactgactatattcaaaaaaacacaaccaactgaggtctactaattgcagatggtctacacttgaactctaaagagagacatgcaccagttaaggcgtaacgcattat

SEQ ID NO: 43252 - DNA, 295 bp, Triticum aestivum
  Clone ID: PAT_TA_43252
cgtccgaccacacatactaccacttttacacccacacttacaaacaccaccggggtcctataactggcgcattcgtaggtcacattcgccacctccaacattcctaaagtaacctccgcgcctgacgacctataggatccttcaccgatatcctatactaccctttgcacgctgaggaactaaaataccctccacctccatttctcaactgttacacaccgtcttcttctatccaacaccaaggttctcaatcaacatatccaaccgttccttacctttatcgacctactttaat

SEQ ID NO: 43253 - DNA, 409 bp, Triticum aestivum
  Clone ID: PAT_TA_43253
cgtccgcggagccagcccagaagttatgctgataggcgtgcgcgccctcgggggcctagttgacgggctgacggccgcctgctactgcgtagtacactatggcgctataccgggcttctgagcccggctcctcaccatcgagtacatggacctcgatgagcaggctctgcaagctctgaagaagatttcactggagcatccgaccggctgtttgagagctggcgcgctaatggccgtcctgtcgtatctggacttcttctccactggcgttcagagagttgcattgtctactgctgccaatatttgcaggaagctaccctctgatgcatccgagttcgtcatggaagcggtaccgtagcttactaatctcctacaccaacatgactctaaggtgctagagcatgcttcg

SEQ ID NO: 43254 - DNA, 445 bp, Triticum aestivum
  Clone ID: PAT_TA_43254
cgcgtgcggccggcgccggcatgtccggccaccccgcctatgccctcccactgccccttcccggcctcggcgccgccgacccataccggaacaggagggccgccaccgccgtcaagcctccctgccagccgcctctccgtcggccacgctgcaaccagagcaagaatggcgaccctgaggaacctgaagatcaagacgtcgacgtgcaagaggatcgtcaaggagctgcgctcctacgagaaggaggtggagaaggaggccgccaaaaccgccgacatgaaagagaagggcgccgacccctatgatctcaagcagcaggaaaatgttttagctgagtcaagaatgatggtcccagactgccacaagccgcttgaagctgcactgacagacttgaaagcaactctggctgagttgaaagagtcaaatgaaacaggcactgagattg

SEQ ID NO: 43255 - DNA, 242 bp, Triticum aestivum
  Clone ID: PAT_TA_43255
cgtccgaacaaatgctcctaattcatttcaaaacgaaatttcttgaaaggagggggtcaactaaaccggaacaccgcggcaccactatccggaacaaaaaatatcaactaaacccacctgcaagatgcttcccgtcggtagcgaactccgcctccaccgtctacgaagacgtcaacatagcgcgcgctgagctacagccacgacttactcctaagttcacaccttacaatgctacgtggtcc

SEQ ID NO: 43256 - DNA, 294 bp, Triticum aestivum
  Clone ID: PAT_TA_43256
cgtccgttacattttcctttccacccgcctacttttcatcgaggtccgcgtactcaaagacggggggctgctgatcaaccgggggctcgagaacattatggtcaatatcaaggataaccaatagaacattaatcttaacaagcagtgttcctacctcttcgacaatcatcgaggtcattttccaattgaaccctggcaatgaggctgaccaggatcgtgctattatatatcttgactcacatgtggaaggactttcgtttgctgtattacaattcccgatagagactaatttcc

SEQ ID NO: 43257 - DNA, 368 bp, Triticum aestivum
  unsure (1)..(368): unsure at all n locations
  Clone ID: PAT_TA_43257
cttncnnttaattgtgagttcnttttttcaatcttgtttcccgggtccaagagaatttctcaggcgagcgagcgagatggcgaccggcgggaaggtgatctagtgcaaagccgcggtggcgtgggaggcggggaagccgctgtccatggaggaggtggaggtggcgccgccgcatgccatggaggtgcgcgtcaagatcctcttcacctccctctgccacaccgacgtctacttctgggaggccaagggccagacccccatgttccctcggatcttcggtcatgaagcttgaggcatagtggagagtgttggagagggtgtgactgagcttgcccctggtgaccatgtccttccttgtgttcactggg

SEQ ID NO: 43258 - DNA, 271 bp, Triticum aestivum
  Clone ID: PAT_TA_43258
gggggccactcgtccttggactctttttctccaacactctcattaagagagagagggaggtagatagagcagtgactctctatgccgattaggcgtacactttcgttgcaaaaccttcgtctttcccgtcgctctcgtgggcgtaccctagcccatctccctctgtcgccgcgcgcgcggatggccgtaatctccttgggcatctccccccaatccccacctaacccctcgctccttccgacccccgatttgtcttgcacgccttccaccg

SEQ ID NO: 43259 - DNA, 424 bp, Triticum aestivum
  unsure (1)..(424): unsure at all n locations
  Clone ID: PAT_TA_43259
ccctgggcgtccctcccnttccctcactcctccactctctcttccggataatcgtactccctgccgccccctccgtggccgcctacatgaccgaggtctgcgtcaaggccgccgtcggccaccccgacacgctcggcgactgtcccttctcgcagagggtgctgctcacgctggaggagaagaaggtgccctaccagatgaagctcatcgacgtctgcaacaagcccgactggtttctgaagatcaatccaaagggcaaggtgcccgtgtataacggtggtgatggcaaatggattgctgattcttatgtgatcactcaagttattgatgaagaaattcccaacttccattcactttttatcttcttctgagtttgcatctattggtttcaaatgatcttcttcaccttttttttaatttcttt

SEQ ID NO: 43260 - DNA, 170 bp, Triticum aestivum
  Clone ID: PAT_TA_43260
attcccggggcgaccgacgcgtccgctccttgttatcttttttcttcatttttacttaaaacttccgattttttacaccaaacgtccggggcgttcgtagagataaatacgctttgtgaggagtgagaagcattagcggcaggagaggcagagggagccatcacccggta

SEQ ID NO: 43261 - DNA, 377 bp, Triticum aestivum
  Clone ID: PAT_TA_43261
cgtccgggggaaaggcgtcttcgtactctcctctctccgagcaaccgatccttccacccaccgggttcccatttgtgcaggggcgcacccacctaccacccccacccggggccattagggagtgcatctcaatccacatcggccaaaccggcatccaggtcaggaacccatgctgggagctatactgcctcaagcatggcattcaccctgatggccagatgcccggtgacaagaccgctaggggaggtgatgatgcttcaaacaccttcttcagccagactaggtctcttaaagcacgtccccttgcatccttagtaaatgtagaccacactgcgattgatgaggagaggactggcacttacccccatgtcttctaa

SEQ ID NO: 43262 - DNA, 120 bp, Triticum aestivum
  Clone ID: PAT_TA_43262
ttctattctagtagctaactaaattcatatttaaacactacccctggatgggcacaaaaactggagagtgcgaacagaagataaccacttctatatcggtagaggcaagtggacccatcg

SEQ ID NO: 43263 - DNA, 436 bp, Triticum aestivum
  Clone ID: PAT_TA_43263
cgtccgcgtagcgctggctctcctcctgtccacgccacgctacgcgcccccggattccgcctccagattccatccaggctcaaacctccaccactccagcccgccggtgaccagcggccactcctcggcccggattccctcgtgcgcgcgttccatcgcctccctccaccggcagatccgagcatcgtcgtcgggtcaccggcccagcagcatatatcatctgttgcgtacgctgtcagctcggtcgcaccgccggcgctgcgctagctctgtggcgctcggctcagctcacgccgggagcatatctatctggcgctctgcgcctgccacctaccggcctagccccctagttgtagcttagtgctgctgtacctacggcaccggcggcgcgtccccgccggagtacatgacgtcggcggcggcggcgcaatacgcg

SEQ ID NO: 43264 - DNA, 343 bp, Triticum aestivum
  Clone ID: PAT_TA_43264
cgtccgacgggatctagacatggccgagaggaggaggaagacagctccgggaagctctagatgaggcgaggagcaaaggagagggatcgcgttgcatcgtcgtctatggcgatggatcggtgtccctgatccgcgctgttgctcggcgtcctgttggcaggatcactgtgtgctcttcgtgctgcaaaggaggaggccaagaagctcgggaccgtgatcggtatcgatctcggcaccacctactgatgtgttggtgtgtacatgaacggtcatgtcgtgattatagtcgacgaccattgtcaccgtattacgcgctaatgggttggggtcacccatcgtgata

SEQ ID NO: 43265 - DNA, 433 bp, Triticum aestivum
  Clone ID: PAT_TA_43265
atgcattctttcaatcatctgaagaaggagggtcgggaacttttcgtcaagcttcaattgatggaataaccgcccgttcacctttggttggcttgccagagttctcctaccttggctggggtcattggtttactttgagggatttggaacttgccactaaccgtttttccaaggataacattattggtgagggtggatatggtgtaatttatcgtggcgagatcgttaatggcactcctgttgctgtcaaaaagcttctcaattaacctagggcaagctgagaaagaattcagagtataatatgaggctattggtcatgttctccacaagaacttattccgtcttctttgttactgggtggagggtactcataggatacttgttctattaatatgtgaacaatgtaaatcctaaagctatggctttatttgat

SEQ ID NO: 43266 - DNA, 321 bp, Triticum aestivum
  Clone ID: PAT_TA_43266
cgtccgcggacgcgtgggtttggatgtatcctcggatggtaaaaaaaggaaaaaggaagtctggagctctcttggttgtacaacaaagaggggttacttcacatactcatcagcagtgaggctaatatcatctctaatcaagtgaaaaagcaagggcgcatccttagatttctgttggaagacttctatttctctcattccagatgtgctagcatgtgcaagcagtgagagtgtactttttattgatatgaatcttcaggcttcattttgaaattttgggccacgaacgcttgatcgcaaaagtaacagatatcatgaaat

SEQ ID NO: 43267 - DNA, 361 bp, Triticum aestivum
  Clone ID: PAT_TA_43267
cgtccgcccacgcgtgcgcacccccacactcccccggcgctctcactctcccctcgccgcctggggtgcaccagagctagcagaggagggctctccggactctagccgggcgccatgaagcggaccagggcgcataaccccaaggcccaggacccggagccgcatgaccccgtcgtcgccgggtgcaaccccaacccgaagccggatggccgcgcgaagcagccccggcagcccaaggcggcggcgacggcgggcaagaagactgacgcggcgcgcgatgccgccgcggtggccgttaccgctgacgctgctggtagcaacttcgatggcgcactgggccctgctgcggagatggcgcccg

SEQ ID NO: 43268 - DNA, 179 bp, Triticum aestivum
  Clone ID: PAT_TA_43268
cgtccgatctagacatagtcctttccactcccccgcatcggcatatcttctcgtgcaccactcttgaggccggaggcacccgctcctcggcgccggcggcttaccacggccactttggcgctcgtctccccccctgtcatggtctccaggatggcgctccggccctacggtgtttcgcc

SEQ ID NO: 43269 - DNA, 170 bp, Triticum aestivum
  Clone ID: PAT_TA_43269
cgtccgcccacgcgtccgccggatgctgattggcctcgtgacaaaaaatcaccgtctgggtaaggtactatgcgcgcgggatgaatggacacgccgctgagagcgctcgtcaatgactgcgttcgctggccgcaaagggttcccaccagcgaatggtggaccactacaac

SEQ ID NO: 43270 - DNA, 356 bp, Triticum aestivum
  Clone ID: PAT_TA_43270
ggcaagctattattaagggacggaatccatccccagggggggataagctggcatttaacaaaataaaatctaggctgcctggacgagtcaggactatgtcctcaggtgcttgtccattgtcggcagatgtaatggtattcctcagaatatgctttggtggcgatattcttgaaggcttcggaacgacggcaacatgttgcgtcattactctaacgcatgtcggagatatatcaactgctcatgtgggatctcccaatcctgcttgcgaggttacaactcgcggatgcgcctgatatgaactacacatctgaagatcaaccataccgtcagggagaaatttttgcccagatacctat

SEQ ID NO: 43271 - DNA, 435 bp, Triticum aestivum
  unsure (1)..(435): unsure at all n locations
  Clone ID: PAT_TA_43271
acgcgtccgcttgactcccgtggcgatgatgccttcctcctcctcctcccgccgccgtcgtcgccgccgcggcaaccgcaacaggcctcctcctcctccagcgccgataacgggggcgggggacgtcacgagtgacgaggcggagcttcccccgtcggccgttgcccacaggctggaatgcatcccattctcacgcgccgccccaccaaaacctaaccctccagagcctcaaccccaaccccatggcgcgacgcaccactcctgcttcacctcctnctctcgccgccgtcgcggacgacgcggacgcaaggggacagtaccagcgccaagcgcctgctgcggaggaggcgagggactgggcggggctcctgctggacgtgctctgcgccatccttcacaagctcgaccacgtcgagatcctgaccggcgcggggc

SEQ ID NO: 43272 - DNA, 350 bp, Triticum aestivum
  Clone ID: PAT_TA_43272
gcggcgccacgcgtccggccaccgcagcatcaacagcagcaggggcacgagattcagcccgtgtggatgtgggtggggcagccgaccccggcgcttcccttcgagttcggggtaccggcgacgtggccgatcccgccgctgcacccgcagtttgggtcgcagcagcacccctactacttgccgctgggcccaacggtgtgggggccggccttcgacaccagccaggacctggacgccatgggtgcgcaacagatgtccggggggcctacctgggcggaagaggcccaatttggggagcatccggcgggggacgggccaatggccgccgaagcaggggcaccgatttacta

SEQ ID NO: 43273 - DNA, 441 bp, Triticum aestivum
  Clone ID: PAT_TA_43273
cgtccgcttgctctcttggcgtgcagactctggtgctccgggtgtccatccactgcgagggatgcaagatgaaggtgaagaaagtgctgcagggcgtcgatggtgtgtcgtcggttctccaacattttcactctgctgtcttcacttgtccatctattttgcttgctcctgtgaaagggattttcctctcattccatagattcgcctttttctgaaggcgtgtacagatgcgacatcgacgcccggagcaacaaggtgacggtcgccgtcaccggcaacgtcagcgccgacgccctgctgaagaggctccgcaggtcgggcaagaacgcccagctgtggccggagcagcagcagcagcagcagcagcaactggccgtaggaacccagagacacggagaaaccaagaacgacgccatccatccagacaagcccggtggcact

SEQ ID NO: 43274 - DNA, 278 bp, Triticum aestivum
  Clone ID: PAT_TA_43274
gtggggccccgggtgagtaagccaagggggagagcgagacccatgccctggaccagtacgaatataagaggccgacccaccccccgccgctcagaggcaccggaggccgccgccggaccagctcccggccccgatctcctcctcccgagccagcgcccgtcgaggccgcgccgggcgcgcaccggcttactcctgccactgcccacggaaagccatgcgggatttgataataaagggggagagcaaaaggaagggaaaaaaatgggaggagatggata

SEQ ID NO: 43275 - DNA, 256 bp, Triticum aestivum
  Clone ID: PAT_TA_43275
cgtccgtttttgtgaattaaataactgcgctcaggatagtggagcctaacgctcacttgggaggggggcatccaaggagggatgacacgctttcgatagagaggtctgcaaagaaagctgaccgtgacaggcttcgtcctcgagctgaggcacaagctgttgatgagaaggccaatacgaatgagcaatcatcaagccgctctttaagaggcatgcctgctggaatgcccggaggattgccattcccaagaggcat

SEQ ID NO: 43276 - DNA, 466 bp, Triticum aestivum
  Clone ID: PAT_TA_43276
cgtccgcggacgcgtgggcgagtagccgtcccaatcctcgatctgttctcagaccctctctccgtgccgtcgttttctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccaccggtgttttcaccgacaaggacaaggctgcagctcacattaagggtggtgccaagaaggtcatcatttct

SEQ ID NO: 43277 - DNA, 247 bp, Triticum aestivum
  Clone ID: PAT_TA_43277
cgtccgagttaacctctagctgtctgtgtatatgccctctagttttccttgtcggcccacctctgccaggtgggtatgtggttagggcgaccacccccaacaagacgatgatggcgtcccagtgattaacccgtgcgggaatgcgatagaagaagccggaggctgtctccgctcctcccttcctgcctagctcaggattctgcagtagcttggggtcattctcatctgcctcgatcgctcttcgatg

SEQ ID NO: 43278 - DNA, 430 bp, Triticum aestivum
  Clone ID: PAT_TA_43278
ggggcgacccacgcgtccgcccacgcgtccgggttaagcgtatttccagccggccgttttctttttatgttggatggagaaaatgcttgctgtataggtaaagcgtatttccagccggccgttttctttttatgttttatttaaaaacatattgaccacgactttgactgactctagtttttaaaccataactctaaatgacttgattctttttctgacatccctcatttttcgtctaggttggtttagtatttatttcaaaaatttatgaaacactttttggtactggtttggaattatgtggtaattgcaatatttttgaaaataggtaaatggagggaagataaatttggcaaagtattgaagtgcacccaatcttttttgatgctcaagatcatggttcagagaggagcactacgacgaccccccg

SEQ ID NO: 43279 - DNA, 467 bp, Triticum aestivum
  Clone ID: PAT_TA_43279
cgtccgatgtaacaaatctttttcggatgctgcgagcctctgctaagaaggctgctggggaaagaatagttcctgcaactgacaataggaagatgtactataacaaatcccaaaaggagatattagaaaatagcaagagtgacataaccaatgccttgatgaagaggtacccgcaacttttgagaaaatacttgcctgacaaggccaagatatcccctctaattgatatgatgatgcttttgaaacttgagatgtactcactgaagaggcaagagcagaatttcaaggccgccatagatctcattgttgatgccttctttaaacatggggacaaggatactttaaaatcttgcatcaaggcaatagctttcttgtgcatgaagtgacaggcggatcttctagattatgctgaaaataaacttaagattcttgaagatgaggtggttttgaaagtcaaaactgcgatc

SEQ ID NO: 43280 - DNA, 178 bp, Triticum aestivum
  Clone ID: PAT_TA_43280
tcattcgtgccaggtgatgaccaaccttggggagaagcttttcgaggaggaggtggaggagatggtccgcgaggccgacgtggatggcgactgccagatcaactacgacgaggtcctcaagggtcatgatggccaagtgagggacaacccacccttttgaataaccctttttattttc

SEQ ID NO: 43281 - DNA, 250 bp, Triticum aestivum
  Clone ID: PAT_TA_43281
cgtccggtctacgtatgcaatttcatgcctgacattggagttccgggaaatcacaatgtgctgggtggaccggattgaatgaatgatctttaatataacaaatgagactagcaagtctaacgacatatactcacaggtggacgaaatccatgtgtaagaaccacttgcatttttaaattatttccaagatgttgcaggttatatggcatcatttggagcagaactagcttatagtagatcaaattaagaa

SEQ ID NO: 43282 - DNA, 270 bp, Triticum aestivum
  Clone ID: PAT_TA_43282
tcctccggactgaatacccaccttccggcgccgccttcgactccagcatggcgctcctgaggaggaaccccagcacgaagcgcatgctccacgtgccccgcacctccttctgctccttctcctcctattgctcctccaacaacagacctacatttcgtacccatactccgtcgttcctacgacgaccccagccacccggccctgaaccacgtgcatggtccaccataggccggttcagatcctacatctttctggacattcactagcgcc

SEQ ID NO: 43283 - DNA, 245 bp, Triticum aestivum
  Clone ID: PAT_TA_43283
ccgcggcgacccacccgtccgtttttttttttttttttttgacatcacaaagttccaaaatatattatagtaggtggcagagtatctcacatccagagtcataccatatcatacaattcaatacacagccaagcactacggtgttaattacacattcaactgactcatgtgcacaagaccgagataaggcataatcgatcacagaatttcacatacacacacacacagaatttttctcttattgc

SEQ ID NO: 43284 - DNA, 318 bp, Triticum aestivum
  Clone ID: PAT_TA_43284
cgcgtcctctgactcgtgggcggctcccccgtctaccttgccgccgtccttgagtacctcaccggtgaggtcctggagctggccggaaacgcctccagggacaacaagaatacccgtatcgtgccgggccacatccagctcgtcgtgcgcaatgacgaggagctgaccaagttgctcggcggcgccaccatcgccagcggcggtgtgatgcccaacattcaccagctcctccttcccaagaaggcctcttcctccaaggggggcacccggaatgacgactgacaactgaggccctgttctttccctttgctggcaccg

SEQ ID NO: 43285 - DNA, 391 bp, Triticum aestivum
  Clone ID: PAT_TA_43285
gcgtccgaggacgcgtgggcggacgcgtgggcggacgcgtgggcggacgcgtgggtgagccccgtgcccgtcctctttctcctccatccccgttccctcatctaaccctaaatttcgccccagccgtctctttcctccccgcgccgcctgccccggatctggaggaagaggagggaggcaggatctggaggaggaagaggagatccgggcatcccggcggtggctcgaccgatgcgaggtgacgacgagctaatgagtgcctcttcgactccttcctccgtcctcgccgctgccgccactccgactcctctctccgtgctcgccgtcgctgccgcctctatttacgtcctgcgggatgacgccgcaagtccgtctgaccgaccctcatgga

SEQ ID NO: 43286 - DNA, 241 bp, Triticum aestivum
  unsure (1)..(241): unsure at all n locations
  Clone ID: PAT_TA_43286
cctcctttgncgcgtgggcggacacttgggcggacgcatggtcgaacgcttgtgttagccctgtgcgggtgctttttctactggcagtgcggttccctcatctaaccctaaattttgccccagtacgtatgttttcttccatgaccttctgccctggatctggaagaagaggagggaggcaggatctggaggaggaagaggagatccggtcatcccggggttggctcgactgatgcgaggt

SEQ ID NO: 43287 - DNA, 301 bp, Triticum aestivum
  Clone ID: PAT_TA_43287
ggcgcccacgcgtccgcccacgcgtccgtcttaagctactccataaagcgttctcggaagtcactttcagggggagactaatttaaattcggtggaccaaacagcatctccccaaagttttgagagaaatacaccaaatgtcgagtttaatatctctgcatcaatgaaaaagcgatgataaaattagcgagcttgctgatgccaaaagcctgagagacgaagcaataaaacatgtggatagaccagactctatacttgctcagatgaagtgcagcctttctttatccagtccaaaaactgc

SEQ ID NO: 43288 - DNA, 258 bp, Triticum aestivum
  Clone ID: PAT_TA_43288
cgtccggtcatacacaggatggcgtccgccatggagctctccctcctcaaccccgcaattgaccagcacggcatcgcgggcaagacggcctcccacctcccgcttctccccgcgcgccggggcgccgtccgcttccgcgtgagggccgccgtcgcggcgcctcccgcacccgccgcgaagcccggctcgcccaagaagcggggcaagacggaggtcaacgagtcgctggtcacgccgggcttttacaccacggacttt

SEQ ID NO: 43289 - DNA, 369 bp, Triticum aestivum
  unsure (1)..(369): unsure at all n locations
  Clone ID: PAT_TA_43289
tggggggcgccacgcgtccgggactataagtttgaagatatatctaacaagggcagtggcaagggatcctctnaacgggtgttngtagaggagaggacagccatnataactgggaacttgatcaagggacttcaaatccgcttcctggggatgatttcaaaagggggggggggcatttctagaaaaggtgttgaaactgtcgtcaaatgatcagataactctgagcgggctggtgtggggagggctcatatcgatacaagtggtgaaacaggagatggcactccagagggggcgggcggtattgattctgattctgaggcagggaatggcacaccaaaaaagaagctgccccaatcacctgcccctggc

SEQ ID NO: 43290 - DNA, 392 bp, Triticum aestivum
  Clone ID: PAT_TA_43290
cgtccgatttgattgaggaggtcgagatgacgagaacacacagccgtaggtcgagatgactagaatcagcagatggacaccatgcagcgtcgtctagcctgtactatttctttggttgttgttttgttatcccagagttttgtagtattagcacgtagacgcttgacacttaattatcgcatatcatggatccatcatccatcatccattagaacttgaaagagtagcaacagtcctaattgtttaacacgtgagtatagtccccacatgctctagagttgtgtcagccatcttcctcaaaaaaaaaaaaagagttgtgtcagccaccttttagtatttaaaacaaacatacagagtaggtatctgctaccatccactacatttagcgtgtt

SEQ ID NO: 43291 - DNA, 378 bp, Triticum aestivum
  Clone ID: PAT_TA_43291
cgtccggctcgccgcctccaaccttcctccccaagcagaagggacctccctccagatgggcgcgatcctccctgcgtcgccatgtaccgcgccgccgccagtctcgccttcaaggcccggcaagccgggagcagcgcccgacaggtcgggagcaggctcgcctggagcaggaactatgccgccaaggacatcaggttcggcgtcgaggccagggccatgatgctcaagggggtcgaagacctggctgatgcggtcaagttgactatgggtcccaaggggcgcactgttattattgagcaaagctttggtgctcccaaagttacaaaggacggagtcaccgttgccaagagcattgagttcagtgacagagtcaagaat

SEQ ID NO: 43292 - DNA, 228 bp, Triticum aestivum
  Clone ID: PAT_TA_43292
cgtccgcggacgcgtgggccgtcttgaatcttctgacaccttcgttgtttttgtccataggtggcgattaccctgggtctgcgtcctttctgttactgcctccaggaatgcttgtagtagtaacattggaactaatccagtttcgtctgtttgatctttttaccctacctgttgcccttggtgtacttggaggctcgcttgtaaagaagttgtggtccgggataaaaa

SEQ ID NO: 43293 - DNA, 294 bp, Triticum aestivum
  Clone ID: PAT_TA_43293
cgtccgcccacgcgtccgggccggggtcgtctccttcgacccgtccgggatgaaggtgctgtgggacggcttcgatgcggacctgggcggccggtacttcgacgaggtgctgttcgagcatttcgcagaggagttcagggacaggtataagatcgatgtcgtgggtaatgtgaaggcgagcatgaggctgagggccgtctgtgagaaggcgaaaaaggtgttgagcgcgaatgccttggcggttcgtaacaaatagtgccttatggcagagaaggatgttaaggtgatttttat

SEQ ID NO: 43294 - DNA, 415 bp, Triticum aestivum
  Clone ID: PAT_TA_43294
cgtccgctcctactcttcctcagctccctcctaccaacgcctggtcgtgctccactcccaggtgtgacggtttcatgagctccaggcgcaccaacacgagacgacgaagctgacgtcccgtgctctgtataccttcgtctgctcatgattcgacctcctattactccacaacgacaccaacccatactcccttcccctccacagccaagcaaccgctgcatcaggcacgggtacgcatgccgactgcctgatctggagacgccacgctgggtgttgtagctacggaggtcatcgattgggcgaaggacgcccagtggcagtgggaagtgacccgaggcgaggtggagtcagcaaggcggcagaatggcgagattcgggatcgatggatccgacttccgacgctgcgagcccgtgt

SEQ ID NO: 43295 - DNA, 353 bp, Triticum aestivum
  unsure (1)..(353): unsure at all n locations
  Clone ID: PAT_TA_43295
cgtccgcccacgcgtccgcccacgcgtccgcccacgcgtccggctaaaagagctaaggattcttctgtagtcgacacaacattatgtgagttacatagttctgatgttgagcataacatcatgagccctgggaagaactgtgtaggcaaatcttcgacaggttgttccagtcaaactgcaaatgattttgaagctcccatcgatcctgaagtggaaggtgaaaatggtaaagctgattctgatcctgaaaatctttctgatattgatgatgtggagggtgacgggtatcttcacaacgaggaagaaacacagaaccnantgggtatctgggaggaaatgaacaaagaatacct

SEQ ID NO: 43296 - DNA, 378 bp, Triticum aestivum
  Clone ID: PAT_TA_43296
cgtccgtggtcgcttgtgcgaggggattcacctgcgtgtttgttcaaccctaaccacctgtccgcgttccttgacgagagatgcccactcggcgcctcagaatgacgcgacccctcgcatgcaagtagtaacgcgaaccgagggcatcggagggttgatcgagatggtggcgagggcttgcccttacaccgtgcgctgggcgaacgtcatgaagatggccaggcctgactccttcttcaactgtgcgcgaaagatacagcagggggagaccgccgcattggacgagcgcaccttcgagcctagaaccacgcaagagcggtttcgcaacatccagctccaggaagaacttgctacatatgatcctaaagagaacaggtc

SEQ ID NO: 43297 - DNA, 423 bp, Triticum aestivum
  Clone ID: PAT_TA_43297
cgtccgcccacgcgtccgggacgaagaggtgctcgtctccgagagcatatccgtcggatctccaggccaaaatgccatcattggaaagttggtgctcttcaccaagagcttgccttcaaggtatgaagattgggaggaaggaactaaggcattggttgataaagactgccttgttggtggagggtcagttggcacggtgtacaaggccacctttgagaatgggttgtccattgccgtgaagaaactggagacactcggaagtttgacaacccaggatgagtttgagcatgagatggggcagcttggtaacctcaatcaccccaatctggtcacattccaaggttactactggtcgtcctcgatgcagttgatcctggcggagtttgtgaccaaagggagcttgttgaacaccttcatgggaac

SEQ ID NO: 43298 - DNA, 262 bp, Triticum aestivum
  Clone ID: PAT_TA_43298
cgtccgcggacgcgtggggttgccgcggagcagcagcagcagcagaggggggtggcatcaggatgagcttcagcgttgcgggcatggagaaggagcgcggcgcggcggcggcggtggaggagatccggcgcctaccggcggaggtcaactgggagatgctcgacaagtcccgcttcttcgtcctcggcgccgcgctcttctccggcgtctccgccgcgctctacccggccgtgggcgtcaagacacacctggaggtcgggcc

SEQ ID NO: 43299 - DNA, 410 bp, Triticum aestivum
  unsure (1)..(410): unsure at all n locations
  Clone ID: PAT_TA_43299
cgtccggatttcttcaaatgagagcaaggatcctgatgcttgcagagatctgcaattggtaccagctgatggagcagtaccatctgatggcctaaagcagcagcagattctcaaagctgtggagaaggtcctggctggatcaatcaggcgagaaatggcacgtgatgaacagtgcgcgaagcaagctgtagaaattcaacagctaaatcgtttggtgcaacagtacaagcatgagcgagaatgcaatgctgtaattgcacaaacaatggaaggcaagattgctaggcttgaaagcttgatggatggaactttaccgacagatgaatttatacatgaggagtatctntctcttatgaatgagcacaagatcctccaaaagaaatatgacaaccaccctgaagtcctacttg

SEQ ID NO: 43300 - DNA, 352 bp, Triticum aestivum
  Clone ID: PAT_TA_43300
tcgtccgcatttcccccctcctctcccccttcccttcctccccgcgactccggcgacctccgggctgttcgcccccgtcgggccgcatccgccaccgacctcgtcaacctcgtccgcgacctggggctttgtgaagatgaagctagtgcaggacaatctggctgggacctcgatgttttactttgtgaagatgaagcaggtgcaggacaatcgagctgggacctcgatgttttacccggtcctgcctgattcaatgcatgatctacctgctcccttggtccccaggtttaccacagccaagaagtacaacaggtactatcgggctcgtctagcagcaaggaggtccgtgttt

SEQ ID NO: 43301 - DNA, 353 bp, Triticum aestivum
  Clone ID: PAT_TA_43301
cgtccgcccgctcgaagcctccaaaaccctaccgaactccgccccgccagccatggcgccgccccccacgctccggcccgcagcagcggcggctcctccaggcggcggccgacggcgacctccgcctcttcaagagcatcgcgagcgcgctggacggcgggaagggccgcgtcaaggaggcggtggaggccgtcaggaattgcggcgccggggcgctgcacaccgccgccggccgcgggaggaccccgatgtgcgcgtacttggacgaggagcttggcgtggacgttaatgctgcagacgaccaaggtgctacacctctgacttatgcacttcgttggcgggctgtgggtact

SEQ ID NO: 43302 - DNA, 423 bp, Triticum aestivum
  Clone ID: PAT_TA_43302
gggacgccacgcgtccgcccacgcgtccgctcgttcctgatctctctccccttccggtcctcgcttgctcgtcgtggtcctgccgatcgctcatggattccaagccccaagccccatcgtcggagggcgcggcgtacccactcatgtgctcggaggacctcgcgcctcctgcgtcaactgtcgtggcgcccgcgtgctccaacccctacgtgctgtactcgacctgctccgtaccgcccgccaagagcaccaaggagaatctgtgggagacgctcagctcgcaggcgaagaggttcagagaggccgcgcgcaagaccgagggcatcgacggcgacgtctaggcatgactagaaaactgtgcctagcattacggacgctgcaatggggaggatcgaccaaggatgcaacggcatattgggaggg

SEQ ID NO: 43303 - DNA, 457 bp, Triticum aestivum
  Clone ID: PAT_TA_43303
cgtccgcccacgcgtccggttgttactgatgcagtaaaaagtaacagatatgatgatgaccgcagtgcttttcttcttgtggcattaaaattgatagtcaactgacgcgtgttgagggtcgtgttctgtctgcaccaatgttggttgtgggaaatagtcaagattgtgttccattcaagggcaggtggaattataataacaagaaactatttgagcctgttaggattgagcgttgggcaattgtgaacttctctgctcgttgtgacatgagccggatctcaagagagctgataaactgtggacgaaccaaaggcattatcattgaaggcccttacagcctggtggatgaagataaccaagctaggagatgtgctcccattgtaagagttgaaaggatgttcgaaaaagttaaagcaaaccttcctggtcctccggaatttctgctatgtgttttacc

SEQ ID NO: 43304 - DNA, 459 bp, Triticum aestivum
  Clone ID: PAT_TA_43304
cgtccggcggcatgaaggaggctaatgtcagttgtagtctgttcagacagcaggtttttataagctcgcttgatgatcataattatgctccctccgatgtccatatgtatacataggttgtacattagaagattatgctccaacaaatctccatgaggtatccataggttctagtgagaagagccgggattgcatccctggaaagcacaacactatccaagcacatggtacaaaacaaagtgatctcaaatccaaagttattgtgtattcaagataaacctcagactatgagtgtctatgatcaggtcttctgttgtgcttgcctattcctgcacataaggcaaacatgacaggctttgcatgaaagtaatctggatcgaggtgcaaagccactgaagcagctagtcacatagccgttgcgacgtttataagtaggtgcataatcttctaatgtacaac

SEQ ID NO: 43305 - DNA, 455 bp, Triticum aestivum
  Clone ID: PAT_TA_43305
cgtccgcggacgcgtgggcggacgcgtgggtcacagtttaggtctgaccagcacaaggtggcaacagcagtagtggagaaggcatgaagaggcccacatctgaaaatccgttctgctgaccgataaagggagatggtctcagcatccattgtgacaatgttgtccagaacatggactctggaaactgaaaagtaacagattttgcttccaggcgcacaaaggccaccgatcggatcagcgcgaagaaacctgttcggatcacctcagcaacggatcaacctctgcacctacatccatttcgacagatcattagtcaaagcaggttggtcttttggggttcctttttgtcgctgatggcttgacgcacactggatcatcctatcagaagggtttggcttacctctgtttgagaggagaaatctggagggatagatgttcagggtcgtgatgtgatc

SEQ ID NO: 43306 - DNA, 449 bp, Triticum aestivum
  Clone ID: PAT_TA_43306
cgtccgcccacgcgtccgcccacgcgtccgcccacgcgtccgtgacgccgagatgatgtacgtagattcatatgcaggccgatcgcttgctgaggaagaatggtttgcttattttacttattacctagtacttattaaggggccgtacgcttcccgtcaaaattcgttgggcctctgaaagagacgggttgatcgacggaaccagaatcggtgacgaaatgttcctctccgatcggtcggttgcttttatttttaggctagtgctatctccgtcctggtttattggctttttttataatttgtgttaaattttgaccaagacttaactaataaaatgttaatacatgccaacaaaaattatatcgttggcaaagttttcaatgataccccctccgttttaaaataagtgtctcaactttgtattaagtttaagacacttatttgaaacg

SEQ ID NO: 43307 - DNA, 298 bp, Triticum aestivum
  Clone ID: PAT_TA_43307
cgttcgccctctcctccttccacgcttccctcctcttcttacttgacgcctacattatgtaggaggttcatatacaggggcggcgcttcctgatcaacaatggtttgcttattttacttattacctagtacttattaaggggccctacgcttcccgtcaaaattcgtttagcctctgaaagacacggactgatcgactctaccagaatctatgactaaatgctcctctccgatcggtcggtcgcttttatttttaagctattgctatctccgtcctgatttattggctttgtctataa

SEQ ID NO: 43308 - DNA, 231 bp, Triticum aestivum
  Clone ID: PAT_TA_43308
cgtccgcacagccgtttttctccgactctcccaagctccccgctccccgcatccaaacgccaaaacgcgacaggggaaagcagccgctcgccgcggcgagtcggaccgtcgcgatggtggatgtggagcaccggatggcgggcatggccccggcggcgcacgcggccggcctgtgccgccttgtcactcgcgccgtggtcggccctttcttttcattggcgtccccttacc

SEQ ID NO: 43309 - DNA, 228 bp, Triticum aestivum
  Clone ID: PAT_TA_43309
gggcacactgagaaacgtcgacttttagaagatggtacaggaatcgcagaattacacatcttaggatgacgagcccaagacgaagggtggtggcaagaactccctggagaactacgcctacaacatgaggaacaccattcaggacgtgaagattgacttcaagctggctgttgaccacaagaagaaaattgaggatgccgtcgacaccgcgatccaatgggttgacgc

SEQ ID NO: 43310 - DNA, 402 bp, Triticum aestivum
  Clone ID: PAT_TA_43310
gcctgcactggtcacgcctccaaattcccgtccggacctacccgttcgaccacacacgtacgaccacgcgttcgtccaaaggcactgaagtggagatgaaagatgctgagggggccaaagggactgacctggacctggatatgaaagaagcttacagtgctcatgaagagaagaaagaggaagaggctggaagttctgttggtgagaataaagagaccgacactgttgctcatgaagagaataatgcggctgacactgttgctcatgaagagaagaaagcgggtgacactgttgctcaagaagagaagaaagcggctgacactgctgttcatgaagagaagaaagcgggtgacactgttgctcaagaagagaagaaagcggctgacacttttgcttaagaag

SEQ ID NO: 43311 - DNA, 380 bp, Triticum aestivum
  Clone ID: PAT_TA_43311
cgtccgcccacgcgtccgcccctaccctcgcgtgatcttcttgttcctctccggagtccgtacagcgggcgagaggaacaatccactcgaatcctccctcgctagcagcacaaatccagtccaatccaatgcaccacggtccaaccaaccaccaaatcgaagctaaccacgccggccggaggggaatcaacgaggagaaggaggaggaggaagagtcggatccggtgatcgacgggccacacgccggatgtgcggtgcggatccgtagcgcccgcatagccatggcctcagagcatcttggcgattggttctagctagggtttctatccatcaaccggtcccccaatccctgccatggagcttccgccgctcaagctcaa

SEQ ID NO: 43312 - DNA, 402 bp, Triticum aestivum
  Clone ID: PAT_TA_43312
cgtccgcccacgcgtccgaaaacaacaagaccaagagaggccgcgaatggaacaggaagaagaaggagcagcagcgcaagcggaaggggatctcctccgcgactttgagcgaatcctccatgacgaccccctcatagacgaggtcgggttcctgcatcccacgcagttccactcactactcgtagacagcaccaacaaatccacatcccaatacttctggtgcgcagaccacaagctcgccatcttcttcaacatcctacccgacctttaccgcgccgctcgccgcgcacactccaacgcgacacttaatccctcattatcaccatctgcatccgctgctgccttgatcatgacgcatagcaaggcgctgctcatactctgccctgacttgctcaccggatg

SEQ ID NO: 43313 - DNA, 421 bp, Triticum aestivum
  Clone ID: PAT_TA_43313
cgtccggactgagaatacagcttccacgctccacataaaggagacatgtttagctgccaccattggcgagacaccacctattgtttttggtgaactggatgcctatgtgtagactcctcgtgacctccgtactatcaactatgcctgggcacagcatatcataaaagatgtgaggagaaggctctacacgaactgttgcatgatcaagaagaaggccttaaccaagtatgctctgaactatgacacagatgctatcacgaaagaaacccacatgcagattgagacaataaagaagtatgctactgttgtcacgctcatcgtccataccccaatcaggaagatgataggttcgaagcataagaatgctttccttatggtgatccacatcaatggcggctccattgccgataaggtcaactat

SEQ ID NO: 43314 - DNA, 269 bp, Triticum aestivum
  Clone ID: PAT_TA_43314
cccacgcgtccgccgcggcgcaaaatcccccaccaccgcgaggatgttcccgtgccggccgctggtgtccccgccgctgccgcgggccctcgtcgccgcggcgcccgtctccgtgcggcggctgccgtggccgtcgtcgtggtcgccgacgtcgctgcgcgtggtgcggtgcatggccaaggagcggcgggtgcggatggtggcgaatcagatccagcgggagctggcggacatgctgacccgcgaccccgtgatgcaatgcgccgtcc

SEQ ID NO: 43315 - DNA, 431 bp, Triticum aestivum
  Clone ID: PAT_TA_43315
catatgggtggatggtcaataccagatcctcctgatccaagcatcattagcagactaaagtcaggtggagcagatgcatctgcagcttcaaatgatatgaatgtccctggtcctgcaaagctttcatctacaggtgttaacacatatgccaaaataaggataaatgtggcagaatgcgatataaaagggcatgacaatcctagtggcgagaaggaagctaacgagtcatatattacaaaggggaaagttgaaattccagcaaagactcaaagtaaatcttgtgtccaaactgtaaacatgaacacaggtgtttttgacagaaagaactcgggtgtagaggatgtatctacagtgttaaatgctgcgggatcccccgttctccggagatcagctaggaagacacaagatgctgatggcagtagtagcctcaa

SEQ ID NO: 43316 - DNA, 158 bp, Triticum aestivum
  Clone ID: PAT_TA_43316
cgtccagtcaaaaaatacacctccattaaaatatacatttttacataatacattattaggacctaggtaatttagggtcacagggaacgtaccacttctgcatataagtgaaaacaagttaacatttagatttgtccaggctcatgcctatctgtact

SEQ ID NO: 43317 - DNA, 416 bp, Triticum aestivum
  Clone ID: PAT_TA_43317
cgtccgccctcccgcacccgcgcctcccccacgcccagctcctcccgcctcgcctctctctccctcaaaaccctaacccgcgcccgcctcccagccccgccgccgccgcctcctctcctcttcctcccgcccgcgcctccctgccccgctcccgtccagggccagccccacaccgccgtcatctcgcctccgcgtcctcttccttcctctccctctgctccgcccgcgcccgctccctccaggggcgacggcggcaaggacggcgtgctgcgcccgctccctccgcgaggctgactgaccctgcctcgccgatcctcgcccagtcaccgacccgctcctctggaggcggaggaacgcctcgcgggggatgccatgctcgtgtggttcctcttcgagcacgccgggtacagcctcgc

SEQ ID NO: 43318 - DNA, 140 bp, Triticum aestivum
  Clone ID: PAT_TA_43318
cgtccggactattgctatagcatgggcgtaccgtgctatctaaccaagcggactctccccttcaggcgacggctgagcgtgtatataggaccacctatattgaactccctccgctcctaaatactacgtcattttctaga

SEQ ID NO: 43319 - DNA, 380 bp, Triticum aestivum
  Clone ID: PAT_TA_43319
cgtccgggcctcagctcacgcatggttgcctcagctgcggcaagcaacaccaggggggctctcggggcgcgggcgtgctgcaatgtcgaccgacgtggtcgtcgatgtcccggcccctgaggaggaggggaccgacgaccccggcgtggtgaccacgggcgtggccggcgacggcgacgcgaaaccggccaaggagaccaaggtcaaggggggcaaggccaataagccctccgtccagaggaagccccgcgctaaccgagcccacccgacgtacgcctagatgggttacaaggccatcaccgccctagaggagcggacgggattgagccaggacgccataagcaaggtgcggggagacaagcgcaaggggcacctccccg

SEQ ID NO: 43320 - DNA, 147 bp, Triticum aestivum
  Clone ID: PAT_TA_43320
cgcatcattcatgagcggtgattactggacaatagaaggtatcaactgtaacggcatgcggcgtgacatagagagggagtggtcacgcacgcacacttgtctggagcatactgggcacgtcaataggtgctacacacacacacacgc

SEQ ID NO: 43321 - DNA, 172 bp, Triticum aestivum
  Clone ID: PAT_TA_43321
cgtccgcacccgcaccccaccgaggtgcgagtgagagtaaccctgccccagtcctttccccaccctgcaccgatttgtgtaggaggaggatatggatatggctcttcatctggttagaaattttcccaccaacactgtatgcctgctatcctagccggatggggcgcagccc

SEQ ID NO: 43322 - DNA, 324 bp, Triticum aestivum
  Clone ID: PAT_TA_43322
tcgtccgcccacacttacatgcacccgtacattcaacacatattgacgacgtccacaccccacgttgatttattctcgggcaatcccaccacgcgcgcgtaaataacatccatttcgcctaatttacgccgattcgtcccttcaccccctctccctcattttggatcaggaaagtccgcgcgtgagctagcgtttccagtaaaggtacaagaacgcgtctctaggatcgtgaggcccaactaggaaaaatctggcgatcgttgttggatttcttgatttgcggtgctagtgctgatcggtggagttctgtggctagtggagggc

SEQ ID NO: 43323 - DNA, 415 bp, Triticum aestivum
  Clone ID: PAT_TA_43323
cgtccgggctcgcgtggggccccactcccccaacctcaagatagcccaattctacttccgctcctacgcctcctcgtacttcgcgcagtcaccggagacgccgtcgtcgattcggcagacccctgcgcgggccgcacgatccacatccgtgacttgcccccgcgcattaacacgcacctctttcgccactgcgacaccgccttcccgatcgacgacccgtcctcgtagggcacctccacgccgacctgcgagttgatcggcaaccacgggctcggcccgagcacccactcccgcagctgctcctggtaccgtacggacacgcgcctccttgagcccttcttccaccgacgactcctcgagcgccgttgcctcgttgccgaccctggcctcgtcgacgccgttttccttcagtact

SEQ ID NO: 43324 - DNA, 289 bp, Triticum aestivum
  Clone ID: PAT_TA_43324
cgtccgctcggagtgaagcacatgatctgctgctgcaacaagatggacgccaccactcccaagtactcaaaggcccgttacgaggaaattgtcaaggaagtctcatcgtacctgaagaaggttggctacaaccctgagaaggttccctttgttcccatctctgattatcatggtaacacatcgccatttcgacaccttgttcacgatcgaagacgccttctcctatcgcacttccaaacagttctgcaagctgcttgacaactacgacctccccttttgcatccaatta

SEQ ID NO: 43325 - DNA, 138 bp, Triticum aestivum
  Clone ID: PAT_TA_43325
cgtccgcgtactcgtgtgtcatattctagtactaccccacttcctcccaaaccgtggcccatgagagcgggtccatctctgggggcgcggctatgaaacatgatgttggcggttagtatgactagtggtaggaggttt

SEQ ID NO: 43326 - DNA, 227 bp, Triticum aestivum
  Clone ID: PAT_TA_43326
cgtccggtcgacgtcgccgtcggggcggcaaacccaaaaaaatggcgcctcctcccctacacgacgctcacgcacctgctcgccgaggtggcctcccgcctcgcccgccctcccggcggcgcgggcccctcctccgcggccggcgactcgctctccgccaacgtctcctccctcgcggcggccctcaaccccggtgccggcgtccttgtctcctccggaatccaggg

SEQ ID NO: 43327 - DNA, 214 bp, Triticum aestivum
  Clone ID: PAT_TA_43327
cgttcggccacccaccccgacctccaccttggcggcgcccgccgccggcgtcgccgttcccccgaggaggccgtcgatatggccggtcgtcgccgcagccgctccggaattcacgccagctaggacgacgacggggcgacccttcccagccgccgccgccgtctccgcgccgaggtactctgtccctctgacggacggtggcgataccctgttg

SEQ ID NO: 43328 - DNA, 176 bp, Triticum aestivum
  Clone ID: PAT_TA_43328
cgtccggttttatgtaacttcggccttgcgatctatctagcccaacatccttgggggggcacatggaggtgtcggagatggacaagatcacggaaaagttccacgtgggggtcctactcctcgtcatcgtcggacgtcgaggggaagctcgggtcgtcttcttactcaaggtcaat

SEQ ID NO: 43329 - DNA, 411 bp, Triticum aestivum
  Clone ID: PAT_TA_43329
cgtccgcccacacgtaactgcactgctgggcttcctccgccgccgccaccttagggagcctcagggatgctatagaaaggacgataattcactctgcttgatgtgcatatctgcgccgattattacaaccggaccttgatactaacaaggacaactttcagttattcgcacaagaaccttcatggggaaagcttagctcataggcggcgaactttttggaggtaggggatacgaagacttgtattggccaaaaagatggaagcgccatgggaagcaattgcgatcaacagtctcagccgatgcataacagagctggggcgggctcccaatagagaaatttggtggattataagactattggaggggaccattcaaggattacgatatccgaatgttatgacaattgcccta

SEQ ID NO: 43330 - DNA, 340 bp, Triticum aestivum
  unsure (1)..(340): unsure at all n locations
  Clone ID: PAT_TA_43330
cgtccgcccacgcgtccgcacccatggtggtattctaccatatgtcatcataaagattgcagccgggcaatagagagatgattgtgacgacnaggcaacttgtaattgttgtaaacagtttgtttagcaagtcgtgtttgaggagtaccccctcaaataacatctgagatgtctgcagagaactcggaaattttgagcgcgtaacacgctaggttttcgtttgaaggcactatgttaataatatgcctcacaactgatgagatgcttttgcatattgtaacggtctatgaacaatgaggtggaatcagccgaaggaatgtccacattgttttctcaaaaa

SEQ ID NO: 43331 - DNA, 430 bp, Triticum aestivum
  Clone ID: PAT_TA_43331
cgtgcgaaaaaatgttcatcttggttagatgaaccaaatgggctgtgtagttcttctgttatttgaggaggcacctgaaaaaagtaaacagaataaataagatggcagtaacaaccgggttgactttttgtaattttctgtgtacgattgcagtaccttttgtaagaaaacacatggtactttgtaaaaaaacattctgaatctatttggactgaccgttcagttggcagcgttcatgctgctgcaaatgtggtcgttggggccagtcaattggaagatctgtagctcctcagtccaacttattgcttagctaccgaccactcaaaaaatagtagcatgcatgccaccccgtgctccgccccctgatccggcatttttggtatgaatttgatgaatcttcttcatgctctgttcttatccatctagagat

SEQ ID NO: 43332 - DNA, 322 bp, Triticum aestivum
  Clone ID: PAT_TA_43332
cgtccgcggacgcgtggggaaaaatagatgaatcttttgaagaaaacctctatgagggttgtataggacatattggagcaaaccaaagcgagtacaacacccctcttacatgtatcttgtagtactaatagcctaggatacgtgtaccggacctttgatgtgtattactattacatatggtatgggccctgactggtttttggtgaactaactggccgtactgtgagtttgccgtccaactatacattggaatttagtcgctcaatgacagacacatattattctttgaaaataaacagaaatctactcagtggttcatgga

SEQ ID NO: 43333 - DNA, 355 bp, Triticum aestivum
  Clone ID: PAT_TA_43333
cgtccgcggacgcgtgggcggacgcgtgggccccatcgtccctcccacatcgccgccaccaaccaggtcctcgccgggcctcctgtcattgctcgccattggcccccccccttctctcctctcacctcgcagcaccagtagctaccagatccgccgcatccctcacgccgcagccaacgcccgccggttccggtgactccaccaccgcgcaacacatagatgagctgggctctgacccctcgtcctccaagccagttggatccgccgcacccgttcccctgcgctcgcctgtgacgcctaacctgtggctagggtttcggctgcagatcgcgtccatcctcgggacgtttccggc

SEQ ID NO: 43334 - DNA, 378 bp, Triticum aestivum
  Clone ID: PAT_TA_43334
cgtccggtggtactgtatcttcatcatatcagactgcaaacagcgttcatacatttggcaggcaggtcctgaagaggaagaatattgctctcaacaatgagactgtgtgtgttggccccatacgcaaaatgcaccaaagatataacagagtatcatcactctcggaaacatggcctggttatcgtgagtatcctgctagtgatgcaagcaaactggatgaaggtttcgaacactccacacaaactcaaaagcgtctgcgtctggctgaagttgatgatggcactctacgtatctgtggcaacagtttttgttaagcaccagctcattcaactgagatggccgcatagatattgaaacagattgatacatttagttcct

SEQ ID NO: 43335 - DNA, 278 bp, Triticum aestivum
  Clone ID: PAT_TA_43335
cgtgctgccgatcacacactctctccttgccgccaagatgttcggtttcgggcaccaccacaagggccaggggcctacggcgttgggccccaaccaaatcttcaagatctactggcgggccttggaggactactgcctctccgtgcgcgacggcgagggggtgctcgtccccggcgaccccaaaggcgagacccatctcttgttaaggacatgcgctttaacaccaccgttaaagacaaggagggcatgcccgccttctcgctcgttaacaagggcac

SEQ ID NO: 43336 - DNA, 339 bp, Triticum aestivum
  Clone ID: PAT_TA_43336
cgtccggtaaagtaactagtggcaagtggtactgtaaaacatcacatcgtctcaccgggacggggttctgccgagccggtcgatcgacacggcagccagcatgaaggcgtcctgcttactggtcgtgcttctgctcgccgtcgccacggggagcaggctctcgctcgccgcccgcgagggcagcaccctgggcggcgagctcggcgagctcatcgtcaaggccggcagcttccttacgtctgcacgccgtgcggtagcagacggttggcacttccacactgccgaggaggtggacgcctcggcgaataaggggcacggccatctcggcggggccgagga

SEQ ID NO: 43337 - DNA, 307 bp, Triticum aestivum
  Clone ID: PAT_TA_43337
cgtccgtccacgcgttcgttccaacggcggcaggctttttattgggtttcaaacccaaccaattgcggtccaaaatttcttccagtctcggttttcccaatggggcaatcaccacaggcccggctggccaaccccttattcccgtgcgccgtccttctttgtgcccgatctggacgcccgtagcttccgtgcgctcccctggtcgagagggctcacacgcaccccatatggctctctttgtgctttcgcgcgcgtccgcgattagcagcaccaccggagttctccttggcgtggggcaccaccacca

SEQ ID NO: 43338 - DNA, 273 bp, Triticum aestivum
  Clone ID: PAT_TA_43338
ggagcaaactgcatggttttggtttatatgggtggttcacatctgcttctttttcgaagagctctttttcggagagctcttctttgatgctgcctttttctgtggagacaccaccggctcgaccttttcagctaggcacttgttgcaaacatagacggtatccacagcacctctaggaacgttgaaatgttttctatggaaaagtgcttcacaatatttgcagttcacagcttccctggcaggtactggtttgaaacacttgccgcaaagcct

SEQ ID NO: 43339 - DNA, 439 bp, Triticum aestivum
  Clone ID: PAT_TA_43339
cgtccgcataacgatgtaagctcttgctatcatttcgtaaatgtttgctggaagcaggggatcaggtttaatatagggtcgaagcataaatttctagagaggcatgcttggtacgttaaacttttaaagaagcttaatatatctacttgcatcatctgtgtttcctttctcctcgaagaatgatgcaatggcctcaaccagtttgagtagaggtctccaatggcagctattcattaaagataaagctctcttgatggcattgacagccttgtccatatgcctactctgaacaagtgcctcaatcaatatctcccacgtcttgtagattggtcgtgcacctttctccagcatgtgcacatgaagcttcttagccttttcaatccacccattccttacataagcacctcaaagaacatttgaaacccgacatcatgcttcc

SEQ ID NO: 43340 - DNA, 315 bp, Triticum aestivum
  Clone ID: PAT_TA_43340
cgtccgctagagtctttcatagagcggatccagagagtgctagggtttctctctcgggcggcggggagggcgatgtcgatggcggcttcatctatggcggcgacgctggccccggtcagggcggcggcgcggttcgtgcagaccaggctccgctcctccggcaaggtgctcatcgaggaggagagggccgccgagaacgtctacatcaagaaaatggaacaagagaagcgggagaagctcgcacgcatgggtcccagcgcaggagagcaagcttcgttcaccccaagcgccggatcaatcgatgtgagttcgacc

SEQ ID NO: 43341 - DNA, 441 bp, Triticum aestivum
  Clone ID: PAT_TA_43341
cgtccgcccacgcgtccgcggaggagcaccgctcgactctttgcagcctctgacaaacggcgcgggcgacggcgaggatctccgggcgaaggaagccatattttcctttgatccgctgggccccattctggtcgcagagacctgtcacttcttcgagcattagtttttttcctgtgactctccgagcgggctccggagcatcccttggcttggctgtgatctccagttgtctatttggtggacaacaccatttgcaggtggtgaaagcatgaggttgtggtctctccttcttcttgtttgcttgcctacgctgatcgtgtcggaagattactccgatgtaaccgtcatcgtacggggctccaagacgatcgctgcgaccagtgatgagtttatttgtgctacccttgattggtgggctccggagaagtgcaactatgatca

SEQ ID NO: 43342 - DNA, 406 bp, Triticum aestivum
  Clone ID: PAT_TA_43342
cgtccggctgccgcctcgtcctcgtcgtcgccgttgtcgccttcctcttcttccgcccctaggtggcccgggaggaggcggccgagtcgccatggaggcctacaaggtctgggtgcggaagaaccgggacctcgtccgctccctcgagtccctcgccaacggggtgacgtggatacttcctgagcgcttcgctaactccgagatcgccccggaagcaggtgatgcaagtctttcaataggagtaacatttagtcccactccacgtttttttggtctgaatcttctatcatcggttgtatatgcacttctgggcattgtaagttctgtcaaccagcatataattgagacaccaaatgatggtcactcactggccctcaaggaacaatctatcccatgggctcttggt

SEQ ID NO: 43343 - DNA, 412 bp, Triticum aestivum
  Clone ID: PAT_TA_43343
ctgcagtaccgtcctaattccgtgggcgcaggtgcgatataagtaaagccatactcctttagcaggcccatctttagatgggttgggggggaaaggcattaaactaattgggccataggggcgaaccaacctgtggttggatggttagaggattatggtatcccagtccatcagggtcaaatcttgatactcgcatttattcttagatttatttcaggatttccggcgatgcacattcagtgggaggagacgttcccgtcgacgacgaggtgtctacagtgactttgtaaatttcaagatgatatgccggctcagtctttctgaggtgctcataaggatagggtgtgcgtgtatgcgttcatagggtaagtgtatgcgcgtgtattatgagcgcttgcgtctatacttggtt

SEQ ID NO: 43344 - DNA, 299 bp, Triticum aestivum
  Clone ID: PAT_TA_43344
tcgtccgcccacgcgtccgcggacgcgtggggagaagttgtgtcgccgactgcagtagccaggagtggtgttggtgatgtctgtaggtatttttgtgcttgccagttaaacaattccaggttatgggattggatctccattttccaagattcttagctgataagtatattatgcgggaaaatctctacgtactgatgttgtgcacatccaaatacaagcaatcgaggaagatttcatccttaaccttcctcacgaccccaggttggggtcatggctgtaagatatgggtttgggatcta

SEQ ID NO: 43345 - DNA, 424 bp, Triticum aestivum
  Clone ID: PAT_TA_43345
cgtccgaaaaatcgcttcctccgtgccctgctccgtcagagaagaggggagggtcgaggcagcgctgtcaacgcggcggcggggggtaatcgggggccgtcgtagacagctcacaagggcgccggagaccgggagcgcgcgtatgctgcggctttgagacgggcccacctggcagccgcctgcgctcggatggctgcgtcgccggagatgctgcggaggtgttggtgggcggcggcggcggtcttgtcggcggtgctgaccgtgagccgggtctccgccaacacagagggtgatgctttgtacagtctgcgtcaaagccttaaagatgctaacaatgtgctgcagagttgggatcccactctggttaatccatgcccatggttccatgttacttgtaacactgacaacagtgtaatcagagttg

SEQ ID NO: 43346 - DNA, 404 bp, Triticum aestivum
  unsure (1)..(404): unsure at all n locations
  Clone ID: PAT_TA_43346
cgtccggcaccagcagcctcctcccatggcgaccatcacctgccacctgccccctatcctccctggcccaggctacgggcaccatcgccacctcaagccctccccgccccccttcaatcggcacctgcgcgccccgcctccgacccgtctcctccgcgccgcccgccgccgccatcccgacgccgtcgtcgtcgtcccagacgcgcgcccctgggtcggcgacctgtcaggagccgcctcctactgggacgggagggaggaagatggggacgaggaggaggacgctgacaacgactaccgaagnctggacctnctggcccagttcctggactcggtgtgcaggaaggactaacgccgcgcgcgccaaggcgccaggtccgtgctgccgcccttcgtccccagtg

SEQ ID NO: 43347 - DNA, 417 bp, Triticum aestivum
  Clone ID: PAT_TA_43347
cgtccgcggacgcgtgggccgccggatagataatcccagcccaaacccaaccagacccgatccccgcgcgcattccccccgctccccgccccggatccgaccgtccgtccaccaccgaccgcgccgcgcgaccgccgggggagagaggttgagcatggcgagcgggggcaggacggatctggacggcggcgccgtggcgccgctgaccatctgcgtgatcggcgccggcggcttcatcggctcgcacctctgcgagaagctcatggccgagaccccgcacaccgtcctcgccgtcgacgtctactgcgacaagatccgccacctcgtcgacccgtcccctccccaccttgccggccgcatcgccttccaccgcctcaacatcaagaacgactcccgcctcgagggcctcatcaagat

SEQ ID NO: 43348 - DNA, 311 bp, Triticum aestivum
  Clone ID: PAT_TA_43348
tggggcacgcgtccgttttagaggctgctcatgttcggaaggagtatgatgatgctagctcaaagctgtccaagattcaatctaggataacctctctgacagataagctaaagcaagactttggtaaggagaaggagttctattacttttatgaccagtgctttgagggcaaggagggcaagtatgtttacaaggtctgtccatacaagaaagcttcacaggttgaaggacacagttccactaacctggggcgctgggacaaatttgaagaatcctacaggatgatgcgcttttcaaatggagacaaatgc

SEQ ID NO: 43349 - DNA, 325 bp, Triticum aestivum
  Clone ID: PAT_TA_43349
cgtccgcccacgcgtccgggatgttatggctgctccagggactctcattccagcagatgtctttaattcaggagggtactccattcaacttcagtcaaacattgggtcagaatcaggtggtggagtcagcaagtaacatcgaagatgacccagttgcattacagtcagagcataaacgtaaccaagggcatatgtttgccaataataatcggatctcagtcaatctatcaagctatgagaatacaatgaccggtggaagtagtgctagtgaacctgggacattggaccctatgatggcattagggaaaacatcaactttgcctag

SEQ ID NO: 43350 - DNA, 184 bp, Triticum aestivum
  unsure (1)..(184): unsure at all n locations
  Clone ID: PAT_TA_43350
ggcgggctcccacgcgtccgcttacgcgttggggaattcgcggtatctctgatatcattacacctcctgggagggttaatgtanatcccgctgacccaccagccgtaatcgagccagcgagagggccgtttagcgggtgtaaggactccaacaggaacatggggcagcagtcgctcatctactc

SEQ ID NO: 43351 - DNA, 375 bp, Triticum aestivum
  Clone ID: PAT_TA_43351
cgtccgccactttccaccactttcaaggaccccagtgccgcaatccccttctccctggtcgccggagaagctttcttcctttcgcagacggccggcgctgcgatggcgtgatatggatcttgtaaccgtggactgagttgattggatgattgcgttttctctcgttgccgcggagcagcagcagcagcagaggggggtggcatcaggatgagcttcagcgttgcgggcatggagaaggagcgcggcgcggcggcggcggtggaggagatccggcgcctaccggcggaggtcaactgggagatgctcgacaagtaccgctttttcgtccttggcgccgcgctcttctccggcgtcttcgtcgcgctctacccggac

SEQ ID NO: 43352 - DNA, 399 bp, Triticum aestivum
  Clone ID: PAT_TA_43352
actgccgcgaagtcatcataaccacaaacagatgcagttgctgatcagccgtctgaccaggtattagaacctcaaagtgccggattagtggaggaaccagtagtccatcaaagtgacacatctactagcaagccacatatgtctcagggcgaggcggccgctggtgaatcatacagacccgcatacgagtctaagaacaatgcatacctcggagaaccctcacaacctatggttgacgcacttaccgaggagcgaccagagggtcagatcgatgcaggtgctcatgatttaactggagcgacattgtaacctgaaaaggataggcggattgagaagccaatggaagctgctacttacgttgttgctgataatgcatctttacgcaggttagacactgaa

SEQ ID NO: 43353 - DNA, 215 bp, Triticum aestivum
  Clone ID: PAT_TA_43353
cgtccgggttagactagggtcaccaccatggccgtcgtcctcgcgcgccgcgccgccgccaccatcccccagcacctcgccgtcggcggcgtcaccgtcaccattccccgccacctcgccgacgcgaccgcggctcccaccatctcgcccggcgttggcgttggcggccgctaccgtttcgccggcgcgttcctccgccgacgcggtcaccacac

SEQ ID NO: 43354 - DNA, 402 bp, Triticum aestivum
  Clone ID: PAT_TA_43354
cgtgcgcccacgcgtccgcccacgcgtccgggaacgggaaggttgcctacattggcactgagggaacgttccggcctgaacgcattgtgccaattgctgagagatttgggatggatgccaatgctgttcttgacaatgcatggctccttttacatctctcttaacccatttaaggaagaatagataaagatctttgtttaattcgtgatctttctgttttagatcatatacgctcgtgcatacacctatgagcaccagtacaacttactcctgggccttgttgccaagatggctgaagagcctttcaggcttctgatcgtggattctgtgattgcgctattccgtgttgatttcagtggcaggggtgaacttgcagagcgtcagcaaaaactggcacaaatg

SEQ ID NO: 43355 - DNA, 462 bp, Triticum aestivum
  Clone ID: PAT_TA_43355
gcgggcacgcgtccggcgcagctcgccggagagagaagcgaagatgtcgggccgcggcaagggagggaagggcgtcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacacggagcacgcccgtcgcaagaccgtcaccgccatggacgtcgtctacgccctcaagcgccagggccgcaccctctacggattcggcggctaggccaagcgaatcggcccccgccatcagatttgtgctcgtagctagctatggttgtgtagtgttcatggtcttcggtgtaatggccgcatctcgctgctgtatgtctt

SEQ ID NO: 43356 - DNA, 401 bp, Triticum aestivum
  Clone ID: PAT_TA_43356
cgtccgcggacgcgtgggcggctcagctcctacaactccgttcccagcgcacctttcgtcgagcacctggcaatggcggcttcctccccgtccgccacctctcagatgcgcctaagccctctccgtccttattaaagaccaccgccgccgccgctttccttctatccaactcccgcaaatccctacctaccccgcgcgcgttcgctcgcttgcgcccgaactgcccgcatctctcgcggacacagacccccgttccggtccttgcctctgccgtttcgtggctagtggatgcccctgcccttcccctcccgcgaatccaggtgattcgcatcaccttcgcgtcgtcaggatccagttcgtgcgcaatgtcggcagtggcgccaccgctgcgcacttggatc

SEQ ID NO: 43357 - DNA, 395 bp, Triticum aestivum
  Clone ID: PAT_TA_43357
cgtccgctccctgccactctttgacccctgtgccgcgtcccgacccccgccacccacctcgctggactgcacgctcgtcactccctactgagatagcacagtggacagcggcgtcggtggtaggagtgtgcaagcgcgtgcgacgaggggtctggagatgtcgccgccaatctcgctctgcgtcttcgtcctcctctcctccctcctcgcggcggccagggccgaggacccctaccgcttctacacctggaacgtcaccttcggcgacatctacccgctcggcgtcaagcagcaggggatcctgatcaacgggcagttcccggtgccgcatatcgacgccgtcaccaacgacaacatcgtcatcaacgtcttcaacaacctgcccgcaccattcc

SEQ ID NO: 43358 - DNA, 237 bp, Triticum aestivum
  Clone ID: PAT_TA_43358
gacccactcgtctcattatatgaaaatttttttaacctttattctactcgcataattacatcctcgctcattgcgacattgccttagcgcaacacatacctcacaaatcacatttcttgtctcatattatcttgccgtgctttcatttgtctcgaggcaaaacccaccataatctcactatccattcatcaatcccagcaaatcaatgtcaatggcaccctcatcattccatgtttt

SEQ ID NO: 43359 - DNA, 450 bp, Triticum aestivum
  Clone ID: PAT_TA_43359
cgttcgatcagaagcgaggcccttgctgctcgtgtctccttgctggtggcaacccgaccttcaggttgccagcgacaggcaggaatccggtcagtggccgccaaataagtacaggttacggaagagacctaagtccgaccaccgcccaactcccagctactcgctgcaattcccacatccacctcaaatgggataagcgctccaggtgaggcgtccccggctaggagcagatctggatcccatgggtccacctctccccgttcgttggatctttgccccccagccgtggccactcctcaggtttgctggctgatgtcacgcccgttccaaggcaggtttttcccaggggaacctcctggggtgtgtcctatgaggtagaagattcttgctcggttccttgtgtttgggatgatccagatgagatagtgcatcagttgctcacacgaagaa

SEQ ID NO: 43360 - DNA, 370 bp, Triticum aestivum
  Clone ID: PAT_TA_43360
cgtccggttttcttccggccctcatcgtctattcttctcctttctctgggttttcttccagcggtggtcgtgcatccgtgcgaatcctcatgtcacgctacctactactagacgatagatctgagatctgaaattactctcctagtggatggcatgcggtacatttgcacaccacgcgggcgccttctccgggagcgcgcgaccggaggccccctagactgcgaggccgtattactcgaccgcgtatctgcggaggtcggggtcgaatctcgacacgacagcggtgaggacctcctagggatcctaaacccattaaggcgcctgcagaagctggtttttgagtcgcggaagccctatcggggcttctgtg

SEQ ID NO: 43361 - DNA, 243 bp, Triticum aestivum
  unsure (1)..(243): unsure at all n locations
  Clone ID: PAT_TA_43361
ccactcgttcgttcttatgcttacttctactacattattgcttcctctattgcaatnaaaagcgacctggggcaaggaatctggatcttcctcttccataaaatctactgtgtccctcacaagaacggttcacgcccaccttactttttcaagagcagtgttgctgtttcccgcaacatcctccatgagtttcataatatggtcatcattgttttctaccccaaaggtgtaaagctcatcacc

SEQ ID NO: 43362 - DNA, 301 bp, Triticum aestivum
  Clone ID: PAT_TA_43362
cgtccgcggacgcgtgggctgtgctgcatagaactatggtgaagtcgtcaacctggggctgtggatggacaaggcggggaatctttctcttgggtttgggtacgttgagtttaagatgagagctgatgccgataatgcgcttttttacatggacggtgctcaaattgatgggaatgttgttaaagtgaagttcgtgcctgcaccggtccaaacagctgctgctgcttttttgtccaaggctttttccaatccttcaaaaagaaatctttatgagactgacacattagtttctttcctttgt

SEQ ID NO: 43363 - DNA, 425 bp, Triticum aestivum
  Clone ID: PAT_TA_43363
ttattagtgtgtttcgctttactcccgctgcacacagttccgaattgccgaggcggcccacgcgtacgcggacgcgtggggcgtcggccccgcggaccacctgcgctccttcaacatggccctcgtgctgaaccagtcggcggtcgggcagggcatggccgacaaccccatgaacgccatcttcgtgccgtcgccttcccccgtcgaggtctccctcatccaggtcgtcggcatcacccagttcggcagctacatcgagggcgccagcggctccaactgggccaacccgcgccaccagggctccggcgggaaccggcggccgccccgcaactttggcatgttctctccacagactgagcagctggccacggtgcccccgaagcagcgcactgccgaggctatcgcgcgcgcggcggacgcgatga

SEQ ID NO: 43364 - DNA, 267 bp, Triticum aestivum
  Clone ID: PAT_TA_43364
cgtccggagaaaaggaagagcccattgagtgaagaatcaagctcatgtgctgcagtgaaggacagggcgagcgacaaaccaacactgtctgtaaaatgcacagagaaaaatatgaacgagaaggatgacttccatacaagcttggataagtttgatattccaaatatcggtgcacatctagatgaaaggtcagaattcagggatgaagaagaataccacaaaagagcaatagaccggaagaatcttgaagcagattattggccagac

SEQ ID NO: 43365 - DNA, 272 bp, Triticum aestivum
  Clone ID: PAT_TA_43365
cgttcgcggactcgtgggagcatgcatatcttcaggtcgatgctcttgggagagtttctttctgtgccatgcgcaagccccgggctcttcttgaatttgacaatcctttgtcaggtgagggtcctcatgatcagaattcttccgtgaggtccctggagaaagaacctatgctagcagccagggtcactgttgaagatgccattggtcttcttcttgaggtggatgatattgacaggctcctgcagtctaaccaggcacaggagaatagcttt

SEQ ID NO: 43366 - DNA, 353 bp, Triticum aestivum
  unsure (1)..(353): unsure at all n locations
  Clone ID: PAT_TA_43366
tgtcctcccactcgtcctcaccgtcgccgcacacaccggacctcgagagtcctcntcggcggaggagaagcaagcatgatggccggaatgaatgcctgctacaggaagaaggcggtgaccaggtccgtgaaggccgggctccagttccccgtcggccggatcgggcgctacctcaagaaagggcgctacgcccagcgcgtctgctccggcgcccccgtctacctcgccggcgtcctctagtacctggccgtcgaggtcctggagctcgccggcaacgctgccaatgacaacaagaagacccgcatcatcccgcgcgcacctgctcctcggcgttcgcaacgaccatgatctcg

SEQ ID NO: 43367 - DNA, 422 bp, Triticum aestivum
  Clone ID: PAT_TA_43367
cgtccgcccacgcgtccggctttctgcccagcgtaagaaacgacaggtaccaccaagtttggcgtgaattgatgaactggagagatatactcagatctctagtcatccactccacaagacaaataagccaggcattttgtctatggatatccatccgtcaaaggacatagttgcaactgggggtatcgatacgaatgcagtgctatttgataggacatctggtcaaatcctgtgcacacttgctggtcactccaagaagataaccaccttgaaatttgttccacgggatgagctcgtggtaactggatcagcagataagactgttcggatttggcaagggggtgaggagggaaactacagttgcatccatacattgaaagatcataccgccgaggtcgaagctgttactgtgcatgcgactc

SEQ ID NO: 43368 - DNA, 321 bp, Triticum aestivum
  Clone ID: PAT_TA_43368
acgcgtccggttcgctggcaagggcagtcttcattttgcatcggaggttgatttaaaggatgggttggggatatcctcgggttgggttggcattttcgtttccttaggttggaggaagcttcatgctgaagcagttgggggtagcgtttcagaattgctgatgggaggcaatacaagtcactgaagacagaagtgttcaattgctaaggttctgtatggtggagatgtcagcataccctatactaattgtggacagctgtggccttagtgttcacactaaacacatatactttgagcactcaccttgggggatctccaccc

SEQ ID NO: 43369 - DNA, 326 bp, Triticum aestivum
  Clone ID: PAT_TA_43369
ccgtccggggagcctcatccggtgcgattgatccactctgaggctctcgacatcccatgggatcgcggcgtcttgccattcgggaatctgtatagatttctggtccgggttgtgggcaggaaagtctgtagctgaatctctgatccgacaatgggtctcgacatggactactacatggacccctacgaggaggccgaggccgaggcctcctcggaggccgtctgcgtgaccggcccattctctctatccgcggacgaggagtcggacggcgatgacgactctgaggcctagagcaactaccaggaggatgcctacgggcttttcat

SEQ ID NO: 43370 - DNA, 282 bp, Triticum aestivum
  Clone ID: PAT_TA_43370
cgtccgcggacgcttgggttttgctggtgtaattgtgaatctgctgtttcatgtatcggaggagggtatttatttatcggggtctttcttcttactaaatcttttttgtgtatcaaatacatacctactgctttctattttattttagactgtgccaggggtaattataaattctgctattgtgtctctatctatttatgaattgacgcccatttacatgtttatccgtatcatatttattttattctatataccatttacaacatctgttatttttcattc

SEQ ID NO: 43371 - DNA, 399 bp, Triticum aestivum
  Clone ID: PAT_TA_43371
gggacgccacgcgtccgctctccttcccgtcgcagatctcggcgacctccttctcctactggctcgtcgaccggggcgtcggcgtcctcctccacgctggagttcggcgactcggagcagccggccgtcaccgcgccgctcctccgcagcccgcgcaccaacaccttctactacgtggggctttcgggcatctccgtgggcggcgaggccctctccatcccgtcctcggccttcgccatggacgacgcggggtcgggcggcgtcatcgtggactccggcacggccgtgacgcggctccagtcgggcgcgtacgccgcgctccgcgaggcgttcgtgcaggggacccagtccctggcccgcgcgggcggcatcttgctcttcgacacctgctacgacctc

SEQ ID NO: 43372 - DNA, 296 bp, Triticum aestivum
  Clone ID: PAT_TA_43372
cgtccgctgactcgtgggctgactcttgggctcctatctccgcatcctccaccgaatccaatagaggaggggggctaaaggaggcgcggcggagatttctgataataatcgcgcccccggcccgcgcaaggacgaggtggtgacccgtgagtacaccgtcaaccttcacaatcgcctccatggatgcaccttcaagaagaatgcgcctaatgccatcaaggatatcaggaagttttcacagaaggccatgggaaccaacgatgttcgcatttgcgtgaagctcaacaagcacatct

SEQ ID NO: 43373 - DNA, 191 bp, Triticum aestivum
  Clone ID: PAT_TA_43373
tcttccttgccctaatagagctctctcaaccctatcttcttcgccgacagccctcctgggctccgggactccttgcgcgggggcccttcacatctactcctcatcccacatttctccacccatcacctccctctattacctttcattaaaataccatattttcctcctacaacaatatgtctcttccttta

SEQ ID NO: 43374 - DNA, 405 bp, Triticum aestivum
  Clone ID: PAT_TA_43374
cgtccgccaaaaactagggttagggttagggaggcggcggctgctttattcccgatgccgatcggcatggacactggaggcgcgccggagccggagccggaggaggagaccgtcgtcctccctcattgggtgatgctggaccgcaagggcaacaccctctgccacaacagtctagaagctgctcgtgtggctgtcgacaaggacaagaccgccgctccggtcgacatggacggcggcccctcctgctacgtggccttcaccctcgcggctcctcaaaaagggatctcctgcctcaacctccacttgccggagggacctccaattgccttagacaccccgcccgcctatgccttcctccgggcaaccgacaacaacctcgttctctttgacatctccaacccgcag

SEQ ID NO: 43375 - DNA, 390 bp, Triticum aestivum
  Clone ID: PAT_TA_43375
gggcgaaggctggatctgttctcaaaccctcctccgtccgtcgcagctccagatttccttccccatggctccgagcaagggcggtatcaacggggggggccggatcggcaggcttgtggccagggttgcgctccagagccccgatgtcgagctcgtcgccgtgaacgaccccttcatcaccaccgactacatgacctacatgttcaagtatgacactgtccacggacagtggaagcaccatgaagttaaggggaaggactccaagacccttctcttcagtgagaaggatgttgcttgggttggctgcaggaaccctgaggagatcccatgggctggtgctggtgctgaatacggtgttgagttcaccggtgttttcaccgacaaggacat

SEQ ID NO: 43376 - DNA, 391 bp, Triticum aestivum
  Clone ID: PAT_TA_43376
gggagcccacgcgtccgcggactcgtgggcgcatcatccgccgccagcagctgcgcaaaggctcgacaaaccctagccctagggcatagctagcttaggttccttcctctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccggcaagaaccaggtcgccatgaaccccatcaacaccgtcttcgatgcgaagcggtttattggcagaaggtttgctgatgcccctggccaga

SEQ ID NO: 43377 - DNA, 328 bp, Triticum aestivum
  Clone ID: PAT_TA_43377
ggggagaagctcctggatgacgacggcgtccagtcttgcatcgtgacctacgtggtgcgactttacccggcgcggggtggctggcccggggcatcgtcagccggctcgacaacaatctgggcgccatcatcgtcaagctgaagaagctggggcagaccactacgtgcccggcagcgccaccggccggccttagatgcaactgccaggaggcgggatcgaccagaattaaacatctgaattctataaggacgggcacgtaccagcactgtcaccattaggcggatagagaataccgttctgtgggaaacggagggtacagacttgagag

SEQ ID NO: 43378 - DNA, 323 bp, Triticum aestivum
  Clone ID: PAT_TA_43378
cgtccgtgaatttatataacattttcagaagcaagtctacaacatatgcttaggtcattcctgagtactgggttctatttgagttactatgcctaattgatatactaaatattgcatcttctcctatgacatgtagttctgcagttgtgtccatttcacctgctctttaatgatgccatcatgattcctccttttcttcgcttggtgtatgtttattcaatggtccagttggtgttccaaaaatatgctcaattgttatatgtatcaaatacagtctctcccgtggtggacattaatgtctctccctatcttgaccctgcatt

SEQ ID NO: 43379 - DNA, 318 bp, Triticum aestivum
  Clone ID: PAT_TA_43379
ccggtccggaatggccggggggagccactcctccgtgcatatccaccttcaattcctgcagagcgcctgcctgcctacaaatctaggggggcggggatctagaggcaggcgcaggcacacaataaggcccccctgtcgatgcccatgttgggaaaggccgtctttgtgctctgcgccacgcagcttcttcgcgggggtgctgctcaccggccggatgactgggctgtcgccttctgggttgggcagccacggtggctccaagatcgccctattgttcgacgacgactgccagcacaggcgtaagctggaagaagagag

SEQ ID NO: 43380 - DNA, 355 bp, Triticum aestivum
  Clone ID: PAT_TA_43380
cgtccgcccacgcgtccgcagggttttacccgttcctctcctccgccatcccccgtccggccccggcgagagctcgggcggcgaggccctcctccgccctccgcccccttcccccttcccctgcccggaggccatatcggatcggcgttcccccccccctcctccccgtgacgggcttctgcccctacccaccggccccgtcttaccagacgcgggtctgaatcttcgtcccctgcctgttggctccgtgcgcttcatcgagcgctacgacatttcactgcccccctttctccctgccggcagtcttttgccattgggctccaaaggccaagaaatggtgttccaggaagaagtc

SEQ ID NO: 43381 - DNA, 410 bp, Triticum aestivum
  Clone ID: PAT_TA_43381
gggagccactcgtccggcattcttgagatgttcagtggcgttcagccttggcgtggcaaatcaccaggggaaggggatcagtgggttgggctgaagaaagagaaaccgatattcccatacaacttacctgcagagggtgagaatgtcctttctagctgctttgagtacgactttcgggatcgccccttgatgtcagatatcttgcaagcatttgaaagtgctaaagatggggattatgacaacaatggctgggataggtctgaaaacccaatggcagtagtgccaagtcacactaattggtcacactttaaggataagctgcaagttggtgacaaggtccgctcgagaaaggttaaaaactcttgtactcctgaaacaatggaaattcctgatggaaccatagttggcat

SEQ ID NO: 43382 - DNA, 395 bp, Triticum aestivum
  Clone ID: PAT_TA_43382
cgtccgcatgcttacgtgctcaagaccagccttgggtctttggatgtgtctgtcggggactcggtggtccatctttattccaggtttgcaagaatggatgacgcgtgggcagtcgcgacaacaatggcctgtgcaagggacaacctcacatacacaagccttgcaaaggggctgaatcagatcggccttccaagcaaggcccttgagatggtagtccacatgtttcgtgaggaggttcgtatcgacggtttcagtctcgcctgcttactctctgctgctgcgaccttgccatccatagagcctgggaagcacttgcactggtggtcgctgaagttgggattgagcagtcatgtcccagttttcaacagccttatcaacatgtacagcaagcataa

SEQ ID NO: 43383 - DNA, 192 bp, Triticum aestivum
  unsure (1)..(192): unsure at all n locations
  Clone ID: PAT_TA_43383
cgtccgcggacgcgtgggagtgccttcacattgtacttaattatcccatttcatacgggttggagtgtggtctggtcaaggttccanctagaggtattttggaaaggtgtcaggccgggtaggctttgtggggtcttgaaccttataagcagaagggcaagcactgaggttaaaaaaggtatgaccctaaaa

SEQ ID NO: 43384 - DNA, 405 bp, Triticum aestivum
  unsure (1)..(405): unsure at all n locations
  Clone ID: PAT_TA_43384
cgtccgggaagctttggacggcctaatgcggtgccatgagctgaagctcgagacagatganaggagctggaggaggtgtgtgtcgacggcggtcaccgtgctgcaatcgaagcttggccggggtacaattgctgaaaaggagagcgagggaactgagggtttgccatttccgcgcaacaggcatttcattggaagggagaaagagcttgctgagatcgagggaatgttcttcggttgcgccggcgaagtcgaagatgtggagtgcccagggggcagcaccatgcctaattgtgtatccagtggtgtgtcagatggaggatttgctgatgaggacagggacagggtgaggacaagcagtggcaggtttggcaggttggagttgcacaagtgcaatcgggctatgtt

SEQ ID NO: 43385 - DNA, 386 bp, Triticum aestivum
  Clone ID: PAT_TA_43385
cgtccgcggacgcgtgggtgcattagctagatatactttaacaagaacattttcttactatatggtgcattctggactataaatgtgtgttatatactactgttctgctcaattattaaattgtgtctgcgcagtttatatgaaaataaaataaagaaagcactgatttgattgtctataagcagttggtgacttggttctgatcctgttcctttggagccatgagcaataccataacactctatgacttcaaaccttgattttttttttcaaatatagcattttccccattgactgcttgcttgagctaaactcaacgttcattttttatagatggcgacacatcattaaatgagctcattattggattagctagattgacttta

SEQ ID NO: 43386 - DNA, 340 bp, Triticum aestivum
  Clone ID: PAT_TA_43386
cgtccgcggacgcgtgggcggacgcgtgggcggacgcgtgggctgcaatcagcagtcaagcaatgcccacggacatctgtgcactggccgaatcctttctccagctctcgccatggacgcctcagccaccgtagccaccgggaaggggaagaagggcgcggccgggcgcaaggcgggcggccccaggaagaagtccgtgtcgcggtccgtcaaggccgggctccagttccccgtcggccgcatcgggcgtgtcctcaagaagggccggtacgcgcagcgcgtcggtttcggcgcccccgtctacctcgcgggcgggctggagtacctagcccgccgagct

SEQ ID NO: 43387 - DNA, 171 bp, Triticum aestivum
  Clone ID: PAT_TA_43387
cgtccgcggactcgtgggggcgtccagtcctccttcaccatggtctcccccaattccaccatctgccaagtgttcattggtggtgcgctctgctggtccaatcagtggtggtgctggtgatggtaataaccttacaaaatgataaagattaataataagcctccaaattta

SEQ ID NO: 43388 - DNA, 428 bp, Triticum aestivum
  Clone ID: PAT_TA_43388
cgtccggtgttgaagaagaggttataccaaccgaggccaagtgcactgaacttacccatgcctgatatagatggctattctaaattggatgcccttgtttccagatttctcttcgtttcctgattttgttaattttcaactatttcacattgccatgcacgtttgaggctcaaatgtggagacctctcctccaggggacaacatcacaatgtattttcatagaatacttatgtaggtcttctcctctcggaagtattaacattcttcgttcttcaagtgagttttcatatgcttgaggttgtgggaagaaaacgtgctgtaatatctgaaagatatgtaaatagttcaagcaattcaaagatatcactaatataaataaataaataaataaatatacatatatgttgtatacaactctattatgaaat

SEQ ID NO: 43389 - DNA, 210 bp, Triticum aestivum
  Clone ID: PAT_TA_43389
cgtccgataaacgcgaagaaaaagtaaagcacaaaaaacgcgcagcggtgggagagccatggaggtgggcggggactagatgatgatgacctctggcgccacgggccggatcgttgcccgtcttccgttccgtgctctcccgccgcgcgctgctccgactggccggtttgctacacttgatctttctctgggtgctcctacttggggggc

SEQ ID NO: 43390 - DNA, 375 bp, Triticum aestivum
  unsure (1)..(375): unsure at all n locations
  Clone ID: PAT_TA_43390
gggacgccacgcgtccgagataatctagaacataaggcgaaaggcctcaactttgtgaagatgaatgatgaanggggtcagggatctttcaaacgtatcttgaaagccaatcctgatcttctttgagttcgtgttactcggggcttggtgagactaccccttttggaatggggattataaaggttatgtcgaatgaggtgtatgtactatgaatctactggtgcattactagaaattatgggtattatggctaatgtaatatgaacatgcactggtacaattcatgggcattatggcttatggtaattggttgatttttttcttcacattaaaaaaaaaaaataatgggcgggcggtctataggatccaagctta

SEQ ID NO: 43391 - DNA, 370 bp, Triticum aestivum
  Clone ID: PAT_TA_43391
cgtgcgcccactcgtccgcggacgcgtgggctccaaatctcgcccgctcgcccgccactctccggcgccatggacaccggctcctcgctcatgggcgggccctcctccgccgacgcccccaccgacggcgagcaccggatgggcaccaccatcgtcgggggatgctacgccggcggggtcgtcctcgccggcgactccaggaccagcaccggaatggatggggcaaaccgggcttcggacaagattaggcagctcactgataatgtctatggctggcggtctggatctggcggtgatacacaaggtatgtcagattatgggcgctattttctccaccagcacacaattcaagttgggcaaccagctaccg

SEQ ID NO: 43392 - DNA, 423 bp, Triticum aestivum
  Clone ID: PAT_TA_43392
cgtgcgaatcaatctagatctgcatactcagaatgattcaaataatgaactgcttatgtctaaagtgacaggtgggaatctatcaagtggaaaatcaggtgctggtagaagatgtatagctcaggcattggatacagtaagatacatgcctatggaaacattatttcgtgttcttgaagtttggagcatccacttagaaggaatgaatgagattaatgccaaggtcaaagagcttcagtcaaccacaaccagtgaagattgtgtgacaatcacaaaggataagtggcctaggagatcatccaatagcatggtagctttatcgtttaatggcactgttcggaaaccctagccgccgtcgtccagatctgcttgggttggtggagggtatggctatggcgctgcgcaccatggccggcaagctga

SEQ ID NO: 43393 - DNA, 250 bp, Triticum aestivum
  Clone ID: PAT_TA_43393
cgttcgcgtctcctcccgccggcgccgcagccgccggctgcctctagccggcctcggggtggggaggatacctgggaggtgctatctgcatatcaagaacaagccgtaccccaaggcaaggtgctggcgtggggggcctgaccctaagatcaggatctatgatggtggcatgaagaagaagggtggtggtgaggtctctcactggggttaccttggggtatgggagaagggggaacgggtccagggaggg

SEQ ID NO: 43394 - DNA, 323 bp, Triticum aestivum
  Clone ID: PAT_TA_43394
gggacgccactcgtcctcaaatccccaagcgcgacaaccaactccggctttacctcccgcctcatctccgactagggggcccggaccaaggagacggctatgaattccaccggcggcaaggcgccgaggaagcagctggccaccaagggcggccgcaagtccggccctgtgcacctgctgcgttaagaatccccaccgcttccgccccggtatcgtgtcgcttcgcgagatcctgaagttccataatagcaccgatcttgttatccgcaaggtcccctttcagcgccttgtccgggagatctgccaggactttaagaccgacc

SEQ ID NO: 43395 - DNA, 169 bp, Triticum aestivum
  Clone ID: PAT_TA_43395
cgtccgcggacgcgtgggctactgcccactccattccccattcctccagtccggccaaaaccctcggcggcatggccgtggtcgtcgtggatgtcctgcgctggttccccggaggcgaggccatcttcagggccaatgtagcctttctctgcgacggcaccggccatta

SEQ ID NO: 43396 - DNA, 436 bp, Triticum aestivum
  Clone ID: PAT_TA_43396
cgtccgcggacgcgtgggcggacgcgtgggctcgagaagcatcagcagcagcagctagccgatctggggtccttccccccatactctttcttctccacccgtcgctgcgtcggccgacctagctagccagctcgctcgctcgcggtggcgcgcgcgattgcggggtcggaggaggtggatcgggcggcggagatggggcgggggaagatcgagataaagcggatcgagaacgccacaaacaggcaggtgacctactccaagcgccggtcggggatcatgaagaaggcgcgggagctcaccgtgctctgcgacgcccaggtcgccatcatcatgttctcctccaccggcaagtaccacgagttcttgagcaccggcaccgacatcaaggggatctttgaccgctaccagcaggccatcgggaccagcctggggatcg

SEQ ID NO: 43397 - DNA, 263 bp, Triticum aestivum
  Clone ID: PAT_TA_43397
cgtccgcggacgcgtgggcggacgcgtgggtgttgtccgtgttgagactggtgtcatcaagcctggtatggttgttacctttggtgccactggtctgacaactgaagtaaaaaacgtttccattcacaatgattgtcatctgaaggcgatccctcgccacaacgctaagtttagattgaatacacttgccgatatggatatgaatcttgattctcattattctaatacaattatgacccttccaaattatcattcatttttac

SEQ ID NO: 43398 - DNA, 213 bp, Triticum aestivum
  Clone ID: PAT_TA_43398
cgtccgcccacgcgtccgcccactcgtccgcccacgcgtccgggttccgctctcactccctcagtgggcggacagcgcctgaagaccctagctcgttccgccgcaatcagaagagggatccgctcacatggctggccagcgtagccgcatccgccgccagcgcgctaaggctcggttggatccgggggtggaggtggaggttcttgcctaatg

SEQ ID NO: 43399 - DNA, 437 bp, Triticum aestivum
  Clone ID: PAT_TA_43399
cgtccggctgttcgctaaatggcttcgtagagagctgttctcgctctcaatctccccacagccactggtcactccttcccactatccccgaccataaccctcgatccccttcctccactcctgcggccatggacccgccgccgccgccgccggcctccatccccgtccccgacgacctcctggaggagatcttcgtccgcttgcccaccccggacggggtcgcccgcgcctccgccgcctgcacctccttccgcagcgtcatcaaaggccgctctttccgccgccgcttccgcgcgatgcacgggcctcccctcctcggcttcatggacgcggcaggattccacccggctcaggcgccgcaccccttcgccccgctagctggagccctcgccccctgcgccgccgatttctccttcggaccggcagtcgtttcttct

SEQ ID NO: 43400 - DNA, 291 bp, Triticum aestivum
  Clone ID: PAT_TA_43400
gcgcacgcgtccggtcaaggcgcgcatggcttggagaggaagctgatccacagtactctgatcgattacttatggggtgcaccagaccagtggaggttactactgctgcggatcaacaagagtcaaggtggtttatatccaaggatgcagttgtgtcaggccttggtcttcttggcatcaagcaaggtgggcctgaggcacaatttgtcaagccccggtgaaagagagtaatccgcaagaaagttgcattaggttgaaattagtggatttgctggcggtgctggaagaatt

SEQ ID NO: 43401 - DNA, 335 bp, Triticum aestivum
  Clone ID: PAT_TA_43401
gaacccctcctcctgttctattatttgatgtttacagagcctacttctctactattcttccaactgccactggggggtgcttcctactatcgtagaccattattctttaaccaccttcctccactccagcgaccatagacccgccgacgtcatcaacggtcttcatccccgttccagacgacctactggaggagatcttgtgtacgatagcccaccccggacggtgtctcccgcgcctccgactgctgaactcacttccgcaaagttattaaaggccgttttttacgacgacagtttacggcgatgcacgggcctccccttctttggttcatgga

SEQ ID NO: 43402 - DNA, 207 bp, Triticum aestivum
  unsure (1)..(207): unsure at all n locations
  Clone ID: PAT_TA_43402
ttcttcccnccctcccttaanatagatgcatggggcgcccccgcgccctgtatgcngggatgtaagagngtgggcccccccccgaacngcctcctcccgggcctattgccgctgctgctcctctggctgccgcttctctccttcgccgtcgccgtcgtccggttccgcccccggcggaggagaatgatggtgaccagggggggctgc

SEQ ID NO: 43403 - DNA, 280 bp, Triticum aestivum
  unsure (1)..(280): unsure at all n locations
  Clone ID: PAT_TA_43403
catccgttcttttgcgccacgaggtcacttatgtattatgccagctgcaaaacacggccttttagagangcgaatacaaganggcgggcccccgcccctaaccacccnctggccagacaagaagctgctgaggcccttgggccaactgcagatcaagaaagccttcgcgcttctggcaggaatcctccacggcccccgagcccatcgtctaccaaagctgggaagtagccctaagcatgctcaaggacgacagatcagggaagtcagccgagtggctgac

SEQ ID NO: 43404 - DNA, 357 bp, Triticum aestivum
  Clone ID: PAT_TA_43404
cgtccgcccacgcgtccgctcgacttggctggcctcggccacttcgatctctccacctctccagtggggtaggagtaccagcgggcagcggtggcggggccgaatggtggtctccgtgagcgcgggcggtgggctggcggacgggttcggcctcctctgcccgttcttggcccgcttgatgatgcccaggtttttatgttgctggtctggtctatgagctgcaagcgactgtccagttgtcggtcagggaaatcataatgtcaacaagtgaaaacttacgggtggagttattggtcagaaccccgccttttgggttgagactatgggttgggctcggcataagcatttgggcttcaa

SEQ ID NO: 43405 - DNA, 409 bp, Triticum aestivum
  Clone ID: PAT_TA_43405
cgtccgccgcaatcgtcgccctctcctcctctcctccccatggccgcgtcggcgtcggcggcgggcggcgagccccagaagcagttcctatccatcatccgcgacttcgcggccgagaagtcccacggcgagcgcacggtgtcgggcctgaagcgccgcctcgacgacgtggtctcagcgtccgacgcggccacggcggagctcgaggccgcgaagcgcgcgcgggaggcggcagagacggagctgcgcgggagcgaggtgcatgcattcatcgcagacgcgtcgatacaggcgctcgaggcgacgatctctcgtctccaggaggagatcgcgaagctgggctctgaactggaggcgcttaagatcacagtggacatctagagagaagagttcttgagactgatgcttg

SEQ ID NO: 43406 - DNA, 241 bp, Triticum aestivum
  Clone ID: PAT_TA_43406
gtcgggtgagaggtttctttccaaggtactgatggcattctagagctcaccggccgggagtcttgcttggacctgccattgctaccccactgcataggcagcataactgcagaactagattcaggctagcccagtatcctctgtgtgcctattgtcatacatcccacccttacagtctcctttagacaaagtaaatccgtttggaatggatgtaagtaaccagtgtagaaggctctctatt

SEQ ID NO: 43407 - DNA, 285 bp, Triticum aestivum
  Clone ID: PAT_TA_43407
cgtccgcggacgcgtggggtgaagtgagagatcagttctcgatttcgattccgggtccagagaattgggcaggcgagcgagcgagatggcgaccgccgggaaggtgatcaagtgcaaagccgcggtggcgtgggaggcggggaagccgctgtccatggaggaggtggaggtggctccccctcacgccatggaggtgcgctttaagatccttttcaccttcgtctggcgcaccgacgtttttttttggaatgccaaggacctagaccccgttgttgcctgggatct

SEQ ID NO: 43408 - DNA, 272 bp, Triticum aestivum
  Clone ID: PAT_TA_43408
cgtccgcggacgcgtgggttttaaatgccccctatttgagtgtatgctttagggagaagcctaactgggtgaatttaaactatagaatgtggtcacctaaattggagtagtctaattggtcacttcattttctgttgtcaatattataatgtattctaattgtgagatatggtgcgctgccatattatgcaaaatctacctgtattacttgttcaaacatcatgtaccttattatgccaattggtgctcaacatgaaaggcacaatcttcgt

SEQ ID NO: 43409 - DNA, 440 bp, Triticum aestivum
  Clone ID: PAT_TA_43409
cgtccggacctctcacgcacgcaagccttttcccccattctccggcggcggcagctatggcggcggtggcggcaaggtccgggctccgacggatgttctccatcgccgacttcgcgacgccgaacacgcgcatgttctccatctcggccttcgcgccgccgagcccgcccacgcctcccccgaaggccgacccctcccccaacctcttcgtctccgggctaagcaagcgtagaacaactgatggacttagagaagcttttgcaaagtttggggaagttgaacacgctcgagttgtcacagatcgtgtcactggtttttctaaggggtttggctttgtaaggtatgtttcggttgaagatgcaactaaaggaatagaaggaatggatgggaaatttctggatggatggggtatttttgccgaatatgctagacccaaacca

SEQ ID NO: 43410 - DNA, 175 bp, Triticum aestivum
  Clone ID: PAT_TA_43410
ttcctcgcgtcttctcctgcgcatctctgaggtgcttcctagtttccacgaggggggtgatcgcagcctacgttgtcgcctatctgggcgggaactcttcctcaagtgccgctgacgtcaagaacattcttgactcacgtggggctgtgggtgatgaagaaaagcttgagttcct

SEQ ID NO: 43411 - DNA, 360 bp, Triticum aestivum
  Clone ID: PAT_TA_43411
cgtccggtgcggagtatttcactttttcatcccctgggtgctctgccccgccggtcgatccccatgggatccccggtctgccgccgtccgtcgccaagcggcggggcggccggctggggcggggggctatcctagcctctgccatggcgccggagacgaggagcgggagggcgagggagccgcgcgcatcggagaccgcgtcgccgccggcgcagcgccctcggctcacgcgcgccggaagcaggggggatgcgctgacccgccgccgctccggtcaggttaatgaggatgtcgagagcagattccagcatttggcaagttcggcacaaaatgatgttatgcagttaaaggcggcgaccg

SEQ ID NO: 43412 - DNA, 270 bp, Triticum aestivum
  Clone ID: PAT_TA_43412
tcctttcccgcagtcctccgattcccttcggcgcgcttcgctacccgcgtcgttttcctctcggaagaaaaacaaagcgcagtctcggggggatatgggggagggcgatgggccgcttcggcatcactggacgacgtactctgcgcggtgtggagacacgggctaatcattgcatgaccatggaccgccccccgtgacgggcttacgcttcggccctatcgcacctgcaaaccaggtggtagaaccccatatcccgcttggtgccaacgt

SEQ ID NO: 43413 - DNA, 388 bp, Triticum aestivum
  Clone ID: PAT_TA_43413
cgtccgggagaagtggcggttccaggcggagatcctccgcgccgagtgcaacttcctccggatggagcgcgaggtcgccctccggaagctcgactgccaccgcggccagatggaggccgccctcaagaccgccgtcgagacgctcgcctcggggaggaagaagatagacggaagcggcgaggtcggcgtggcggcggcgttggaggaagggatcgaggacctggaggagatgatgcaggaactccgggtggagaatgagagcgggaggagggcgatgagcggcatgcgggagctgctgcggagccacggccggaacttcgatcggcaagcgtcctcgctccgccggcgcctcgagaagatgccaccagccgacgccgagcccattatc

SEQ ID NO: 43414 - DNA, 416 bp, Triticum aestivum
  Clone ID: PAT_TA_43414
cgtccgattcctcccccgtccccttctccccgagagcgaaggcaaagcgaacacacaaacccaaacccggccacttctcctctcaaggcttcgtctgccaccgacgcgacccaaaaacccaagcccccaaccctagcgaggactgaaagaggaggaggcggcggcaaccccgtcgaccggaggggagatggtgttcttcgcgctgctcgtgggggcagagctcgacggcctcaccaacctgcagccccgcggcggctgcgacgaccccagctacccttactacttcaagctgcggtgcgagagctgcggggagacgagcgccaagaccacctgcgtctccctcgacgaggtcggtcaactgcccactggcaaaagcaccggcaatctccttcaaaagtgcaagttatgttcgaggg

SEQ ID NO: 43415 - DNA, 247 bp, Triticum aestivum
  Clone ID: PAT_TA_43415
cctgctgtacctttctcgtatttccttgtcgaccgcgcgcgttctctgacgcttgggctattaaccttcttcttcgtcttccgcccttctgatccgtgagattaataaggtggttggctcctagaagaggagggacccacctcccaccatccagtactccaccaaccaatttaacattcggggtgagagcgtgtactagatgatcatgaagcttgactaggagctggcgcgatacattgagctgatt

SEQ ID NO: 43416 - DNA, 203 bp, Triticum aestivum
  Clone ID: PAT_TA_43416
cgtccgcaggaattgaggcagatggagtcacagtagttaaagttctttcagcttgtattcagtaccgtgcgttcgatgttgcagagaggcttcatcatcgtgtgatgcataatgagctgatcagcacagatgcaagacttgctactgccttagttgacatgtatgccaagcatgggttcatacagacagccatggatgtgttt

SEQ ID NO: 43417 - DNA, 353 bp, Triticum aestivum
  Clone ID: PAT_TA_43417
ggcgcgtccggcctcatcctctcagccttctctctgcaattctttcccagatcttctcctgctagctagggttggggggcgcatgcgcacctgggcagccatcgaggcgaccactgccgcctacaggcggaacgaggcggaggagaacctcctggtacggcttatcagcgcggaggcgacgtgaggaggagacgccaaggtgccggtggtgcgcccgctgctggtggtgctcatcgaggactagtgccggaaggggctaatcgccaatggctggtaataattttatcttctttcagatgtaggaaatcgatacgggtgaacctaaaggtagaatttctaatcttaatcttgcg

SEQ ID NO: 43418 - DNA, 370 bp, Triticum aestivum
  Clone ID: PAT_TA_43418
gggacactacaccgaacgcgccgacctcatccactccatgctcgacgtcttccggaacgacacctataacgggcactgaatccacggatgtcatgattaacaacctctggcaggaggaactggcttttatacaactacactgaatatctacataaccaggtaggagtacctagataggaccataactgcattcatatcttgcggacacagacacgcgtttcagaccttggctgtgccgtacaatggctagcggatgccactgcaattcccctacaacgaatacaagtgaatggcattacctaatggtggtctggatccacatctggcgcaatagtctgaagcggcgccaccgcagatcacttggatcgaa

SEQ ID NO: 43419 - DNA, 427 bp, Triticum aestivum
  Clone ID: PAT_TA_43419
cgtccgcggacgcgtggggttgaaattaagggcgaacttcacattaggaatgagagcagtgatgtgccagagaccaaaattgagctacccataggtactccagtcactgacattgcaggggctgagctggaggttgatgatgttgggtctgcacttcagtttcatgaattctgccgcacatttgcagaggtgcttaaaataagaaagggacagccagaaaaaattcttcaagtcatcactggaggaggccgtatcgggcgagaggtgccttcagttgttgctgaccttcacattagtttgttgtctgtcatccaagaagacagagaagagaacccttcggactattcaaggaatggtgatgcttggataattgatactggcaaatatattagtgaatccacagttatctcgaaggaactgcctctag

SEQ ID NO: 43420 - DNA, 333 bp, Triticum aestivum
  Clone ID: PAT_TA_43420
cgtccgcttcatttcttggaacgagatccaaacctgttcgctcttgtcaacagctgttctcccgggtggcctgtttgccaagcatcggctgatgagttaccgtgctccgatttttcatctgcagcgagccctgtgtttgtatcagatgaaccaacaatccccgaatacgacaaaggatttctcttgcctcatcctgaagattccagggcagacgcgttctcccattggaacgcgatgccacccatcttccagtgatgcgattcgaacgggtctacagtggagcaagctggtatccgtgagcgagggacattccttcgaaccaaacgaattgtc

SEQ ID NO: 43421 - DNA, 290 bp, Triticum aestivum
  Clone ID: PAT_TA_43421
cgtccggccggaatccggctccaccagtcgcccccctccaagccgcggttcactcgccgatccaggggcttctgtcgtgcgcggggcggccgggggcccggctgctctgtccggtgacgccggcggctggagcgggagacggcagcggaggtcgccggggacagggggatggaggccgccgtactggaccccctcggtgggcaagcgcgagctgcggagccctgggaggcgccggcgtcgaccgggcaccatgggcaaggtgaagatgctgctgcaaatgatgactcctg

SEQ ID NO: 43422 - DNA, 433 bp, Triticum aestivum
  Clone ID: PAT_TA_43422
cgtccgcccacgcgtccgcccacgcgtccgctcagagaatgatgatgcctcatagaatgaggatgtggataagtctgtcaaacaagcgcattacactcttcgcaatatccacaaggcaatatatgaggagcaggtattggatatgatgatccgtgagacatttgtccaaactgaagggggcaacgttactggaatgctcgaggattttcttcaaatattcattggccatgaaatcttgttgtgccttccgctcgcgaattctggacaggacagccactcggagatggctggctcatgaagagcacactaagttagacgcgaatcttgtgatagccaccaccaatgggaagcaggagccttgaaatagcaacccgataaggtttcttatcccgcaaagtcatggagattacctgctccatatgttgcatggcaa

SEQ ID NO: 43423 - DNA, 199 bp, Triticum aestivum
  Clone ID: PAT_TA_43423
atattccaaaccgggggacggggtttcttctgatgttactaaactaccgtatgcgctttacaaatcatagggttaaaaatcttgggcactgaattttcactgaagccaagctaggaggtttcttctcaaatctccagtccaggtaaaacccatttccaaccgtctaagggccgtacggtatttatgcttaaacagtaaa

SEQ ID NO: 43424 - DNA, 359 bp, Triticum aestivum
  Clone ID: PAT_TA_43424
cgtccgcggacgcgtgggttcggcggcgccgaccagccccatgcgcagttcgagcagcttgccgcggaccaccaggccatgaccgtgctgcgggactactacggccagtaccccaccaccaccgatgcgtaccttcccggccctcagaggaccggttcgtcatccctggtgttcggtgttgccgaagaggagtcggcctacatggttgggggcttccagtgctcccccaagccgcgggcgatctggcggcaggaagcggggccggggcgctggcatctagctgccacgggtttccggccaacggcggcgtttagaataaggagaatcaactaccttcaacagcctcattgagaaggtta

SEQ ID NO: 43425 - DNA, 303 bp, Triticum aestivum
  Clone ID: PAT_TA_43425
ctgctgtaccggtccggggtgtggggggggagggacgcgtccgcggactcgtgggccccgcgtcgccgccgccgcctgcgcaccagtcaccatggctaaccgggggggggggaagatgctccaggtcgtcaactaccggatgcgcgtgacgatccatgacggtcgccaactcgtggggaagttcatggccttcgatcgccacatgaacctcgtcctcggcgactgcgaggaggtccgcaagctcccgccctcaaaatctttcaagaccacatgcgagcgcgaggagcggaggacgctcgggct

SEQ ID NO: 43426 - DNA, 251 bp, Triticum aestivum
  Clone ID: PAT_TA_43426
cgtccgggtttatttgcatattatttacttaataaaatggtttgaggtgaagagccaaaggcctggagccaagtgttcctaacagaacgacgatccgcaggaaacaaggccaacgctatgtgtgcctgcaagattgaggttcccagatatttttcttttctccatgatcctacaccattgtattgcttcatgtagatccctttatcattcatttttattgtgcaaatctctatatggttgtcatatagatg

SEQ ID NO: 43427 - DNA, 368 bp, Triticum aestivum
  Clone ID: PAT_TA_43427
cgtccggctcgaaccccctctgatcgatccccactcctctcgatctcgtctcccttggggctcctgccagcgccgccacatcttcttgccggagtccccttccccctctgcacgagcgcccgtgcgcgctggcacccgcgccgctcctccccatcgttttggccggagctcgccggagccctagcatctggcgccggcgccaaacctgacgtcgccctcttgcttatacttctcgcccgcgcgtgcccgaccacagcaagggcggcggtccgggcaagttcctcgccgggttcagcgaccttcgccttgaacctgccgtctacgtgctgttctgggctttctgcgacatgctctcctgcatcacccac

SEQ ID NO: 43428 - DNA, 315 bp, Triticum aestivum
  Clone ID: PAT_TA_43428
cgtccgaaaaaatgttttaaatataacaaataattatgtgcagtagtacatggttggggattcctttcctgttcaatgcatattatagtggaatttgtactgtttggtatgcattcacagtcaacatggggtgctgaagtagtgtaaattatttgaagttgccttttggccagtatatttgaagttgccttttggccaatatatataaggatggagtactgtattgtttggtctgcctttttggtctgtatcgttgtatcgacacccttatgctttttttgggttctattattccaggagtcgcattatgagcat

SEQ ID NO: 43429 - DNA, 171 bp, Triticum aestivum
  Clone ID: PAT_TA_43429
gcacgcgtccgccgcacactgctcgctctcatctttcccctctccctcgtcttctcctgtaagtcgccggggccgcgggtcccgccgtcaggcccagccgcccccatctccggccggaatctcttctccgccgacagatccggccgtcccaggctgactcccggcggatcc

SEQ ID NO: 43430 - DNA, 386 bp, Triticum aestivum
  Clone ID: PAT_TA_43430
cgtccggcagccgccaccaccgactcaccaagactggaggctggtgcacatcctatcggagttgcgtccggtccccgaggacgcttgatcagatggtgctgtccctggacgcggagcactcggcaatcctgctccaccagctcgaggtgggcgacgagcagatgcgcgatatggtgctcgacggattcaagcagtgcgcgcactggatcatggggaacaggccagggcatgcggtgttccaagcgctcctgcgcagcatccaggtcatcgtagacgacgacaggcggtacgaggagctccagatcatcgtggaagccgccgccacgccagagcttgcctggaggtccgacgacggggtggcttctctgatgttgctcatcacggcg

SEQ ID NO: 43431 - DNA, 431 bp, Triticum aestivum
  Clone ID: PAT_TA_43431
cgtccgcccacgcgtccggtctccacaaagaacagtgtggtaagctctataacagtcattcagacgtgaaattatgaactctgatatttgattgcttgaaaacagttcaaagcatagccaggaaatgctggcgaccggaatattgggatactatggatgctatcaagcatgcttttgggggcttaccgcaaatcatctgcaagaagggttcagttcaagaactaattaagggtaagcttcaacaatggaattggaggggaggtatcttttgttcttggacagggctccttgggtttcattgttatttgcatgaacacaacatcactggttaaggaataattttggcacaaccaagttatgcagctatatattttctattgattgcttttcatatgcaccatctggaataagagacagcaatggggccacat

SEQ ID NO: 43432 - DNA, 429 bp, Triticum aestivum
  Clone ID: PAT_TA_43432
cgtccgcaaaaaatacatcatctgaattaatatcgatatacgaatcatacaggaggccaaaggatggccaaagaagcaacggtgtctgtccgtgtttcggtagccacaaaacaacacaattccgaaagccgttgtgcattgtcaggtgaaggaggcaaaaagaaacttgctcaaccgtttttatgcgcatgtaggaagcaaagagaataaacagctgaacgcgatgctggacgaggatcctgcgttgatggagaagagggattccctcgtgaagaagctggagctgtacaagttcgcgaggaacgagatctacttggttgcatggaaatgatctgatcttatcaagcgttgcgggctataatagatagaacgtgtgtggtagaaatgcttcattcgttttgcatatgctttgtacacgggcttttcttg

SEQ ID NO: 43433 - DNA, 349 bp, Triticum aestivum
  Clone ID: PAT_TA_43433
cgcgtgcggaagaattctaccctgcctcccttgactagtacatcctcgatctgcaacctactcaactgtggaagggcgtcttcttcaacttcagaatcaatgctccattaggtgagctcaccggacaatgtttccctcatgttcctatatgtgtctgatgcattcagtttagggatcggtaaatgaattattttagagatctggtgttctccatgaagatgaatctcacatctatgaagttgtcatcggttaaatactgtctgttgggatggtgacttagacgtggcgttttcttgcttttcacagatctgggagtttggttgtgttgtgtgatggtatgcttgttcgt

SEQ ID NO: 43434 - DNA, 428 bp, Triticum aestivum
  Clone ID: PAT_TA_43434
cgtccggcccgcgccgccgccgcctcctccttccgcaggagctccctcctcgcaggcgcgatgggggacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatattgtgatggccgctgcctactcccatgagttgcctcgctatggtcttgaagttggcctcaccaactatgctgcaacctactgcactggtctgcttttggctcgtcgtgtgctcaagaaccgtgatcttgatgaggagtatgaaggcaatgt

SEQ ID NO: 43435 - DNA, 331 bp, Triticum aestivum
  Clone ID: PAT_TA_43435
cgtccgctctttattagcagataaaacatggaaggtaccggcaaaatggttggcatttgcttcacaaaaggaaaatgctgctcatctggtttgcatggcgtcttcagtgccgcgctctggaaatcctactctgctgggctctcttgagaaagggaaacgaagggaaaatgtgaaaaacctaataagggaagaaagagaagtgggaaatataacatataaaagcaactctccatctacttacactttgcacaagtgggctgagatgtgcgaaatgcggagagctgtggacccatccctcaaccaaaacccctgtggctccatgctgtggtgg

SEQ ID NO: 43436 - DNA, 425 bp, Triticum aestivum
  Clone ID: PAT_TA_43436
cgtccgcggacgcgtgggacccaatccagccccaggtcccagctcgtcgcggctctgactgaatcgggcccgttcaccaccggacagctaccgccgacgcccctatcccacccctctcccccctccccctcccctgccgccgccgcctctccctcctcgccgcgacgtcggttcgcgccccggccgtctccgccccgtccgcgatctcaggccgattggagatacgctcgtcgattcagccatcgtccagcgaggaggagagatgcaggcagcgccggcctcttgagtctcgacggttttctagacagcgccggcctctcgacatagaaataaccaggcagcccccgcctctcgacaggattctacatcaaaagcaacacgcgtagagcaccacgaggcatctagagctaggctcttcaaggagt

SEQ ID NO: 43437 - DNA, 390 bp, Triticum aestivum
  Clone ID: PAT_TA_43437
ctgcatgtacctgtctcttatgtccgggtcgacccactcgtccgctcatcgtaagtgtgctcttgcggctcaaggtgatcacgtttcgtgaatatggggccaggcaagatgagcttgccttcctccagtacatcttgcagcatgcaatggtgctcaagtatgcattggttcagatggtcaatccaaaattcacttcactgtcagtagatgagatggcctacaccatagacaatttgcaaattaaaaaaaaaatgggcaacctggtgcatgtagctcccgcttgcgctagggtccagggatgggtccgtccactttggggctatagtacacagcctttgcctacttttcttttataggctgtttccaagacttgaacccttgatctcatgg

SEQ ID NO: 43438 - DNA, 183 bp, Triticum aestivum
  Clone ID: PAT_TA_43438
cgtccgggaggatttggtctcctcaacgtaacccatgatccccttgagcttcccctgagatgcaggcttgatagccttcgtgatctcatcatatgattcacccttctatggtctaacagtgagatcatcaacttgcacattcacagtgtggacctggaaagacataccgattagcttgccatt

SEQ ID NO: 43439 - DNA, 263 bp, Triticum aestivum
  Clone ID: PAT_TA_43439
cgtgcgcccacgcgtccgcagcagcaggggggagaggagatgatggtggagcccaaggcggataggacggcgtgcgacatgggggtcacctctcactcccactcgcagtcccagtcgcactcgcactcgtggggcgaggcgcgcacgccggagtcggatatcgtcaacatcgacccgtcgctgttccagcaggcggcggcgtttcatgcccagagtccctccgccggggtggcactccaagagattatggtcaccctgatggt

SEQ ID NO: 43440 - DNA, 333 bp, Triticum aestivum
  Clone ID: PAT_TA_43440
cgtccggtctggagacctcccaggattcaattatgtttatgatcttgaagttttgcggcttgcaggcaatggattcactgggtttgtacctagtggacttctaaagggagattctctggtgttgaaccaactggaccttagtgcaaataacctgacaggtcatatcaatatgatcacatcaactaccttgcagatccttaatttgtcctcaaatgctctttttggggatctaccattgcttgctgggagctgcactgtgttagatctatcaaataaccatgttactaggaaatttagcattttttaccaattggagcaagtgtcttttgaata

SEQ ID NO: 43441 - DNA, 416 bp, Triticum aestivum
  unsure (1)..(416): unsure at all n locations
  Clone ID: PAT_TA_43441
gcgcggcacgcgtccgaaaggaggtctcggcagagagagactggtcctgtcgagatagatggatcatatttacgtgggcggctccncaggagagaaataaatgggtctcctggcatcagcccagaacgcantggagagtcgcgtcggagggatgaccgctacagggaaagggcatatgatggtcaccgtacacacagagatcgccatcagggccctcgagggagcaccctaagctcccgtctgcaaggcagaataaagcttcctggaagatcacctgatagagtagatgctcgctccgagagagagcgagatagaagacaactccgggacaggctgtctccgggtgtgcctatggatattcagggtggcaggcatcgggaggcagggcatcatcaagagaggatcaggcagagatc

SEQ ID NO: 43442 - DNA, 329 bp, Triticum aestivum
  Clone ID: PAT_TA_43442
cgtgcgcccacgcgtccgcccacgcgtgcgtccacgcgtccgaaccttttcagcaatcgccactggcgaatccctcaccggcagaaccctaggaagcttctagaacccctgcgaggccagcgagatgctactccggactccaccgcagcggaagcggcgggccgaccccgaccccaacctcgacctcgacctcgccggcgccggcggcgtcgccaccggacggacccccggctacgaccgccggctcgggccctacgaccgccccacgggcctcgtgtgcggctccggcaccgaggagccctccgacgacatggtctggacataccact

SEQ ID NO: 43443 - DNA, 111 bp, Triticum aestivum
  Clone ID: PAT_TA_43443
tcgtcctcccacgcgtccgtccttgtcatacgatactgccggtgatctattaaaacaggtgcacgcggtaacttagggtgtgcatttgtttttaattatcaccattgtaaa

SEQ ID NO: 43444 - DNA, 369 bp, Triticum aestivum
  Clone ID: PAT_TA_43444
ggaggcacgcgtgcgcccactcgtccgcccacgcgtccgcggacgcgtgggctcacaggagcgccacctctcggggcatgccgcccgggacgccggggccggctacgactcggacgacgccaacgccaacgcccgcgtcccctggggctcccgctcctccgacgagggctccgactcggacggcgcggcggccaaggaccggccccaggccgaggcgcccaagaagcccaagaagcccaaggtgaagaagcccaaggtcacggtcgccgacgccgccggtctcatcgacgccgagagcctcgccgcgcacctcggtaacatctctggctcgtatgagaaccaggagggcatccatgtcatgcgcttcgg

SEQ ID NO: 43445 - DNA, 314 bp, Triticum aestivum
  Clone ID: PAT_TA_43445
gcgtgcgcccacgcgtccgcggacgcgtgggcggcggcagtagcgcgagggaggcggacataggcgggaagatgtggatcgagggagaggcgcgcccgcccgcccggcaagatcatcctcgccggcgagcccgccggcgtccacggctctgccggcgtcgccgccgccatcgacctctacacgcagtcctccctccacctgcccccatcaagtgaaggccggtccggcgaaagtggaggttgaactggcggacttcggccctcggcttttccttggccatgctcggcgcctacttgaagcggctggggggagac

SEQ ID NO: 43446 - DNA, 175 bp, Triticum aestivum
  Clone ID: PAT_TA_43446
cgtgcgcccacctgcgactctccgaggtctgggcgtactccgctccgggaggtggcgcgaaaatgacacagggggcggcggtatcggccgacatcttcctccacaacgcgtttgtcgtgaccatggacggagcccttacggacctccgggacggtgccatcggcagtcgggggcg

SEQ ID NO: 43447 - DNA, 269 bp, Triticum aestivum
  Clone ID: PAT_TA_43447
cgtccgcccacgcgtccgcggacgcgtgggctacggtctactctcaccaacccaccagcatggccgagcgtctcgccgtagccggcaccctccgcgccgacgctccgtccggcccctcgccggccggccgccgcgccaggccatccagctctgccttcttcccctcctcgtcctccccggctctccgactcgtcagcctccgcgccgcgtcctctcggccctcccagaaggccaagtcggcggggggggggcgatcggtgaggcgcatg

SEQ ID NO: 43448 - DNA, 352 bp, Triticum aestivum
  Clone ID: PAT_TA_43448
cgttcgcccacgcgttcacccacccttccttctttatttttgtgaagaacactctttcaccgagggctgccctgatgtgtggcatgggcgaggagaacaccgacaaggacggcttactctacatgacctacagtggagagaacaccttcggattgctctatatggcgctggctgccactgcaatcgctctgaatgcctgctgtaaataaggcgtgccaatcaactgtgtatatatctgggttgcctcgacttaggatctttaaaaagcacaaccaacaaaaacctattcggatcctgacttatgctattggaatgttctgacttatatatatatatatcaaggatcaactct

SEQ ID NO: 43449 - DNA, 394 bp, Triticum aestivum
  unsure (1)..(394): unsure at all n locations
  Clone ID: PAT_TA_43449
cgtccgcacaaccacaccaccaccacacatccatggccggtgcgggcggtgagcaagggaggccgcatggtgtggagcagggatgcagcgcgggcggggagcaggaggcagcgcgggcggcgagcatggcgtactcgcgggcggtgagcagggaggtcacgcggacagcgagcatggcagacgcgcggggcggcgagcatggcggacgcgcgggcggcgagtatggcgcgcggcgccgtctcactccaacgttgactactcaacgcaagggcgcggggggtncttcttttcggcatggcgcgggggggccactacagaggagcttcttccttcggggttgggcggcccacgctacaatggtggcgggggggggccccctcttttttttttcaag

SEQ ID NO: 43450 - DNA, 435 bp, Triticum aestivum
  Clone ID: PAT_TA_43450
cgtccgcccacgcgtccgcccacgcgtccgcccacgcgttcgaccacgcgtccgtccacgcgtgcgcgaacacagcggtgtacgatttaccagcaagttttgtcaatctcagaagattggcacattttcgtattgtcccatgcccggtcacttaatgtttttggtaaaacagcggaaatcccttcaataaaggagttcaagcatttgcgtgttgtggacttcagagaatgcagtcaattggaaaaccaccatcttgtaaatgtagggaggctgtctcatctaaggtacctaacattagctcgatgaaagttagcaagctgccagaacaacattggacacctacactgattagagatgttggacataacgaacacagcggtgtacgaattaccagcaagtttttgcaatttcataagattggcacatttttgtgtt

SEQ ID NO: 43451 - DNA, 455 bp, Triticum aestivum
  Clone ID: PAT_TA_43451
cgtccgcggacgcgtggggagaaatgcgccttaatgaataagaaaaatgaggcaacattaatcactgacacgatacttgccactcccaggcactctcatacacaatatctagactgcacgaacatgtgaattttctcttaatagtgtgtcacagagtactactcctaataagtatctaaattcctagcagattactatgaactactccctcagtcccataatgtaagatgtttttttgacactcatgtcaacacaaacttagtagcaccagcgtccaaccatctaattgtacaatttgctgaatccagctgcaagttcccttgagacgtgcatgacctccttcctggagccccatttgccaaacttcaccagctgcaggagcggaccccaatctggactgttcctcatggccgtatatggcacactttgcataagcaagaaagtcaacatgacgt

SEQ ID NO: 43452 - DNA, 283 bp, Triticum aestivum
  Clone ID: PAT_TA_43452
gggaggcacgcgtacgcacaaccacaccaccaccacacatccatggccggtgcggacggtgagcaaggcaggccggatggtgtggagcagggatgcagcgcgggctgttagcaggatgcagcacggtcggcgagcattgcgttctcgcgggcggggagcagggaggtcacgctgacagcgagcatggcatacgcgcggagcggcgagcatggctgacgctctggcggctagtatggcgcgcggcgccttctcactccaccgttgactactcagtgcaggcgcg

SEQ ID NO: 43453 - DNA, 373 bp, Triticum aestivum
  Clone ID: PAT_TA_43453
ttttatcactaggggtatatgttaatttgagcggcattcttctgggtcgattagttcattcgcagagtacctagcttgagattcctatcttgattaatctaggtgtcatgtcacagggactgcttagtttccttagtaatcgaatgcttgcagttataatttggaacttgagactttataagcgacttctgacatgctgcactagttaagtttggtgcactcagattgtcgtcactatttaattagccatggattccaccgattctgttggggccttaacatatacccctagtgttgatacgataaattaacatctatctaggcatactccccctctatcttaaagatgggcggacgttttcaaggacccaag

SEQ ID NO: 43454 - DNA, 295 bp, Triticum aestivum
  Clone ID: PAT_TA_43454
cgtccgggaacatatacaatgtattctcttgttacaccgaggaggagagcctcttggcaaagcaccaggtggtattctccttgggtgcgtgtgtgtctacagttccatatgtgagcacatgcgatcttgagaagaatatatagagaaacaaccagagaaagagagagggagctgtgagaggcagcaccaaggtagaagaacaagccgcgctgctacgtgaggccgcgccaacaattggcatcagagccttgtccatccgaggcgacaactgcagcgcggcctactccatgtgatg

SEQ ID NO: 43455 - DNA, 206 bp, Triticum aestivum
  Clone ID: PAT_TA_43455
cgtccgccggcgcctttcctataagcctgtaacccagtcatctctcatgcagtaacattatttctacaaacggagagctggtagctataaccacagggttagctatgcagcaactgcatcatagactacctgctggatcacgaggtgaatgtgactcctctgggcaaaagcatacgtatacgctgtatctagagcgatacaaggac

SEQ ID NO: 43456 - DNA, 374 bp, Triticum aestivum
  unsure (1)..(374): unsure at all n locations
  Clone ID: PAT_TA_43456
cgtccgaggacccgtgggtcgtgctctgctgaatggagcacaaaagatgctgctatacggatgccattggggaagcgggggattactatctaccgaatgaaatgcagcgtgagcccactaggaactggaaaagccatcctcatatatactctagctcnaatgaaaaggcnaaattggcataagcctaggatgacatcggcggaggggatatcaatcggagtctggctgatggttattcttatgttacgaatctagttggatattcagangactcagatgtggacgttcctatccagacaggtgatgtgggcgatgtgggatgaaaagaagctactcatgagtgacattctaggtgtccctagaggagcacaacc

SEQ ID NO: 43457 - DNA, 450 bp, Triticum aestivum
  Clone ID: PAT_TA_43457
cgtccgattttttttccttctttgtcttctgctagcatcggctgctacccctgccatgtttgggcatgaacgcagcccgtgggtgccggttcattctttcgagcgcatcttttctttctctcgctctccttcgaatccaaccatggcagcccctccttccattactcaccatcacccatggcttagcacaaaagagaaattaggcgtggcaggaagcgaggcagcagcgtccatgtccctcccttggccgaaaagaccctaagcccccagcgcatcgccgccgggcccctctgcagcaccgtctccggcatcttgccaaagggtgtgtagaccttgccggatccgccctgccgccgcggatccagtatgagttccctactccgagaaccccgcgtctattagttctccgttagttgaattggcttgagaaattgcttttcctgggttgag

SEQ ID NO: 43458 - DNA, 343 bp, Triticum aestivum
  Clone ID: PAT_TA_43458
cgtccgcggacgcgtgggcagctccagagttccccacgaagcgagcgtgcgcgacctgaccgaattccccccaccccaaaccctagcccgcccgcccgccgggcccccggcgccgatgccgaggcggctcctggagggcgccatggcgctggcggtgacgccggacgccgccaactcgtcgggctccggcgccgcccccgggtcgggccccctgtggtgggtgtccggctgccacggggcctggtacagcctgtcggtgatgctgccgtcgctggccttcgtcgggttactggcgtggcaggcccgacgtaggtttcgttgccttagctaccgccgttcccac

SEQ ID NO: 43459 - DNA, 404 bp, Triticum aestivum
  unsure (1)..(404): unsure at all n locations
  Clone ID: PAT_TA_43459
cgtccgcctagctccgccgccgtcactaccactcctctttgctctgctcccggaacggatcgagagctggccgccggcgaccatggcggagcccgcaggagcaggagctgcgcctctcctcccaggcctcccggacgacatctccgtctgggagatcctcgtccgcctgcccccaaaatgcgtcctccgctcccgcgccgtctgccccgcgtggcgccgcgccacctccgcccgcgactttctcctcgatcaccacgcccgacagcccggcatcccctcctgtacgggtacaactacgcgtncgtggaccttctccccttggactaccggccaggggtcgtcgccgtcgaccagtttcggtccgtcgctcgacttgcacaacgactcctaccggcttgatgact

SEQ ID NO: 43460 - DNA, 453 bp, Triticum aestivum
  Clone ID: PAT_TA_43460
cgtccgcggacgcgtgggtcggagagaggttcacacggctgcggttgtctcgtcgccgtcttggtctgcccgtcccggtccgcgcgtcgcggttctcacatgaccaccgggccgcgctagttttcacggcgtggccatggccgtcgtcgtctgcgtcaccggcgccggcggcttcatcggctcctggatcgtcaagctcctcctcgcccgcggctacgccgtccgcggcacctcccgccgcgccgatgaccccaagaacgcgcacctgtgggcgctcgacggcgcggcggagcggctgacgatggtgcaggtcgacctgctcgaccgggccagcctccgcgccgtcttccacggctgcgacggcgttatccacaccgcatcaccgatgcacgacacccccgaggagatcatcgagccggtgatcaccgggacgctcaacgtggtggagatggc

SEQ ID NO: 43461 - DNA, 425 bp, Triticum aestivum
  Clone ID: PAT_TA_43461
cgtccgcagcagagagggagaagcagaggcagagatgcagatgatgggggcagtgctggaccacttccggtcgtcggcgtggtactacctgacgccggtgctggcgtgcgcccccgtcggggtgttccggacctacttcaaccagtacctccggcggcccgtgcggcggctcctcccgttcctggacccgttcgtcaccatcgacatcgcggccaagccggaggactactccttctcgtaccagggcaaggtgaagtcgagcgacgtgtacgcggaggtgctggcgtacctgagcgcggtgtgctcgcgggacgcgcgggagctgcgcgcggagggcgccgtcgagggccacaccttcgtgctcagcctccgggaggggcaggtggtggcggacgacttcaagggcgtcaccatgtcgtggtccg

SEQ ID NO: 43462 - DNA, 155 bp, Triticum aestivum
  unsure (1)..(155): unsure at all n locations
  Clone ID: PAT_TA_43462
tttgtttcctttnccttaggggggaagactgaggggggggtttcatccaaatcataatgtttaggccggccataaatatcttctgtgtgttaacaaaaagggatatgctgcgcactccccatcctccatatgtctaaatatgaacagtaaatgca

SEQ ID NO: 43463 - DNA, 432 bp, Triticum aestivum
  Clone ID: PAT_TA_43463
cgtccgctttgtttagtctccaccctctttctccgataccttttttttcatttgtatgtcaagggtgagaatgagaggctagataaacaaacaggaaaatgctcagttcgttcaggccttagggatgcattccatcatcactgtccatcaacaagttcaactccgacaatggttcaccgataatgtgggccggtgcaccacgtcagcaacgtcgacggcctgacaggccattttccaactgggcctattgtaaatgacgagaccatgaggatgtaatcagtaatgttgctcctaaaaatgaagatgtactttgtcgttccactaatctcggcaaaagagtagatatggtgctcctcgtgctatagtggaattgaatcacaaaaaaatctacaaattcatcaaacaatgaaggaggttagtttttacctgagc

SEQ ID NO: 43464 - DNA, 186 bp, Triticum aestivum
  Clone ID: PAT_TA_43464
ggagcgcacgcgtccgctctgctcgtacggaaaaccccaatccacccacgaccagccagacagccagccgcacggagaggcgcactgagttcctagctccaaaccctggggatccgtttggtggaggcgaaacatcgtgtcagggcggcatgtccggcggcggaagaggacgaggggaggaggagg

SEQ ID NO: 43465 - DNA, 396 bp, Triticum aestivum
  Clone ID: PAT_TA_43465
cgcgtccgcccacgcgtgcgcccatgcgtacgccgcctacacccgacgtcgccgtccccgccccctggcactcccgacccgacggcaagtcgggcgccgccatgcccgcccttccctttgaccgatctcctgcttcctctccgtcgacgccgtgggagcacccatcccgctgcccagaccctaaccggtgacgccgccaccgggacgcagccgcagccacgcccctgcaggcggtgccgacggagccccacccccaccggcgacgcaaccggagccccgaccctagccgatgacgcgccacaccacctggcagaacaccgtggggaaggccgatcccgcgagggtcctttaccaaccttcacttttcggcgaacaccaagcccggtgcgggtgggg

SEQ ID NO: 43466 - DNA, 386 bp, Triticum aestivum
  Clone ID: PAT_TA_43466
cgtccgcccacgcgtgcgtgacagtgcgcttgagccacagatcccactctctaacttggaacttggggagaacgagcaaccgggcagttaacactcaggttgaaatacctccatgcgcgctaagacacccagacaaaggacattgatggggataatgttgttggatacttgcaaaaccaagctatgggctgctgaagaacgtgacacatactacaaactgaccatgacgaaatcccacatgaaggcctatgtgtataatgcgagctgggaaagttgaccacagactatgatgggagctgctctgctgcagagcaacaacctaacacaggctgtggaggatgaacttgactacacaatttgctcttatgggtcacggagatcactga

SEQ ID NO: 43467 - DNA, 453 bp, Triticum aestivum
  Clone ID: PAT_TA_43467
cgtccgcataatctctttctcaaccccatctctctctctcgaactcccaggtctctccgcatctgcccatgatgaccagatccatgtctctcaaattggatcaaggaatttgggcatggatccctctctcaatcacgtctctctctttctcacaaactctcagatctcttctctcctcacctcaaattgcagcaaggactcttttatcctcacctcaaattgcatcaaggactcttctatcctcacctcaaattgcagcaaggacgttggggcgtggatctcctacgctcaacgaggttatcgcactaaaattattttcctcatgtggatcaggttccccttctcacaatgatttttttttctagattggattcaaaaaaatctaagtattcaatttcaaatctaatcttcttacgtatgctctttggatacgtcacggagatcggctcgggg

SEQ ID NO: 43468 - DNA, 370 bp, Triticum aestivum
  unsure (1)..(370): unsure at all n locations
  Clone ID: PAT_TA_43468
cacgcgttcgcccacgcgtccgcccatgcntccgccgccttcacccgacgtcgncnaccccacccggggggactcctcaccggggggcgagtcttacgccgccatgcccgcccttccctttgaccgatctcctccctcctctccgttgacaccgtgggagcacccattccgctgcccagaccctaaccggtgacgccgccaccgtgacgcattcgctgccacgcccctgcatgcggttccgtcgtagtcccacccctaccggctgacacatccgcatnccccaccctagacgattactcgccacaccatttggtagggaccttgaggaagtccgatccggcgaggatcctttaccactcctcacttttct

SEQ ID NO: 43469 - DNA, 282 bp, Triticum aestivum
  unsure (1)..(282): unsure at all n locations
  Clone ID: PAT_TA_43469
cgtccgtacttagctgccatggccaggttccacttccaccttctcttcttcttcgtcgtgcttgcgctgcggcaccagcagcagcgggaggcaagtggcctctgcggacgacgtctatgacacccagctgcggcaggaggccatgatgcaggccctcggggtggtcgccctcttcgacctggccaccaccgacnccaaggcattgaggcaggtgaagcgggcgctcgcggtgcttaacggtgaggtcgaggcccgcccccagcagtggaaggccatctttaa

SEQ ID NO: 43470 - DNA, 319 bp, Triticum aestivum
  Clone ID: PAT_TA_43470
gcgcgtgcgcccacgcgtccgcggacgcgtgggtgcgtatccggcaccttggcccgtgtttgaatgtgacaaagggagggaaaccaaggcgggagaccctgccttccatgcctaggtccttctacgcgccccgcatcctcggcagggccatggccatcctattcctggcgctcaccccgctctccaaggccagggcggcgcggacccttctcctcttcaagaagcgccgggcgcgccatctgcgccactacaactactcctactttggcaagtaccagtttctcgccctccaggttccccatctggtccttgccccttc

SEQ ID NO: 43471 - DNA, 241 bp, Triticum aestivum
  Clone ID: PAT_TA_43471
atctatttctacccacgcgtcctcctactcgtgcgaaaaaaaaaacctataaaaaaaaactttaatataaatttaaaaaaaaaaaaagcgaactaaaaaaaaagggacgtagacaaatcttcaccttctactatcttatataataatcaaccatcacattacaacctcccgccccttcttaaaaaacccacttttcttaccccttcttcccaatataaatttttttttatttcccccctaa

SEQ ID NO: 43472 - DNA, 230 bp, Triticum aestivum
  unsure (1)..(230): unsure at all n locations
  Clone ID: PAT_TA_43472
aattcccggggggagccacgcgtccgcggacgcgtgggcggacgcgtgggcagacgcatgggctcactcgctccatgggttccggcgtttccttcttggccgtagagagatgctncccctnaactgagctgcttccttacgggagcttccctgacctgagcttggttctacctggagtgggcgcaacaagctcctccatcagagcaaagcaggcttccttggcttctcca

SEQ ID NO: 43473 - DNA, 439 bp, Triticum aestivum
  Clone ID: PAT_TA_43473
gggggccacgcgtccgcgaagccattaaatccctcggtgataatctcagaagaactaggtaagaaaaacattacgaggaccggccctcatgtgacgtgttcccctctctgtgcaggccctggcccctgggtacggagccaaattgatgctgcaaagaattaagaccgggatcagcaaaaagaaaaatcttaggttttcacatgtaggatttggcaaagacgagcgtcgtgcattgcatattactaggggcttgcatgctgatgtcacttgggtggaagaagaggagggaacttcagaacccctgggatgcacatgaggatgatgcagcctcctcatgaagccaagaacatatcatcattctactgtttggtggtgaagtatagagctgcacccaacggccaaagtggtcagagagcatgtacttgggcagcttctgcta

SEQ ID NO: 43474 - DNA, 188 bp, Triticum aestivum
  Clone ID: PAT_TA_43474
cgtccgcccacccattaaatgactcgttggcaatgtcatatcaactagttaataaaaccgccaggggaccaggggtggggggagtgtcaacctttatttgcaatatatgatcccattttaccagaccaaaatgatgctcaataaattataacgttacatataaacaatatcttaattcttcatttatt

SEQ ID NO: 43475 - DNA, 453 bp, Triticum aestivum
  Clone ID: PAT_TA_43475
gggagcccacgcgtccgcggacgcgtgggcggacgcgtgggcgcgcctcatccgcaggcctctggggctgcgccggctcctctgcaggaggggcccgcgccgccgcagtactaccaggcgccgccgcagtactaccagcagggacccccgccggctatgtggggccatccgcagcagcatatgcctccgcagtacgcgcccccgccgccgcagtacgcgcctcagcctcctcagcagtacgcgccgccgccgcagcattacgcgccgccgccgccgcagtacggagcgcagatggctggcgggccgccttccggaggcgaggatatcaggtcgctgtggatcggagatctccagtactggatggatgagacctacctctacaacgcctttgctcctgtggggccgcagcaggtcacctcaatggaaaataatccgcaacaaacatactgggca

SEQ ID NO: 43476 - DNA, 177 bp, Triticum aestivum
  unsure (1)..(177): unsure at all n locations
  Clone ID: PAT_TA_43476
cgtccgacaacttcaatcactttctcgtcgtcattgatccgcccccattctacggctctaacccctatggcacccnctacgagatgatcggcgtatacatcaanaccctctccacatttctctgaagtgaacactaaccaaggtataatatctacttcttttcaactacacatcatt

SEQ ID NO: 43477 - DNA, 404 bp, Triticum aestivum
  unsure (1)..(404): unsure at all n locations
  Clone ID: PAT_TA_43477
gggagcgacgcgtgcgcccacgcgtgcgctccctcgcggggttctcctctccccccccatgggctccgccgaaaggcccggcgccgacaccgggggacccaaccccagccccaaccccggcggccggtcggcggcggctccggtcccgccgcgcaagggccggctcttcctctccccttcacgggccggctcccccaggcgctccgtgtgtcggtcccggtccccccgcgaccggcgcagccgcagccgcaggcggagccggagccgcagccgcagccgtagccgcantcgcagtcggaggcggagtccgcgccagcccgaagggaagggggggggggaaaacgacctcaccggcgagggggggcgggactacctgggcgacaggtgcacccgctccgacctcg

SEQ ID NO: 43478 - DNA, 426 bp, Triticum aestivum
  unsure (1)..(426): unsure at all n locations
  Clone ID: PAT_TA_43478
cgtccggcattgtgcgtagctttacaccaacgcacaactaactattactactccagtantnaaggagcagaggtangatgggggacttggtggangcccanaagccggtggtggacttcctgatcagaagggccgggctccggcaggacacggtggacgtggacggcgcctgcactgggctcaccttctgggtgcgcaaggacaagctccccaaggacaaggccaccgggtgcgagatcacgcccgaagcggcggggccgggctccaagaagaagagcaagactaaaggcaagggcccgcgggcatccggcgggctcgtgcacgggttcccgggctaaggcgattggacgtggcagttccaggctggggggctggggaagcactacgacggttacattcccgacctgctctacttcngggggttca

SEQ ID NO: 43479 - DNA, 424 bp, Triticum aestivum
  Clone ID: PAT_TA_43479
cgtccgccgacgcgtgcgttcaatttgagtccaatagtaaattattagctgtggcgcgcgtgtgtgtgactcatgcatgggggagcgaccaatgggatacctaattgccagtgcaagcgattgactctgtgagcttatgctctccacatatgaaatgaacaccgcttggattgggtgcccccttcttgattccgatcgaaactttcttggaatgaacctacaaatctgcaaaaggactacattcgcaccattgaacaaaatacttcaatgccttgaatactttgggcctggaagtgattatacgctagctggccttaaacaatgacacgcaacaaatgcacaaaatgtttgaacaccccaagattgtatacatgagactgactctttacgataggaatactgggccgatccctggatctcactt

SEQ ID NO: 43480 - DNA, 328 bp, Triticum aestivum
  Clone ID: PAT_TA_43480
cgtccgctgacgcttagttagcagagaccaaatacatctactgtgacatacctcttgagggtgtggggaaacccaaagagcgggggggcgcatcaattctcacaaataccaattttaaacatatctactgttacctgacgcatcaactagcacacaacactgtgaatggatgcaatctgagaccaactgacatgtttgcgactggcacccttagtggacctaaaccatactctttgggatcttctctggagataacgtggaactggcaaaaagagatatcagtcgggaattctatccgcatgtttctccaaaatggggattaattcat

SEQ ID NO: 43481 - DNA, 448 bp, Triticum aestivum
  Clone ID: PAT_TA_43481
gggaggccacgcgtccgcccacgcgtccgcccacgtgtccgcccacgcgtccgcccacgcgtccgcggacgcgtgggactcgctccgcctgcgggtggcccctgctccgctccgctcctccccatttcctgccttcgttggtccccagtccacagggcagcaccggaagcccgaaccccaccgcgccggtgaccatgaacgcgggcgggcgccggcgctacacctcggagcagctcctcttcgacgtccccgccaatgccgcaacggcgggcggtgccggcaggtggacccagcgcggcgggttgcgccgcggggacggggagatcttcttgtcggtggacccggcgaccccggcacgggtgcgcggaggggacacagcggctggggagtctcccgggcagaagcaccagctcagccccgggctgctcgacctccacgcctttgatac

SEQ ID NO: 43482 - DNA, 452 bp, Triticum aestivum
  Clone ID: PAT_TA_43482
gcgacgcgtgcgcaaatggcctgcgcctttctcttcttcttcttcttctctctctaaaaaaaaaaaaacgcctgcgtctccatccacggatgcccgtgccacccccacccccgcgcgccggcggtcgccggagcccgcctcgcccccctgtcaagcccgcccccaatcttcagctgcgagcctgaattgctgcgggccgacagggggcgttaaccagcctctgaggaaactattcagagccagccagtcttcttctggtccattggtggactagggcgaacttccttcctcgacaaccggcctcaatcccatccttcctcggttccagatagacgtcactcaggagatctacgcaggcggggatccttggttggcagcggtgcaccgtacctggcgttcgttcatacacatgggttatcactctaggttcattgacgaggatgagagcacaa

SEQ ID NO: 43483 - DNA, 231 bp, Triticum aestivum
  Clone ID: PAT_TA_43483
cgtccgcggacgcgtggggccgagatgaagaatggcgtgctctgggtcaccctgctcaaggtcaaggaagaggagcgcacggacgggttccacttcaaggtccagtaggcagtgccgtcttggtagtgctcatggaggatggccgacgcgagagtgtgagagacgccttggtgatgtgggcatgtttggtgtctttctccttgttttgcttaggtgatcgtcttggatcca

SEQ ID NO: 43484 - DNA, 369 bp, Triticum aestivum
  Clone ID: PAT_TA_43484
gggggccacgcgtccgtagccacccggcaactctcccacactccggctctgtagcctttccctttccccgttcatgtggtccaagcgctggggcgtgctggctagctattttgctctatctagcccgtcacaaccctaacctaaccctgcgggtctccaatcctttcctcatggagcctgccatcaacggatacaacccctacgactagcatcagcagttcgatcccagtcggatgattcgcttcatcaaaatgaacgccttggttaaacacctaggcgatccttaccacgcttattgtatagcatgttgtaaagagcttttcgaactccatatgaagtgggagggggagcaatattttaaacctaata

SEQ ID NO: 43485 - DNA, 443 bp, Triticum aestivum
  unsure (1)..(443): unsure at all n locations
  Clone ID: PAT_TA_43485
cgtccgcggacgcgtgggggaagaatggttggagtggcttctcttcaaaatctgtgttgaggaggagaagttcaaaaccggggttgcggccctaggttcaactgatggtggtgaatctggaaatgagttcagtgctaagcatgcatttcttatgggtacattgtcaaagtgtttgactgaacgacctgaagaagttagtatctcaaacagttttgctcttcatgtattcaatatactgaagcatgctgctgagactctggattttacttgccgaggtagctctgagcttccaattggtctccctggaattgatgtccttggatattcattagtgctcttgaaggacatatgtgcttgggaaccctcttcatcagagactgaagcaccagttgactcaccgttgcanggtgagccctcttcatcggggactgaagcacctgttg

SEQ ID NO: 43486 - DNA, 156 bp, Triticum aestivum
  Clone ID: PAT_TA_43486
cgtccgaaaaaaaaaactaaagataaaatgccctaaataaaccaccttttagctccgggcctcaccagggggggggcggcctctttacagggtccatgttttctttctcgctcaggccacgccataccccttgcattgggtaacctaaattcaatc

SEQ ID NO: 43487 - DNA, 188 bp, Triticum aestivum
  Clone ID: PAT_TA_43487
cgtccggaaaattcaaagcatgacagaatgtgacatacctatcaatcatacacaccatcttatcgccggggcattactacacatgtgggagcaactatacaccaaattgtttcatcacaattcactacccaacaccagtccattagataacaataatcttggatctgtcacacatcttatcaactgaa

SEQ ID NO: 43488 - DNA, 448 bp, Triticum aestivum
  Clone ID: PAT_TA_43488
cgtccggaaaattggaaagcaagcaaaccagccaattgttttgctcatcgacgagcttgatctccttttggcaagaaatcagtcggggctgtataacattcttgattggcccaccaagccaaattcaaacctagttattatagggatagtgaacacaatggatcttccagaaaaactgttgcctcgtatctcaagtaggatgggtattcaacggctgtgttttgggccctataattatcggcaactgccggaaattataacaagccttcttaagggtaacaatgcctttgaagatcaagctattgagtttggttttagaaaggtaatttgttattccggtgatgctaggggggccttagaaattagtagactgcgcagcagagttcgcacactaccgtgttaaacaattttaacaagttgaacagacttcctcttatggaatacagga

SEQ ID NO: 43489 - DNA, 418 bp, Triticum aestivum
  unsure (1)..(418): unsure at all n locations
  Clone ID: PAT_TA_43489
ggtgctgagttcgacgagggtgaggatggtgatgagggtgatgagtactacagcagctgatattgcgacctgaggatctgcccgagggggtttatctgctttctgtctgatagaattgaatgtttgctgtggggaggtcgggttacaaccttttgttgtgtatgaacctggttctcaccttggtcaatttgcatattatccactttgtcttctccagcaacaaaggaaaagagtacttcttctccataaggggggccggtttcaatgatccctggttacntacgcgtgcctctgataaatcactttcctatacgggacctaattctagtccactgtccgacgtttaacacctctgtcgctgttaataccctgatttttcctaactatactacctctcattacattcctcttttcccaa

SEQ ID NO: 43490 - DNA, 363 bp, Triticum aestivum
  Clone ID: PAT_TA_43490
cgtccgttaaattactgtgcacagcaccaactttcttcgttcatgagcatatgcagtcagccaatttgcatatttcaagagcgcgagccctgttaaaaaaaaaaaaaaaaaaaattaaatataaaataaaaataaaaaaactaaaaaaatataaagatgataaatacaaaacaaaaatacctaaaggggggtgatacaaaggatcaatctacaaacacgactgaaggtgattaaatctttttttaaaaaattgacttatgtttataacttggcggtttttctaaaaaatctttattttaaaaatccttctttttcccaataaaatccttttcttgacatattctttttaaaatacaatttata

SEQ ID NO: 43491 - DNA, 428 bp, Triticum aestivum
  Clone ID: PAT_TA_43491
cgtccgcccacgcgtccgcccacgcgtccgcccacgcgtccgcgcgctcaaaagctcccgccagcgccatgcttaaccagagcaccagtcttgggcaggatactatcatcgtcggtcgtttcatcgtattcactatcaccatcagcatacgtcgtagccctgccattctggggtgctgtgtctatttcataacgaagctcatcttgaattttctgttcatccatcaatagctctggttgatcagcttcacatgccttcattgtttcctctccaacagatgcaatagcagcagccactgaattctcatcatcgcctatagttgattcgtcctctttgatctcttgattggcacacacttgtagctcatgtgccgaaacaacaccatttctgccgtgatcatcattgacaactgtctccaccatttgaac

SEQ ID NO: 43492 - DNA, 453 bp, Triticum aestivum
  Clone ID: PAT_TA_43492
tccggggggggcgcacgcgttcgctcgagcaaccgcgccgccgccgccgacgctccacccagcgtgttgtttgcgtgggcgccggggaactcggggggggggtggaccatcaacctgaacatcgcgaaccccaccacggggtggcagaagaagggcgagatcgatgactaccagaagctggggaacctttatgacaagagaatctcccaggagggagttggtgatcttctgggtgagggattcaagggttatatcttcaagatcatgggtgggtgcgataagcaggggttcccaatgaagcagggaggggtaacttctgggcgggtccgccttctggttcacaggggcacacctttcttacgggggtttggcatgcgtaatggggagcgcaggaggaagtccgtccggggttgcattggcagccaagacctggctggtgtcaacttcatgatt

SEQ ID NO: 43493 - DNA, 154 bp, Triticum aestivum
  Clone ID: PAT_TA_43493
cgtccggcaaagcatcctcgcctgagaaggtctcctcataatagtcaaaccccatggcaaaggcgagcgtgctctcgaacgtgtggggggactcctaccgctagctctaaaagagggggcggcgattaccctggacctacccccactgcaccaa

SEQ ID NO: 43494 - DNA, 426 bp, Triticum aestivum
  Clone ID: PAT_TA_43494
cgtacgcgtacgcgtgcgaaaatacaagggctatccaacttatgactcatcctcgaccacttggtgatgcgctagaacgagggagtggtgcgtgttctttcacagcgaatacgatgatcggaatgcacattactatcgtatccttcaagacatgggcctggggagggtagaaatctatgagttcaccaggctcaatatgggttataccggtcttagcaagcgcaagcttctgtggatcgtacaaaacaatattgtggaagactggactgacgcacgctttcccactgatcgcccaagacttcaagaccgacctccgattccagtcctccatccaatttatacctgggcgagggcggctcaagactatctcattcttatcgattgggataaactctggacaatcaacaagaagatagtggatccttt

SEQ ID NO: 43495 - DNA, 450 bp, Triticum aestivum
  Clone ID: PAT_TA_43495
cgtccgcccacgcgtccgcccacgcgtgcgcagaaccgcagaggcttcggcttcttctgtcggcggacactgttgcaatgggcgggcgacagacagaagaggattgtcactgtgatcccgaacaactgctcctcctcaagtcatccctgtctcctgtaagaatgcagcatcagaattcagtttggcagttccttctggtggtgcgcaccaccgattggaagcaggggtaactggcttgcaaatgttctggacatgcacaaaaagggtgcttttgcgtcccattttgtcagttgcaagtgtagccatctctagatcatcactgagcctaagtaactgatgcacggcgcccgacactgtctccttcccatctccatggaccacattatttttaagctgccaagctttccaaagaatcatcaggattttgcatctaaaccacgaccacccgcg

SEQ ID NO: 43496 - DNA, 442 bp, Triticum aestivum
  Clone ID: PAT_TA_43496
ttggcgggggggggccacgcgtccgcggtgatctttgtagcgatgaaatgttcttccagcaattcatagcacattagggcccgggattcaaagggggagggggcttcataattgatccctgagattgaaaccaattaaaggattatcggagggacattttagatagggtagataacaagatatagtaggtacatcagtaaaacatgaagctttgcatgttaaggaggaaattaataagaagagtgataggcatagaagctagaacgaggatgggtgataactgacagctaggtttgtgagggggtcagcaaaaagttttgatgaatttagtgggagatcccaaaggacatgttcgcattaagaacacagcaactttgatcagtacaagtgtataacagtaggaagttcacaggctacctttgttcaagtgaaatactacttg

SEQ ID NO: 43497 - DNA, 452 bp, Triticum aestivum
  Clone ID: PAT_TA_43497
cgtccgtgatgtcaaagttcccagacctgccgagggttgcgacctcagagaagaaggagtacccagtggatccatccctggcggatatcaagaacagcatctatgcctctgatgagttccgcatgtactccttcaagatcaggccgtgctcccgggcgtactcacatgactggaccgagtgcccctttgtgcaccctggggagaacgctcggcgccgcgatccgcgcaagtatcactacagttgtgttccatgccctgatttcagaaaaggtgtgtgccggcgtggagacatgtgtgagtatgctcatggggtgtttgagtgctggctccacccagcgcaataccgcactcgcctttgcaaggatggcaccggctgcaatcgccgcgtctgtttcttcgcgcacaccaccgatgagctccgcccactgtatgtctccactgggtccgcagtg

SEQ ID NO: 43498 - DNA, 230 bp, Triticum aestivum
  Clone ID: PAT_TA_43498
gggggccacgcgtgcgttccaaccccctcctcgccccgtcgaatccatcgaggcgaggaaaaaaaagagtatagggtaggggtcctaatggacgagtgctagaaggttctagaagcgtacgctcgttgggagggctgcgggcggtgcgctgcggtggttgatggaggaggagaaggccagggggttctcctctggggcctcgtcgctgatcccggcgacatccccagaga

SEQ ID NO: 43499 - DNA, 243 bp, Triticum aestivum
  unsure (1)..(243): unsure at all n locations
  Clone ID: PAT_TA_43499
cgtccgcccacgcgtccgccccgccccctnctccaccgtatctgcccccttaaatccaccgtacctacaccgccacgatggggggcggccctcccccatcttttaatatataaaatccctaacctcatacatcatcaaacattttattaataatatattttcccctaatcattaattttgtgtttccattcaaattaaactcatattgccataattcccaattataattattacaactacacc

SEQ ID NO: 43500 - DNA, 262 bp, Triticum aestivum
  Clone ID: PAT_TA_43500
cgtccgaaaaaaaaaaaaaaaaaaaaaaaaaaaaaaacgggcgtcccttctaaaatatccagtctggcctactcgtgcatgcggagggataactcttctattgtataacctaaattcactcccctgacacactttatacatcccagttattctttaaaccctggcatcacccaccttaatgggctttccgtacatacccctttcatcaccttgcttaataactaaaaagccctttaccaatctccctccctaacatttcccc

SEQ ID NO: 43501 - DNA, 306 bp, Triticum aestivum
  unsure (1)..(306): unsure at all n locations
  Clone ID: PAT_TA_43501
ccaatggccgggtgcgagcccacgcgtccgcccacgcgtgcgcccacccctgctctgccctactgctaatcaaactcctacggtcaggggangaatgcgggggggtgtggactgccttttataagccctttatgagattataaaccttaacaacttcccaggaaactcacttacgcggtgcaaacacagcatcaaagactctccaataactgaaggtgttctggaacggtatcttctttcccatacacaacggcctacacaactatctaaactcctacacgaccaccaaaacatgccctcaaacta

SEQ ID NO: 43502 - DNA, 349 bp, Triticum aestivum
  unsure (1)..(349): unsure at all n locations
  Clone ID: PAT_TA_43502
gggcacctatctaagcaaatttacctctcccatctgatacatacaatnatgggtntagancagaaaagtggggggggggaggggcaattttttcattattaaccatcgcatattctttgctacaccatcanctcttataactattgtggctgcacttggtaagaaggatgtctacttggcgtacctcccggttggacacattcttgaggtggcaggtgagacgattatatctggtgggggggctactataggagatggaccaccatttaccctggctgggacgttatataaaattaaaaaggcgaccaaaggggatacccttccacttatgccaacacttatgactggg

SEQ ID NO: 43503 - DNA, 427 bp, Triticum aestivum
  unsure (1)..(427): unsure at all n locations
  Clone ID: PAT_TA_43503
gggggccacgcgtccgggttccacatccgctcgcaactcgagatctgcatccatgtccggtcnttacaaggggggcgaaggcctcgggaagggcgggcaccaacctccacaagaaggttctgctcgacaacatccagggcatcaccaagccggcgatcctgctgctggcgcggaggggcggcntaaaacacatctccgggctcatctacgaggagacccgcggcgttctcaagatcttgctggagaacgtcattcgcaacgccatcacctacaccgatcacgcccgtcgcaagaccgtcaccgccatggacggtctctacgcgctcaagcgccaggggctcaccctatacgggttcggcggataggccccgacaaccggctgatgtctctctcgccggcttcaaattccaaaagcttgattgaaccc

SEQ ID NO: 43504 - DNA, 450 bp, Triticum aestivum
  unsure (1)..(450): unsure at all n locations
  Clone ID: PAT_TA_43504
gggggccacgcgtccgcccacgcgtccgtcctcctctactctgctctactgcaaatcaatctgctacaatggggggagggtcatgtgggtggggtgcatggggatgaggagcccctgctttgatttgagaacgtgatgcgtcttcaggggggtcacatgcgcatggcgaacagataaggaagggcacggtgaactcagccgtgtttggtgcccgcatttcccctgcctaggcggtggagctagcacaactgaagaaccgagccaagatcacgggaagagctgtgcgagcgagcgatcggtcggctagctcgatcgccatgagcagcttctcggggcagcantcaagggcgtggacgggggacgccgcnncccccaccccgtctggcgactcgcgggacgacngcgcctcctccatgaaggacctcgggtgctccaccaacgccagcgcca

SEQ ID NO: 43505 - DNA, 187 bp, Triticum aestivum
  Clone ID: PAT_TA_43505
gcggcgccacgcgtccgcccacgcgtccgtccacccgtactcttttctactaaaaaaaaaaataatacaagggtggggggctcccggtgtggaggagccaagcttatcaacacccgcttgttacattatagatcttctatcgtgttacctaaattcacatgactatgcggaactttacaacgaaggg

SEQ ID NO: 43506 - DNA, 329 bp, Triticum aestivum
  Clone ID: PAT_TA_43506
cgtgcgcgtcccctccctgcttctccgccggcgccgccgccaccaccctgcaaatacatcacacggctgcatgagagctagcccgcccgcactggcaacgcgccttcgcctcctggtcttctctatctcggcactggatccgtacccgcccccgtttggcgtcccggtcgatggcgctgaggaggaggcggatcggttctgtcgttgggttgagcggcggctggaacgggttggccacagagatggccgtccgcagtgttcttctcatgcagagaataggaggggagcgtgagatgaacaggtgccggaatgggggacatcgagcccat

SEQ ID NO: 43507 - DNA, 360 bp, Triticum aestivum
  Clone ID: PAT_TA_43507
cgtccggcccggcgccatcggagccggcgcctacaaagctccttcctggaaggccggggctgttcccaaggtgtctcaacagcccgaaggtccgcgccggacgacgcctgcctttgcccctgtgcctcagatgcctcggagctcgaagagatccctagcccggagaccaccggcctctctccggatcgaaggaaggaggaggaaacagagcatggactgcctgccatgccctccgtcgagaagcgtaagacggagggagtacacgatttgtgcactaattggtcaatggcatatgtgttcttggtggcgagaacagttattttcttagacaccggggttttatggaaagtggatttttct

SEQ ID NO: 43508 - DNA, 377 bp, Triticum aestivum
  Clone ID: PAT_TA_43508
cgtccgacccaaccccaccctcgtctcccccggatcggaggcgcgcgagcgagatggcgaacatcgacatggcggcggtgctggcggacatggagcgggacgcggcggcggacgcgcgcaccccgcggaccaagctggtgtgcacgctcgggccggcctcccgctccgtgcccatgctcgagaagctgctccgcgccgggatgaacgtcgcgcgcgttaacttctcccacggcacccacgagtaccacaaggagacccttgacgcccttcggcagggcatgcacaacaccggctttctttgcgccggattgctcggcacccagggacctggagatttggacttgggtttttcgaaggggtgggtaaaacccaatcaa

SEQ ID NO: 43509 - DNA, 368 bp, Triticum aestivum
  unsure (1)..(368): unsure at all n locations
  Clone ID: PAT_TA_43509
gggacgccacgcgtccgccaagtgccagaagatgctatggatgatgaatcaattgaatgggtgcctcttcaggaggggcccccctctccagatggtgaagtgtcanttgccacgacagacactgattctgtagaaagtgatgacgatgaggactatgttgtatctgcaaatcaaagcatgtctgagtctgaccatccagataatgatgaggactattggcgatctggacataaggtgcctcaggaaatctctggggaatcagatgaccctgatggaaccacgacttcctttagttcctggtatgtctgacccccaggcattggggggcgggaattatttaccctttttagagggtgaaaaggggccct

SEQ ID NO: 43510 - DNA, 157 bp, Triticum aestivum
  Clone ID: PAT_TA_43510
cgtccggtggacgtcagtgggtcgagctagccaactagcgagtgtgtgcggtgcgccactggttggacggccctgccgctttcgcgcggctccatcgcgatcttccggctctccgtgctagtaacccccctgtcctgctgctgtctcgtgcggctcg

SEQ ID NO: 43511 - DNA, 315 bp, Triticum aestivum
  Clone ID: PAT_TA_43511
gcgcacgcgtccgcccacgcgtacgcggacgcgtgggtcggcgcacactacacaaggggagagagagagagagctcatcggcctagctaaggcgtaaccgacctacctccctccctccctccatcccgtcccgtgggcggatcggcggccatggaggtggagccggggtccaacgtatgggaggacgcccccgacaacatccttctccgcgtcgacgtctacctcccctttccgcctcgaccgtctccgcatgtcccttgtcagcccacactggcgccgtgccttgtgcgggtggggccaggggcgccccccgca

SEQ ID NO: 43512 - DNA, 396 bp, Triticum aestivum
  Clone ID: PAT_TA_43512
cgtccgcccacgcgtccgcggggatcttcgtcttcctccatcgctcctcccctccgccaggctccaccccactgctgcagctccggcgtccgcccgcgccggccgcagctccctcgccggccgccttcctccgcttcaattgagagcccaaactcatacgcaactccctcgccgtccgccacagcctccagccgcccgcgactcctggccttcgcgccgcccgtgctcctccctgcaccgaccagcagcagcgccgcccgtgctcctcctcctgcctgagccttccagctcctcgattcaagcactggagctccggatccggccaattgacctccgtccgtgctcctccccgcactgaccaacagcaacagcatcgcagcctgtgctccttcttct

SEQ ID NO: 43513 - DNA, 174 bp, Triticum aestivum
  Clone ID: PAT_TA_43513
ggtggggttgcaatagcgcgggggtggaggagcaatggatctgtgccactaaatagtggacaagaaatgggctggcaaccaaaccaacgggggggctactatgattatgggtcacgatttctctcattttgtgccgtgtacgaactacgatgcactgaaacttagattgagtca

SEQ ID NO: 43514 - DNA, 343 bp, Triticum aestivum
  Clone ID: PAT_TA_43514
cgtccgcacaccagagagcacggagggagaagaccgacagcggcagtggccagctagtcagggaaggccagccatggcgagcgggccgaacgggggaggcaatggcggcggcggcggcggcgggctgatgaagaacatgagcctgctgcggctgcagtactactgcgtgctgggcgcggtggccggggccgtcctgttcgccacgctccgctacatgccggccgccggcagcggcgcggccctctccaccacctccgcgctcgccaccgccgcggcgcccgccgggtccggggccggggcgggcgagcaccggaagatcaaggggacggcgccggcgccggcg

SEQ ID NO: 43515 - DNA, 351 bp, Triticum aestivum
  Clone ID: PAT_TA_43515
cgtccgcctctctcggctggctgggttggttggttggttggttcgtagtgtagtaggtaggcgaggcgaggcgacggcgggaagaagccggaggaggggaccaagcaggcggcggcgccggtgtgcttcaagaagccggcgggcgaggacaccggcatcctggagaccaccaaggactacttcaagcagctcaaggacaccagcgccgacacgcactgggactgcatcaagaaccggttccgcgccgccggcgactacatcttcaacaagaccagctcggtgtttggcaggcagaaagtggagcctgaggccaaggaggagaccccgggggcgaagccagaaagggcaccg

SEQ ID NO: 43516 - DNA, 360 bp, Triticum aestivum
  unsure (1)..(360): unsure at all n locations
  Clone ID: PAT_TA_43516
cgtccgtccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaaaggcgtcngcaagagcggcaagccactgcactacaagggcagctcgtccaccgctgatcccgacttatgtgagggcgggacttaccagggaacggaccggggcagtcattacgggagagtcgcgcagagtcgtcacagcaccagccgatcttcatgc

SEQ ID NO: 43517 - DNA, 174 bp, Triticum aestivum
  Clone ID: PAT_TA_43517
cgtccgcccacgcgtccgcccacgcgtccggctggcagaaatgggttgattgacacagcagtcaaaacatctcgtagtggatatcttcagcgttgtcttatcaaaagtctcgaatcattgttcgtttcatatgatcactctgtgcgtaatgttgatggatcaatcatacaattc

SEQ ID NO: 43518 - DNA, 417 bp, Triticum aestivum
  Clone ID: PAT_TA_43518
cgtccgcggacgcgtgggcggacgcgtgggcgatggagcgccgcgaccgcctgcgcgcgctcatggcccgcctcgaggccgagggccagttcgaccgcctcctccgcgcgcaggaggacgaacggggagcctcgggcgacgacgacgacgagggcacggagcagatcaagtacccgttcttcaccgaggggaccaaccaactgctccaggcgcgcattgacatcgccatgtactcactgccccgcgccaaggccagggtcgagagggccaagcgacgcctcgccgacctcgacgaggaccccgaggcagaggccgcccttgttgtgaagcaagcggcggacttcgcgcttgagcgcagcgagattggagacgaccgcccgctcaccggctgctccttctcccgggatgcctcgatgc

SEQ ID NO: 43519 - DNA, 157 bp, Triticum aestivum
  Clone ID: PAT_TA_43519
cgtccgcggacgcgtgggttggggatgctcctagtgtaaatgtcaagaagaactgtctatggcagccattcacagctcttcttggggatgctcctagtgtaaatgtcaagaagaatgttattgtagccattacatctgacaagggtctctggagtgc

SEQ ID NO: 43520 - DNA, 378 bp, Triticum aestivum
  unsure (1)..(378): unsure at all n locations
  Clone ID: PAT_TA_43520
cgtccgcccacgcgtccgccccaaaccaccggcgatcccccgaggccgttccgaacccctcgccgcgcgcccgctctcccctctcgccccggcacacgagcccgcgccgcctgctgccacccgcgcccgacacgtgttcgacggaaggtcaggccgggcccggcggcgcgatgtacgtggtgaagcgcgacgggcggcaggaggccgtccacttcgacaagatcacggcgcggctcaagaagctcgcctacggcctcagccaggaccactgcgaccccgtcctcgtcgcgcagaaggtctgcgccggcgtctaccggggcgtcaccacctnccaactcgacgagctcgccgccgagaccgncgncggcatgaaccgct

SEQ ID NO: 43521 - DNA, 377 bp, Triticum aestivum
  Clone ID: PAT_TA_43521
gggacgccacgcgtacgcggacgcgtgggaaaaaaaaaataaaattaaaaataaaaaaaaaataaaataataaggggggggaaaaaaaaaaaagggggaaaaaaaactatataaaaggagttttaacaccctaatagtcccctttaagaaatccaaggttacttcacacaaggttgctattatataagttttataaaatggaacttaaattaagtctattgaccatgtattaacagctaaatacctgggaaaacctaacggtaatccaattttaaaacattttacaataaccctcttttattaatgtgaagaaatataaaaaaggcggccacggaaacgttttccaaaacatatcgcagattgaaaggctattggta

SEQ ID NO: 43522 - DNA, 377 bp, Triticum aestivum
  unsure (1)..(377): unsure at all n locations
  Clone ID: PAT_TA_43522
cgtccggtcgcccccgtccgagtcgccgccattgtcccccgacggggccgcctccttccgccgcggctcttgcggctcttggcccggcgttgggtcgcctgtcaatgacgtcctcgcctcgctccgccagctgcgcctcgccaaggcgcaggcgtcgccgtccggtgggtggtccggctaccccacctcacctgccgcctacggctcgcccaaggccgccggcctctacagtctccccaccacccccatgggcgcacagactggcgcctncagcttcatgcccaacctggagccactgaacctccgcttcctcgacgacgaggagcctgtccagagggtggagtccgggagggccctccgcgagaaggtgttcgagc

SEQ ID NO: 43523 - DNA, 144 bp, Triticum aestivum
  Clone ID: PAT_TA_43523
cgtccggtggtccctttctgagtatacatcattgtctcccgacggggcctcctccttacggggtggttcttgcgggtgtcggcatggatatacatagcctgtcaataacgtcctcccctcgttccgcaagttgtgcctcaccaa

SEQ ID NO: 43524 - DNA, 230 bp, Triticum aestivum
  Clone ID: PAT_TA_43524
cgtccgcggacgcgtgggcggacgcgtgggcagtcattgtgcaatctgaggcatttcagaggcgggcttctgatggaggcacttgtatggatcccgttaggtgataatccctgcattggacagcaattttatgaaatcttttcttcatgggagataaacgaccaccatttaactgatgttgtactgactggaatgaaggctatgctcttgacactatgatattgtatcat

SEQ ID NO: 43525 - DNA, 291 bp, Triticum aestivum
  Clone ID: PAT_TA_43525
cgtccgggaagaagtaaaaatagtcatgcaaatggcggaggaagctatctatgctcaggaaagagatccttacactgcatttgcaaatcgttcacgggaaataaattatgggaactcctacttctttaagccaattagaataagtgatttgaagaaagtgaatccaatcagagcatgtgaatatttcaacagttgcttcaaggatccatcagcttttaccggtgtagtagttggaaacatagacccagccatctcaatcccactgattttggagtacctgggtgggatacc

SEQ ID NO: 43526 - DNA, 229 bp, Triticum aestivum
  Clone ID: PAT_TA_43526
gcacgcgtccgccacgctgctttgggaaatggagggagaactccagcgcgcctattaagaacggcgacgggggtgggaagatcctgacggacggcagcatggacctgaactacaagaccctgtcctaccaggagtttctcacccagggcacatggatcggggacctagtcaaacccaacatgatcctcataagcggacgacattcccccaggtgccactacgcccgcca

SEQ ID NO: 43527 - DNA, 363 bp, Triticum aestivum
  unsure (1)..(363): unsure at all n locations
  Clone ID: PAT_TA_43527
cgtccgcggacgcgtgggcggacgcgtgggcggacgcgtgggccacatgttgagtggacaaacggcggttagtggcagcagcagcagcagcagcagcagcatcgtcagccgcggcgtcgagcatgggagcgggagcggggagcagcagcagcaccagcggctgccgatcgaggaggaagaggaggagccagagttcaaggacatccacgcgctgagcccgccccgcgcgctgagcctgtaccgncggagccggccgggcagcaaggactcgtgggggtctgcggggggggcaaggggggagcagacacacgtggatcccgttccgtcggagcgacaaccgccccaagggggcttttccttact

SEQ ID NO: 43528 - DNA, 268 bp, Triticum aestivum
  Clone ID: PAT_TA_43528
cgtccggtgcccccgatctggcttcctctggtacctccagctcggcccaggacggcatgcggctggactgatggcggcttgcagtacgccaaccccctttgtgctcgccaccgatgccctctgttctctccaccgacatctccttcatcctccataggtctgggcactcccgctaccctcgcatccagcgcaggtggggacgagccccggccaccatgctcccctatactgtgacctctctctccaatgtcttgtgctggatgcctat

SEQ ID NO: 43529 - DNA, 219 bp, Triticum aestivum
  Clone ID: PAT_TA_43529
cgtccgcctcgccgtgcaccgccacctgctccgccttctcggcttctgcgccgccgcctccggcgagcgcgctactcgtctaccccttcatgcccaacggctccgtcgccgcccgcctccgagggaagccggcgctggggtggcaaacgccgaaacggatcgcggtgggggccgcgccggggcttctttacctgcacgagcagtgcgaccccaagatca

SEQ ID NO: 43530 - DNA, 246 bp, Triticum aestivum
  Clone ID: PAT_TA_43530
cgtccgcttcagcacgctctcacgagaaaggttctatggatgacgcggccggggccgaaggggtcgcggtcacctgggaggctggagaggaggatttggtggtagcggttatcacgctctaccgcccgcacctgcaatttaggaccagaaccagtttccaaccctcgctgggaaaggagatcgctgcaccatctcaagtgccacctttaccaatatcatctactctggtcaatttagattttccta

SEQ ID NO: 43531 - DNA, 358 bp, Triticum aestivum
  Clone ID: PAT_TA_43531
cgtacgaatacccctcccctgaaaccctatttaatttctcccattcataccttctttttttcccggtgcgggttctttactaagggggctagcctaataacctaatcaaaaacctatccaccagttatttattagtctatcatagccattacttctaacactttatattactctcctcctgaaccatcactcctctcccactccaaaacaatcattttccttccactcctatcccttaccaaccttaccatccttcttaatttcacatattccgcctttaccattcttttttatgatcattcccatactctttcaacttgaccacgtagaaacctatcctccttatactactttcata

SEQ ID NO: 43532 - DNA, 418 bp, Triticum aestivum
  Clone ID: PAT_TA_43532
cgtccgcccacgcgtccgcccacgcgtccgcccacgcgtccgcccacgcgtccgcccacgcgtccgcctccttgtactgcatgtcgacttgaatctttgacagggagatatttaaagccttcacttgttcattgtgtcatctgctgattactttttctattattttcttgcaaagcaagcaatggtttggagtagttgatcatggctgatcatggcctgatggaacattcatgttgttagcatttctatatctacactattacaacagcttgttgatcaagcacttctttctatctaaatgtgtgcacaaaaagttcagttaccttctaaaaaaatgatgggtgcactatctatctatatatatatacactataacagcagcttggtgatcaaacgcgtctttctaatctatatatat

SEQ ID NO: 43533 - DNA, 353 bp, Triticum aestivum
  Clone ID: PAT_TA_43533
cgtccgaactaggtatgcggaagcttgccaggagcttggtctgcaagggatagatgtgcaggacgaactgatagaatgtgcaaaaacacttgcatcaacatttaacacaatcttggaagtgctgaacagagatactgtatcacatgccatggagtactatacaacttttggtagggactgccatacacaggataaggagaactacaagtctgtggtacacaatgtgaaacaggtgcaagctaatcctccttgcctgcatgtctcactatgtaaagaggtgcagaattcactggggacagcaatggacggaggagaaccaatccactctaatgttcctgcaaatgatattgatt

SEQ ID NO: 43534 - DNA, 117 bp, Triticum aestivum
  Clone ID: PAT_TA_43534
acgtccgcggacgcttggacagacgcttgggcacacgcgtagacagctcacctacatgacgtttgggatcgatctaggactgggaactccaacatctccgccgccattgggaaggca

SEQ ID NO: 43535 - DNA, 429 bp, Triticum aestivum
  unsure (1)..(429): unsure at all n locations
  Clone ID: PAT_TA_43535
gcggcgccacgcgtgcggggaggaactcaatgttgcaaaacgaaatgaatttgctaacttgaccatcaatttngggggaaagggtattgggcgctcatgaggagtgcgctttnaaaagtcaaacagctgcattagtagcagagggttttcatgtggtcttttctcttcatatttggtggacttcagttattatatcttagcaattatcttatctctgtagggaggtagaaaagaggggggtactttggtaaatacattacttccctctattggttctctggctaacactcgccctggtgaggctgaactaaggtctatgattctaaggggggtttcacaggatatcactggtcacaacgaggatctagaaggggataaaccaccagcacttgttggggggcttaccgatgcacttgcacaaattctacc

SEQ ID NO: 43536 - DNA, 202 bp, Triticum aestivum
  Clone ID: PAT_TA_43536
acccactcttcctctgacgcgtggacagacgcgtggggtaccccctataccaaaaaactgggcgatttcaatggagagattggggcaaatgtaaaccatatatactattgataggccaccccctatatccatatattatcaaccattccgagacggtggtcaagagcgcttacaacctgtgaagacctgcgttctccttctc

SEQ ID NO: 43537 - DNA, 410 bp, Triticum aestivum
  Clone ID: PAT_TA_43537
ctgctctgctcttcccctgagacggacggcacacgccccgttccttgcctgtcgtcccgtggcgcgcaccggcgctcgagccgagcccctcacgcccgccaccgcggcagctcgccagagaacgcgccgagagatgagctgcctggggtggctcaacaggaggaaggggtccgggagcgggaggcggggctcctcggcctcggcgccggccaccacgatgacgaccatgaccaccaccaccaccaccaccaccaccaccgggtcggcggtgagcacgagccggtcggacgactccggggcggggcggcccaccagcaagtccacgggctccgcctcctcgcagcggagcatctcctcgctctacgaggagcgcggccacggccagctgcgcgccttcgagtacgacgacc

SEQ ID NO: 43538 - DNA, 237 bp, Triticum aestivum
  Clone ID: PAT_TA_43538
gttcgcggtcgacgccacgcgtccgccgagctgtaccttgccgtgtgcggaggcaaaaaggatgaatccatggggcgtatttgcgaactaaactctgggctacaccacgtcaacccaaaaaggaacaatgtttttcatttatctacaaatcaagggcatgactagcttatccgaaagctttacgtcagcttcagggacaagagcttactttgtttccccaactcggatcttgacacg

SEQ ID NO: 43539 - DNA, 226 bp, Triticum aestivum
  Clone ID: PAT_TA_43539
gggcggggggggagccacgcgtccgcccacgcgtccggggtattgaggtcaatcatattctccaacaaaacatttgcgctacttggggtgtcgggggccatgcattaatagggcacacgtatattttagcttcttcttttgaggtgcagttagaatattaactgggttcctggcccgggtcaaagcccttcttctagcaagcaatgaacacgatcatgaacgaaaa

SEQ ID NO: 43540 - DNA, 163 bp, Triticum aestivum
  Clone ID: PAT_TA_43540
cgtccgcccacgcgtccgtgaatacttatacccttcctacctttcgcccccgcgtggtcccgcaggggcggctgggaccgttccataaacgccaccactcgcgccccgtctaccaaccgcacattaccatcttctgccctgaggggcgggtataccaaattga

SEQ ID NO: 43541 - DNA, 429 bp, Triticum aestivum
  unsure (1)..(429): unsure at all n locations
  Clone ID: PAT_TA_43541
acgcgtgcgggaggaggacgatgaccaagagacgagctttgggcagttcgggttcagcaacacatacgcgcangagcacccgcgggtcctggccaggggcctcaggatcgaccggctgggctcgggcctgctgagcgccgactgcgggggcggcatcgacggcggctccgggggaggctacctggtaacctccggcggcgggggaggggaccgctccggcatcgagatccactacaagaggctcatcgaggaggacccctgcaacggcctcttcctcaagaactacgcgcagttcctctaccaggtacgcactaccctcgctgctctgctccagtgccgccattgccgcggccggcgattgcacttcacaactcagatccggagataaaaggtctaacaatggcgccaacgcgacgttcggaatggtgc

SEQ ID NO: 43542 - DNA, 270 bp, Triticum aestivum
  Clone ID: PAT_TA_43542
gggcgcgcacgcgtgcgctctcaccacaatctccatcaaattcaatatatgaacaaagcgaaaggaaacacttgcgcatttgggagaagaggggggcgtgcttccacaacaacgaccaaatcatgaccccttagtacactttaaacctacacaagtgccttcattcatgcaccttttaaaataatgtgccaaatgccatcaaagagatcacgaagttttcacacaacggcatttaaaccacctatctgcggattaacctaaaactcaaca

SEQ ID NO: 43543 - DNA, 345 bp, Triticum aestivum
  Clone ID: PAT_TA_43543
cggggggaggcacgcgtgcggtcctactactactactatcctacccgcggccacacctttacttactacctccaatgtgtcaactggtccatgcttttgaggccaaactacacctaccttcaatattaacacttaagcacgccttaaaaaatttgatggctaccttctgtctcgcaattacatcttttgataccaaacttccaaagatgactttggtgtgtattctcaattcttaattcctccaccatcaacttgcaccaatattgcaaggggggacaatcacattgattcactcctgaaacttaattgaattactgaccctcgtcaatacctgaaacatctttc

SEQ ID NO: 43544 - DNA, 408 bp, Triticum aestivum
  Clone ID: PAT_TA_43544
cgtgcgcccacgcgtgcgcaactccataggcggggcttctccaatcaactcatgcgggcaacgggcacctcccgcccacccttcccccattcccgattcttccgcctaggagcagccaccattacccgagccttcggaggagaggaagcaatgggctccacacgcgcggaccccgacgacaaagaagaaggggggatgaccacggacttcttctggttgcacacagacgagcccaacgcggagggcccacgggagatcctggtcaagaaccacgacatcaaggggctcttcggcccggaccctatgctctgtattaagatagccgcacatggtttactccacctatggaccgacacgctgctgcgcaaccaggcttgtgctagatactggcgggcggttactttttcg

SEQ ID NO: 43545 - DNA, 455 bp, Triticum aestivum
  Clone ID: PAT_TA_43545
gcacgcgtacgtaagctcgcaatgtggggccacgcgtgcgcccacgcgttcgggacgtgttaacggaactgactataataggaaggctctaacgcttgacactgcgggcttctcattgagaagtgaagatactacccacaaacacccggatgctggcatggggttcacaaatggccaaacaatgagcttgtgaggacttacaaccttgaaaagaacgccattgtgcaaggtgatgcagaccctttcaaacagtggaacctgactaattatcgaggcgaaatacgcaggaagaacaaagctgctgtaactgtcaagaaggaagctggtgatggacaagaggctgcgggtgctgctgctgccccacaggaagcaacgaagagcaacaatgtgcagaggaagcttgagaagcgccagcagggacgtacactggactcgcacattgaggagcagttcag

SEQ ID NO: 43546 - DNA, 360 bp, Triticum aestivum
  Clone ID: PAT_TA_43546
atgggtggcaaacatattgatacctaccttacggaccactggggctcttggatgaacaaatacaaaacttcatcccaaacacaacgcaccgatcatgcaaggggcacgtgttctataaagcaaaaggatatctttgaccatattacataaataggagcatgactaacattcagtgtgacaagattatacaccacatgctgacagttgatgagtttgacactggatggaagcaactcatataaacaggatggggtgagaaaacacacttaccttacccaaatatatgaaaaaaaagagaaatgggcaaaaccatattataatggggaattctatgccaaaatcacaagtacataacacatg

SEQ ID NO: 43547 - DNA, 428 bp, Triticum aestivum
  Clone ID: PAT_TA_43547
taagggggcaatgctttatgttttggaatctcaaaaagacagtcggcgcaccagttataatagctggggcttggggggaaggctgctatagatggacagactatcaactctgatgctcatgttagccatgctatggtgggtctccgtaagctgtttacggatgctgctgtaccagatccaggggcatcagttgtcacaaattggggccttgatccttttagtagaggggcttactcttatgttgcaagacgagcatcaggtcaagattatgacatcataggacggccagttgcaaactgtttattttttgctggggaagcaacatgcaaagagcatccacatactggtggtggggcaattttaagcgggcttcgcgaagcaggtcagattattgacttgggacacaggggtaaggattatgtggctga

SEQ ID NO: 43548 - DNA, 434 bp, Triticum aestivum
  Clone ID: PAT_TA_43548
ggggcgccacgcgtgcgcggacgcgtgggcggacgcatgggcaactccaaatctctcgtggtagacagcttccaggtcatctggggcaatgtctgggcgtggcaaggactacaaggggctctgcaagggcggcgccaagcgccaccggaaggtgctccgggacaacatccaggggatcaccaagccggcgatccggaggctggccaagaggggcggtgtgaagcgcatctcggggctcatctacgaggagacccacgggggcctcaagatcttcctggagaacgtcatccgcgacgccgtcacctacaccgagcacgcccggcggaagaccgttaccggcatggacgtagtgtacgccctcaagcggcagggccggaccctctacagattcgggggcgtgagcgccatcagggcgctggcggtggctgacactg

SEQ ID NO: 43549 - DNA, 251 bp, Triticum aestivum
  unsure (1)..(251): unsure at all n locations
  Clone ID: PAT_TA_43549
cagagacacacagcaagcgacgcaccacccacttccgggtccngcgggatctggcgggacgccttcacattaacccaggatctggcccaggctaccaccgccacattaccatctttttccccgaggggcggctctaccaaatccagtacgcgttcaaggggggcaagtcggcggggggcaccttaatcggggtgcgggggaaggacttccgttgcgttcggacccataaaaaagttccccgacaaggtgct

SEQ ID NO: 43550 - DNA, 340 bp, Triticum aestivum
  Clone ID: PAT_TA_43550
ggggcggagtgtgcgcagccactggtcaaccaagtgaggatgatgctggcatcaatgagtgatggcaacatcggcgtgtcggcatacgacactgcctgggtcacccttgtgcctaggcttgatgacggcgataggccccagttccccgccaccctgcaatggattctcgacaaccacctcccaaacaggtcctggggagacgctgccctgttctcctcctacgaccggatcaccaacacccttggctggggtgtggctctaacaaagtgggctcttgggcctgataaatgcattagaggggtctcttttttggaagagaacatgtggagggtatcaaaag

SEQ ID NO: 43551 - DNA, 306 bp, Triticum aestivum
  unsure (1)..(306): unsure at all n locations
  Clone ID: PAT_TA_43551
gggggccacgcgtccgggtgtgccgctacagagattccgcgactccatatcccaccagcgcaaaccggaccggcggcgcggacgcctcccctgaccaccggaatcccgcgccgacgggccggatccggccggccgcccggccggtggctcccctgcgggcgctgggggtccacacttctatacantgggtggaggccgcagagatgcgtgattggtcgcggcggcgctaggtgctcttatccggccggggggactcatggcatggggggcgtccaggccacgccgaagcggaggcaggaccctggt

SEQ ID NO: 43552 - DNA, 332 bp, Triticum aestivum
  Clone ID: PAT_TA_43552
ttcccaggtggagccacgcgtccggcgacgggaatcacaaccctagaacccaacactcacatggggcactcgcgcctccgcgcgcggagcactaggcggtgagaaccttctcaactacctgacgccaaccctcctatacaggatccttgttcgcctccaactacgggagggcagccggacctacgccctctctcaaacctggaaccaacagtgggtggacctacactccctctaccttggcctcatgcagaagggtgggataccctcggagggcgaaagcaagcaactccttcactaccccggcaacatggagaaattatccatgcgctccc

SEQ ID NO: 43553 - DNA, 328 bp, Triticum aestivum
  Clone ID: PAT_TA_43553
tacatactttcacctaaaccaccaccaatcactgcctttatccacaacgcgggggaggtgggcaagcggcgcaaggagcgctcagatagaatcggatctgctgtgctggatgctgcagcagaccgcctatcgaccttcctatgggcgctccgtgtgtctacgctcggcgccttcactggcgccggcacacacctacctgaatctggacgagggggtgcactattgcctgctaaggaacatgtacatgctcgacctacttctattcgccttgaacctacgatgttacgccctcggcggggccagctttaaccccacccgcgggggcggc

SEQ ID NO: 43554 - DNA, 399 bp, Triticum aestivum
  Clone ID: PAT_TA_43554
cgtcctggtggacccaacatcaaagctaacttggctgagaggcttctcttacagtgggacatatgcaacgtatggacaattggaggatgctactactcaactacggtgtgctgatagagcaactactcaaggaattttgataattatgggttcaccaggcttaacaatataccatgtgaaacgtcacctacataaatacaggctagcaaaggacattgacgactcttcagttcatggatacaacggtgataacaaaaaaccaggggattcactatcaggacttggttgatcctcttgaacgcacatctatgaatgcctgcaacttcacatggatggccataagcgaatgcatgaacacctcgaagtacaaaggcaacttcaactgcgaatcgaggcaca

SEQ ID NO: 43555 - DNA, 202 bp, Triticum aestivum
  Clone ID: PAT_TA_43555
ttggcatggtggcttgagaacctactgaaactcgactacaacgaggctatggagggagcatgtctttatcctacgaaggatgggaaactctaaacaagccctacctgattttataaacaaataggtggatatagaggaggcctgagaggttgtcaccatgcatcaagatgaggaactttgggaagaattaagtaagcaatgc

SEQ ID NO: 43556 - DNA, 415 bp, Triticum aestivum
  Clone ID: PAT_TA_43556
acgcgtgcgcttcccgcaggtacgggggtcgagagcgtggcggcgcaacaatcgcgggaggtgaaggggaaagggggtcggtggcctctctgtccccgagccggcggcatatgaggctcgcccagggccagctcctcctctcatgccccgccggctaccggctcctggcgggcgcgccgtcgtcacagagggtctcccggaccgcctcctcgccatcctcctccatgggtggtctgagctcggccgccaccgtgatgcctgccacatgtgcgaccgaatgctggagcaggaccttgtgtcctgggggaatatgggacggaagggataccggggctaccagcttcctgctatgccgcatggtctaagctgagcttacgagaattcaggtaatattgccggcatcaacaaaacaact

SEQ ID NO: 43557 - DNA, 319 bp, Triticum aestivum
  Clone ID: PAT_TA_43557
tacccatacatacatccacccaacccaccaccaatcactggcatcatctacaaccgggggacgggggcaaggggggaaggggcggctcaatcccaatcggaaccgcttttccaaaagcaaaggagtacttgaatcataccttcctctgggtgctctgagtctcaacgctcggcgcctacaccgacggcgtcaccacctacctcaacctgcacgaagggatccactacgccctcctcgtgaccgagtgcattctcgccgctctcctcttcggcttcaacccactattctacaccctctgcggggcccggttcaaccccac

SEQ ID NO: 43558 - DNA, 296 bp, Triticum aestivum
  Clone ID: PAT_TA_43558
cgtgccgcccacagcgtcgcggcgtgcagcctcgcgtatccgtggtaaggagccatccatccccataggcatcggcgcgcgttcggttccggagggtgaagagatggcttaaccgaactaacacacccatggtggatacagaagtttgtgtggacacttccaccttgacttcagcttctctgaaggtgtgtcgcgctctcaacatctgcccttctgtgccatactatgatatgcgcttgaacacaagcaggtacataactcacaaccttgggatcaacgtaccaatcatgtgatct

SEQ ID NO: 43559 - DNA, 375 bp, Triticum aestivum
  unsure (1)..(375): unsure at all n locations
  Clone ID: PAT_TA_43559
gtgcgtttcctttggctgtccccgggtgacgaatccgatccgattccgccagatcagaaaagccagcggatgataattttgcggatctcttggctgggagggactgcactcattcctgctgaattctgtgggctgtgctacatttgcttgggcgtaggggaggagagatggggctcacattcaccaagctgttcaaccggcttttcgccaataacgagatgaggattctcatggttggtctcgatgccgctggtaagaccaccatactctacaagctcaagctcggggagatcgtgaccaccatcccaaccatcggatttaacgtcgaaactgttgagtacaagaacatcancttcactgtttgggatgtggggg

SEQ ID NO: 43560 - DNA, 344 bp, Triticum aestivum
  Clone ID: PAT_TA_43560
attccacgggggagccacgcgtgcgggcccaccttttttttttttttttaaaaaaaaactcaaactaggtttttgttaattgggaataatgggtaacgggatgtggggaaaacaaatttgtaactaaccaattcggcgagtatgtacataacacaaaaaatttttaagagccaatttagccaacatgtacacaacacaaagaaattttaataaccaattctggtagcatgtacaaaacacaacaaagcttttaattaattttaccaccaatttcaaaaacaaaaaaatatgttacataaactccaaaagcgcttaccatacacaacaagaaggggcacacaaaa

SEQ ID NO: 43561 - DNA, 397 bp, Triticum aestivum
  unsure (1)..(397): unsure at all n locations
  Clone ID: PAT_TA_43561
ccatcgccggcgaagctttgactccatccctctacctctttctgtcacgcggcagggggaacaggtccagcggccatttnnaanganaaaatccacatcagcattgggggcattggccatggcgactctggcaaggcaaccacgaccggccacctcatctacaagcttggagggattgacaagcgtgtgatccagagggttgggaaggaagcccgtgagatgaacaagagggctttcaaggatgcctgggtgcttgacaaactcaaagcttagcgtgagaaggggatcaccataaatattgctctgtggaaatgtcagaccacccaagactcccgcgctggcattgatggtcctgggcaccgcggtttcatcaaaaacatgatcacttggaccttcc

SEQ ID NO: 43562 - DNA, 389 bp, Triticum aestivum
  unsure (1)..(389): unsure at all n locations
  Clone ID: PAT_TA_43562
ggggcgccacgcgtccgcccacgcgtgcgcggagctatggaggaggaagcagtcggacgtgatgaggttcctgcggcgcgtgcgttgctgggaggacaggcaccacccggccatcgtgcgcatcaccaggcccacccgccccgacagggcacgccgtctcggcttcaaaggcaagcagggggatggggtctaccgtatccctgtcaggcgtggtgggaggaagaggccagtgcccaagggtattgtttatggtaaggccaaccaccacggtattacccagctcaaggtccagaggaacaacatgtgtattgctgaagaaagagctgggcgcangctgggtgggctttttgtggtcaactcctactgggtgaatgacgactgtacctaca

SEQ ID NO: 43563 - DNA, 338 bp, Triticum aestivum
  Clone ID: PAT_TA_43563
aactgggctaagacactcaatgtcacatcatcgggtgagggtccctggggacaactatcttgacactaacaatacacctatgtggcagctacggtacagaaaatcatggtgatgcgcgggcggacctacatttaagcggggggagcataaatgtgtggcctgacaaggaccaacagagcgccacaagggcatgactcggagaagggcggacacatgttgatgaccatccctgtgtaggagaaacaatgtacttggaaaacagacatgaaagttgcatcctgctgcctttacaggcggggaactacatctatgtgattcaagtggtccgactaacaata

SEQ ID NO: 43564 - DNA, 238 bp, Triticum aestivum
  Clone ID: PAT_TA_43564
cacgcgtacaaacgcccctggctttcgtgccttacacactgcctcgataaaaggaccctcgggtccctgcggatgggcgcaggagcccaagctccagaagccatagacagcgccctcgcaagcgcgggggcgatcgccgaccagggccagaagatcaagcaggacccccacatcctggcctcctccatttcgtgtttccccgcggacataccccaggctaagcgcttcctcaaccaca

SEQ ID NO: 43565 - DNA, 313 bp, Triticum aestivum
  Clone ID: PAT_TA_43565
cgtccgcggacgcgtgggcgctcgcgaacatagaagcctggcttataacaccatcggggccatcggttcgagccgcgccgagacatatatattccccgagctgctatactgacggtatggtcggctctctgtattgcatggatttgttgaccatatgctgctattatgaccacaactagtatgccctagagactgcttgtgaatttgtatacgattctactgacattggagtaatcacaaataatatggttcactgatctaaataatcctattttaatatacgtgatcggtacctacctgagtatgttctttt

SEQ ID NO: 43566 - DNA, 273 bp, Triticum aestivum
  Clone ID: PAT_TA_43566
cgcgtgggcccacacgttcaaagttatctcacatcgagtacaaatagttaatattgaccattcaatgcgccttggggtggctggataaagacatactactcatttaatgattggacaacacgaaaccctacatataatcaacatgttgtctcacccaattaaatgggagaactcgtacatctggggcggtaaaaatttatccacggaaaggcgatatctgggctttggacccaaattactccgctgactgaaattgacaatacctccttctaa

SEQ ID NO: 43567 - DNA, 401 bp, Triticum aestivum
  Clone ID: PAT_TA_43567
cgtgcgcccacacgtacacggacacgtgggctttcccctccagaaccctactgcccactaccaggacctacggggccaccgaggcagcggcacacggcttatcaaggaaaccctatacccctcccccggccggcccgtcccgtcagcaacccgtcgacgacatgcaccaccacccgatttaaatctctagggcttctccccgcgatggacgactgggagaatgatgattttcaacctaacgcacctgtggggaaaggtcaaccccttaaaaggaactggggagatgaatatgaggatgaagatgatgctaaagaatcatgggaaggggagggaaaaaaacctaatccacaaccttgggaaaaagctggttcaaaaactaaggctaaaactggtgggaaaaa

SEQ ID NO: 43568 - DNA, 272 bp, Triticum aestivum
  Clone ID: PAT_TA_43568
cgtccgcggacgcgtgcgttcaccagctcccctcacatcccactccaaggccaacggtcgaacgagcaccaccaccaggacccatgggacccaaaggggcggagaataaaccccgggcggcggtcgtggagaacacgggcgccggcaagaacccccagggggtgaatcgggttgtgggcaccaatgacggctgccgctatgggataacgaggggccggaagaaggggactaatgccaagaacggcgtggtgaccgacaagatttacatgttc

SEQ ID NO: 43569 - DNA, 270 bp, Triticum aestivum
  Clone ID: PAT_TA_43569
cacgcgtccgcccacgcttccgaacataccgtacaaataactaatactcccaattcaatgggggcatgtggtgggtgcataaaaacatacgaatacttaaagattcataaataactacaaccgacatttatgcaataccttctctgaaacaataaaatccgatgattcgttcaacttgttcgaacactatttctgcttcgacttgggatatatgggcttcagaacaagcttgactcatctcactgaccttgttatactcgtgagaatttt

SEQ ID NO: 43570 - DNA, 271 bp, Triticum aestivum
  Clone ID: PAT_TA_43570
ttccaggggggggcacgcgtacgcccacgcgtgcggttcgcttccaagaaaaagccccgattggaggcgcactgggagcgacgggatcgaatacatccactccggatccgaggcgcagagaggacccaatgcatccagtctggtccgattcaaggagcggcggaccgaccacgtgtaattcatacagcccggattcatccactccgtgaatcgcccgtcggctgttcgtctcttgaaactggtaccgtgggtgtgaaagagagaatcactc

SEQ ID NO: 43571 - DNA, 382 bp, Triticum aestivum
  Clone ID: PAT_TA_43571
acgtaagctcgcaattcggcgcgacacggtggggtacaatatgtccaaaaggggatcctctcttaaaggacatccgcagaaataccatcctgggaaaagcggggatttgtcaaactgattgtggaaatttatatcagttgtctccacctatacatgggcaagtgtggaggctccactacacagacttggatgtctcaatgtcaagagacaaagggctgtacctcaagacgactcattctcttttcgtgaactagcttatgcaacatatgccatttgcagaccttgttacagactcattaagatttaagattgtacttagggaatgttaagtcatacgcgttatcaatagaggatccttgaattgggatgacagcgcactttt

SEQ ID NO: 43572 - DNA, 231 bp, Triticum aestivum
  Clone ID: PAT_TA_43572
cgtccgcccacccctccgtggacgcgagggcttagaacacgtaacccagaaagcgaggtgatagagatatctatagcgattctgatccctacttacactatcgttggatggtgaggactaggcggagctctaccctataatggctcgatcactcgaccatcagacttgtaattgattctccagccgaatgcctgcatcatctttcacgctcggatccacattggcaccatt

SEQ ID NO: 43573 - DNA, 328 bp, Triticum aestivum
  Clone ID: PAT_TA_43573
cgtccgcccaactccaggcccaacaggtgtagcggacactctcttgtgcctatagtgacttctgggggagatcattcacgggcatagccttcctgatgaatagcacatcaaaagatggcctcgataaggatgaggtctacttcaagaagatgcgatcctctcgcgggtagcacaatgaatggtcgacacaggcgcaatcattatcatttcaatgactgctacagttccaagtttaaaccctgaaagcgctccaacatgcccaccatgtagattggtgatcagaggtactaatatagccatggcagtggtaatcaacttaggctccggc

SEQ ID NO: 43574 - DNA, 410 bp, Triticum aestivum
  Clone ID: PAT_TA_43574
tgcgcccacgcgtccgcccacgcgtgcgcccacgcgtccgcgtctctttaaattgactatatggactttcgcgcacatcatttggggcttttgcattgccgagagttgttacccgaaaggtcatacattggataatttcttggtatccttctgggcatggagccatcttctgggtagtacaatccaagtcgaccatggtgagataatcatcattttaattatgacaggttaccaaggttaatatttgagttctccgcaacataatgtgattatgacagcttatcaaatttaatattctgcacatggtgaactttatcaaattaagatacgggtacctacttggtttatcattctatcagcaacctaagctcttactgtgagatattaaacccatttgtatttcaaacctt

SEQ ID NO: 43575 - DNA, 279 bp, Triticum aestivum
  Clone ID: PAT_TA_43575
cgtccgtgatgctaaagttaccagacctggcgctggtcgcgacctcataccacatggaatacccggcggatccatccctggcggatatcaataacagcatctatgtctctcatgagttgcgaatgtactacttcaagatcaggccgcgctcccgagcgtactcacatgactcaaccgagtgcccctttgatcaacctgtggagaaccctcggcaccgcgatcctcgcaaatatcactacagttacgtgccatgccctgatcatagaataagagtgtgcc

SEQ ID NO: 43576 - DNA, 328 bp, Triticum aestivum
  Clone ID: PAT_TA_43576
cgtccgcgatgctcccgcgtgccaagccaccgaccaacatggcatcatatatccaagcctacgcggcgctgataccaggcaagatcgtgaaccggacctcctacgcgcgggcggagttgcacatggaccgggcgttcagcatgcactcttgcgccaggatcacctattacctgaaggacggcatcagggaggtcccaaggaagtgcgccgacgcccgcaagatgggcgggtttgacctcagcacctctgcactccttgtatacagaacaagcgcggagggggcgcccaacatgctgacctttgacgagatgcagaacaagacctacat

SEQ ID NO: 43577 - DNA, 203 bp, Triticum aestivum
  Clone ID: PAT_TA_43577
cgtccgaccgccggggattgtactacagcgcctactcccttaccctaatcctctcggggaaaccgggtaggtcacaatgtgccgctacctcaacaagggtcaataccaccaaagcgttggggacattggccctgtataccatggcaacctaatcaagattgtgcacctcatgtaccaagttggtcggtgcggcacacgaggaa

SEQ ID NO: 43578 - DNA, 376 bp, Triticum aestivum
  Clone ID: PAT_TA_43578
gcacgcgtacgtaagctctcaatgtgggtgcacgcgtgcggccggaaggaagggcggggacagggaaaaagcggtaacaccatacgtgaaggccacgcggcaatttgggatccgccgaatggggcggtacctcaacaagggacggtacactcaaaggggcggatacaggggcccagtataccttgcctgccaacttaatatcctggaccgcgaagcatgatccggtctgtgccgtacacgagcacattgatcggatgacggtcttttccggcggggcatgatatctcacaaatctcatggtcgaatgtgaagagctggagcttgacggcaacctggacaaaggcgacgggaagacccgtatgatacggggccacct

SEQ ID NO: 43579 - DNA, 404 bp, Triticum aestivum
  Clone ID: PAT_TA_43579
cgtgcggcaacatacaccaacctcaacaggcttgttgggcacgtaatttcataagggactgctggggtgaggtatgatggggctcttaatgtagaacaaaacaagttccagaccaaactggtgccctacccgatgatccactacatgctttgctactatgccccagggatctcaaccgagaaggcctaccatgatcaagtgactgttgccgagatcaccaacaacgtctttaagccttactacatgatggagaagtgcgacctccagcatcgcaagaacatggactgctgcctcatgtatcatgaggatgttgtgcccaatgatggtaacgctgttgtggacaccatcgagaccaaccgcactattcaggttgttgactgaggccccactggctataagggggg

SEQ ID NO: 43580 - DNA, 411 bp, Triticum aestivum
  Clone ID: PAT_TA_43580
cgtccgttgagccacagaattttgatggattacttctgatggcatatgctacaattctctccttggattaggatcatccgctcatgtaccaaaatcaatgatggagtcgacatggataactgagctaaatagaagaggtataattggctgcatcaaaagcttgtgcgccttttcagatgacaaatacaggtgctgctagcttcactatggcttggtatgtgaagaaaaaaaacattatggcttgaattcatgctaaacaagattggttctaatgatcatgttgacagaaggcatcaccctgtctgtcaaaagaaacggttcacatgggaaattttgtatgtgaaatgtgaagagaatctggggtctcatgcatttggcatacacgtatattctgtgtctacaaatgccaca

SEQ ID NO: 43581 - DNA, 246 bp, Triticum aestivum
  Clone ID: PAT_TA_43581
cccggggggaggcacgcgtgcgcggacgcgtgggtccagctccccagccacacatagaaagagcgtctaatctccaactgggttacagggggcggcggactgggggtccgggcacacttctccctgcgcgccaacgggccaccggcgccccgtgtggtcctctcacccgtggccctgaaacttgccgtctccaagcatgtgctgggagccaggctccccccgcaagcgacgtacaaagtgaagctc

SEQ ID NO: 43582 - DNA, 255 bp, Triticum aestivum
  Clone ID: PAT_TA_43582
cgtccggggaagcatatgatctgctgctgcaacatgatggatgccaccactcccaagtactcgggggcccgtgatgagggaatcggcaatgaactgtcttcgtacctgaaaaaaggcgggtacaaccctgacaaggatcccttcgttcccatctgtggggttgagggggacaacatgattgagaggggcaccaaccttgactggtacaaggggcctacccttcttgagggtcttgaccagaacaatgagcccaag

SEQ ID NO: 43583 - DNA, 321 bp, Triticum aestivum
  Clone ID: PAT_TA_43583
cgtccggaagggaagagcatctagaacaccaccacctactaatcaagcatggaagaaccaaaaggtggttgatcagcaggatggcaagaggaagacaagaaccaaattaaagtttggtgatgtgcatgtctgtatctatcaagattcagggctatgtagaaatgtgcctgagatttggttcactcaacgagaccaaacaatcaggaacacaagtaggatagttgatgctttgcaaataatatttggcatgaacatgtccatttttgaaaatagtttaccatcctcaaacatataacttgcgtggtggtgcttccattatat

SEQ ID NO: 43584 - DNA, 290 bp, Triticum aestivum
  Clone ID: PAT_TA_43584
ctggggcaccggcccggacttgcccggggtacccaggtcgacccacgcgtgcgggcgtcttcacaaacgccggctctcccacgctccgcctcccttcctcatggtcccccgggtaccacgctgcgacgacagataccttcaagccctccgatcccacgcgtctaatatgacggagtgcatctcgatccacatggggcaggcccgaatacatgtcggcaacgcgtgctgggaactttactgcctacagcaccgaatacagcctgaagggcagacgaacggagacaagacca

SEQ ID NO: 43585 - DNA, 199 bp, Triticum aestivum
  unsure (1)..(199): unsure at all n locations
  Clone ID: PAT_TA_43585
cgtncgtggacgcgtgggtgaggatgaatatcgtgtttttatggttctcgacaatttgccactggttgttccagtccaaaggccggataggtacactgtggcctaccaaggtggatatcatgttggtgtcaagggccagtatgctggtagcatggatgtaaagtactatattcacaaccattttgtaatttcagtttaa

SEQ ID NO: 43586 - DNA, 232 bp, Triticum aestivum
  Clone ID: PAT_TA_43586
cttccgtgcgtttttcatttatgccacggaatactccttctctactcatcatcgcgtagtctggtgggctcacttatgacgcgctgggagaacaaaccccttgctaaatcttccccatttcaggcgacaaggatctggccatggcgccgctgcccaccgccttcgtggccttccgttgtctcccacacattcttcgtagtggcctcctgcccgtttgtgtcccgatgctccc

SEQ ID NO: 43587 - DNA, 198 bp, Triticum aestivum
  Clone ID: PAT_TA_43587
cgtccgattattcaataaatgttactactatgttaattttttcattagaatgatctcaatgcaattgatgatgaccctgttatgctccaccacagtggatatcatcacatcaacatgtcagtgtcaaaccatttatatcatttggagaaggcgtggtcgccactccaacctttagctgttcatgttagaacttccggg

SEQ ID NO: 43588 - DNA, 136 bp, Triticum aestivum
  Clone ID: PAT_TA_43588
cgttcgaggacgcccatgcagtcgcttaaccaaccttttctttacatgcccggcaacctctccgggccgtatcacgtgacgctcggggaccttaacctcaccaatagcgtcatcaccaaacataaatggacgttca

SEQ ID NO: 43589 - DNA, 413 bp, Triticum aestivum
  Clone ID: PAT_TA_43589
cgtccgcgtacgcgtgttgtctattcgtcgttcttgttctccttcaccaccaccaccaccaccggcgagcgatgttgtccgtggggaaggctaaggctagcggtgtcaagcggggcggtgccaaagaccccgactaggtgccccggtccgacatgaggctggcgcgacatggacgacttcgtccccgagctcgagctcgacagtgacttcaagcagatcgtgacgatgctgtgccacatcaaggacaaggcttacaaggacggtcagaataagaccgtgcatgccatcttcagttgttcaacagagattcattctattgtacaggacaccaagactaagtttgagaaggaaaggcagaatgtttttaaagctttaacgaatgcttccaaagagtgtgaaggttcattgtatac

SEQ ID NO: 43590 - DNA, 215 bp, Triticum aestivum
  Clone ID: PAT_TA_43590
cgtccgcggacgcgtggcgatgcatgtgcgagggctgttctaacaattcgagggggctggctgtggatgtgttgacgacgaagggcagcttcaaaagcaccagatgcaaaaccatcccagaaagtgcgcttgctttatggatggtttgccttgctttcgtgggccattcatgtgcgaggtctgctcttaacaatttgagggggctggctatagat

SEQ ID NO: 43591 - DNA, 308 bp, Triticum aestivum
  Clone ID: PAT_TA_43591
cgtccgtccacgcgatcgttcgccgacgtcaaccagttttatttctttgcttgacttgcacacgggcgtctacctgatacatgacgggttcctatccgaggtctgctgctacagtctccttatcgattactgtcaggactcgacgaaccttttcagttgcatcccggcatcacgtcagttggcacccctcttcgcagcttgaaggcttcatgctcctggggatggaccctcaccctactactggcgaggtccgaccactgcctatacctgctacccacggatttggcacccggaagcttatgatggct

SEQ ID NO: 43592 - DNA, 219 bp, Triticum aestivum
  Clone ID: PAT_TA_43592
ctcaagttcatgcttgatctttatttccatgatccaactgcttttgatttctttgctgaggcaaatgctgatgtgggcgctcctgctgcatgcatcatggaactatttgcatgtccgtgtccagcagctgcaatagtagaatgagcttgacttccgtacagggcttgtagatagacattcagcttattaacaatgatactcaagtgctcttcaaatagg

SEQ ID NO: 43593 - DNA, 152 bp, Triticum aestivum
  Clone ID: PAT_TA_43593
tcgtactcacccgtcggcgatgtctccaaccaccttctgctactttctatgggtcgacggatccgtcggccaccccatggactacgcctggagaacgcgggctgtgagagagagcgcggtcgtgcggtagaggagggtggcggtcgccttct

SEQ ID NO: 43594 - DNA, 313 bp, Triticum aestivum
  unsure (1)..(313): unsure at all n locations
  Clone ID: PAT_TA_43594
tncgggcggcgtttgaactgaaccggtcatcattgcggaggcagctgccgttttaagaagctgctcgactatctctggggccgttttcgggctgaacgtgcccattgaggacctggagttctttgagcggatcctgttcctgctggagcaggcgcactgttcttacatagacaactcctgtgagcacaacctctacctcaaggtcctcttctttaaggatctcaccttcctattgttcaatcagctgtgccggtcttaggccctaccgcgcgcatctttactacatttacagggtctttaccccattactagt

SEQ ID NO: 43595 - DNA, 307 bp, Triticum aestivum
  unsure (1)..(307): unsure at all n locations
  Clone ID: PAT_TA_43595
ttngggacgctttcttcctgttccttctctctagtccttgtcaagcccatttttttcgacgtgccgctgactataggggggccgcttagtagctgtcgcacgagctagtactcctttatgcccatggatcgcgccgtaggcctaagatcgtcttcctgcaaccgagtaaacgaggcgctcttcaccatccaccagtatcttgaaacctggctgtgcgctgcgtattatcttcttacccgtctgaacagccggatcgaggtgaatgcctgggtagcggagtctagcgacttgtggatcctggagcgga

SEQ ID NO: 43596 - DNA, 345 bp, Triticum aestivum
  Clone ID: PAT_TA_43596
cgtccgcccacgcgttctgcccgacttggtggccacctttttttccttcgccatggacatgccgagcgccttccacaaggggagcgtgcggcggtttctagatgtccggcggtgagaccgtctgctgctactgcaccacctgcaagtgcggcaccgcgtgcggctgctcctgctgcagttgcatctgagccgtcgcccaggaggccgttcggcgagtgtagcacgaggatgaggaggacatctggacaagtcaccaccatcaccaccaccaccatcactagccgttgtatgcgcccgcccgcgcgcgcgctgaattaaataaaaccgtcgtgtgttcctttaaaa

SEQ ID NO: 43597 - DNA, 412 bp, Triticum aestivum
  Clone ID: PAT_TA_43597
cgtccgcggacgcgtgggttttcaaagatcatggcatttctttccttccaaaggtgccaggccacatacaccgcagccgtaatttgttgcttgagctgattgtcaattgcatcaaggaaactgctgccacacctctttggcaaacgggcaggagatcggtaggccgccagcattttccaagcactggccacacaagctgcaagatccccacatatttctttggagcacagatttgcttccaattaaccaagcactttcctccatgggcttcctctgcttcattccgactttccaacgaaagattctcgccattctgtccagtttcttggtggcccaagcatccatatagcaaaggtggggagaatcacccttctttggcttcctgaatcggagaagcaggccgggtagcatt

SEQ ID NO: 43598 - DNA, 358 bp, Triticum aestivum
  Clone ID: PAT_TA_43598
aggaccacccctacactttttccctcacatgcactcccctacaaatgtttatcactgtcatgacaataattgcggggtgcccaatgttttaggacagtgttttattttattcaagctttccaggtacaaataaaataagtttttgtttggacatagtttttccagtttcaagtgatatatttcttgatgagaaccttccaatccataaaggcaagatgactgatgggctgaacgtgaggtcattgaaaccatcatcaaagccatcattaaatccattatcaaggaaggccttgcggaatgtgttcaacatcagcaagtcccaagcgcctagcattcaaaaaggtcaccccttgaaaga

SEQ ID NO: 43599 - DNA, 161 bp, Triticum aestivum
  Clone ID: PAT_TA_43599
cgttcgtccacgcgtccgcccacgcgtccgtccacgcttttgtccacgcgtacgcttctctctggggacctcctgtttccgcccaccttctccggctctcgcgccggcgaaccaatcgcggatcgagcgattcctccgatcaggagaggcgagccgtgagg

SEQ ID NO: 43600 - DNA, 419 bp, Triticum aestivum
  unsure (1)..(419): unsure at all n locations
  Clone ID: PAT_TA_43600
gattaacatctgacttcaatataatcccaggaagggaatatatattcggatattacatgaaagggtaggtgatggtacatattcacaacagtaatcaccccgaaaatatttaaaaaaatggccaaactacatgccatgggaacatttgttatacaatgtgacatgaaatacctaagcaaggtttgttatgataaaaaccaaaagcaggccagagtattagtcccagataacttttttacactgtatttcatactgcatagtaagctacattgttggctattagatataataactttgcccacacgcctttattccaattagaatggatatnnnnnctttcacctccttcatttgatttgcttgccaggttgggacacaccggatttgatgggttttttgaatgtcaagcccacctaggc

SEQ ID NO: 43601 - DNA, 250 bp, Triticum aestivum
  Clone ID: PAT_TA_43601
cgtccgccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtcccttcagaacgccttctccaagtacggcgacgtcatctactccaagatcatcactgacagggagacgggccgttccctcgggttcggtttcgataccttctggt

SEQ ID NO: 43602 - DNA, 389 bp, Triticum aestivum
  unsure (1)..(389): unsure at all n locations
  Clone ID: PAT_TA_43602
cgtccgatataatcccctcccaaatagggagcaacccggaaaaacgcgaaccgactctagctgaagcagctctcctcgccatcgatccttctcgatctgctccgatggccgacgccggcgccgccaagcccgagccggagaagaagtcctgggccgacgtcgaggaggaggaggaggccaaggccaaggcggaggcggaggccnagctcgccgccgtcgccttatacttcttctccggcgcccccatcgagccggtggttgaggctcaggcgaaacagatcgaggcgctcttgctctccgtgccggacgacgacggcggggctcggggccctgccctgcttgacgacttcgacgacttccaaatccaagtcgtgaccttgggcggcacg

SEQ ID NO: 43603 - DNA, 173 bp, Triticum aestivum
  Clone ID: PAT_TA_43603
cgtccgcgccagccctaccgtggcggtggacgtggtggttaccgcgggggtggcgggcgttcccgtgggtactacggtggcagaggagactattgaaacatgggaaggggcggtggtcaggagaactactacggtggcggtagaggaggccatggaaacatgggaaggggtgg

SEQ ID NO: 43604 - DNA, 440 bp, Triticum aestivum
  Clone ID: PAT_TA_43604
cgtccgctctgggagccccaagccctagctccattcctccctccatggccggcgccggcagcggcggcggttcttcttcttccacggcgagagaggggagggcgagagcgcgggcccggaagaagcagaagcagcaggagcagcagggggaggaagagaaggggccgaaccctctggaccctagattcagcgactacaacccaaggagggccgatatggttaacaccggtttcaggaattcacgctcgaacttgaacatgaagcaactggtggtgccaagcaccatactaacaggaacttcccagaggaggggttcttgttctgtaactcggcaaatattgtctcggtcaggatcggtttcttcgactatggatacccgctcaatgctacggcaccatcatagccagggacagtctggaacgcaacgcgtctatttattt

SEQ ID NO: 43605 - DNA, 390 bp, Triticum aestivum
  Clone ID: PAT_TA_43605
cgtccgcatccaccgccgccgccgcagccgcccgccgtattccgagcggttcgagttcgccggagagggaggagagatggccaggaagggcggagagaggaagaaggcggtgacccggtccaccaaggccggcctccagttccccgtcggccgcatcgggcgcttcctcaagaagggccgctacgcgcagcgcgtcggctccggcgcccccgtctacctcgccgccgttctcgagtacctcgccgtcgaggtgcttggatctcgccggcaactccgtcatggacaacatgaatactcgtatcgtgctctgccacctgctcctcgccattcgtaacgaccaggatcttgtttagctgttcgccggcgttacttattcttcacggtttgttt

SEQ ID NO: 43606 - DNA, 421 bp, Triticum aestivum
  Clone ID: PAT_TA_43606
cgtccgcgtgctctccctctccctctccctctccccggctgctccaccgggcgtctgcttccgcttctccgttgctctcggtcgggcatgtgcgctcggccccgtcctccacgttcgggtatgctcttcccatcacatcgattcactcttgctgtgctctgcttgggcgctgctctgcttcgggttcacatggccgattgcggagtatgttcatctccgcttcctgcttcacttgaggccggggtgagctgcttcatgacgccgacgtccgttttcccagtcggttgtggctgttgcggtggttagcccacaagaaaatcgttttgtgatacttctctgtagtagtatgttccaagtgctctgcgtgcatttcggatgaattttttatactgctgttcattctgcagaatgttagtggtta

SEQ ID NO: 43607 - DNA, 234 bp, Triticum aestivum
  Clone ID: PAT_TA_43607
gctatatcctctatctataccttatccccggctgctccaccgggctgtctgcttccgcgttgtccgtagctctcgggcgggcatgtgcgctcggccccgtccttcacgtatataatgtgcaatacccataccatcggatccactctaagatgagctctgaaatgggcgcctgtactgctttgggttcacatggccgaaagcggagtatgtacatcttcgcttcctgcttcactt

SEQ ID NO: 43608 - DNA, 167 bp, Triticum aestivum
  Clone ID: PAT_TA_43608
cgtccgcagtatatcttatttacaaaagcatatggacattgttttaactcttttgtcagagtctgttgatggagagggtgatgaatctatggtactgacactgaagactgttgagcaccttgcgattctagctgcatttctacgtaagaactcctttaagccaagct

SEQ ID NO: 43609 - DNA, 444 bp, Triticum aestivum
  unsure (1)..(444): unsure at all n locations
  Clone ID: PAT_TA_43609
ccgtccgcccgaagctgaaaggcgccgcccgtatttatgctgctccttccagtaaaacaaaaagcaaatcgaaaaagaagctgctcctcatccaccttcgttccccccttccgcggctcgttttctcttccctcctccgccgaagccgaaccaccccagcggcgagagcgagcgccgaacgacagggtgggctctgcaaggtacgcccgcacgatcactgcgatgaacccccgccacctctgcgtcggcgcaacccccggcagcggcgggagtggcggccagtcaggggacgcgtcagcaaggcgccgccgccgcatgtcggccccgttgacaggcacccgcctcatgctggccttcaacgctgctgctggtgacggttaatgcggnaggtcggcgaacttctcctctcgactttctgaggggtggacctttcgttagatgaac

SEQ ID NO: 43610 - DNA, 434 bp, Triticum aestivum
  Clone ID: PAT_TA_43610
cgtccgcggacgcgtgggcggcgccgccgcctctgcgtgctttgggcgggaggccgccgccaccatcgtgggcgtcgcgaccactgccggagacctcgcaccccttcggacccgaggaggagtccagggtctttactctggagagcgatggattcttcagaaattccgccctctgaccgcagagaagagcagccgccggcgtcgctgccgctgccggcggcctttctcgagttcctcggcgagaacggcctggaccccgcgctatactccaaggcggacaccatcccgcgctacatcaggttaaaaccaggcacggagcccatggtggtgacagagatcgaaagcgagctcaagtgtgatctcatgaaggtgtcgtggctgccggacttctatgcgatcccgcctgaaattcaaaatgctggatccatggctta

SEQ ID NO: 43611 - DNA, 302 bp, Triticum aestivum
  Clone ID: PAT_TA_43611
cgtccgctcaccagtaatataattaggtagttgcatttctgaattgcattgcatccccaaaatggcatagaggtgtatgcatggccctatacatactttgctgatgatgcaacacccctgttgtagccttcacttgaagcggttcttcggttaggaattgctttcggctgatccgtcgaccgccgaccgccgggaagcgttctgaaaggacaagctgaccactgcgcactggcgctgagctgagcgatggtgggaggaggagactatcaccaggctgttcatggccatggagggggaggagg

SEQ ID NO: 43612 - DNA, 410 bp, Triticum aestivum
  Clone ID: PAT_TA_43612
cgtccggtcaaaatcattacactgatgatgttctttgtctagataaagagtgtagtagtagatgttatatatatatttgttattattttcattcttcaactattatgtatctaggctagattaatgagatcgatgttgtgttttaattattggttttacttgtctcatacttgttcccccttcattctcgattttattatttttaaataaaaaataggtgtcaattcttctcctttttcatatctaattattaaggacgcccagtattaaaataataatttgaacacgattctatttccctccccttgattacttattactagatgctaattaattctttatgggggggggggggcttttatgaaacgccttttttcttctccgcgtttgggagagtttttttttttttt

SEQ ID NO: 43613 - DNA, 364 bp, Triticum aestivum
  Clone ID: PAT_TA_43613
ttttggactcaacatacagttgtacgtcgacgtatgctaaagtgtagatgcgactacattttaccccatatgtgcgtcacttggacagatctttagaaagaccagtatttatgcacggaggttgtactccgtaatctaaaggcaggacacacgggaggacattttttggtagagggggatgattcaggcatggtacgctggcttcgcctgtacactgctaatataaagcttgcacggttaccgtgcgctttctttatactttctcagagacatgcacgcacgcacgcatgcatgcataggatatgagcgagatgcacgcacgcatggtggtggatcggcgtgattaaaatgctaggtgagaggg

SEQ ID NO: 43614 - DNA, 436 bp, Triticum aestivum
  Clone ID: PAT_TA_43614
cgtccgcgctcctcccgccgccgcttcacgcccagaaccgacgcacctactacgtctcgccggcgtccgcctacctcgacccggacaactccgccggctccgacgacttcctcccgtcgccgccacgcgcccaccacagcagcctctacatgccgcggtccgccttcctcgaccccgcctccatccccgcggcctccgacatctacagatcctttctctcgtcgccgccacacgcccaccacaacagcgccttccacgttccacccgctctccggctacgccgacccggccaactgctcggacgaccacaacggcttcctcccgccgctctccgttgactcctacccctcagacgtctacaacctcatccagatgcagccgcgcggcaaccacctccgctccctcccgccgcacggagagcatctcggcgccgagc

SEQ ID NO: 43615 - DNA, 438 bp, Triticum aestivum
  Clone ID: PAT_TA_43615
cgtccgcccatccagatcccgccgcccccaaccctctcacccttcccctccacaacgagccacctctaccatcccggcgagtcgcaccgccccaaccctctcccaccctcatctcggtgctccccatcccttcatcatgctaaccaacgggatccctccctcttctgttgcacaaataccagcgagatggggagacggggcacgtcgatatcgtcatcaacctcgccgagcttgatccggggagaccagggccccgggctgccgtagtgctcgacgctgtggccgtctcctcccactgacgggagacgtagggcctgtggcagtcttactcgggagggtcgacggtgggcacaacctgtactgcttactgctggcctctcacggcctcctcctggtccacagctactccgcgatccaacttggcggcattgagaaaag

SEQ ID NO: 43616 - DNA, 369 bp, Triticum aestivum
  Clone ID: PAT_TA_43616
cgtccgcccattgattttttactaatgggatttttatgtgctgttttgtggcaaattatcctttttgtctgttgtttgcttgtcacatgtatgacttgatgggagaaattatgatatcataaccataccacatttctgcattcactgtgatgatcaatttacacatgcactaccatctgatctcccattgctgtttgtatatttgtaagattttttcatgtgattaaaaccttttggattcaatgctgaacctgttctcttgctgtgcaatctgtgatgcaaacaatcccatttgctgaatcactgggattattataaacaagatcaccatcttttcggttgaaattgcatggcaaggttttttttttt

SEQ ID NO: 43617 - DNA, 388 bp, Triticum aestivum
  Clone ID: PAT_TA_43617
aaaggctgcggatagatgtgggcaatggatatcctatacctgacaaagaaccaatgcagatgatagattcttaggaatatgatagtgttgttacagtaaagatggttgtctgcagcacctgctatagttcacgttactaatggtaatatcattcaacctctgaactatgtacttactacaggaacaaatttggctagggaatatgtctcatttaaaatgctgcaatgaagtgtgacaaatggagagggatttttacttcactactttttgacatatataggtaaatatttgtcattccattcctaccaaaattgctacatatgtttttgattctgtaaattcatggtcccctgcaacatattcagaaaatcaattacatttgttatta

SEQ ID NO: 43618 - DNA, 334 bp, Triticum aestivum
  Clone ID: PAT_TA_43618
cgtccgcaaagacccttgtatttgaaatatctgttaagtagtgctagatgggtgggctgccaacaaaatgctactagccaactactgaagtattcagttttgacaaaagacgctccgaggaaaagcatcagcgagtagccatccaagaatattagagaaaaataaacgaaaaaactgatacaaactactagtaaacaatgacctgctttcacaacagttaatattttacaaacaaagctactgcaggaagaatgaagagtgtcagcttagaggaagccaaataaccgacttgatcaaaactgccacccttaacaggggctaacaccggttaatt

SEQ ID NO: 43619 - DNA, 359 bp, Triticum aestivum
  Clone ID: PAT_TA_43619
cgtccggtcgccgtcatggagttggtggcctccgtcgtcaccgtcatcggatgcaagccatccgccggttcggccgcagcgccgctggacgtggtgcccctggcggcctctgcgccgctggacgcggacatcgcgccgccggacacactgaacacggtgctcaccacgtcccgctcgtgaccaggggttgacccgtggctcgcagccggcccaagcgccgtcgccgtgcccgcaccaccccctgggtccccgcctccaccctcttcttcaccggccgagtggcttgtgccgcccgatgcccgcggccgaggccgttggtccgcacggctacgttcccgtgcctatgcgcactgtcgtgg

SEQ ID NO: 43620 - DNA, 437 bp, Triticum aestivum
  Clone ID: PAT_TA_43620
cgtccgcggacgcgtgggcgcgcacgaacccccttcgccgccgacctcgcgtcttctcctgcgcatctcggaggtgcttcctagtttccacgatgaagctgatcgctgcctacctcctcgcctatctgggtgggaactcttccccaagtgccgctgacgtcaagaacatcctggactcaattggtgccgaggctgatgaagaaaagcttgagttccttctggctgaactcaaaggcaaggacatcacagaagtgattggatttggaagggagaagtttgccgctgtgccttcaggtgggggtgccattgctgtgggagctccagctgctgcaatttggtggggccgccgcacctgctgctgagtcaaaaaaagaggagaaggttgaagagaaggaagaaatctgatgaagacatgggtttcagtctggtcgactaaa

SEQ ID NO: 43621 - DNA, 436 bp, Triticum aestivum
  Clone ID: PAT_TA_43621
gaggccacgacccacgcctacgcgttcgcccacgcgtccgcccacgcgtccggcctgttgtgtacgagcatccagaagaaaatcttgtgcttaagttggcagcaagttttctagagcctgtagctcatgaatgccaaggacggggcatcgtacaagtgacagtgactgcaacgagggcaagatgtcaatcttggggctggcaccggagaccgtgagcacaactggggggcgaggcgtcaacaacagctgcatcgcccgtgtggccccttgagttttggacctgccgcgctccaagtctggaagctgtcattcccattcatcctcttcagcggcctttaggttatctgatgaaaagtacattctatacttggaatgatttataattattgtgtggggcggctttatgaaagggatggacatagattacattgacttg

SEQ ID NO: 43622 - DNA, 432 bp, Triticum aestivum
  Clone ID: PAT_TA_43622
cgtccgcggacgcgtgggtaaaattgggaatagagggaggataatgctacctacatctacatgagggaagaaataagatggtcgacatcctcagaacacaccaactggtgaaacgtacccgcccccttgagagtcgctctaggcaccccggcccgatctcgagcctcgtccgtcggcgatgccgatcgacgatggctagggagaggcacccgggagatgcttgtatatactggtttagttcaagtcgtcttgtggtttggcgctatgccgttggggtttctgccgccggtgcttgcgagcagctgccggtggttgcccgccttgtcttcttcttcgtctccatggtggaggaagggaggaggccctggatctggcgaaatccctctcaataagcttcgcgggtctctcaaaatctgaagctcaagctccttc

SEQ ID NO: 43623 - DNA, 364 bp, Triticum aestivum
  Clone ID: PAT_TA_43623
cgtccgcctccccacacgattacacgaacagactgccgggccccgggtccggaggagacgccgctgaaccctaacgcggcgcgagatgcggcctctccgtcgccggggccgagcgacgagtcggccccgtcccgccgcctcccttgtgggcctgtatggacccgccgcctccttaatgggccggattggccccgccgcttccttggtgggcctgccccgtcccgccgcctcttttgttggccggcccggtccagccgcttccttggtgggctggcccgttccggtgccttactcgggggccggcgagcttgtacggcagcctttatggattccccaacctcctgtgttttaacaactgtgcact

SEQ ID NO: 43624 - DNA, 313 bp, Triticum aestivum
  Clone ID: PAT_TA_43624
cgtccggtgcaatgcactctatcttttggaggataacaaaaaaccaacttcagtactctcttaagacaaccatgtgtattatacatggatgtccgctaagtattttgggaagggaatgaacaactctttcagaataacaaacaagtgctacaatataaggaataagtacgtacatcttatatttttttcaccttgaagagcacattacatttgttacgagtgtgaaacaatttgtgtagtttatattgaaaaggcatcatgaaggtgatgtacatgttgtatatttatttacgaattttacgaatttttttac

SEQ ID NO: 43625 - DNA, 364 bp, Triticum aestivum
  Clone ID: PAT_TA_43625
cgtccgaagaagagcacatgcaaagcttagcaaacactttccctcctttccattccattcccctcaatcaatccgccgactgctccgtttatttaaccgagccgtcccattcttggagagcaagaagcacgccaccacctcgcgtccccaaagaatccccatcccttcccctcccctcccctccccggccgcacacagatccggcgaccgacaacaagccatggtgtccaacggggagctgtcgcagccgcaggcgggggagtacggccttgccgtcatgcgccgtcggcccaagaccaagatcgtttgcacgctctgcccggcctcccgctccgtcgacatgatcgagaagctgctgcgcgcc

SEQ ID NO: 43626 - DNA, 349 bp, Triticum aestivum
  Clone ID: PAT_TA_43626
cgtgcgcccacgcgtccgagcgcatgggctctcctcatggcaaccagcgcatgggctctcctcaaggcatatagcggagggacaggccccagtcaagaccttatccatcatatcgcaaccagcgcttgggttctcctcgcggccgatagtccagagacaggtcccggtctagatctaaaccatcagagcgcagccagcgctcggtttctcctcgccgtatagagtctagggacaggtcccggtctagaccggcgaggagtagtagggaccattggcgttccgacagaagttccagtgactaccacgaggatcaccatgacaggaaagagaatgcgcgtctttttctacc

SEQ ID NO: 43627 - DNA, 357 bp, Triticum aestivum
  Clone ID: PAT_TA_43627
cgtccggccctctggaggttgttgtttttcatggtgaccagcccacgattactggcaagtacaagggtgaggagaagcagtttgcagctcaatacatttcttctatgatcatcatcaagatgtttgagatcgctaaaggtttcactggtgtgaagaatgtccttgttactgtccctgcgtgcttcagtgaatcacagtggcaggctaccgaggatgctggtgtgtttgctggcatcagtgtcatgcgtatcatcaatgagcaaacagctgctgttattgcttaatgggctttacaagaaagattcgttcgttggcatagaaaattgtctcatctttgaccttggaggggggaagctc

SEQ ID NO: 43628 - DNA, 365 bp, Triticum aestivum
  Clone ID: PAT_TA_43628
cgttcgccctccccgaccgacttcctttgttcgcctccgccgccgcctatccagcacactccaggagagccccgcgccggcggccatggctgatgatgatggtactcatcatctgccgttcgtgcgggatacggtcctcaagaagaggaatgacaacgaggagtgggccaccatgatccgggagcgcaaggcggtcaagaggcatatgccgccggcacgacgccaagggcgccatcaagcgccccgtggactttgtcgaggagttccgcaacaaggagctcgacttcctgcggatgcgcatgcgcctgaaggtccggaagttgcgccccggtctaggccatctacgccaagctgctctttgccat

SEQ ID NO: 43629 - DNA, 421 bp, Triticum aestivum
  Clone ID: PAT_TA_43629
cgtccgcggacgcgtgggaaagattcttcaacaccccttttagttgtcgtccctggattaaccagtgattctgatgctgctgttagtctctaacctttttctgatgttggcttatacagttatacctgtgttgcatatttgaagagctctgggttccatgattaaataacttattactatatttagtaaccattctaaagatttagttggctattgcagtatgcaaaacacttggttcattccatggcgagaaaagggtggaatgttgttgtaagtaaccacaggggtcttggtggtgtgtccattacaagaagttcagttatataatttacatttccaattattgatatttcactccgcaatctccctgttactttgctgcaaacttacaatattcttgattactgtttggagttcgctt

SEQ ID NO: 43630 - DNA, 440 bp, Triticum aestivum
  unsure (1)..(440): unsure at all n locations
  Clone ID: PAT_TA_43630
ncttccngtcttctttcatatcatggaagcgacagcggttagtaaaggaaagaagtatgaaacccgggctcctgttggccaggtatgggctgtatacatgaactggaatcgtggctgcagctttgaaaatttcaaaagctgggaatatgatcttgtggagggcctggagatttctgctgcctctctaacattgtcctatctgacaaaagtggatggttttagtactgtattcatgctatagaggaagggtgaatctacatgtggcttgaaaatactaagaagtgacatgatgatgttctcacatcagattccttcataccgcatgacaaatgaaggcgacaaactctgtggttactgggaacttgatccagcatctgggcctgaaactttcctggctagaaatacaaagggaggcaaaagctatattgctcaacaggatg

SEQ ID NO: 43631 - DNA, 363 bp, Triticum aestivum
  Clone ID: PAT_TA_43631
tcctcgagccactcttccgctcttcctctatttatataaatctaatggatttgttttaaaggcgacggtcgacgcggtggacttttttgggacaaagtggggacagcgggctcgtgctctggagatggaatgggaggtgaacggcgagagtggtgaatctggtaactgcatcggccatggtgctgatatccaaaggaggaagcatcaggagacaaaattggagattgaagtttgccaacatgagaggttatgtttgcggcattgatttccgcttgcgttgacacaaaattggagattggggaaactgaggtgatgaaggagaacatgccgtcggagatcttgaggtggaagcacgaggggaca

SEQ ID NO: 43632 - DNA, 455 bp, Triticum aestivum
  Clone ID: PAT_TA_43632
cgtccgcggacgcgtggggcgaaaacgtagtccatcctcccctgtttttccgctaccaccggcggcggctcctcgtcaggatcggactgccggcggcgaggtgagcacagtaagccagccacctgttcgacggaatgcctcccggtgagaaggtcgacaatgcgccgccggcgagcggatccgacatcataggaacccttcctgaccatattctccaccatctgctctccttcctcccagtgcaggcagccgtgcagacgtgcgtgcttgcccggcgctggcgccacctctggcggtccaccacgggcctacgaatcgtcggccttgaacggtgccgagtctgtcgaagacctccgggtgttcgtggaccatgtgctgatcctgcgtgagcgcaccgacctaaacacttgtgagatgatattcgatgaatgctcggacgatgacgaggtctatgt

SEQ ID NO: 43633 - DNA, 273 bp, Triticum aestivum
  Clone ID: PAT_TA_43633
cgtccgcccacgcgtccgctcacgcgtccactcctatccggacccctactcgtggtctcactccgggtcttattctcgcttctatgctttgctccgcccctggcgccgacgccggggcttacgctgctgcttcagccaatacgaaagccaagatgattgtgaaaatggtcaggaccatgcgcaccgccgggcacaccagcatgcacagtaagatgcacactatgcacaagaccacgaatacagacgacactacggttcacagtacgctgcaaa

SEQ ID NO: 43634 - DNA, 369 bp, Triticum aestivum
  Clone ID: PAT_TA_43634
cgtccgagatgatctgctgctgtaacatgatggacgctcccactcccattttctcaaaggcccgtggcgaggaaattgtcaaggaagtctcatcgtacctgaacaaggttggctacaaccctgagaaggttccctttgttcccatctctgggtttgagggtgacaacatgattgataggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaaagcctggtatggttgttacc

SEQ ID NO: 43635 - DNA, 441 bp, Triticum aestivum
  Clone ID: PAT_TA_43635
catacgctcatgttctataaagctggtcgatgtattttctgcaaaggcttaccgaatacggtccgatggtttttgacttgagctgagtgatgtaattcgtggaatgcacaagtttgtggaaaatagccagaacaactttgaggttggagaggaagtgcttgtgaaatgcgacactttcagtgccaagggtgtcccagtcttctcagtgcttgattagtataattttgatggggctaatttgctctacgctagagctctacagagatacacttgtaaatgtgtactccctccgttcctaaatacttgtctttctaggcatttgaacaagtgactatatacagagcaaaatgagtgtatctacactctaaaatttgtttacatacatcagtatgtagtaggaatttggaatggctataaagacaaagattaatgaacggaggg

SEQ ID NO: 43636 - DNA, 388 bp, Triticum aestivum
  Clone ID: PAT_TA_43636
cgtccgcccacgcgtccggcgaaccagcaaaaccaagagagcgaaatcgcgtgttgattagacgaccagaccgaagccaacgaattggacatcgagaggaggaggacgtctctagactcagcccaccggaccaagagaggagaacggtcatcctcgacgacgccgccgccgccggcaaggagttcgatttgttgaggggagttttggatgggggaccatgtggtggtgaatgtggacggttttgcgaacaccaaggatgatggcgttgctgagaagccatctgaggctgtgtcggtggctgttgttgatatggcggaggatggtggccaggatgagccactcatccaggctggagagtgccgcatatgccaggaagaggacagtgtca

SEQ ID NO: 43637 - DNA, 450 bp, Triticum aestivum
  Clone ID: PAT_TA_43637
cgtccgcccacgcgtccggaaggaagacagtgatgaggatataaggccaataaagaggggggctgaaaaaggcagatatataaaacagcagattttttttgcaaaaagagacaataaaagtgataaagatcaaggtcaaaattctgcagaagataatcccctttcatctgctgtgaatgataagaaggcagctccagcccatggcaaacgagtagaacgtcttaagtcagtaataaaatcttgtggaatgagtgtgccaccttctgtgtatcggagggcaaagcaggccccggagagcaagcgtgaggcttgtttgataaaggagttggaggatatacttgaaaaggaaggattgtcttcacacccttctgagaaagaaattaaagcagtgagaaaaagaaaggaaagagcaaaggatcttgagggcatagacatgagcaatattatcac

SEQ ID NO: 43638 - DNA, 424 bp, Triticum aestivum
  Clone ID: PAT_TA_43638
cgtccgcggacgcgtgggcgcagactccagcgatttcctgtggtactcaacaagcatcgtcgtggcgggtggtgaaccgtatctgaatggtagtcagtccaatctgctggtcaactcacttgggcatgttcttcaggtcttcaccaatggcaagtttgcaggtagcggtaagggtaatgctagtagctccctgatctcattgacaacaccagttacacttgtacctggaaagaataaaatagatcttctgagtgcaacagttggtctgacgaactatggtgcattctttgacctagttggtgctggaattaccggtccagtaaagctgactgggccgaaaggtgcgctcgatctatcttctgcagattggacataccagatcggactcagaggagaagactcgcacctgtataatccctcagag

SEQ ID NO: 43639 - DNA, 461 bp, Triticum aestivum
  Clone ID: PAT_TA_43639
cgtccgcttatgtgctttatctgtttcattgtatggaagagaagaaaaggaaaggtaaacataaacaatcaagctgccacaaataggccggaagaatatgcactggtttggagattggaggagaggagttcagagttcacactctttgactttcctgagatattacaagctacacacaacttttccaaagaaaatctacttgggcaaggtggttttggccctgtctacaagggccaattaccagatggaatggagattgctgttaaaaggcttgcctcacattcaggacagggtttcacagaattcaagaatgaagttgaacttattgcaaaactacaacacaataatctggtaaagctcttaggatgttgcattcagggagaggaaaaactattggtgtatgagtatttgccaaataagagcttggacttttttatatttgatgaaaacagaacaacttt

SEQ ID NO: 43640 - DNA, 437 bp, Triticum aestivum
  Clone ID: PAT_TA_43640
cgtccgcccacgcgtccggtcgccgtcttctcctcctctcggttccctctccttgcttcgagagcctcagccatgggtaaggagaagactcacatcaacatcgtggtcattggccacgtcgactctggcaagtcgacgaccactggccacctgatctataagctcggaggcattgacaagcgtgtgatcgagaggctcgagaaggaagccgctgtaatgaacaagaggtctttcaagcacgcctgggtgcttgacaagctcaagggcgagcgccagaggggtatcaccatccattttgtcctctgaaagttagagaccaccaattactactgcaccgtctttgatgcccctggagaccgtgatcttattaagaacatgatcaccggcccctcccaggctgactgtgctgttctcatcatcgactccaccactggtgg

SEQ ID NO: 43641 - DNA, 347 bp, Triticum aestivum
  Clone ID: PAT_TA_43641
cgtccgatcaactcaagcaaactatgattcaaatttcgtgaaatgcaagtatttcttctgtaatggtaaaatgggaagaatgcttaactgggatgcttcaagcaggtttcctgcttatcacccatatgaaacctaacatatgattttttatttacaataatatatatgcattttcctataaatattggggaagtaaacttctggtgctttagaaacaaccctgcacatatatatcaggtgacgtattggcttgcaggtatgctccggctaggttgtttcttctcttccttaggctatggttgcaaccgttggctgctatgtgggtcttgatgtatttgcttttttta

SEQ ID NO: 43642 - DNA, 309 bp, Triticum aestivum
  Clone ID: PAT_TA_43642
catccgccttgatccactcaacaaacccttgccatccaccaccgacccgtctgctgcttcctcgggatcgaacccgagccaacaagcgaatctcctgatcccatcctcctcgatttcagtcaccagccaaccaaatgcataccctgatcgatccacccgtccaccagctgctactccattgggatcccttccggtccaccacctcccctcgtttttcagccccaagccagccagcagttccttctcgtccccgtgcagcagcgagcgggatctaaccttcctgtctccctcggttcaaactacaggagc

SEQ ID NO: 43643 - DNA, 407 bp, Triticum aestivum
  Clone ID: PAT_TA_43643
cgtccgcggacgcgtggtgcgcgcgggatcgctcgtccggtgaggtgaggtgaggcgacccaccaccgacgccgcgcccgccaccaacggccaatttgccaaagccactggtagaagcacagcatcccgccgccgacgtgcgccccggccgaaccccccacttcctcctctcccccctacatctccgcccctccgcggcgggagcgagctccacgcagctcccccgtgctccagcgccgcactccctcccgctccacccgcctcacagcctccggctcctcggccgcccgattcgggtcggggggcgccggtgccgcggtgcggatcagatcccgcgcggctggcccgtgcgggttgatcgggcggtcgggcgggcgcgcggatcatatctatatatgcgcgagatc

SEQ ID NO: 43644 - DNA, 225 bp, Triticum aestivum
  Clone ID: PAT_TA_43644
cgtccgctgaatttcagaatttcagaatttaatgtgtagcggctcggcggcgactgagaggattcgattcggcatcggcaccgtagccagcggggcgatgggagggatcgatgatttccctgtggatccggtgtgcgtgctagtcccccgccccctcccccacgcatttgtattctgtggttgccgtgcgagctcatccatggtccttgacgacccccccccccc

SEQ ID NO: 43645 - DNA, 306 bp, Triticum aestivum
  Clone ID: PAT_TA_43645
cgtccgcacaagggcaactaaaagcagtcaaggggcagggcttgatctgctataagtgtggtgatgggcaccgtgctgcagagtgcacctttagtggtgactgccacggttgtggccgacagggccacaaggaccgagtgtgcaaagtgaatcctaacagcatcgtcaagtggcagccggcacatgcacaagacttagtcacgccctcaccggggtctgtctcccggcaggcagcccctcatgtgccttctccacctccagcttcccccgtcgcgggttggcgtaccacagaacaactgttgaaac

SEQ ID NO: 43646 - DNA, 173 bp, Triticum aestivum
  Clone ID: PAT_TA_43646
ccaccctttcttcctgttccgccggcggtacttctgtccggtaaacgccgatctagagtggcgttcaacttctggacggcgtcgcacagcatgcatctgctctacccggaggaggtggatgttgtgccggccgtggtccgttagcggggcgtcacgcccttttagttttttct

SEQ ID NO: 43647 - DNA, 287 bp, Triticum aestivum
  Clone ID: PAT_TA_43647
cgcctcgcaagtacccggtcgcaagccttccgcctgtgaccgtggtggtccagcgacgcgaggtgagtggcatggcgaaaggagtcagaggagccaatcaaacaccttttgcctgcagctgcttgttgctacttgcttgtccgccaaaaccaacacccacgtgccaagaaatgttgctgccgccggccaaattgtcagctgcacaggtatgtttgcttgacagtgcaccggttacactcgacagactgtcactgttttttctttaagatgacgcgttttatcatgaa

SEQ ID NO: 43648 - DNA, 162 bp, Triticum aestivum
  Clone ID: PAT_TA_43648
cgtccgggcgtcgctgagcacggcgctgttcaacgacttgtgcggcgagcgggacgagctacgagctgcgctgcgacaacgccgtctgctcgtgccggccggtgtccatcctggtacggacaccaacttgtgcccgcccaactacggccttcccagcgacga

SEQ ID NO: 43649 - DNA, 104 bp, Triticum aestivum
  Clone ID: PAT_TA_43649
cgttcgcctcggccatggcgtgctccttctccgtcttcaccgtgtccacggacgccgcgctcgttcgcgtccccgaagccagccggggtgccgcagtgcctgtt

SEQ ID NO: 43650 - DNA, 318 bp, Triticum aestivum
  Clone ID: PAT_TA_43650
cgttcgtccacgcgttcgatctcacgctcgccgttgcttacatggcttccttcttcgtgtacgggaactacagcggggcgggattcacctttttcttttctttttccttttccctgtccgatccgtcttctttttctccctctgttctcgttttcggttcgttcttcgccccggtattatgtttttcccttttctacgtgaccaccgctttatctgttccggcttttggatagtccctttttggatccacccttggcttcgtttcgttcaccgtcaccggtttcttctcgtccccttttggttttggggccactggtt

SEQ ID NO: 43651 - DNA, 340 bp, Triticum aestivum
  Clone ID: PAT_TA_43651
cgtccgcccacgcgtccgcgacgaggagctcctccctcccgctcctctccggcggccgttgggctgggtccatgctggcgatgagggcccctggcccatattcttgttcctattaacccctccaatggcctgcaaggagctcccctcccatctccaagcgccgcgtgcgtgtgcagctcgcctgcgtattgcgtgcagcccgcgtgcgcgtgcatgtgcagttcgacagtgggtggagtagcactgcagccctgccctccgccgctggggcagcacggctgtggcgatgcactggccgtgcagtgcaccgcggctctacgtgcagtgtagtgggtgtgtg

SEQ ID NO: 43652 - DNA, 275 bp, Triticum aestivum
  Clone ID: PAT_TA_43652
cgtccgcggacgcgtggtcgttctgatcgttgtcgatgaccccgccaaggcgagtaacctctggaccgcgcaattaccccaggatacttgacatcgtcttgcgtgtcgtgtgcatggaccatggataccaccggttatccttgatatatctgcctccactcccccgaggggcgaggacttctcctgtgtcaaagccactgccgagcgttacgcgcatgcgcccgaggggcgcggcgcttccttttctggtgcggtccactatggaaggaggaggt

SEQ ID NO: 43653 - DNA, 348 bp, Triticum aestivum
  Clone ID: PAT_TA_43653
tctttctattaaccactgcgccatgctcacattcaagtcatttatcatcttggtgctcgccggctcactacaatggtggcgtacctcccaggacgctgtgactaacttacccttcacaacctgtgctcgtaccccgtgtgtccgttcatcacttcgaacatcgtcttgcccgacatacctgaccctaacgacgccgtctgccgtctcgacgggagcggcgaggggctcgttaccctgtctttcccctccggcacgtggtccggtcgtgtcttggtacgcaccgcctgttgttgcttcgatgacttcgacttcctcttcccctcctcctcctcgccggcggtggtgacc

SEQ ID NO: 43654 - DNA, 243 bp, Triticum aestivum
  Clone ID: PAT_TA_43654
tactcgtccgcagcatacccttcccgattgttggagagcactccgagatctgccccccatggctttcgggccgacgcagtcgcccctcctcccggacaccaaccccacgccgtgggcttggcgcccgccgtcacaggcggtggtggcggcctgtacgctcctatggtcacgccgtcgtttcgtctctttatgagccggatcttctgagtggcgcgcctatcgttgttcgaccgtcgtccgtgg

SEQ ID NO: 43655 - DNA, 379 bp, Triticum aestivum
  Clone ID: PAT_TA_43655
cgttcttgctgcttcagctatggtttctcgtccacgtccttctgtactaccgtcggtcctgttcgccatgtcgtatcaaggtggaatggccaagtctctcaagcaagccatgtcgtcgagaaggactacgacaagattgaccttggcataccttacagaagtatgaaggatgagcataaggcctctgaatgagctgaaggccaaggcatgccaaaagggtgcgctggtaggatctggtctcaagaagagtgggaagaactgagtctgcccacccattcgtaatacccataaaatgatgaatctttttatctacctatctttgtcgcgcttcactatctgtggttgtaacagactacctataagttgtgttagagcattt

SEQ ID NO: 43656 - DNA, 273 bp, Triticum aestivum
  Clone ID: PAT_TA_43656
cgtccgtgtactcgtgggcagccctgcaaggatggactctcgctggttatgcttgggcaacttcattgcgatgctgacatgttaggcaactggacaacaagctgaggcaatctggctcttgtggaggaacgctgagaatagcttattgcagagatgcccctgaggatctgttaccccgcaattggaaaaccaggaattggtagatagccactggatgcgaccctaagaacacctaatggaactaccacaatggagggatgaggccagtgctgc

SEQ ID NO: 43657 - DNA, 117 bp, Triticum aestivum
  Clone ID: PAT_TA_43657
cgtccgctgacgcgtgggcggacacgtggatcttgattttatggcctcatctgggtggctagagggcctgacgcaacctggcagtgacgaacatgactgtgcccctgcaggacgacc

SEQ ID NO: 43658 - DNA, 412 bp, Triticum aestivum
  Clone ID: PAT_TA_43658
cgtccggtcattcaaaaccctagaggttgcctgcgactagcttaggcacagccgtcttttcaagaagctactggaggctgtacttaaaactggcaaccgaatgatgatggctcctttcgagggggagcacaggcgttcaaactggacaccctcctgaagctggctgatgtcaaggggctcgatggcaagacgacgctgctgcatttcgtcgtccaggagatcatccgctcggagggtgtccgtgccgcgcggtcggccaaggagcataacagcagtgtcttcagcgtgagcggcggcaccgatgatctctccgaggatgtcggcgacgacacggagcactacaagcagcttggccttgaaatggtgttcggcctgtctgacaaccttcagaatgtccgcaaggcatcgatcc

SEQ ID NO: 43659 - DNA, 418 bp, Triticum aestivum
  Clone ID: PAT_TA_43659
tcgtccgtcctcgtacactcgccgcagtatcaatggcggcggaagaagcaaccgcctacgccgccggcaccaacttcgaggtggacctgggccaccttctcgcctacaacccccgcaccacctcgccgtcgtcgtcgccttcttcagggctgatctgcgggacaagtgcctgcggaaggccacggagctggcgcatgccgtcaccgacgccctcttttcgctgccggccaccgagggccgcgacggccccgtcgttcgtcttccgccgcccgactaccgcctgccccgcgagaagcatttaccaaggccgaagcctcctaccaagtgggagcattttgcgaaattcgaaaggtattatcaagcacatgaagaacaaacgtgcatgggatgagcaaactaattcctggaagcggactta

SEQ ID NO: 43660 - DNA, 248 bp, Triticum aestivum
  Clone ID: PAT_TA_43660
cgtccggtgagtagttgactaccttcccacgattattagcagctcccacaaatttgcagcatccgccgacgtcgttgttgttatactgtcgtcgacgccttctgtttggagaaatggtcataaaagccattctatacgccgggttggatgcctttgcgtttgatccgttcaagggcatcctcgtcgaagtatgttttcttgaagaggagggcgccttcatgaccgtggactaccgttggatgcagtcc

SEQ ID NO: 43661 - DNA, 437 bp, Triticum aestivum
  Clone ID: PAT_TA_43661
cgtccgcggacgcgtgggctcgaactagagcagggccagcgctagggttccagcgccgccgccgggatccactcccgccgcagcccagcttcctccacgccgccgtctgccctctgccctctgccgcagccgggacaacgggaagctgccgccgcgcccctctgcaccggctgcccacggcgcctccgtcccgaagctgcagatcatccagtcctccactcctccacggttaagatgacttgtgcataggtcgagctttagtctgatggattctgacgacaagaagtttggcaaaggacctagggagctcactggtgctgttgatttaataagtcagtacaaattggagccgcaccatgatttcttttgcaagaggccctttgcacttgcaatctcagatacacattaccttcacaatgtagtggggggcactgaaa

SEQ ID NO: 43662 - DNA, 339 bp, Triticum aestivum
  Clone ID: PAT_TA_43662
cgtccgcggacgcgtgggaaaaaaaaactgcacgacgccgtcgccgatgtggttcgcaaaacaagggagcgggggcaaaccggtgcggcggctactgcttctcctggacgccggcgctgtcgccaccgaccagatcttcaccaccttaagtgtgcctttcgggaagaactcgcgcgagccaaggtaccgcggggagtgtcattccgctcaattggcctgggttctctgagaatggccaggagtctgaaccaatgaacgaccacggggggagacacttcatctggtacctacccacggccgaaagcaagaccatgaagtcgattgtcccacaaaatgcaa

SEQ ID NO: 43663 - DNA, 402 bp, Triticum aestivum
  Clone ID: PAT_TA_43663
cgtccgttcacgcgcctaccacaacccgagagcgaggagttcacgtcgcggcgtcggtcaccatggaggcgtccaacatttaccagtgcaccaaggaccatgctagctgctttgtgaccaggctatccggaggctccagatgactgtgatagcagtccgggcgctgccatgcgcaaaggcactgctggacggaaggggattcaagcttacagggcgcatataccgactgggaaagtggtgactgatctccgtatgaaggagaatgagaaagcgtgtggtcctgatagcatgaacacacaggccaaggggaaagcagccaggcttgctgctgcagcacgttcttagtttgcaaactattcttactggttagctttttgccagaagtgatgtctagggtaagtc

SEQ ID NO: 43664 - DNA, 389 bp, Triticum aestivum
  Clone ID: PAT_TA_43664
cgtccgatctccgccggagcctgcacgacgccgtcgccgatgtggttcgccggccgggcgagcgccaccgcgccgctccccctcctcctgctgctcctggtcgccggcgctgccgccaccgaccagatcttcaccacctcaggtgtgcctttcgggaagaactcgcgcgagccgaggtaccgcgtggagttccatccagtcgattcgccctaccacccggagaatggccaggagtctgaaccaatgaaggaccacgaggggagacaatacacctgctacctaccagtggaagaaaccaagaccatgaagtcgattgtcccacagaatgcaaccaatgttataatagaaagcgaacggaaagttaagccaaaggagccagatgaactggt

SEQ ID NO: 43665 - DNA, 327 bp, Triticum aestivum
  Clone ID: PAT_TA_43665
cgtccgcgccgccactcctccgaatcctcctcgatttccccatcggccaatcccaccgcagcctcctccttggtcgatcttccctgccacccagtcccgtcgatccacccatctaccgatccccaccaaccagagatcccctcggccctcctcgaccagcagcaaccaggagctcgatctccttcttccaagcccgcgcgcccaaggaaacgcacgaggctgtgccttcttgtccccgcgcctctgcctcgccggtggttgccagccacccaagcagcagcagcagtccggagcttccgtcttctctcgcgagcgccccttcagcca

SEQ ID NO: 43666 - DNA, 418 bp, Triticum aestivum
  Clone ID: PAT_TA_43666
cgtccgcgctggggtacaacgagatggcgtcggaggcgccgctcctcgcccacgcgccgccgctcgcgaggtggcccggggccatcaccgtcttcgcggcccccgacgccttcctccaggccgcctgccccatgtgctcgcgccgccacctcctcgagcagcacatcgccatgggctactacccctactccgagctcgccgccgcagccaccatgaagatcccctccgcctccgtcggcttctgcatcaaggtcgccaccgagcggggccccttcggcatccactacgccaggatctacgccgacggcgtcgaggtgtccctccgcggccaccgctgccttcgtggtgcgcatcatgatccgcgacgccatggcgcgactccgcgacgggggctacggctttatggcgctggccatgc

SEQ ID NO: 43667 - DNA, 401 bp, Triticum aestivum
  Clone ID: PAT_TA_43667
cgtccgatcgacccctccccccgttgcccccttcctccctcgtctccatctcctcgctggcgcccgcttcccgatctagattcctgctccgccgcccctcccttccaccacccagtcgccccctcagcagatcaagcgagccgcccaacctcaccggcctcctccgtctcttccggtcagatctgacgggcacatcttcctgcagccacgagcgaccaccccggcctccactccaccgccggcatcctttcccctacctctccgtagatccttttgagcagccacctcgagggcggcgccgccaccagccgcggcggagaggtggatccccgacacccctgatggcttcgccgtccccaggagccacttcaccccgcgcctgagtgccagctgctgctcct

SEQ ID NO: 43668 - DNA, 415 bp, Triticum aestivum
  Clone ID: PAT_TA_43668
cgtccgcccacgcgtccggctggagcggctggggacccctcccggagggcgcgccggcggaagatgtgcaaggccttctacgctcaggatttcatcaatcgtgttgacaagattggcaccatcaacagctacgccctttttgggcacgccgacatcctggaggttgcggcggaggccgccgagaggtgcatccaggtggttcacctacttcaaccagtgctggtggatgagttcgcgagccgccctcgagccaagactgtggtcggggtcaccacaaccctgagcgttcgcctggtcgaacattgccggatcgtgttgtctgagtgtgaggagggttacgtcccggagcatccgctgcgcgaagccttttacggtctcaatgccctcaatcgaactggctaccccaagcccggcc

SEQ ID NO: 43669 - DNA, 383 bp, Triticum aestivum
  Clone ID: PAT_TA_43669
cgtccgcgcccgcccgcccccgccgccgccgccgcctccttccgcaggagctccctcctcgcaggggagatggtgtacatcaagaaccagaatacaagggcgtactccaagcgtttccaagtcaagttcaagagaaggcgccagggcaagactgactacagggccaggctgaggctcacaaaccaggacaagaacaagtacaacactcctaagtaccggtttgttgtgcgatttaccaacaaggatgtcactgcacaaattgtttatgctaccattggtggtgatattgtgatggcccgtgcctactcccatgagttgcctcgctatggtcttgaaattggcctcaccaactattctgcagcttactgcactgggctgctttt

SEQ ID NO: 43670 - DNA, 412 bp, Triticum aestivum
  Clone ID: PAT_TA_43670
cgtccgcaatactaaaggatgaagatgaagagcaaagttgacaaataaagtgaagaactgaaatcagcaaatgtaaaatgtatgaagtgagtaaaatcttcctattgatacttcatcttgccttgagtaagcttccagttcatacaatattaaaggatgaagatgaagaggaaagttgacaaataaagtgaagaactgaaaccagcaaactgaaaaatgtatcatgagaactgaaacttgtcataaagagggcttcagaaaggtggatcctgacaggtgggaatttgcaaatgagggattcttgcgagggcagaggcacctcctcagaaatattaagcgccggaaacctacacatgggtctcagaatcagcaatctcttggctcttaccttgaggtggggaactttggacat

SEQ ID NO: 43671 - DNA, 225 bp, Triticum aestivum
  Clone ID: PAT_TA_43671
cgtgcgcccctagcaagtatgcatgcattctccgaatcattctcctctcctctcctctacccctaagcaatggggctcactaagcagacgtctagaaattcttccgtcttcatggctctcagtaagcagctatctaccaatgccgtctctaagttttccccggccaccggcgtgtttaataatcctctctcggttttcgcctgtcaccgttttgcttcttgagat

SEQ ID NO: 43672 - DNA, 422 bp, Triticum aestivum
  Clone ID: PAT_TA_43672
cgtccgcggacgcgtgggttttttttgcctcaatttaatatctatattgcctacaatcacatagtattttgccccaatgtactatgcatagtccggggggcatggcctctttttttttgtcccccttcgttttttgcctggatttagatggggtttgcgcatgtctcactgcccccaccccttatcaatatgttctcactaggttacaagccagttaactgacccccccccccctagagttagggtgttctataactctcaaatcacacaggctgtttcttcagccagttaactaacacaatataggttacaagccagttaactgaccccccccccctagagttagggtgttttataactctcaaatcacacaggctgtttcttcagccagttaactaacacaatataggttcagatttctt

SEQ ID NO: 43673 - DNA, 419 bp, Triticum aestivum
  Clone ID: PAT_TA_43673
gggagcgcacgcgtccgcccacgcgtccgcccacgcgtccgcccacgcgtccgggagattcaagaggatgagaagggggttgatgataattctcgacttcagcttgctgttaggaccccacctgctgaatccgtggaaagggaagatgaagatggctttcctgtgttctgaatcaaagaagagttctaaaggtagttccgagaaggataagaatctaaataatgggactagtactgaagacaggaaaaggaaaagtgatgctattaatgatcctcacaaggcgtcaggggaggttaatgctgaaaatgatgtggtttcaaagaaaaagaaaaaggccaaggacaaaaggaatgctgtggacagtgagaaggtaaacgatgaagaaaaggaggtgaaactagcttcctcagctgacacca

SEQ ID NO: 43674 - DNA, 425 bp, Triticum aestivum
  Clone ID: PAT_TA_43674
cgtgccgcccacgcgtccgactcccgcaaaccctatcgctgctcctctcctggcgccgctcgacctcctcctggctctcgctcaggataccaggagaaggcaggggtctagggcggcactccggcgcggcggcagagggaatcagaccctcctctcctcaaggggaaaaccaaccagagagcttcacccagcgcgcgatggggaagaagaaagagcggtcagtgaatgtgtcgggcaagccccgtcactctctcgacgtcaaccgccccaatgacaagaagggtgctggcggcggcggcggcgccggcgggagccggtccgcggccacggtgcggcggctcaagatgtacaaactaaggcccatgagggaccgcggtgggaagatcgtcaagcacgaccttcagtccaaggagctccccaacacc

SEQ ID NO: 43675 - DNA, 416 bp, Triticum aestivum
  Clone ID: PAT_TA_43675
cgtccgcggagctctccttcctccacatactggtgccgccgcaatccctcccgctcccgcctccattcatggacctggactcgggccgcatctccagcacggacaagaacctggtcgccctttacgccggcgggtaccgccctggctctagtttgtcgggaggctatctcatctacgacgccaggaaggactccctctccgtcatcccccgtctcccctccgacgacttgcatggagtcatggggcaccagtcggccgtcgtcatgtgcgacgcccaaggggagggctacgttcttgccgagctcatcaagaaaggattctcccaggccggggtctggctgtggaagtcgtccgccccacaaccagaatgggtctcgttacccgggagccatccccttccatccagcagattcacc

SEQ ID NO: 43676 - DNA, 277 bp, Triticum aestivum
  unsure (1)..(277): unsure at all n locations
  Clone ID: PAT_TA_43676
gggagcgcacgcgtcctcccacgcgtccgcggactcttgggcttctagccatcagctccagccttcctcgcgaccaggccccgggtcccaaccggcgacctgccacncctcaaaaagaaccctccgacccgcccctgtcggcactcctgtactcccacctgccccgggccgggctaccaggcgtcactgccacgccggcggtcggcccagcgatgccggcaccctccctcctggtcttccactggcgggcccctgtccctgactcgccactggggat

SEQ ID NO: 43677 - DNA, 223 bp, Triticum aestivum
  unsure (1)..(223): unsure at all n locations
  Clone ID: PAT_TA_43677
ttcctccccaccccaaccatccccttntactcctccttcctcctctcccccgaccctggatccaaatcccggcgccgccccagagcctgaatcgaggcaagcaaaagcttgagatagatagataggccaggtatggaggctagaggcgagatcatgaatcgcgagtaccagcaccccctatggagcagctgttgcaggggaggcatgggctcctccgaggaca

SEQ ID NO: 43678 - DNA, 255 bp, Triticum aestivum
  Clone ID: PAT_TA_43678
catccggccttattttggttgtgacttgtgacttatgagagaatcaaaaagctggctaggagactagggttattttggtggaggggtggttggctgttatcaaggaaagtattaactagtaagagactaagagggtaagactgtaagactaagaaattgaaatggaagctgagaactaagcttatttggggtattctggacctgtgttgctggctatccaatcttcagggttattaggggacttactatctaaaa

SEQ ID NO: 43679 - DNA, 242 bp, Triticum aestivum
  Clone ID: PAT_TA_43679
cgtccgcggtatcctcgattctcgcacccccgcggcttcgcccacaaagccccgcgaaaccccccagcccacacgcgcgccggtcggctctcccgcgaaaacccctagcttttcccgccgcccgcgtctgcccacatttcgccgagcaccttgcccgcaccaccatccgtctctcccccggcggcattgggggcgggatggacagggaaaacctggttggccggaggggggaaggctccggg

SEQ ID NO: 43680 - DNA, 124 bp, Triticum aestivum
  Clone ID: PAT_TA_43680
cgtccgcggactcgtcttcttctccccttccggacccgttaccggacctcgttccgatatcaaccgggagtggacactcaaagggtgggcgatctccacataccattgatcacatatcaagaaa

SEQ ID NO: 43681 - DNA, 107 bp, Triticum aestivum
  Clone ID: PAT_TA_43681
cgtcctaccacgctttcgcacacccacccaacccttgcatcctgtatcaccaaaacgccctcattggcaaaggggtactcgcacgccggttatacacctgttgcacc

SEQ ID NO: 43682 - DNA, 254 bp, Triticum aestivum
  unsure (1)..(254): unsure at all n locations
  Clone ID: PAT_TA_43682
gagcgcctctgctctcctgcgtcaccggcgagcgagggagcagttgcggggcggtcaccacgggggggtggtgatccnctagcgccgcacgtacctggacgccgacgacgactggcttggcgttttccttctgcggaaccgcgcgtctatgaactcggtctgggcggtgctcgtttaccatgggggtgggcacaactatcatcttgttcgccacagattcacctttggagctcttatcttaggtccacggactt

SEQ ID NO: 43683 - DNA, 350 bp, Triticum aestivum
  Clone ID: PAT_TA_43683
ctcctttcctctgtccctctcgcacagcagaatagaactcctaccctccaatggccgggggggtggctgacgcgggggtgcctaccttggctaaagctaacggctccggggcggggtgctgcccggtgaaaggccccgtgtacgccacgcccagggaggtcatggagatgggcccgcgggaggggctcctctacatgacttgcgtctacaatgggactggggatcaacaagccggattacctggctacagggggcgtgtaccccaatgtagcgacctactctctaggtgatccacagggttccgggcactcacaattgcgacgagctggatcattacggttgggaccgct

SEQ ID NO: 43684 - DNA, 342 bp, Triticum aestivum
  Clone ID: PAT_TA_43684
cgtgcgagtccgtgacaccgtctcacgcacacaacaaggtcagccatggacaagaagagggtggccatcggcggcgcctgcctgagcgggctggcggcgttcaagcacctgctggagcgcggctgccggccggctgtctttgaggcggacaccgtcctcggcggcgtgtgggcgcacgcgccagagtgcaccaggctccagacgccgcggcccatgttccagtactccgacttcccggggccggagtccgtcacggaggtgttccccgaccaccgccagggtgcggactacctctacgcctatgcgcggcactttggcgtgctcgactgcattatgttcggc

SEQ ID NO: 43685 - DNA, 417 bp, Triticum aestivum
  Clone ID: PAT_TA_43685
cgtccgggcaaaatttgagatcgactcactccacgacagcattgacttctatggcaccatcacccgggcccgttttgaggagctcaacatggaccttttccgtaaatgcaccgaacatgtcgagaagtgcctcgctgacgccaagatggacaaatcccaaatccatgatgtcgtgctcgtgggtggctccagccggatccccaaggggcagcagctactccaggatttcttcgatgggaagatgctctgcaagagcatcaaccctgatgaggctgttgcctacggtgccgctgtccaggccgcagcccttaatggtgaatgtgaccagaaggtgaaggatttgctccttcttgatgtcacgcccctctcgctcggggtagagataggaggtggtttcatgagtgtggtgatccccag

SEQ ID NO: 43686 - DNA, 239 bp, Triticum aestivum
  Clone ID: PAT_TA_43686
cacgttggcggactcttgagacataaatgctcaacatccatcatgcataaccctggacattgggggtctgtattgatatgtcttgataattctagttactttatatgaagcaaaagttatcttgcaaccatctagtcacatttaagtgtaagttaagcaggcatgttatagggaacctgttaacacttgcttataagaacgaacttgacttactatatatacccaagtgaagatgtact

SEQ ID NO: 43687 - DNA, 220 bp, Triticum aestivum
  Clone ID: PAT_TA_43687
gccacacgtccttgatgcttaagtgccacaaaccacattctcatattaccatcccgaatctacagggggtggggtttcacgaatgatggatgaaatcaaaaaacctccaaaaagtttatactttttacttcatgcctgtccccataatcctacactgggagactctactgaggaacataggctaaaaacatcctatcatatcacggcgaaaaaacaattc

SEQ ID NO: 43688 - DNA, 398 bp, Triticum aestivum
  unsure (1)..(398): unsure at all n locations
  Clone ID: PAT_TA_43688
cgtccgcccacgcgtccgagtaaatgttctcactgngnngcgcaaaataatatatatttttgttggatgtatacttaatttcaggagatgtagattttcttgttatcttatatatgttccttttctttttttcttcttgtgaaaaatgagttcaacaacaaaggggttttnnttctggcctcctggggttgaaatgattactctaattgatttnnncattgttaatttttttatttggaaacgcttggaagctttcctttgtaannncnntatgaagatcttatgctgcagggagttttcaccaatgccacaaagatgttgctgcatcgaacgcataggataatatgatattagctgcttcaaaccaggggaactggctggttcatagatggttgaac

SEQ ID NO: 43689 - DNA, 157 bp, Triticum aestivum
  unsure (1)..(157): unsure at all n locations
  Clone ID: PAT_TA_43689
tcgnctgtagaggatccaatcttactcactcgtgcaatcaatcttatagcttttatataataacatctaaattcactataggtagggggtaatttacaacggtgaggcttcaaaaaccctatcatatcccatcttaatctccttgcatcacttccac

SEQ ID NO: 43690 - DNA, 297 bp, Triticum aestivum
  Clone ID: PAT_TA_43690
cgtccgcggacgcgtgggcggacgcgtgggaattaaaaaaaaaaaaaaaaaaaaaaaaaaaaaaagggaaaaaaaaaaaaagagggtaaaataaaaaaaaaaaaaaaaaaaaaaaaaaaaaaaaaaagggggcggccgttttaaaggacccaagtttacgtccccgtccttgcaaggaataagttttttattggggcccccaaaattaaatccattggccgggttttaacaacggcgggacttggaaaacccctggctttaccaaattaaatccctttgaagaacatccccttttcc

SEQ ID NO: 43691 - DNA, 281 bp, Triticum aestivum
  Clone ID: PAT_TA_43691
cccgtgtcttgcagagaggaatcaccgcgcggcggcctcctcctagattggagcggtggatccgcatctattctcttcatcaccgagtccatgaggtgctcgatgtggcaggggcgacgaacaggagtgccgcatcaataacagcgacgaacgacggcccagacttggtggccgagcagcagcgacctcgacgcggcgcatgcgtggtagctgatgcacggcacagcgaccgcgaccaggacgcggtggccggagaacggcgacggctgacaagacctggc

SEQ ID NO: 43692 - DNA, 344 bp, Triticum aestivum
  Clone ID: PAT_TA_43692
cgtccggacaccgcgctcctcctcgcggcggtggacagcatcaagaaggcggcgctgggtcggctgcgcaacggctccgacgccgccaggatcctcgaccaggagatgtccaacaggctcctccacctcgcctgcaggcacgacgtcgccgagtgcgccaggctcctcctcgacggtgagtacgggatcacgccggcctccgtcgacgccagggaccagctcacgcgtacaccgctccacgtcgccgccgaggggcactccaagaggtgcctccagctgctcctctccaggaacgcccggacggacgtcaggctggtcgacggcacacgcctaatcccgctcga

SEQ ID NO: 43693 - DNA, 324 bp, Triticum aestivum
  Clone ID: PAT_TA_43693
cgtccgcccacgcgtccgcgcgagcgggccgcccttcatattttttttttaagttttaacaccacgggacataaggccgctgtattatgacctacaaattgcatttgggggcctactcttctaacagagtttattacctcacttttttgaatagccggatacactatacacatattataacagaactagacctacagagctcccactcatattcatgcgctgagcaatggttgggttgataccacctgcctttatgtacgcccggacaagggcctcataatcttaccgctcctggcattggtccttattcatgcactcccagaa

SEQ ID NO: 43694 - DNA, 274 bp, Triticum aestivum
  Clone ID: PAT_TA_43694
cgtccggtcactagtgccaactagtactccaaaacatcacatcttcgcaccgtgactgtgttcagccgagccgggcgatctacacagcagccagcatgaatgcttcctgcttactggtcgtgcttctgctcgccgtcgccactgagagcaagctctcgctcgccgccctcgagggcagcaccctgggcggcgagctcggcgagctcatctccaaggccggcagctttctcacatctgcgcgccgcgctggagcatactgctgtcactccatcac

SEQ ID NO: 43695 - DNA, 242 bp, Triticum aestivum
  Clone ID: PAT_TA_43695
aatatccttgtggacccactccgtgcggatgatcaccaatattaggttgctggtcaccaatatcctcagatgtctatcattagaggggtcactgtgggggagcatcataagggcttttggtcctcttcatcgtgggtcatggtgcacttcaccacgattatttcttgaagatcaatttggatgtcatccctccggagattggcatgtcacagatccccggaagctatgaagattgatgatac

SEQ ID NO: 43696 - DNA, 234 bp, Triticum aestivum
  Clone ID: PAT_TA_43696
cccttcgtctcttctatccggaggtctgagggagggagggaggaagagaacactgggggaaaatatggaagagagatacacatgaaaaaagcgcgcacatacgggaacgctcgacccaaatcgaatcccctccttacggagaaacccttatcccatataaaagaccccccaaatcccgccaaatttttccctcgatctcccccgtggtccaccgggaggattccccagatcttc

SEQ ID NO: 43697 - DNA, 150 bp, Triticum aestivum
  Clone ID: PAT_TA_43697
ccactcgttcgtccacgctttcatccactcgttcggattttttgtaaaacaccctctttgctcaccggggcctccaccgccgcgacccgcaagccattgctccgtccaccagctcctccttcggcacggactccactggttcctcctcct

SEQ ID NO: 43698 - DNA, 420 bp, Triticum aestivum
  Clone ID: PAT_TA_43698
cgtccgcggacgcgtgggtgctgcagcctctctcctgctgctttcagagcattctagcaagatttcagcttatgaagattgctatacagaagttatggacagttttgcccccaatgtgtcgaaggatgtgaagctgaatgcttttgatcatcaactggttcgatctgctgagttcaagaagccgaaaggttgcaagtgttcagcttatgatattttctatgggcaatgtgttaaggacaacaacttgatccccaatgttgccaaggaaaaacttcgatccctaatattgccaagaattcagcttgtgaggattgctttggacaatgtgagaaggacagcagcttgatcccaaatgttgagctgaaagaaagaaagttgatcggcaatgttcctgagaaggacaacactttgatctccatt

SEQ ID NO: 43699 - DNA, 288 bp, Triticum aestivum
  Clone ID: PAT_TA_43699
cgtccgtgctctcgaggatactagctcctttctcctgctgctttcacagcattcgaggaagatcggagctcatgaagactgctatacacaacctatggacagtgttgcccccaatgcgtcgatggatattatgctgaatgctcttaatcataaactgaggccatctgctgaattctagatgccttatggttggctgcgttcctcttaataatttgatctatgggcaattttgtatggtcaacaacttgttcccaaatgctgcccatctaatactcagatccctatttt

SEQ ID NO: 43700 - DNA, 261 bp, Triticum aestivum
  Clone ID: PAT_TA_43700
cgtgcgcggacgcgtgggggcataacaccagctagatttctggagtaaataaaatgagaataaagaggtccaagtgtggaaagaaaataaatgtatcagtttgagcttgaaccctagtataactatggccagacatttcttatccatcaaaaaatcacacttgcccaaaaacgcttgcatggcacatacccaatcaggcaagtgggggtaatgccaccatccaaatatatattggagattccatctgagtacacaagggac

SEQ ID NO: 43701 - DNA, 199 bp, Triticum aestivum
  Clone ID: PAT_TA_43701
cgtccggtaaactggagttgttgtcttgaggttttgtcctctctttttacataagacaatgcaatgcatattcagtactattagaattaggtattaatttcctaattgggtgagactttcatgtattcatctctgtcatttataggtcagacacgaaccggtatatcgagcgtaactctgatcggtattcctgttgata

SEQ ID NO: 43702 - DNA, 321 bp, Triticum aestivum
  Clone ID: PAT_TA_43702
cacgcgtgcgcccacgcgtccgcccacgcgttcgcccacgcgtccgcccacgcgtcctcccacgcttgcggccacgcgtccggcgagccggcgccatcatctgcacaaaggctcctcaaaccctaaccctagtcctagcttatcttccttcttctcgatctagctagagccatggcgccgaccaagggcgaggggccggccatcgggatttacctctggaccacctactcttgcgtcggggtgtggcagcacgaccgcgtctatatcatcggcaacgaccatggcatccgcgccactccctcgtacgtcggcttcaccgac

SEQ ID NO: 43703 - DNA, 271 bp, Triticum aestivum
  Clone ID: PAT_TA_43703
cgtccgcccacaccttctcaatcccacctactccacctttcgccggagccccatcatggatcaagggaggaagatggactccggcaagctgaataaagtggccgcgaagaagttcggcgggccgaggaagaagtcggtgaccatggtccgtcaaggccgggctccagttccccgtccgccacatcggtcgcttcctcaagaagggccgctacgcccatcgcgttggctcctgcgcccccgtctaccttgccgccgttcttgaatacctctc

SEQ ID NO: 43704 - DNA, 415 bp, Triticum aestivum
  Clone ID: PAT_TA_43704
cgtcctgttttttctctccccacctccctccccctctaaacccgcaccagaagcagggctcctaggggttgcttctgccacaaaccgtaccaccagattgcccctattcctgcagaggcggcggctgcgagctggtaggatggcggggtaccctggggacaaccatgcacgccatgaacgggttcgaggatgaggtctaaaaagtggaaggaggtcgacgaggagggccgtccggtgcggatggggcggcgagatgggggcgattggggtggcttttgctaccccgggggggatgacgggagggggtgggggcgttgactcggtcgggtaaaatttccttatgagagcgttgtatggggagaccactggaataatcactcttcaaaggctttttgggaaggtatggggggctata

SEQ ID NO: 43705 - DNA, 425 bp, Triticum aestivum
  Clone ID: PAT_TA_43705
cgtcctattttgcttggtaagggagtcaatgttgaatcctaaagcgattccgtcactccccttgggtgggctgttggtcatggacaggaatactcggtcaatcttctgcttgaacacaatgctaagcccgactctgaaactggtgatggtatcactttgttcttgtctggtgttgctgctggttccctcccatgcttggaggttctaatccaggcaggtgcaaacccaaatgtctctgctggtggagcaacccctttgcatgttgcttcaaacagtggaaatctttaaatgatcaaatgtttgcttcaagctggatgcgacctaaatacctttgacgatgatgtgattaagccattataggtttgtgctttaaggtataacctttgaatttaatggacattttttaccattaaatttgtcaaatc

SEQ ID NO: 43706 - DNA, 163 bp, Triticum aestivum
  unsure (1)..(163): unsure at all n locations
  Clone ID: PAT_TA_43706
ttnnnctagactgtacccgcagtaccttccntaattccggtggacccactcgtgcggccactcgtctctgccctcttattgttcagcggaacccggcatgtgctcaagcttatcgggacccgggggatcatgaatgatcagtgtcctacttctactatccatg

SEQ ID NO: 43707 - DNA, 331 bp, Triticum aestivum
  Clone ID: PAT_TA_43707
tcgtccgcggtcgcgtgggcggactcgttggcgccgttaccccccttccaaacacctactccccgggccccgaatgcgatccatggcggctgctgtttgtctcctgcgagcggcatctgcggtggcgctgtctctcatgccgtctggactcaccatcatgccatccccttcccccgttccttttccctaggctcagtccctcgtgctccccggcctcggcgctgccattctcccctcgatggtacttatggccgtccccaatatgaagatctcatattattagagggggttgagaaatggacccatagccctgaagcctgtgccagttatt

SEQ ID NO: 43708 - DNA, 280 bp, Triticum aestivum
  Clone ID: PAT_TA_43708
cgttcgcggacgcgtggtggcaggtggccaccaggatctacgccggcctgcgcgccaacgccgggggcgcgctgtccaagcacgccgaccagaacgacgtgctccgggcgctctgcgccgaggcgggctacgtcgtcaacgacttaagcaacgtgacgcgctgccccgagcgttccccgggcgtctgcgcaagcggcagtttctacaatcttcagtgcggcttacacagcggggggagctgtggcatcaagggggggtcattcaccaggcgtctgtttga

SEQ ID NO: 43709 - DNA, 381 bp, Triticum aestivum
  unsure (1)..(381): unsure at all n locations
  Clone ID: PAT_TA_43709
cgtccggccctcgtgcccttcctccctcctccattcctccctcgcctccctcctcccgccggcggggcccgcctccccgtctgcggatcgccggcgcgcgctcgagagatgcgggaaatgctcgatcctcctccgcgccgcggcccggccttcaagacgaagctgtgcgcgctgtggaggcgcggcccctgcccccgcggcccctcctgcggcttcgcccacggcgaaggcgagctccgcacgccgnctccctactccacctttccgccgggcactggacctggggggcgagatcatagaattcatggaatttagaggcaggccctgagagaaagaaacttcaccccggcgggggtatttcccctggcagaaatacccaga

SEQ ID NO: 43710 - DNA, 291 bp, Triticum aestivum
  unsure (1)..(291): unsure at all n locations
  Clone ID: PAT_TA_43710
tcttccgngtccacctctactcttgcaagtctaccaccactggccacctgttctataagcttgtaggcattgacaagcgtgtgatcgacacgttccactatgaagccgctcaaatgaacaagatgtctttcaaggacgcctgggtgcttgacaagctcaaagccttgcgtgagatggtatcaccatcgatattgccctctggaagttcgagaccaccaagttctactgcacctacattgaatcccctggtcactcttgactctatcaagaacataatcaccgggacctccc

SEQ ID NO: 43711 - DNA, 325 bp, Triticum aestivum
  Clone ID: PAT_TA_43711
ccggtccgggtttcctgggggggcccactctttctcccacgcgtttctttaagcctgctgtgggtgctttagggggtccacttcgaggtgcttgggacctagcgctccgagatgggcttcaacttcataagagagcgcgcgcattgagcgagcctccgcccaaagcgagctttactatgttggtgtgcctgtctccgactatcgccgttgtactataatcgaacggacgctgattggggctggctggctggttggtgtgctttgccagcattttcgctctatgcgatctgactaggtgtcgggcttttgatttatgaaatattta

SEQ ID NO: 43712 - DNA, 250 bp, Triticum aestivum
  Clone ID: PAT_TA_43712
ttttcagacaacagtatgatctccaagttgacagcatacttaaaacacacacggaaatttcacatggccgattaatctccaacggaagcagttagggccatcacgcatgcatcgttcaggaagggcgaactgagcatagaagccaacacaattcagtgtttacaaaatatacaacatgggctttatatatgctcaccaaaaatattggggcctggcccatttcttccaccttccaaggtttttccatacc

SEQ ID NO: 43713 - DNA, 196 bp, Triticum aestivum
  Clone ID: PAT_TA_43713
ctcagtaccgtccggattcccgggggagccatcggccggcatatgttcttaacggataatggggaatgggacgaattttaatggaatgtacaagtgggtgccttggctgttctgcacgatcttatactaaagcactgcaaactgaagcgtctttgctctatgccttggctgtcaagcaagggctttgaataaatta

SEQ ID NO: 43714 - DNA, 367 bp, Triticum aestivum
  Clone ID: PAT_TA_43714
tgggggaggggctcgttcgcggactcttatacactccaagggagaggagagctcggaaagcaccggcagcgccgcagggggccgcgaatccgcgcccgggtctcccggcccggcggcgatggcgctctccgacctctcccgcgactcgctcctccccagcttcctctactcctcgcgctccttcggcggcgccgccccgcgcttcccctcctccccggcgccctaccaggcgcccgcctcgcccggcgcgggcccgggtggtggccttgtcagcgctggcggggtcggggccacatggccttctcgtcccgcgcgcccaacgagaagatcgggattggactcgcgcgggcttttacccgcggcctgc

SEQ ID NO: 43715 - DNA, 144 bp, Triticum aestivum
  unsure (1)..(144): unsure at all n locations
  Clone ID: PAT_TA_43715
tcgtccggccctgaatgagaagctgcacatcatgataattttgaggccttgtccaaattaaatatgagggatttggggtctcccgttaacgtgaatcttgggcancactttactaaacctccatcccgttattctgatggggca

SEQ ID NO: 43716 - DNA, 353 bp, Triticum aestivum
  Clone ID: PAT_TA_43716
cgtccgacatccgccacgcggtgtatcgcatcagatcctacaagttgtcacaaaaggagtctaagaatgagttgtgccatgataaactgaaagattgccctgtggagcttcttgacagggacgaatttcctacagatttcctcgtgaagatgcaatattttaggttcttggaggaagaaggtgtattagactggttcttccaccctgaactctgcaagcttgcttgcctgaatgactaccagcgtctagtgcctcgggatcatggtgcgtgttttgattgggagtatgctgattgggagttgaccgcaattactttcatagctttgagatgcaacatgaatacatcgagtact

SEQ ID NO: 43717 - DNA, 297 bp, Triticum aestivum
  unsure (1)..(297): unsure at all n locations
  Clone ID: PAT_TA_43717
tnggggtcccactctttctattttcatcccccctcccgccgtctccttcgtctctagaccagctctccaggagcaatgggccggatcatggtgcacgtgctgaaggtgaagaacaaggctgatctgcagggccagctcaaggacctcaatgctgagctgtccctccttcgcgtcgtcaagggcacctgcggcgcccccaattagctctccaagatcaaggtggtgcgcacctcaattgccagggtgctcacggtgatctcgcataatcagatggctgtgttgatggaggcgtacaat

SEQ ID NO: 43718 - DNA, 164 bp, Triticum aestivum
  Clone ID: PAT_TA_43718
tcgggggacgcacgggttcgcggactctttggaagcctttctcctttctctttttccgagcctggtccttatcctctggggtgtctcggcccacacagatttagcaatctatgtttagcgcctgcgtccatcttgtagactggttgcgatgggggatcaaagag

SEQ ID NO: 43719 - DNA, 259 bp, Triticum aestivum
  Clone ID: PAT_TA_43719
ttgggacccactcgttcgggcgtgcttcatgttgacgcctttgaagtaagggtcgactagcttccttgaggcgaagggggccttgatgcgggcccagtacgtctccaagctctggttcgcgccggtggttgggtcgaggcagactactttccatgctttggcgaggcatgcctcctgcttggacgttcacttggtgcgcgggtctactgacctgggcgcccacttgttcttgttttggggccccatcttcggaacagga

SEQ ID NO: 43720 - DNA, 427 bp, Triticum aestivum
  Clone ID: PAT_TA_43720
cgtccggccgacggcgctcggtttaggctggtagcggcctgcatcctcgcatgccacagcgcgagcgaggcaacaccctccagcgtgcagccaggcgtccagcgcgtgcgcgccgtactccggctctggcgcggcccggcagagcgtttttggcgacgcactcctcggcgagggcgctgccgcacatcgagtcgcatcgcgatggcatcagcttcctctggccttggccccgtgctagaccgggacaccggaaccacctgtttcacagacgctccgcgacgcggtcgatgcccgtacggagacgcgcggaggcaccctaggcctgggctcctggaccgtccttcgcggtgaagccccctggcgcacgacgcggccaccgcatttgacgcggagcgacttcgtccatgggctcggcttccgagggaat

SEQ ID NO: 43721 - DNA, 347 bp, Triticum aestivum
  Clone ID: PAT_TA_43721
cgtccgcccacgcgtccggcgaggctcgccgacttgggtttgcgctgattctctctgccgtccgggtcgactccgaccaggcgccccgtcgcgattccacatttcgtcctggtcgatcgcgcgaccatgcagtcgttcatcgggcccgactggtgcctgaaccttgagatctgctacatcctgaaccacgaccccttgcaagctaaagatgtacgtaagtctatcaagaagcggattgggcacaagaattcaaagattcaggttctcgcactaacactgctggagacgctgattaaaaattgtggggattttgttacattcattttgctgagagagatatactccat

SEQ ID NO: 43722 - DNA, 173 bp, Triticum aestivum
  Clone ID: PAT_TA_43722
cgtccgcccacgcgtgcgggaagagtggacgactagggtttgcgctgtgtcactagtctataccgggggacgcccaccaggcgccatgcaactatgccacagccccttctggtagatcgcagctatcaatcatacatttatagctgccgggtgtggacagaatctacacacct

SEQ ID NO: 43723 - DNA, 241 bp, Triticum aestivum
  Clone ID: PAT_TA_43723
caaccccgagtttatcataaacaaaaagcatttttgttccatcacattgggataacaagacatataaacgagtgaagtggcatagcatagtagttaacatctcagcataagtggcatagcatagattcgctaacatcttagcataagtggcacatagcgcatagggtgacgaacgttttacagaccacaacaggaattctaaaatcaagaggaaagttcggtgggcatatgggggatcatt

SEQ ID NO: 43724 - DNA, 422 bp, Triticum aestivum
  Clone ID: PAT_TA_43724
cgtccgatccaatccagcccccctccgatctcgccgagaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggttcttaagctccgtggtggtatgcaaatatttggcaagaccctcactggcaaaaccatcaccctcgaggttgagtcctcagacaccattgataatgtgaaggccaagatccaagacaaggagg

SEQ ID NO: 43725 - DNA, 390 bp, Triticum aestivum
  unsure (1)..(390): unsure at all n locations
  Clone ID: PAT_TA_43725
gttccgttctctaattcctggggggacccactcatccncttatctccccgcccgctcgtccctctgttctcctcatccctcctttgctctagctggtgcgcctcctatccctgcacaacgcggccagctcgagctccacctcctccatctcaaggagacgactgcacaagacgtccggcgccgtcaccatcttccttggcacaactgaagcacgtgatgcttgctgcgtcgtcgtcgtccctttctctcgctgccaccaccaccctgaccgatccatccccgtgctctcgctgagccttcccctcctgggtcactgacccatgtggcggataatgagagggtgagctcgatgggctggcaagggaggagggggttgacagggtctgatct

SEQ ID NO: 43726 - DNA, 245 bp, Triticum aestivum
  Clone ID: PAT_TA_43726
gggacggacgcgtcctcctaaatattttcctccctgtcgccctccctccttcctttcctccactcgcgcttcggtctcagatcccttctctgcgctggcccggtgttgggaggagcagcggccactcacgcgccagatcgcgagtcaggagcctcacctttcacaggaccgaacggtataacaccagagctggaactgggtgccctgctgggcagaccccactgaggcagagcttcaggatatga

SEQ ID NO: 43727 - DNA, 326 bp, Triticum aestivum
  Clone ID: PAT_TA_43727
ttcttcctccttcaccgtcaccttcggcaaccaccttatccctagaagaaagagccatctcccggcggggcgaatcttgaggaagagatggtgtgcgctccgtcctcgtctgtggtgaacgtgtacccgctcgccaactacactttcggcaccaaggaggccaagatggataatgacacctccgttgccgaccgcctcgctcgcatgatggtcaactacattaaagaaggaatgcggacaagtgttgaagcaattctattggtgcaagatcacaaccacccccacatactgttgttgcatattggtaacacattttgcaaacttcc

SEQ ID NO: 43728 - DNA, 302 bp, Triticum aestivum
  Clone ID: PAT_TA_43728
cgtccgcggacgcgtgggcaggctagccagccagctgcctgcctgcctgctcctccccacccggtaattttcctcccttcctttcctttgttgttacaagtagaacccttgttggggtggtggtgtgtgtgtattggtgctgcaacataactaggtagggaccgggaagggggaagaaacaaccgaatcaaccattgggagggggagggtggaacctaaaccgatccaaaaccaaataaaacggccgggtcaccttcgccaagcgcaggaacggcctgttcaagaaggcctacgagctctcc

SEQ ID NO: 43729 - DNA, 455 bp, Triticum aestivum
  Clone ID: PAT_TA_43729
tggggggccactcgtacgctccgcatcaagggtagtcttcctctccctgttcggacccaacccctcctctcctcggtccacaagccaaccccccctccctcccctagcgttggggaattggatctagtctagccccctcggcggcgcggcggcggatgccgccgatccctggtgctgatacccagaagtttgggatgggagacatggttacggaattggacgaggcatgagtaagaaatgcacagaactccacggaacagagggaggcatacaatgtagttgacgatgaaggttccccttgtacctctactaatgttgcctagtggaaaggaacctgttggcaaccaatcaatgacagaaggaagactgcaaccagccggtgataattaccaagaacctgttggcaaacaatcaatgacagaaggaacactacaaccagctggtgattatgatca

SEQ ID NO: 43730 - DNA, 340 bp, Triticum aestivum
  Clone ID: PAT_TA_43730
cgtccgcgacaggaagtcctctcacttcaggaagggctactacgcccggcatcgggtcgcccttcggtggctggcaacttggcttgatgtgaagtgggtcaaaatggaagccatcgaggttatggtcgcatgctctgctatggcagcagcaaaagaacaagaacagtcaggtgagaacgcaacacccaaaagcaaatgggcgtaatggaagcgtggaggaatcatcgttgcagttgcattgaccggaggagcattaccggctattactgggggtgtagctgctccagcaattgctgcatgaatttggtgctcttgctcctacgcttggtacaattatacc

SEQ ID NO: 43731 - DNA, 297 bp, Triticum aestivum
  Clone ID: PAT_TA_43731
attccgggggggagccactcgtcctttgactcgttggcactccgctcccctacactccctccttgcctctactccgccagcggggcatgggcaagtcaagcaagaagtccgcggcccctactgtcgtggcgccggcggccgtccttaccaaggggaaggccgtgtagaagctcgaagcctatgactagatcgagaaggctgtaagcgcaaagaaacagaaggcttcgcctgcaaatgcggtgcccgggcccaaagaggccgccaagaaggccaagaatcattcccctcccaagaagg

SEQ ID NO: 43732 - DNA, 459 bp, Triticum aestivum
  Clone ID: PAT_TA_43732
cgtccggattcgatgggtgtagaagacgatgttcatcctatgaagcctccaaagaagggcaggaaaataaagctgacaagcaatggaaatcaaaaggtacatataaaagtgaaattaaagtctcagcctgaaaataagaacatagtcaatgactttgagttgaccaatggaaatgagagcaaacatttaaattctattgctgatcaaaggttcaaaacacctgccatcaatgctcctgaaagtcgttttagagatgtgccagctcctcttgctacaaaaatgtatcattcacggggaaactaccagcttcgattggagcttgctcagctttaccgtgaatcatgcgcggagcagtcacacagctatgcaagtaatacaactccaaactcgtcacagaataatgggttggtaccatgtgataattcaacattacatgggtctgatgattcggtattacat

SEQ ID NO: 43733 - DNA, 250 bp, Triticum aestivum
  Clone ID: PAT_TA_43733
cgtccgctctccctcacccccctcccctgctccgtctcactcactcactcgcctcgccatccatggatgtggatccttgtcccggggcaatcatttcgctcccctgctgattctataaaaacgccggcacgatctaccccgcactcccattcacaaggtgtcacccccagttgcagagcttctcacgatgcggtgccatggcaggagagctgcgctcttcgccgtggccggggtctgggtcatcgtggcg

SEQ ID NO: 43734 - DNA, 301 bp, Triticum aestivum
  Clone ID: PAT_TA_43734
cgtccgttgacgcgtgggcggacgcgtggggtcccccgtccactccgacgtcgccggcgccggcgcgaattccgtccgcgtccaccggcgcgcgtcgccccggcggactccaggacctccggatcggagccccgcgcctcgccatggcggtcgacgagctcaaggtgcaaatgaacgcgctcctctgcaacatgttcgccacggatatggtggacgagcagatgcagaagatgcattcgctggaggaggtgggcacctggtttggcattggcatgcgaggaaccaacctgttaatggaaaa

SEQ ID NO: 43735 - DNA, 364 bp, Triticum aestivum
  Clone ID: PAT_TA_43735
cgtccgcccacgcgtccgtgcagcgctagctacgcactatgctgtggacaacccataccccaaccccaacccagtatatccagattcctgtcttgcagtcgcagctcggtaaggaggaggccagcgccatgtcggcgctgttcaacttcaactccttcctcatagtggtgctgctggtgatctgcacctgcacctacatcaagatgcagttccctgccatcctcaacgatcgcaccgggtatgttttctacgctgacttcccggattgaaaagtcattggggatttcttcctgagcgatctgatctacgcgatttgtctttcctttttcccgcataggcagatagtcgtactgtcaaaattcag

SEQ ID NO: 43736 - DNA, 452 bp, Triticum aestivum
  Clone ID: PAT_TA_43736
tcgttcgctcctagtcctctctttgctctcttcccctgcagtagccatggccttgcttgctccaccgcttgtgaatcgccggcacggaacagctcccagcctgctgcggcgagcacctccatagccaccacaaaaaatacgagctcactgctgggcatggccggcggctgcaactccggcgaccccttcccctctccagcagccatggccggtggaagatctgcccttttttatgctcatcggttgtagctttttggatcaccggtagtagcttcctgctaaaccgggtgcatcttttctaaatcatccctttcaagcttttcttcaaaatctaattcttgcatctggttttcggaaatcgctgggtccagctttttgaaataaccgggtgtagcattttggtcagctaggtgtagctttttgaatcacccggaccaagttttagaatcacc

SEQ ID NO: 43737 - DNA, 417 bp, Triticum aestivum
  Clone ID: PAT_TA_43737
cgtccgcccacgcgtccgggtgaaggagaatcatcaaaggtgtcggagcatgaagcacacatgcaggagactggtctgttggtcgctatggacattacagatgaggagggcattccagctttgcatgagaatgtccaggctaatggtgaagtagaatcatcaacagttgagctgtcatcatgtacctctggtcagcaagaatcagaaactacagcagcaccttgcgaggagagcagtccttcacaaatcaaggtatcaccttctttgccacttggagttgcaaaaatggaagtagacccactggaggtgattgaccatgaagcataaacatcgtaggtggcggagcatgaagcatacatgctggagactggccaattggttgccatggacatagcagaggaaggcattgcagcttta

SEQ ID NO: 43738 - DNA, 463 bp, Triticum aestivum
  Clone ID: PAT_TA_43738
cgtccggcagcagagagaagagagagagagagagagagagagagagagaagagagagagggaccaggaccatgacttccgccgtcgctcgcaggggtgccgcgctgcccagcctcctcaagaagctgctcgccaagccgtccgcgtcgggtgcgcccgtgtccttcgcgctccgtcccgccgccgtcaccgccgctcgccgcccgtacaacaccctgggcaaggagggccgcctctacgacgacgacggctcctcctcctccttcagcggcgagagcggcagcgagtacgaggacaccgactccgacgaccgccgccgcgcccgcgacttcttcgtccccagcttctctcaggacgtgctggaccagttcggcgcgcacacgagcctgggccgtctgctttctgggctggaggacgccgccgctccgaccggcctctgcttcactggcggggcgtcgcggctc

SEQ ID NO: 43739 - DNA, 452 bp, Triticum aestivum
  Clone ID: PAT_TA_43739
ggaggcacgcgtccgcccacgcgtccgcaggatcctccatcgcggggagctccgcagcttcagccgatgcttctggcggactcgggggttcttcccagccatgtcacggatcggagatttgatgccgagggagcggtctgtcaagtcaacaagtcactcaaggaaggctgatgggaattctgcgaatgtgagtggtacaccacatgacattgccaaacattgccacgatgaagagttgggaaacataggaggaaaactttgcaagaatgatggccactccttcaaggagagctgcagtatcacaaattctgaagtcctcaccagagtgaaatggaagataaggtgctcactcaaatgatcaacaaacatgggctgaaaaactggcaaatggtcgcacatgctatacctggccgaagtgcaccgcaatggcgacaaaaggggagataccaaat

SEQ ID NO: 43740 - DNA, 422 bp, Triticum aestivum
  Clone ID: PAT_TA_43740
cgtccgcggacgcgtgggctcatctgtgctgtggtccgctgccccgcccagagcctcactatccccgtgactgacaagcggcctctcgccgtcgccgcctcgcctcgccggccgtccgtcaccgtgggaactgactggtctatatatatagtcggcggtgatcgataccagacacggtgccaagatggggagtctgcacaagaccacctttgttctcctcatgttctgcttggcggcgttggggagcgcggactatctcaagtacaaggacccgaagcagcctcttggcgttcgcatcaaggatctgcttggtcggatgaccctggctgaaaagataggccagatgacccagattgagagggagaatgccacagcagaggccatgtccaagtacttcataggtagcgtactgagtggtggag

SEQ ID NO: 43741 - DNA, 187 bp, Triticum aestivum
  Clone ID: PAT_TA_43741
ttctcttatttccttgtcgacgcacgcgtccgtcctctcgtcttttgacgcttggtcggcgctgtgctaggtcacctgcgccaacgtgtggggggtgtcgtacgccatcgggatggactctcggatcgggcccaagattctgaactccatttgtggggttcggcgtggtcgtgctttcagaaggaca

SEQ ID NO: 43742 - DNA, 450 bp, Triticum aestivum
  Clone ID: PAT_TA_43742
cgtccgatcttttgataagggtactctgcaccttattggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgtagagacaattgagaacgatcttgctcagcttcgtgagcagggtgttgatgcacggattgcatctggtggtggaaggatgtatgttaccatggaccgctacgagaatgactggagtgtggtcaagcgtgggtggtatgcccaggtgcttggagaagcaccacacaaattccaaaatgcacttgatgcttgtaagactttaatagcagagcccaagggcaattgatcattttttgcccccattgtgatagatgatgagagtggcaa

SEQ ID NO: 43743 - DNA, 354 bp, Triticum aestivum
  Clone ID: PAT_TA_43743
tcttccgcgttcgactcgccaagtctgcaggctagcatattatttagattctttctaactaccggacttctaagctcggtgctggtctccttcaagctacaaccccaaggcgagctctggtggtcaagctgatgcttctttgcctcatgttgaagaaaaggatgataaggatgtccatgctcgagtgaccaggaacaattggggatccccagataacttccgaagcggaggtgttaattttcgacatattcccgtttcgcaatggctatcacgcactgcttggacgaactgcatttgcatagttcaatgcggtgccgcactatgcataccttaagctcatgatgctaggccctt

SEQ ID NO: 43744 - DNA, 332 bp, Triticum aestivum
  Clone ID: PAT_TA_43744
ccactcattctctcattcttcttcttcacctcacggttaaatctcctgccgcctcttcttctaaaaacggggctcaacatccgatgacatgatttcataataacactacctcttcaagctcctgctcataggggactacctcgtgggaatatcttgcctgctacttaggttagctgatgattcatatcaggaaagctatattattactattggtgtttacttataaaatccatacctgtgatcatgatggaaagactataaatctgcaaattttggataatgcataacaaaaactatttatgaccatctcatgcagttactacctgaggttc

SEQ ID NO: 43745 - DNA, 368 bp, Triticum aestivum
  Clone ID: PAT_TA_43745
ctgtacgcctgcagtaccgttccttaatttccttggcgaccgcacgcgtccgctggtggcattttttgttgcacaggactcgcttctgcctccaaatgtagatattgcagggcaggcgtgctctactaatcaagcatgttttttcaaatcatacacttcaagaatatgtatctaacaagctcattcgttctctcactgctgccttagaaagagagctgctctatacatcatccatcaatgaatatatttcgaggaccatatacttatcattcatcatcttcagaaaggttcgatttttccaggcatcaacatctgtcataccccatcttgtctgtgcccctaatggattgaacctgatgcttgtccat

SEQ ID NO: 43746 - DNA, 354 bp, Triticum aestivum
  Clone ID: PAT_TA_43746
cgttcgtggacgcttgggaccgccccctctttttccaagatgtcaaagcgagggcgcgaaggttccgcgtggaaacaagttccggatgtctgttgggtctgccggtggctgccactggtaactgtgctgacatcatcttgggccatgaacctgttcattattttcgagaagggaatcaaggggcgccttatcagtgcttccatttgcctgtggtggtgacatggttatggccacttgtcaagaagggtaagcctgtccttaagaagaatgtcatgccatctggcattgttaaggaagcgcaagccgtgtgcgcgaaaggacggtttctttatgtactacaaagaacaattgctg

SEQ ID NO: 43747 - DNA, 438 bp, Triticum aestivum
  unsure (1)..(438): unsure at all n locations
  Clone ID: PAT_TA_43747
gtaccgttcncttattcccgtgtggaccgacgcgtccggcgaaaaagaatcttagccccaccgcaccacacaaccgtgtctagggtttccacctcggcgccggcatgtcgtccggcgacgatgaccgcgtcaccgtctccaggcaccaccagcggtacaaggacaaggaccgtgaccactcctcctctcgccgccaccgcgacatggaccgccccttctcttgccaccaccgtgactacagggacggtgagcgggagctggaccgagatcgcgaccgccaccaaagagacaaggagcggtatcgagaggagcggaaggcgcgggagcggtcggagaaggagcgcgagaaggaggagaagagggagaaggaaagggaaagggaaagggagagggagagggaggagagggagatggataaagagagagagcgggcgcgtc

SEQ ID NO: 43748 - DNA, 108 bp, Triticum aestivum
  Clone ID: PAT_TA_43748
cgtccgcttttgtgtagaataaatatggttgttggagtaagacgaacttgatatgtgatgatggtcaaaagaagatagacctagcacggcatttttgtacatactcca

SEQ ID NO: 43749 - DNA, 367 bp, Triticum aestivum
  Clone ID: PAT_TA_43749
tcgtccatactaatcatgaagtttttgccttggttgtgtctgtgtgccttgtttagttgtactggggtatttctaggaaggtattgaattcttatcgagctttccttatgctttctattactaaagtagaaattttaattcgcatgatttttaatattttgggaggtgagaggtgatgaaaaagggctgttagggcgtactttggtgcatctctggcaaatgatgtctggattcatctgacgctctttcaagcagagcatttcatatttgctgactggttcaacatctaaaccttggcttctctaggttctttttacatatgttagtattcaacatattttgttgtgttacaatatatacttgtatg

SEQ ID NO: 43750 - DNA, 225 bp, Triticum aestivum
  Clone ID: PAT_TA_43750
tttttctttttttttttctttttggggggggttttttttttttttgttacacccacatagggttggttcccttccattaaagattgcaccacttttggtacacattggtgtaaaatccaccaactttacacgaagaagggcccattttgaaccttgctctaaggaggttaggcatgttgctttgtttaacgcgaacgatcttacataccaggaaaaatctagtgg

SEQ ID NO: 43751 - DNA, 140 bp, Triticum aestivum
  Clone ID: PAT_TA_43751
cgttcttttactcgtggtctgacgcgtgggtgaacatgtatcgtgtgcaaggaacacttttagagtgggtgcacaagagatgaagggcggcgcttcatcgcaaagaaatttaatgaatttcttgtctagagggttcacgc

SEQ ID NO: 43752 - DNA, 202 bp, Triticum aestivum
  Clone ID: PAT_TA_43752
ccgtactcgtcccataagaaatgctctttaggagagcgtgctgagactcgggagcatgggggagcacaacgaggagccggtggcggagtccatgatggacaagatctccgacaagttccacggcggggactcgtgttcgtcgtgctctaactcggacaaccagaagaagggctcgctggtgtgcacgaagggcaagatctac

SEQ ID NO: 43753 - DNA, 181 bp, Triticum aestivum
  Clone ID: PAT_TA_43753
actgtatcctgccctaccatgactgacttgacatgaaccgcacgtttgagatgaaaaagggggtggattcttaagggctcctgcgaactatggtgccaaaggctgttgctattttggaaaacacacctctcacttagaacatctagacgcatattgagcaaataagagattatgtagaata

SEQ ID NO: 43754 - DNA, 299 bp, Triticum aestivum
  Clone ID: PAT_TA_43754
gctctactgtacgtgcggttgtttatgcaaatggtggcaccgtcatttgtgaagctttcggaagagttgaagtgggtatcccagtggctattgcattgagtactcaaagggaccgtcttcgaattgtctgtagcaagccaaaactacccttccgctcctaaggcgagagccatgttccttttatgaaacttggcaaagtaacacgcaggctgatagcagaacagaaggttgtgacatttcaatcgggtagatcttgtcataaaccggcttgatcaaggggtttatacatagggaaaaac

SEQ ID NO: 43755 - DNA, 335 bp, Triticum aestivum
  Clone ID: PAT_TA_43755
cgttctttcgcggtgaaagaccctgtggtgcatgcaacgactctgaaatgttgctgaagcgaaggccgaatggtggttttatggttggctgtcggggctttcctcagtgtagaaatgtagtatggctgcccgggtcccttgcagaaactgctgtgacgcaacaaatttgtcctacctgcgttccaggtcctgtttataagatccaatttaagttcaaccgaggggatatcccaccaagtttcgatggtgaccacctgggttgcattggtggatgtgatgatgtacctaaagagcttacagagatgattagattttatcatcataaccaggctacg

SEQ ID NO: 43756 - DNA, 202 bp, Triticum aestivum
  Clone ID: PAT_TA_43756
gttcgagagcgagggcgatcgagggttcgagacggaggcggcagcggcggcgagtacggggattttcgaggagatgaacggcggcggcggcggcggcggaggaggggaggtggtcttcgtggggcgaggcctggagctcaaggtctatttcaatttacatctcgctgcttatttacatggtgaccttttgcttgtttaagat

SEQ ID NO: 43757 - DNA, 393 bp, Triticum aestivum
  Clone ID: PAT_TA_43757
tgctaactttcgcgaccgcggacgcgtgggattcttctggatttcactcgctcgctttccccgggctaggcggactccttcgggtgtcgtctactttccccaccctaccccgacgcccgccggcgacgccgtcgccatgaaccccacctttttggccgccggtgatgcacccccccgccggtgaatggtttatccccgagttcttttcccccggcccctttacacgcgaagctttctgatcgatggtgtgctggcttcggggaccacagcgccgttttgcgactttcaaatcctgctcacccgagccggacagaagatcgacattatgtcgattcctttgccagcccacggtcggacagttatacaccctgtgcgatcgacctttttgtgttg

SEQ ID NO: 43758 - DNA, 204 bp, Triticum aestivum
  Clone ID: PAT_TA_43758
tcatataacactgagcaagacgtggatctcctgaatcttgtagtgggagcactggacccggcaaaacgtcatcgagttgatggatccatccctgagcaaccatccttcccacgaccaggtgcttaagggcatatcagttaggcgaccttgtgctgccgggggaacccttaggtttgtcctacgacgatataacgtttccttttt

SEQ ID NO: 43759 - DNA, 263 bp, Triticum aestivum
  Clone ID: PAT_TA_43759
cctgatgcctctcttgaagatcttgaaaaactctggggtcgatgatgaacctctagccggtggttttgaagtatgaagatagcttaccagcatcaaattgtctttagctcccgcttgataaaagctttgaggtctgatgtactgaccaagatgtatgtaaagagtcaacagatccatgggacaagtgcaacttgtttaggcggggacatatggacttgaacatagaagctgggatggcctatttttgttcttttcaaaaagaa

SEQ ID NO: 43760 - DNA, 161 bp, Triticum aestivum
  Clone ID: PAT_TA_43760
tgggcggacacgtgggcacttgtatagtcttggacctattaccagaaaaggggatgccagctatgtcagtttctaaaaagcaaccagtaatgggtgatttcaaaaatattttttggatgaaaacattttttgtcttataattaccatgcaaattgagaata

SEQ ID NO: 43761 - DNA, 255 bp, Triticum aestivum
  Clone ID: PAT_TA_43761
cgggggcggaaccctgaaccagcgcagtctgacagcggggacacacctaactcgtgtgagggagtgacagcagctctatctatcactcaaggtgctttggacgtggtcgccttcattgagggtgtctgtgtgcaaaccgaaactgtgctgcgccaagatcttggtgaggagggttatggccgtgccctcacccgcgaacaagatggacagatgcttccttgagcttcaagtggaaggtgaggaagcataccaaac

SEQ ID NO: 43762 - DNA, 269 bp, Triticum aestivum
  Clone ID: PAT_TA_43762
agaagaaggccgaggccagcgccgagagcgctcaggtggacggggagctccacacggccgtcgggcgatgcgcaccagcacgaggtggatgctgagccgtagtcgtgacggccggtccgccggtccaaccacctggcctactaggtggccgcgtcgggcgtgtcactacgtccaagcgcggcctcctggtggctgctctcgctccgggggcatcaacacccaccggccgggggagaagaccggttgtacaacttgggcatggtggccta

SEQ ID NO: 43763 - DNA, 401 bp, Triticum aestivum
  Clone ID: PAT_TA_43763
gccaccacattctctcatacatgggagggaggtgccctcccaaacatcatggcggccagagtgactccagtattatgccattacaaacaagatgtttatgcttctgctgtagcgctctccaatgtacatgcacctgaaaaacctgggctctagactataggtacagaaagaaagaaagaaaacagcatagagcagaggaaggacaagtcaaggaagcaaaaagcacaccactacaataccactaccacaacgacatcagcatcaatctagaatctacactgccgatcacccgaaacaagcccgaggcaccggcatgtcttgggatggagctatactgattgcgaggatcagcggtgcagctccaatttgagcccgccacaagatgaagaattcagtaagca

SEQ ID NO: 43764 - DNA, 380 bp, Triticum aestivum
  Clone ID: PAT_TA_43764
tacgcacttcttcccggtgcctcgtttactcatatcacaaacgtgggtccggttcaagcactgtaggcatggcctcaatgggcaaggcgatcggctcgaacgctgccaagaaggccatgttcaggagctccaaggctgggctccagttccccgtcagcaggatcgcgcggttccttaaggccggcaagatcgcctagagggtcggtgccggcgccatcgtctaccatgtcgtcagactccagtatcttctcactgatgttctggagttggccgttaacgcgttgagggacaacaagaagacccgttttgtgccgagcaacattcagctcgccgttcgtaacgactaggaggtctgccgcctgctcgtacatggtcacaat

SEQ ID NO: 43765 - DNA, 399 bp, Triticum aestivum
  Clone ID: PAT_TA_43765
ctgacgcacgcgctcaaccgacatggttggtattacatggtgcccaatacatgcaattacatggctggagttttactacgacattactgcaaaaaccatggcagttcccataatctaggtccttacaatgacattacctttcgactgttcgtgctctagccagaagttaaggacagatagccctccctaacatgtgcacaaactggatggccgaatttacgctcctctgtatatgggctttattccgcggagttagtttgtttgctctcaatgcaacctgatcactttcttgtatgctaactccgaacctttatggtatttcctttgcttatttgtcaaatgggcctgcttttcgccccaactttcaaattgcagactgccattagggtttatatttag

SEQ ID NO: 43766 - DNA, 508 bp, Triticum aestivum
  unsure (1)..(508): unsure at all n locations
  Clone ID: PAT_TA_43766
ttaattactttatttcctttttttttaatttttatgtatattattatgnttattattttttataatgattcatttaaattaatattatttannnnnaagacgccttcgtgattaggcacaaccctgtcaacggttccttaaggatcaagcttccgtctggtgccaagaagattgtttccaagcatcatgccgtgccatgattggtcaggttgctggtggtggcaggactgataagccaatgactcaaggcttggtatacgtcctactcacaatgtactcgcgctgtaagagtgaactttctgtcctaatgtgcgtggtgtggccatgaaccctgctgagcattcccactgatgatgtaaccaccagcatattggtcacgcttccactgtccgtcgtgttgcaccacctggccagaaggttggtcttaattgtttcaggaggactggttcgtctcagaggccaggctgtcgtctttgttgtcaaggcctacaaggccacttagagctat

SEQ ID NO: 43767 - DNA, 404 bp, Triticum aestivum
  Clone ID: PAT_TA_43767
ccacgcgtccgaggacgcgtgggttcttcacttgcttctcgccttcttctgcgcgctgcgcttctgatcggagtgtgagccgcggcatccatggcgaagacctaccccgtcgtcagcgcctagtaccaggaggccgatgagaaggccaggctaaagctccgcgccctcatcggcgagaagaactgctccccgctcatgctccgactcgcgtggctactccgctgggaccttctacttgtcatccaacacaggacgcccattcgggacgattaagaaacctgttgagcaggctcacgccgtcaacgcgggcctggacataatcgtgcggatgctcgagcccatcaaggaggagatgcccaccatttcctatgctgatctgtaacagcttactggaggtgtagctg

SEQ ID NO: 43768 - DNA, 266 bp, Triticum aestivum
  unsure (1)..(266): unsure at all n locations
  Clone ID: PAT_TA_43768
ttataaaaatctttgttatatattaaattatatatattataattttnaagctttatctcatttctctttgtctgtaggagtccgtggccctcctccatagggtagcgctcacctgcaagcgggacagcgcctgcaaccgatggaccattttcacgacggtcagcacgtgcggctgcggaaccgtcggagcggacggtacgtacgcgccttcatctacggggtgagagttactcttagtcagagtcatgcgttgcttaacgttttgt

SEQ ID NO: 43769 - DNA, 182 bp, Triticum aestivum
  Clone ID: PAT_TA_43769
tatgtgggatcggcgaaatctgggtcctggaggagcggggccgtcaatttacaaatgtgggggccacaaaactgccgcccctagtgttcagcgggctcccgacaaagcatacgttttcggaagctctgcggaaaatgggttcttaaatgtgtgggaccaagaaaaggggggaaagaagaaaa

SEQ ID NO: 43770 - DNA, 164 bp, Triticum aestivum
  Clone ID: PAT_TA_43770
ggcgtccggtgcgcccctggaagtgcgacgactagctgatggcggagcaccctgaatagaagaatcagacacttgccgatctccgagaggatctgttgccaattgctgctgatcaaccatttccgtattctgacacctttacatattgtggtcagagcattctt

SEQ ID NO: 43771 - DNA, 300 bp, Triticum aestivum
  unsure (1)..(300): unsure at all n locations
  Clone ID: PAT_TA_43771
ttattttttttattttatttatattatttnntaagtagctctctggttctagaagaaacctgcacactgaacgacctgccttacggcatgtacattggaggtacctggcgcggcggatttcctgtcgagcgcgtggcagtgcaagtgctcgtacaaggcgtatttggacgcgctgttcaagcagtacggtgttcgcacggaggcggcgctggtgacggagcacatatggtagttccccaagtacaacagcaggaatcattgggacataaaggagaggctgcagaacgcctactctgctct

SEQ ID NO: 43772 - DNA, 336 bp, Triticum aestivum
  Clone ID: PAT_TA_43772
ggggggtgcaaagagctttcctcgggagcttcctggtaatcgtgttgtccaccggaggcgggatatctccgggtcgggcaggaccggtccgacggacaaggcaggtcaagatgacgtgaataagccggactgcgtgccgtatatcgacccgtacaatatccccggccacgggggcaccaccgggccgatgccgtggaacggaggctactccggtacgccctcctaccatggagggttcggcacgacgccgtggcacgggggcttcggttcgacttcgtcgagcagaggatctggatcgttgcctgagcccgtgcacggctggatcgggacgccggc

SEQ ID NO: 43773 - DNA, 396 bp, Triticum aestivum
  Clone ID: PAT_TA_43773
ccacctgcgttgtgcctctgagcatcttcagatgactgaagaaatatctgatgacaacctgattgcacagacagaaatgttccttaaccaggtggtgcttcgtaactggaaagattccttgaaggccctcgaaacctgcgatgaccttctccctcatgctgaagatcttcaaattgttaagagatgcatcgagtcattagcatcgaaagcaaccactgatccgaacctgtttggctggccgataagggaacacggcatcatgcaaagccctggaggcagtgtactgtggaatgggatcagcaccggtgccaggcccagaaactttagttcagactggtggtatgacgatgtttcatcattgagttttcccaagtacaagagattgctatctggcat

SEQ ID NO: 43774 - DNA, 403 bp, Triticum aestivum
  Clone ID: PAT_TA_43774
ttttgggtcggccgcgttggcccgaaacagtaccgtctatacagggtggttgtccgatatggataccgcgatgtgccgaaggacgacatagagtttgagaaggacctggtgtgcagcattgcagagttcatccgctgcggcgactccgacgaccaaaacggctctctggacggtgccacggaccatgcctgtgagaggctgtcctccatcagtaaaggcctgccatttcaggaggacgatgacagtgaggtcaacgggtcagactcatcgatactgtccacgggcaaggagacgtaccagaacgcggtaggaccgaaggcgaagagggtgaggttcgtgctcccgaaggacgcgcagatcgacggcgaggtccgcagcgagctgcaggagctgacagatgcta

SEQ ID NO: 43775 - DNA, 202 bp, Triticum aestivum
  Clone ID: PAT_TA_43775
gccttccttcctctccaatctccattttttaaggggttggttttttctcaggggaaagggcctggaggcaaaaatggctacccctccgagcccaccgtcaccaccacctgccactaattcctctgcgccccctttcaaaaccaacaccccaagctcaaacctccactgttcgcccgccgccagggcgcccttcttaccggcg

SEQ ID NO: 43776 - DNA, 398 bp, Triticum aestivum
  Clone ID: PAT_TA_43776
cgcggacgcgtgggcggctgcgccgctgcggtaggtcgtgagcggcagcgaggaattcttcaggcacatcttggagctatgagccgccgccttgtccccgtcgacagacgcatcttggagcagaacatcaaggctcggtaccacgccggagacattggcacccaggatgcactccacctgtttgacgaattgctccagtgtgctgggtcctcctcgatccgtgccatcaactatctcgttactactgtcggccgtgattgccctgcgctcggcgtctccctcttcaaccgcgtcgcaagtgccaatgtggcaccaaacagtatcacgtacaccatccttgtcgactgctgctgccgtgctggccggttggacctcggtttcgctgccatgggccacat

SEQ ID NO: 43777 - DNA, 407 bp, Triticum aestivum
  Clone ID: PAT_TA_43777
cgtccgaagggatcgacgtgcttctccgggcccgagtggccaggatcttgttcagttacaaagggaccaagcccgtggcgcgcggcgtggtgtaccgcgactcgctgggcatcgttcacgtggcgtacctcaaccagggcgacgccaacgagatcatcctgtcggcgggggcgctgggcagcccgcagctgctgatgctcagcggcgtcgggccctccgaccacctccggtcgttcggcctcgacgtcgtcgtcgacaaccccggggtcgggcagggcatgtccgacaaccccatgaacgccatctacgtgccgtcgccgtcgcccgtcgaggtgtcgctcatccaggtcgttcgcatcaccaggttcggcagctacatcgagggcgccagcgggtccgactggacc

SEQ ID NO: 43778 - DNA, 366 bp, Triticum aestivum
  Clone ID: PAT_TA_43778
cgtccgggagtccttgcgatttcttcttcctccatggccaatccgagctctccctcttctccatcttcaacatttccactccagtggttgtgatttcggttggtgtgtagtggtttgtccttgtcttctccctttccctgttcaattttggtgttcctgtcccttccagatctcgtagtttggctcgatcccctgacgtttgatgtggatgaaggtgcacgtattttgattcccctggtccttttgtggtggatgtagtggtatgtgtttggatcccccaggcgttttgattctgctagcacatttgacgtagatgtatgtgcagatggttgatcgccctggcctttttttgttgtagatgtaata

SEQ ID NO: 43779 - DNA, 153 bp, Triticum aestivum
  Clone ID: PAT_TA_43779
cgtccgcacacgccgacgccaaactcgccaaccaatcgaaggctcggaaggagcgacgatggtccgccgctgcggctgctccgacgccatgctcctagccctcttccttgccgaactcctcgccggctcggtcgaacggggggccggacagtt

SEQ ID NO: 43780 - DNA, 237 bp, Triticum aestivum
  Clone ID: PAT_TA_43780
cgttcgtttagaccaatgcagttgctagtattagggttgcagtcactgataaagcggaagcggagaagatactccagattaagagggctggaggtgaggcagaattaaactactttactgttgtgggtattgcaaggcagagccaggccatattggacggactgcgagacagtgttctcaccttctctgagacatgacttgggacctctgcgaaggatgtgatgacatatggttttg

SEQ ID NO: 43781 - DNA, 165 bp, Triticum aestivum
  Clone ID: PAT_TA_43781
cgtccggccacgtgtccctacacacgtacgcgcgagcggagcgaacgtgatagtctctctcaagacgctcatggactcctacttggagaccgtcgaggactccgaattcaaggtctatgttttcatcaagctcattgagactgatctaaagaagcttatacgaca

SEQ ID NO: 43782 - DNA, 292 bp, Triticum aestivum
  Clone ID: PAT_TA_43782
cgtccgctgcctcgtgcgtgcctgcgtgtcctccgcccgtgccaccaccaccatccgttgaacggttgttgggccgcgccttcggtgccgaggagagagagagagagagggggggagaacgaggggcggcgaggaggagtaggaggagggggaggagcaacggcctccgcgcgccaccggcgagagcgagcgaggggggaggaggggcggttggttggttggttgatcgctcggccgacaatatgatggcgttcagggtgcagaggcccgcccatgccgaggagatttgcta

SEQ ID NO: 43783 - DNA, 122 bp, Triticum aestivum
  Clone ID: PAT_TA_43783
cgtccgttcgtcttgtatctatcttgccctgtaacggaagaactgaatcggaactaaaacttggattaaccaatcttcgtccgtcggcacacggaaggaaggagtgtctaggttttggttgt

SEQ ID NO: 43784 - DNA, 426 bp, Triticum aestivum
  Clone ID: PAT_TA_43784
cgtccgcccacgcgtccggaaacatggtgccaagtaattgattcacccagttgtgttttcttaaatctagcataaggagcatgttagatttccaacagacataacatccgaaaaaataatcatcatttacttgatttctcacacaattaacagaatccacaaaaacagcttaaccaaacaattagagcatgaggaagagatgattcagacagagctgcagttgatgtgcccctgtgtgtgaattgctgttgtgctatgtgagaggtaagagcttaagatgcccacgacgctggcatcggcgcactgattgtagaggccgctgccatggtcattgcccggcggttcgtccttgaataccaagcggcttgatgacaacaccggcaacgtttcctgtgagcaaccatcaacctcatattcagatggtgt

SEQ ID NO: 43785 - DNA, 316 bp, Triticum aestivum
  Clone ID: PAT_TA_43785
cgtccgcccacgcgtccgcacatatccgcgctacactttgatcgggcagagtcaagcataagtagtatatcgctatgggatggtcttaacaaattcaccccacatttttactttgatacaagtggctaagcttgtactgtatttactgcattggctgcttgtttgcaagggcctctgctacactcattatcctacgatcagtatacaatttggtctaacgtgtgaagcagttcttctcaatgtacatcatcaactttcttatttctggaagcatctgtttgtcctcttatgcattgttctgttctactcccttatt

SEQ ID NO: 43786 - DNA, 216 bp, Triticum aestivum
  Clone ID: PAT_TA_43786
cgtccggcaacgcttgctcatatgagaaattgaaaaagactcaagcacaactaggtcctgagggagcttgacgcctaccctgattccgcgtaggacaagaactcttctgaatgcgagccggaagagttagagggcgatgacactttccaggaatcgatccacatttggagttcttacagttcatggaacgtgtaatatgagcatggcctgtgctac

SEQ ID NO: 43787 - DNA, 421 bp, Triticum aestivum
  Clone ID: PAT_TA_43787
cgtccgccttcctcctcccccagcaccccccgcccactccagagccccgaacatcgggggcaccaagggacggccggcggcgggagggatgaagtacccgcccatcccgccgcgccgggccgcctcctgcggctgcggctacctggccgccttcgtcgccctcatcgtcatcacctcgctccagatccagcaccaccacctcaaggtggatctcggcaggtccgactacgccgcggccacggccacgcagcagcggcgccgggaggaggggaactggaaccggaggaccggcgccgagggcctgccgcgcgggatcgtccacaccagctccgacatgttcctccgcccgctctgggaccccgccgtcaaccgcgccattcccaacaacaagaatgatagacacaaagctctcctggcgatg

SEQ ID NO: 43788 - DNA, 405 bp, Triticum aestivum
  Clone ID: PAT_TA_43788
cgtccgatcaaagtttcgtatgaagccacgaaggcaggatttcctggtggtaaagttatagcacatcttgatcagaagagcttcaagggctggcaaaagaacgccatcacgagctatttgcaggagcaaaatatcaggataggaaaacccaacgatttcctctgcacaaaaacttggccgtgcccacaaggcaagccgtcgaagtgacttcaccctccctagggcttggcacatgcaaattgagtaaatatagagcactgtattttgataatccgatttgaagatgtagagtggtccctccccgttcgtcttagaaggcctgacttgtgcctatacgagagaggcatatcttaaggacacgtttgtcgagttttttgaaaaaaaaagaggacacggttgtctgcc

SEQ ID NO: 43789 - DNA, 324 bp, Triticum aestivum
  Clone ID: PAT_TA_43789
ccgtccgggaaggagagtgcagttgaggggggcataccttatcttacatgtcagcccagtggaggtggaagcattcgagtttcttcgcatccggcgactgcggccgccagattcgtgaccacccacacagcgatgtgctggagggagagacggtagggaggtgatgccactgcatagagactgcgtttgcgcggaccactggctctcttaagacgaaaactggctgtattcctatataacaattttggtgttattttcttactgattctttccctgatagccaagccatcattataatgaatatgtctccatgttcttaatgca

SEQ ID NO: 43790 - DNA, 353 bp, Triticum aestivum
  Clone ID: PAT_TA_43790
cgtccgaaacaattcacgctgcctgggatgagtccaatggttacgaacgtggggtcgttggtggtgcatagacattgagaagccaagcaggtcttagatcccgcggacccatggtacagctccaggcgtgacatatatttagatgttggtgcagcaggcgtgcggcactatgaaacggccctctaccagttaaatgactatctactagatgggtgccgtaaggttgttgatgctcatggaggtctcgcacgacaggaaggagaggacatgccaaccgccttatggatattgttgcatttgacaggacgcgagcaggacaccgcgctattcgcaatgggatcagatcctgtaat

SEQ ID NO: 43791 - DNA, 404 bp, Triticum aestivum
  Clone ID: PAT_TA_43791
cgtccgatttcctccgaaccagacaacctcaaaagcgcaaggcctccgccgcctccgctcccccctgcaccccacccccacccaccccccattgcccctcccgtgaccggcgccgccgcacgcatcctccacccacccacccccctcacgccgaacgcgccgtacgcgcgaacgcccgccggaccggacgagccggcgcgccgtcgtgaacagggtaaggcgatgttctccggcgactggacgccgccgtgcggcagctgctgcaccaagaagtacgcgactctcgtccaaatcccatggagggtgttctgcaagaaggggtgcaacgcggacggcgacacctgggaggagtgcataggttaaatgcactgaaatatgctacaaggatccggcggtggaagatc

SEQ ID NO: 43792 - DNA, 425 bp, Triticum aestivum
  Clone ID: PAT_TA_43792
cgtccgccaggttgaagcggcgatggcggctgtagcgtgactgacggcatcagcaacaagcagttactcatctttgcatcagcaacagatggattatggaattgtttcaatctggataattcgcttggaaaaaattgtcacgtacactaccagacgggcgagagtgaatctcagtacgcttatgacaacggaatgcccaaatcaaagtcctggtagcctacatatgaagaatgcttaaatatgatagatgtaccgcaggtgaacgcctcgcgttgagactctgtgccttctaaactaagaacaaatgaacttgcctttaggcttttcgcactgcactatgcatccaggtccaacccaatggttaggacggcggttcttgcatagcatacatggagatggtacatgtggggaagaaatataagaaa

SEQ ID NO: 43793 - DNA, 415 bp, Triticum aestivum
  Clone ID: PAT_TA_43793
cgtccgcccacgcgtccgggcagctcttcttcctttcagtagttgtctgtctttgagcagagccacctccaatccagccagagcgcctgcctgcctgcagagcgatgatggcgctgagcgagaggcagccgcagtcggagaagaaggccccccgggcgaggcccatgtcgggaaaggccgtcttcgtgctctgcgccaccagcttcttcgtggggctgctgctcagcggccggatgacggtgctgacgccgccggcgtcgggcagccacggcggctccaggatcgccctcttctccgacgacgactgcgagcacaggcgtaagctggaagaagagagcaacccgaacgatgtcatgaacgaggtgacacgaacccaccaagcccattcggtctcttgacaaagtcgtgtcgtcgc

SEQ ID NO: 43794 - DNA, 320 bp, Triticum aestivum
  Clone ID: PAT_TA_43794
cgtccggcaacttcctccaaaaaaggagctgattttacgagttgagctgacttgcatacagacagagtactacaaggctatgattaccgagcactacgccgagttatctaagcgtggtgcaggacatgttcccattatgacagtaaaactggacctgcgcggaccatgttgccatggattcatgacggctgtacctgatactgagcctgctagcccagatgatggtttaacgaggctcttagattattctggcaagatgcaactatcacacaagatgctggagcagcttgtagagcaacgacatatagtacttatctatt

SEQ ID NO: 43795 - DNA, 418 bp, Triticum aestivum
  unsure (1)..(418): unsure at all n locations
  Clone ID: PAT_TA_43795
cgtccgctttttttgatgctgttccccaccaaatggagcaagcccatggcacgctgcctgctcctccgccgccacctcacggccgccaccgccaccgccgcagccacggcgccgctccccgcgaggagcgcccaccgggtgctcgacaggagcgcgcaaaccgaccgtatccaggagctcgcgcggctcggccgcctgcgggaggcccgggaggtgttcgacgccatgccacaccgcagcatcttcgcctggaacaccatgatctccgcctactgccacagtgggatgctcgaggacgcgaggtccctcgtcgacgccatctccggagggaacgtgcgcacgagcaccatcctgctgtcggngtacgcccgcctcggccgcgtgctcgacgcccgcagggtgttcgacggaatgctcg

SEQ ID NO: 43796 - DNA, 224 bp, Triticum aestivum
  Clone ID: PAT_TA_43796
cgtccgctcagcttacgttgacgcttagactgacttttatgataatgattaacttaaatgagggggaatttttacctcaaggttgcaacctataacaatatatatacaatgccttttagtattctgagcattcattatatgtatcacagaagcccaggatcctttcgttaaaagaagatatcgcgttttgaacaaccatttacttcctgggtcttcttttaatc

SEQ ID NO: 43797 - DNA, 425 bp, Triticum aestivum
  Clone ID: PAT_TA_43797
cgtccgcccacgcgtccgcccacgcgtccgcccacgcgtccgtggaagtgctatgtttacatggcatggcaattctagcacttacgagcaacagcagtgggcagcgaaagttgctgaattcttgaagcctggtgtgacagtgaaacattgcaaggagggaacagagagttctgctttctggtttgctcttgatggaaaacagagctatacaagcaaacccatcatgcaggatactattgtcagagatcctcatttgtatgccttctcaattaggaaagggagactggaggttaccgagatattcaatttttgccaagatgatttgttgactgaagacttgatgattcttgacacacacggagaggtctttatttggattggtcagtgcgtggaaccaaaagagaaacaaaaggcgttcgaagttg

SEQ ID NO: 43798 - DNA, 355 bp, Triticum aestivum
  Clone ID: PAT_TA_43798
cgtccgacgcgagggagcggaggtggtggtgggtggcaggcagatcccggagctccgcgcgcagggagcacacgctttacgtctcgtcttctccccttttcgagatctcgccagtggggattttgaagctctgcttcttgatactcatctgatctggtggctatttgtacaaggtcacatgacgtctgtgctggaccatctacattacagcgctgatgctcgtctaacggaggtcctagctgacgccgccgtggtggagcagtcacagcgggtgcaggatcgccctcttgtcctgcgacatctgggagcacaggcgtaagctgtcagacaagagcaacccctacgatgtgattaa

SEQ ID NO: 43799 - DNA, 226 bp, Triticum aestivum
  Clone ID: PAT_TA_43799
cgattaccgtccgttggtgggctctgcgccgctcttgcgcggaccggactccgcgcccgccgtgacttctcccagggagcaaccgactgacagccaaggactgccccgccgcctcgcgccgcgtcgcgtccacgctacgctgatccgtcggcagagtgaagtaggccgtttctggcggcggtgaagggggttccttggagcaacagctagcccctcaccctaaatc

SEQ ID NO: 43800 - DNA, 385 bp, Triticum aestivum
  Clone ID: PAT_TA_43800
cgtccgtttgatattcaggaaccacactactggccctatattgcttgtctgctctcccgtttcgggtggggatttcatcccgagtcctgcgcgagacggctgcaatccgaccccgggacattcaatactagcggcgccaatctgagcagcaccatcgtcaacctcgagaggcgattcgtccgatctcgcgcgcggaggcggaggtagcgatgaagaagatcttcggcgccaagaagagccaggacccgccgccgtccattcaggacgccaccgaccggatatacaagctgggggacacctttgacgagttgattaaggagctggacgcggagctgtctcgctacatggagcagtacaagaataccaggccgtaacctgctctgga

SEQ ID NO: 43801 - DNA, 314 bp, Triticum aestivum
  Clone ID: PAT_TA_43801
cgtccgagcagaacctactttgcgaagagcgcatgcagatcataaggaggatcacatgccaccaatggaagccattcttgctccacttggatcagatctaatgctatctaggcaagatgattacatcagcttcaggaggtataatagagtcttgcatcgactaacaaaacaaaaagaggcagcactattggaagcagaaaggactgttctaaacgcaatgtcaaaagctgctatgggttgattgctgtgaattctagaaccaagattcgatgaatcaaattgagatctgtattgaaaaaaataatatattggat

SEQ ID NO: 43802 - DNA, 422 bp, Triticum aestivum
  Clone ID: PAT_TA_43802
cgtccgagaagcaacagcgtacatcacgaagataggcacagataaatggatgcattccaatccttctaatccaaatatagaaaagcatcctattagattggtcaccacagggtgagtgttatctaacttacggatttagagtgtgatgctaattaaattacacgcacaaccaaattatttatttttactttcataatagtaagatatgacttctgaagactttgtcgtatgttcttgcgtgattttttttttcataaatgggtcttcaattttatcttcaaacctttacatgccatcaatagttttggagatatccatgcgtttggtgccaaattatcatttggtgtggcgatcatgaccaatggtaatgttttaataggctggaaacctccatcattcgtctagctacaaatttcaaacta

SEQ ID NO: 43803 - DNA, 417 bp, Triticum aestivum
  Clone ID: PAT_TA_43803
cgtccgcggacgcgtgggtggcgcagcagatagagcacacccacctcctcctccgtgggctcaacctccaccttgctcaagtaggcaagatgagcttgggacggtggtgttcttgcacggcttcccggagatatggtacacgtggcgccaccagatgctggccgtggccgccgccgggtaccgcgccatcgcgcccgacagccgcggctacgggctctccgaccagccggcgggggacgtggaggccacctgggaggacctcgtcgccgacgtgctcgccatcctcgacgccctcttcatccacaaggtgttcctggtgggcaaggactacggcgccatgccggcgtacgacttcgcgctgcggcacccggaccgcacccgcggcgtcatgtgcatgggcattcccttcagcccggg

SEQ ID NO: 43804 - DNA, 389 bp, Triticum aestivum
  Clone ID: PAT_TA_43804
cgtccgcggacgcgtgggcacggacaaaaacccagcgagccgcgagccgcgcgcctccggacccttctcgccggtatggtctgcaccacctcgtcgacggcttgttaccggtgaccaccgccgtcaggctgtgagggaaatcgaattactcggtattccttttgaaactgtcttgtgcaaatgagaggctccaacttgtgagagttgatttattggatgtagggagctttgactttgcttgttatggcttgtgagggcgtatttcacatcgctatagctgttctctgaaaaacctactccaatttgatggatgcaactctcgttactgtcaataaaggtaccttaaactatctatagtagttcttttatagttcgtttctcaaaatggt

SEQ ID NO: 43805 - DNA, 410 bp, Triticum aestivum
  Clone ID: PAT_TA_43805
cgtccggaacgactgacctatggccaccaatcctaccatgggcatgttcattgtcaaatcctttgtcgcaatcgacgagcaattcaccataccaccaacctttcttgcgaaacttgtcggcctggtgttagcatcgaggtgttcttcttggctatgcacccgccgcgcccctccaagctgttcgtccgctcagtccccgatctgggtgacagtgcctttgacgagaaacccatcgtcatggccatggtggacgacttcttcctcatcagggtcgtcatggcgttcccacgacgcctagtcacctgggagcagaaatacgatgactacatctacaaccccaaccgcgggatccttactagaatcccgcaccctgacggtcgcatcttctaccccggccaggtcggtctcct

SEQ ID NO: 43806 - DNA, 417 bp, Triticum aestivum
  Clone ID: PAT_TA_43806
cgtccgcggacgcgtgggcggacgcgtgggcggacgcgtgggccgaaatgtgactattgtattttttttgaaagatccagcaaaatctggcttgattcgatttagcaggaagcaacggaagaacaacaatatgaagatccgaagatcaaagaaaaagaaaaacaacatccctattagctgccgagctacccaccacagtcaacaccactacaaagcaaaaagggcctgtcctaggctaagcgtgaccgtcgcgttacttgaccaacgccggtatcctccggagacaacagcagctccaactaagactttctttgtcaacgcaccatccacccttgaagcatagtgcaggcagaaggcggaactcggttggtcccagaaaaagcttcgttttggacttatcagcaatggcgtacattg

SEQ ID NO: 43807 - DNA, 415 bp, Triticum aestivum
  Clone ID: PAT_TA_43807
cgtccgggaagggcaaggatccggtgcccccgctgccgccctgggtcattcctcctcctcctccgagccccgcgggcagcagcagccctcctcctcctcccccgactacgccgcggcattcagagccggggccttcggagacggggtcacggagtcgagcgccgccgccgaactcagagcccgcggcggcagggcgcgggctacgtggagcgaccccttggtggcggacacgagggaggagcccaacgcggcggcgcatccgtcgttcgaccacgggatgatcgatcggctggtgcgagagcaagcggccgtcgacggggcgatcgggctacgggaagagcccgacggaggcgggccgtcggtcgaccccaagctggtttggcagtcgttgctcgagcggctggcgagagtgcag

SEQ ID NO: 43808 - DNA, 123 bp, Triticum aestivum
  Clone ID: PAT_TA_43808
cgtccgcggaactcgtgggcgtacgcgtgggtgctcaccatgtttccgctctacgtgaccttgatattccttctaggagctaacgggctgacgctgagacttccttcagctttgtcaacgagt

SEQ ID NO: 43809 - DNA, 322 bp, Triticum aestivum
  Clone ID: PAT_TA_43809
cgtccgcggacgcgtgggtagaatgttgcttatattcctgctggttgtgggttgccctgtgattcaacgaatgctgaaacttgaagaataaaaatatgattttgtacttgttattgtcacgaaccaaatgttgttttaacgggaggtttttggtcatgtaaagctacattttgaaagttccagtgttaacttaatgataccggttcatttgattgaccttaattaaaaggtttatggttaaaatgcaaagaacaccttactgtggtggtggattattattctttcaatatttactggggtggcaatttggttattatttttt

SEQ ID NO: 43810 - DNA, 308 bp, Triticum aestivum
  Clone ID: PAT_TA_43810
tcttccgtgaaacttattagtctacaaatgttccgcgtcgctccgcgaatgcgcgttggtaacctcatctacgcaggccgttcgggcactccgttttcaagcaggaatcacggaccagcccgttccccccgtccatagaaactatccctacacgcattgtctcatctgaccacctcgccgcaaacctagatccgtatttacggattagggtttactactaatggtatttggtgagcagattttaaaggggatgtgcacggttggcgcttggaggcgagcacaggatggtttcgtcattaccggtgaag

SEQ ID NO: 43811 - DNA, 224 bp, Triticum aestivum
  Clone ID: PAT_TA_43811
cgtccgcccacgcgtccgcggacgcgtgggctgcgggacaccatcaagcccgtgctcatctcctgctatgacctgaagtcgtcccgccgctcttgttctcgcgcgccgacgccctggagagcgggagctatgacttccgcctctccgacgtcggccgcgcggcctggtcggagcccggccgattcgagccggccgaggtggcgtcggtggacggcgtgaccttc

SEQ ID NO: 43812 - DNA, 269 bp, Triticum aestivum
  Clone ID: PAT_TA_43812
cgtccgatgacccataccttttcaaggttgagcacgcatttgagtgagatgacatgtgatctggagatcatgtctgcagataataatactcttcaagatcaggtacagacaaaggtctcagatcctgcaagagtccaagaaacagttgctcaattgaagcgacgaatctactattaggagcattgctgtactagggctaataatgtgcactgttctaagttttttggacgaattgcagcaactggttaacggaagggttatgctgaaag

SEQ ID NO: 43813 - DNA, 443 bp, Triticum aestivum
  Clone ID: PAT_TA_43813
cgtccggcttggagaaggttttaagctcaacatggaagtgatccgtgatgttctaggcagctgtgggtatgacatgaagaagagcatggaggaattaatgtcattttctacaaaagatctaggcaaaaggccagagaatgagcatattgcagtacaagacatggcggtagaatcctctttttccatggggagttgcctaggatcacaatacacatctaggtttgtactttcctctctttgttactggtttattcctttttgttccatcacgaatgtgactttttgcttcatccggcatttctctttgcgtggatggtgacttaacccaagaccacagattacccctggagagttactagaatcaatattcactgcacctgaaagatcttgaggaggaaccaaaagtaaggcggtatgaattgggcgcaaatcgaaagagagtt

SEQ ID NO: 43814 - DNA, 440 bp, Triticum aestivum
  Clone ID: PAT_TA_43814
cgtccgcccacgcgtccggccccgtgcgcgtctacatggacggctgcttcgacatgatgcactacggccactgcaacgcgctgcgccaggcgcgcgcgctcggcgaccagctcgtcgtcggcgtcgtcagcgacgacgagatcaccgtcaacaaggggccgcccgtcacgccgctcaacgagagaatggtgatggtgggcgcagtgaaatgggtggatgatgtcattccagatgcgccatatgccataaccgaagacttcatgaacaagctattcaccgagtataatatagattacatcatccatggcgacgatccttgtctgctcccagatggcaccgacgcatatgcccttgccaaaaatgctggcagatataagcagattaaaagaaccgagggagtgtcaacaacagacattgtcggaagaatgcttctttgtgtt

SEQ ID NO: 43815 - DNA, 435 bp, Triticum aestivum
  Clone ID: PAT_TA_43815
cgtccgctccacccagttgccaatggcggaccacagcagaagcccgtcgtttgcataagggtaatcctcgatgagaagcctgatgccgtgaggctgtgtggcgtcctccacggccactcccctgagaaaatgaggatgtcagtgatcaccatagtacaaatcattctcagttgcaatgtcacagtggagggtacatgcctgcggaggaggtcagccgggaggccctcgaggtcgaagcgccagtggttgcggtagtaggcggagctgatctcgccagagacagggccaggggtgaagcaggactcgatcactccttcggcgttgatcaggctctgccgcgcaagcgcattgatctccagcgtgtacctcatgtgaggatgtaggagcttgaagatggggtgcatcgcgctcattcgccggtgcgccgccaggatg

SEQ ID NO: 43816 - DNA, 427 bp, Triticum aestivum
  Clone ID: PAT_TA_43816
cgtccgaatctgttttgtctagcatcagggcataggaatatattcgttactctgccatgttctgaatttctgagggcaatgttgatagatttggcaaatggaaacatgtacctgtttcaggcataaaatttgatcaggtttaaggcaagatacattagtgttgcttgtggctcaaagggtatgtggatttgtcaatgcgtcattgctgcatccagaaaattagttcagatcttgatattcaagagataaagtctgagcggagtgcagtcagagtcactttcttcttctgtttgtcattgaagggttttttaaaaaaaaaaaaaactcgagaaactatggtcgactctcagtaaggtcaagatggaaataattctgaacatgttggaacagggtctagatggaatgttttatcaagttaaaagccaac

SEQ ID NO: 43817 - DNA, 409 bp, Triticum aestivum
  Clone ID: PAT_TA_43817
cgtccgctcctaacgaactccgtgcctccatgagataccgcgcgaccgcccgtcctcatccaagacgccgccgtgctccgatcccatggtgatcgggccaaagaaggcgaggagttggacgcagttgccatgcccacaccggctgctctgcgtgccggagcactgcgcatcggcccggttcgtggccgtcgccgccgtctgcctcctcgtcgtggtcggcacgtactacgtgctctgctcgccggccgacgccgacggccagacggagcagaggttcttcgacatgtggcgtcgtcgatcagcggtgcgcgcctacggcggcgatgatctggaggcggcgctgcgcggcgcggcggacgctaacaggacgctgatcctgagcgttctgaacaaggcgtacgccgaggag

SEQ ID NO: 43818 - DNA, 442 bp, Triticum aestivum
  Clone ID: PAT_TA_43818
cgtccggtttttacccaagatgcatactttggtgctgacgaacaatcgcctcacaagtcttgcggagattgaccccctggcctctcttccaaagctgcaatttctcagcttactggataataccgtaactaagcaaccagattaccggttatatgtgatccacaagctgaagcatctgcgtctcctggacttcaagaaagtgaaacaacaggagagagctgacgcagcacaaaagttccactcaaaggaggcagaggaggcggcaaagaaggttgctgccaaagcttatactccagtagtgatggattctcaaggtaccacaaaagatcagggccctaaagtagtcgctccaacgcctgcgcagatcacagctatcaaggctgctatcgtgaactctcagacacttgatgaagtaacaaggcttgagaaggcgctgagcact

SEQ ID NO: 43819 - DNA, 307 bp, Triticum aestivum
  Clone ID: PAT_TA_43819
gagcgtcagaaaagatccactgagtgagcaaataaacaaggaaacaagtcctacaagtatatagtttcatcatccactcaagcattgccacatttaatttggccacatcagaggaatcattctccactcacagcggcgaggtgagctagctagctctgccctggcggtggcggcggtgggcccgggttgtggcaaaacatgcacgccttatcgccggacaaacggcaagcctcgcaccttgaataggcggcacgctgagaacccgccggaggagaagggttggtcgccgccagcaatttcaccaccg

SEQ ID NO: 43820 - DNA, 439 bp, Triticum aestivum
  Clone ID: PAT_TA_43820
cgtccgcggacgcgtgggcggacgcgtgggcggacgcgtgggcggacgcgtgggcggacgcgtgggtggacctctcacctagcgcacatccatggcgcgcttcctcgtcgccctcctcgccaccaccctggtcgcggttcaggctggagggcagctgggccacgcggcgccggcgacggcggaggtgttctggcgcgccgtgctgccacactcgccattgcccgacgccgttctccgccttctcaaacaacccgcagcaggtgttgaactgctcacagaagccaccagcttcgtgagggatgccgaggacaggccccccttcgactaccgtgattacagccgctcgccgcccgatgatgaaccgagcaagagcaccggcgccgcctccggggcgcgggacttcgactacgacgactacagcgggggcgacaagctccgt

SEQ ID NO: 43821 - DNA, 422 bp, Triticum aestivum
  Clone ID: PAT_TA_43821
cgtccggaaatccggtggccgcatttcacatgctttgtctgtgtatagctgtcaacttcgccagcccaaccaggtgaagaaaatatttgagttccttaaagacggattccatgaagtcagcagctccctcgatttgtccttcgatgacgattctgttgctgatgaaaaaattcctttcctagcatacctagctagtttcttgcaagagaacacatctaatccttgtgagcctccagctggatgtttaaatttccggaatcttgttgctggatttatgaagagttaccaccacatcccgttaactcctgacaatgttgttgtgttcccatcccgtgctgttgctatagaaaatgctcttcgattgttctcaccgggacttgcaattgttgatgaacacctaaccagacacttgcccaagcaat

SEQ ID NO: 43822 - DNA, 343 bp, Triticum aestivum
  Clone ID: PAT_TA_43822
cgtccgcatgcgcgtgggtgtacatatggccggagccgaacccgtagaccaacaaggcagtactataaaagagctggacaagactgcaccagctggccattgatacccggacgggaccataaacataaagaccgagacagaaaattcgttaagcacttaaagttggcctatatgtctgaaagccagcatggcttactcacagcactagaggcacgtaccggactgcatgtgtagcatgatacatgatgcaactgcaaaagacatgcctgagcacggtgttggatgagctccagagcatatgcattgggaaagtgaggagcttctacctaagattgatggagcc

SEQ ID NO: 43823 - DNA, 357 bp, Triticum aestivum
  Clone ID: PAT_TA_43823
tggaggggatacgagagaaggtacttcatgccgaaaccgaggggctcgtcatcgtcgcagtcgaggttgaagtggcgctcgcggtccccgtgctcatcaacgtagtgcgctgagatcttgatcttctcccccggcggtgaggaaaaaaaaaggagagatgaaggaggcgacggcgtcggggggcggctcgacggctggggcgaacgacccgaggcagccgcggacggcgaggccgtacgcgccgcccaagctgtctgctcaagacctgcccgtagactacgcggactttctctccggcttcttcggcgttggcgacgtcatgctccaatacaaggtttgctcgtggatcgtcatcat

SEQ ID NO: 43824 - DNA, 126 bp, Triticum aestivum
  Clone ID: PAT_TA_43824
cgtccgctgacatagccgatggatgttcaaggttctttattatttgcaatggcttctaaaaattcaatctggatggggtcttctggttaccttcaaaaaattccgggtcttttggatattccccgg

SEQ ID NO: 43825 - DNA, 319 bp, Triticum aestivum
  Clone ID: PAT_TA_43825
cgtccggggacgcgagggctgacgccacgcctacaccttggaacttgagagaccatgggctgagcaacctccatttagagagacaagactagcacactcacaaccaatgacatcactgagcgcgaggcttgcatctgtggcaaaattaaagaagtggaaaaatcttcagacaccaagagcttattctctgaactaccggcttctgtcatgacaatgctctcgcagtccatatttaacaacaccggtggcgatgttgtcatcaaccaggatggcaaacgcgaaatactgggcacaccaactgaggcagcaattctagagc

SEQ ID NO: 43826 - DNA, 446 bp, Triticum aestivum
  Clone ID: PAT_TA_43826
cgtccgcccacgcgtccgcgccagtcccatctcccaaatccctacgcagaaatccttcccacatcgaggccagcgccgccgccgccgaattccaaagatgcctgccgccctctccatggtgcccgcctgcgacgcggaggagccgctcctggcggagtcgtcggaccgcttctccatgttccccatccggttcccgcagatctgggagttctacaagaaggcggtggcctccttctggaccgccgaggaggtggacctctcctccgacgcgcgccactgggacaccacgctctccaacgacgagcgccacttcatctcccacgtgctcgccttcttcgccgcctcggacggcatcgtgctcgagaacctcgcctccaggttcatgtccgacgtgcaggtcgccgaggccagggccttctacggcttccagatcgccatcgagaaca

SEQ ID NO: 43827 - DNA, 413 bp, Triticum aestivum
  Clone ID: PAT_TA_43827
cgtccgatgcattcgaacccatcccacagtacgccgcccctgattgtaccttgcagatcttctacatccgagtctccgagatcggcaaagatggtctccagtggcctctgcatgtccatggattggttgctgccagggactccgtaaatcacaagcgtaacttccttttcaatcgcactggggatgattggcaaaccctcacccaaagaagatccatggttgatgttaaatggcccatctcgtgcgctcgtgttaattgacccgattgcatttgaagttcaactaaaagtaaagagcaaaacagagcctggaaaggatgaactgttggctttcaaagttttcagctactacaaagcttttcattctgatgaggaggtatttacacgctgtacgtgcaagcgctggacgcttga

SEQ ID NO: 43828 - DNA, 442 bp, Triticum aestivum
  Clone ID: PAT_TA_43828
cgtccgcccacgcgtccgcccacgcgtccgcggagatcaatgacgacgacgatgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccatctccactagagttatcccaagtttcacttcacatcgtgatgttgttttaccttttttttcttgtcgtcgtcccgctgcctgctataacggacagcgctccctgttggcgccgccgccggcgggagtggtgccctggcggcggagggtgatgtcctctgccgccgggtgctcccctgcttgtacctagatggttggttactctttccgtccattgtcaccggctaacattgtgataatat

SEQ ID NO: 43829 - DNA, 407 bp, Triticum aestivum
  unsure (1)..(407): unsure at all n locations
  Clone ID: PAT_TA_43829
cgttcgctcacaccttcgaaagttgggccgcgtgtgtggttattgttgatgtacgtgacagaaaccctagccctccgatcgacccgagccccattccgcgaggccgtcaggatgctgcatggatgctcttttccggatacccgacgtcctactagcggatgagacctcttcaggcgaaacaccaagtgccgctacacgaccgngctgttggagcagactcacgaggagcgccgccgtcgactggaactgctcgtacagaactcctccaacaccaatattcacaaatgcttcagagggaggaaggcgttcgaattgtcacgcttgggagttcgaaagaactttggttctacttttgcggaacactgccagatggttcataggttctgctttagcaataattctgattt

SEQ ID NO: 43830 - DNA, 139 bp, Triticum aestivum
  Clone ID: PAT_TA_43830
cgtcggggacatcaccttcctgaaaccagaggtctatgtctttctgaataacaaattgtcagaactgtaagtttctaaatgctgccatattattgactttatttgattacaggcatgtgcaaattttacagtctgcaat

SEQ ID NO: 43831 - DNA, 441 bp, Triticum aestivum
  Clone ID: PAT_TA_43831
cgtccgccgcccacgacggcgccgatgtcgccgcctatgcctccgcgtccctcgcccgcctcggccgcctcgtggccaaccgcgccgatcctctcgcccgtgacgacggatcctcccctccccaacatctctcgcgagctaggcgaatcctcccgacaccgtcgccggcaagagcaaccggagcagggacgcccgacaacttgcccggtgaaactggagagagacaatgatgatgtgggcatgacgtgatgcagattttcccggcggagctgacacgatgctactccgtgcacaacccgcagtgggcgctgaaggtgttccgaagagcaatggagggggcggatccggcacacgtcacggtgttcttcagtcagcctcgctgaccagttgcaggcacaccgtgacatgccgctcgaggagtaccaggataatcaatttgtg

SEQ ID NO: 43832 - DNA, 431 bp, Triticum aestivum
  unsure (1)..(431): unsure at all n locations
  Clone ID: PAT_TA_43832
cgttcgtgcgggcaggttgcgcgcggccctcgtcgtccgcatccgctacggcggtggccgggcccacggcggaggtggcggcccggctgcgaggggaggtcacgtggtgaggaccgatggatccaccggcgagaccgggcggggctcgtaccaggggggaggctcgtacggcggnaggagcagcgagggcgggcagggctctgtaccaggcgggaggctcttgcggcgggaggaccggcgagggcgggcagggctcataccaggcaggaggctcatacggcaggaggtccggcggagactgcaccgggcatggacacgganggagcgcacggggtgggcgcggcgcgcgcggatcagagcatgtgcaggccaacggtttctgtagagggcttcggcgccgcctgaagaagacgcttgatgagcgtgacctg

SEQ ID NO: 43833 - DNA, 445 bp, Triticum aestivum
  unsure (1)..(445): unsure at all n locations
  Clone ID: PAT_TA_43833
cgtccacccacgcgtccgtgtctacaaaggttgaaatgcgccttgcaaaagctgagccagtaacttggacatcattggattatactggtaaaccaaaggctcctcagaagataaatgtaccaggtaattccttgagggctgaatgcgagcaaaattgttgacttgtctagtgataaccttgctgngattgagcttttgtatggattactactccctctgtaaattgtgttctacaattttttcttatgaaagatgatcactgaaaatattgtaaaccagcgcaaatttatggcntgttcctgacatgatagtcaacaagaatatggtgatttctgtacttagtgagaaagatacttccatgcacactgagtggatcagatctataagaaagttaactaaaatgctggttggtgctgactcctaagcttgcaaaatggctactatt

SEQ ID NO: 43834 - DNA, 410 bp, Triticum aestivum
  Clone ID: PAT_TA_43834
cgttcgtccagagcacgcccgtgcggcgcggtcggtcgcggcatgggctctccctcctcctcgtgagcagcggcgccgaccagttgctggctccttctcggttctggcagcggcggccggcgggcgaccagtagtccagcggctcgtggcgagctctcctctcctctcctggtcaccagtgcggcgctgcgacggccgccgtctcgccatgatggaccaggagcacctggacttcatcatgcgccaccagcaccagggcggcatggggtttgctcccgccgaccgcggcgacagcgaggaggcgctggggtcgtcggagtcggagccggtggggaggccgtgcggcaagagggcccgctgccgtcgaggtgcacaacctcttcgagaagaggcggcggtgcaagatcaac

SEQ ID NO: 43835 - DNA, 309 bp, Triticum aestivum
  unsure (1)..(309): unsure at all n locations
  Clone ID: PAT_TA_43835
cgtccggtaatcgcagctgctgaggcgaaggctggggccacgatcggcggttcagcccagagtggcaccacggcgaagggaggtgcgcctgttcggaacaacggctccggggtgaatgcaagttcaggggaagccacggcgagcaatgtgacggcaattccatctgtcaatcagactcgcagtgcagtttcagcgangctacacggtaatgttgctgcgcctcataggagaggacatccaggcaagaaccacactgctcaaggctcgttggtccatcatgatcagcagcagagtgtaaacaagagctgc

SEQ ID NO: 43836 - DNA, 323 bp, Triticum aestivum
  Clone ID: PAT_TA_43836
cgtccgcggacgcgtgggtcagacttccagtggacccaaaattcgggtgtccacagatgacatgtactagtatgaaactacgcttatagcattgtttgagattattgcctgacagcgaacaacggagacatcaggctacatatgtgaatgggctgcatacgcgagcgtacgacctttttctttttgttcaaaaattgcaatgacgcaagttcgttactattgatgcatggatacgcggaccaccaactacagcttaagctctacaggcatacatcaatatttaattgtaggactcatgtcacaatggggggcacaaatagtat

SEQ ID NO: 43837 - DNA, 439 bp, Triticum aestivum
  Clone ID: PAT_TA_43837
cgtccgcaattttgagtgctaccatatctattgttgttctaacagtacttctgattggaggctcaacaagcacaatgcttgaagctctgcatgttgtgggagatggtaatgaaggtcgtcgcccttcttcacttgaggaccaggagaactatgaggggaacaataatgcgggcaacatagaactgggcagtgaagaggggacttctaccacaagcaaattcaaactgaaactccaagaaatccagaaaaacacgccgtccttggccgcattggacagaaactacctcactccatttttcacatctcaaaacggcgatagtgatgacgacgaacatggtcctaacagagagccacggagatctaacgagctgcaagacctggagagccatggattaccggctcgagagacgggctgaagagccccatttcgacggtgtcg

SEQ ID NO: 43838 - DNA, 355 bp, Triticum aestivum
  unsure (1)..(355): unsure at all n locations
  Clone ID: PAT_TA_43838
cgcctgcaccaccggtaccggatctccgtttcgggctagacctacgcctacgcgtacgcttccacccttgccaccctggacccttgacccacatatacacatgggggtgaattcttcacacctcaaaactagcagctaactacgccttatgctatgctccaccagagccatgaagggttatacgctggcccgagtactgggagcactgctgctcgcaacacaggcagctgcattgtgcagacnccccctagcacaagcaaattcaaactgaacggcgccaccgtcggaacatccaggaacaccaccaccgtatgcaccacacattcttcgacncaactgacaccgacctttaaaa

SEQ ID NO: 43839 - DNA, 202 bp, Triticum aestivum
  unsure (1)..(202): unsure at all n locations
  Clone ID: PAT_TA_43839
tcctcgcgttcgttcacgcttccgtaggtacccgtggatattattaccaaatattgagccgctatattggggtgttaactgcggggaaacaggtgtgtccctggacttatttctctgattggatcagggatctgtcattctgggtgggaaagcccttttacccgatcctcttctttgcctgaacagnccaaggtggcttccg

SEQ ID NO: 43840 - DNA, 445 bp, Triticum aestivum
  Clone ID: PAT_TA_43840
cgtccgcggacgcgtgggggttcttagaaatcctagtcctggtgctacattgctggaaccaactaaccaaagtcagacattgaaaggatctcatagaatgcaaggtttcacggggggctccggtgctctgaaagagctgccaaacttctctaacattagtgcagaagaattattgccacaggctgaagcagatagagttgatgccatgcttaagcagctaaagcatgcttccgagtttcataaaaggttgtttgagtctgctgttagctcaatacgtacaattgcagctaatcatctttggcagttagtggttgtacgcgctgatctcaatggccacttgaaggcacttaaagattattttcttttggcgaaaggtgattttttccagtgttttcttgaggaaagccgtcaattaatgcgcctaccacctcgtcaatctacagct

SEQ ID NO: 43841 - DNA, 434 bp, Triticum aestivum
  Clone ID: PAT_TA_43841
cgtccgggaaacattgcaattgaaggaattatacttgcaacaagacaaccttatccgtgatgcctgtgccaagctgccacccatgctgccaaatattgaaactcttgccatagaatcaccgtgggaggtggtcgatgcaccaatgctgcctaccaaattcctctaccttaagcacctcaacattaatttgagaacaggaacaaccgagtaccggccatatgactatttttctctggtttctttcctggatgcttctccttccttggagactttggaattagatgtgactcagttgcgtatgttgcacaagtcaatttttgctgattctcaactgaggcacatgcctgaacaccgccatagctgcctcaagagcgtgaagatcagtggtttcagctcttggaagtgcttgattgaactgacatgttatattctca

SEQ ID NO: 43842 - DNA, 263 bp, Triticum aestivum
  Clone ID: PAT_TA_43842
atgtgggccttcggcgtcttcttctccttggttgcttgcggcgttgccgtggctacatataacggtggggcatcagacttcagagacactcctgctttttaggaatcaacccaagtccaggagttccccggagagtcagaattatctggcgccgatgtgtttgagggtatccaactgagttgcccagctcttggtggactgtaaggagcataggaaaagaatgaggcttttcttggcttaggcctgagtgcagaactgacaca

SEQ ID NO: 43843 - DNA, 326 bp, Triticum aestivum
  unsure (1)..(326): unsure at all n locations
  Clone ID: PAT_TA_43843
gcggactacgcctctattcatgcgtccggacctgtccggccgcactaaatatcacattcatggtaaatgacactctagcacccatcgaaaatgtccatgctgtgatagaacgcaaagcatagactgactcctatctgatgatgggcacccatctgttcgaccggtcaaaggcggccttcaaggccagcaatttcnccgcctgcttgctcctgctcncncagaggatggtccagctcaaaaagtaaggcaggctaccaacgctaacacaggtcactcccaactccgatgaagaactaatgcctctnatggaaattactgaacgggcc

SEQ ID NO: 43844 - DNA, 438 bp, Triticum aestivum
  Clone ID: PAT_TA_43844
cgtacgcccacccgcaccaacctcgcggaaaccctaggcgagcggcagcctcctccgatcccctctccccgatctctataaaacaccgcggatttcgaattctgtcttccccgcgggaatcacaccggcgcctcctccctcggcgcgcccggaccgggctcctcccgcggggccggggctggtaccaggggcggcggcggggggcggtggatggcggaggcggctctggaggggagcgagccggtggatctgaccaagcacccctccggcatcatccccacgctccagaatattgtgtcgacggtcaacctggactgtaaattggacctgaaagcaatagctctccaggcacgaaatgcagagtataaccccaagcgttttgctgcagttatcatgcggataagagaaccaaaaactaccgcattgatatttgcttca

SEQ ID NO: 43845 - DNA, 458 bp, Triticum aestivum
  unsure (1)..(458): unsure at all n locations
  Clone ID: PAT_TA_43845
cgtccgaggccattcaaagggtggtgcagcaaaggaggcaaccgctagcgccgatgaaacagagggctattcaaagggtgctacagcaaagcaggccaccgaagagaaggtagaagaagatggcaagggcaggtcatcaaagaaggccagcactgctgatactcctgctaagagtagaaagcggggaaaccacaatgaggaattggaaggcnntgcaaaaactgccactacaaaggagaccgtggatactaccactcaaaatggtggcactttggtgaggagcatgagtggaaagtctgacaaagagaaagcggatggagatgctgagagccccacaccaacggaggaaatggctgacgctcaaaatggtggcacacttgctctgtataagacggaaggggaagctcatgaagagaaaatggacacagatgctaatgtgaaaggcacgcgcaaagggg

SEQ ID NO: 43846 - DNA, 439 bp, Triticum aestivum
  Clone ID: PAT_TA_43846
cgttcggtcgacctcttctacgtgcccttcttctcgtccctcagcctcgtcgtcaaccccatccggcccccagccgccgccaatgcctcggaggcggcggccacggcgggaccttcgtatagcgacgaggccatgcaggacgagctggtggagtggctggagcggcagtcgtactggcggcggcaccggggaagggaccacgtgttcatctgccaggatcccaacgccctctaccgggttgtggatcggatcagcaatgccgcgctcctagtctctgacttcggccgcttgcgtggtgatcaggtctctctcgtcaaggatgtcatcctgccttacttccaccgcatcaaccccttcaagggcgatgtcaatgttgacagcaggcctgcattgctgtttttcatgggcaacagataccgaaaggagggcgggaaggtcc

SEQ ID NO: 43847 - DNA, 422 bp, Triticum aestivum
  Clone ID: PAT_TA_43847
cgtacgcccacgcgtccgcgtttccttcttgaaggcatcatcgaggtgaagctcccacctcattccgctaccttcgggggaaacccttgatcggccgatctaatgatggcggcgcttaagtgtcgttccctcgttgggggcatcattcttgtaggggttcatcggctggagggaccagtggacgactacaacggtggagcggtgtggcatctaacaacccgacaacggcgggtctcggtgatggtcgcgtgttgatggacgcgtgcaggatggtggcgctgtctggcgttgtggtggcttcgacggcagttgggcttggcaaggcatatgcattgatctgtcctgaagatgggacggcggaagatgacggcggcggacttttccgtgtgtgttgagggtctgctacaccggttggtgctctc

SEQ ID NO: 43848 - DNA, 437 bp, Triticum aestivum
  Clone ID: PAT_TA_43848
cgtccgcccacacgtccatacactccagggcgcttatttcctcaagacgtgcgaacgatgaacatggacatattctgctgccgccatgggcccgtgttcatcttgtcccaacagatgcgcgcgctggtgctggtcgaccacaccacgcgcgccacgctgagggaccccagcgaaccagccaataccggattgctgagtgacctgtaggacgcctacgagcgtttggagctgctgcacgccgacctgctgcacgaggactgcttcaacacgcccgttaaggtggtgtagatgggcatcaacgacgactatagacaagctttcagctctgtctactcatcggactctgacatatggggcgatatcatcttcattgacaatcctgagatgtatgatttgaggcaacccagtacacttattggaaatgccctttactggtt

SEQ ID NO: 43849 - DNA, 401 bp, Triticum aestivum
  Clone ID: PAT_TA_43849
cgtccgccgccctccactgtccccgtggctagctagggtttcggccgccacccccaacatcgccaggatcagccacatccggcgacggcgaggccagagctcgacgaatccattaccggtgtgttgcaggtcaccttggcgcggtctggacgacaacaacggcaggagggcgtcgtccttcctactggcccacctagctggcggccctgccctgttggaggaggcggcctgtttagctaaagcacggccacaacaacccacctgggcaggtagtgcccgttgatgtactggagccttgatcttaatttttctacatggatgccctgggaaaagatggccattggagtgtaggggaggaacaaccttttcttgctcgaggaggaggaccacccgatctcgac

SEQ ID NO: 43850 - DNA, 439 bp, Triticum aestivum
  Clone ID: PAT_TA_43850
cgtccgcggacgcgtgggccggaaggagcggagccgccgagccgggaagagccaccaccccatcccatcgcccgcctccgcttccgaagggtcagagatggcggaccgagctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatcatgtcatcttctccaatgtttgccaatgcaccccctgagaagaaaggtgtcaagaactttgcgattgatttcctcatgggaggagtgtcagctgcagtttccaagactgctgcagctcccattgagcgtgttaagctgcttatccagaaccaggatgagatg

SEQ ID NO: 43851 - DNA, 196 bp, Triticum aestivum
  unsure (1)..(196): unsure at all n locations
  Clone ID: PAT_TA_43851
tgcctgttgctgctaatcggactcctggccgcccccgccgtcttctccaacatgaccgaggtctgcgacaaggccgccgtcggccaccccgacacgctcggcgactgtcctctttcgcatagggtgctgcttactctggaggagacgaagggccctaccatatgaagctcatctcntccacacatgccctctgttt

SEQ ID NO: 43852 - DNA, 434 bp, Triticum aestivum
  Clone ID: PAT_TA_43852
cgtccgcaaccagacgccgccctctgaggttccgaccgcgcaaccccgcaaaagctccaggacggcatgctagggccgccggggacggtggacatggaggcggagccggaggctgcagccgcgctcgtggccttggggttggagccctctgcgtcgcagctcgatgttttcaagagcagacttcatttattgattgatggaaatacgagtgattttgatacgtgggtatcattgataagttctgcagaggaaacttctgttaatgacataagggttattagcttggtctacgataccttcttattggaatttcctttgtgccacggctactggattaaatacgcagctcataaagcaaggttatgtacatatgatggtggggggggggtttatgaacaagccgtccaagcagtaccttattgtactagactttg

SEQ ID NO: 43853 - DNA, 429 bp, Triticum aestivum
  unsure (1)..(429): unsure at all n locations
  Clone ID: PAT_TA_43853
cgtccgccgacgtgtgtgcagacccttgtgaaccacatgagccgcatcatcccccgccagctggtgctcgacgtccggaacgaccacgagctcggctggctgctcgtcggcgtcaccatcgcccacggcggggtgttcccgaacatcaacgccgtgctgctctacatgaagaccgaccagatgtttcctccggcgctcacacagtggctctgatgcctgacaggtacgcacgaaggtgtaggttaacattgattcactgtgtcgaagtctgtgacatgtactgatggctgtgcagcgtctgcctccacagcgtcgttgacatgcagctgtctaaccagaggctgnaatacaatggggcaatgattggctaccaggttcagagattatgccagttccgtgccaagctcgagaacattacgggagacaagc

SEQ ID NO: 43854 - DNA, 151 bp, Triticum aestivum
  unsure (1)..(151): unsure at all n locations
  Clone ID: PAT_TA_43854
accatttgnggtgagttatttaattnagatgattgctgctattacaacttgactgccaaattctgcagcattttctacttgaataataaagaaccaggtcacaccattgtttttactttattattcggattatatgcaggagttttggtgt

SEQ ID NO: 43855 - DNA, 251 bp, Triticum aestivum
  unsure (1)..(251): unsure at all n locations
  Clone ID: PAT_TA_43855
cccccccgtcttccccggggacccacgcgttcgcgaaaactacgttacgttatccnaccacccccttttcatgtttaccgtctactcgtcctggatgcttggacctttccaccacgcccccgttctctttccatccccgccgttttgtttgtttttacccgtaccttctcgactcccttttttcttggccgacgcgaaagcctttgcgtctagtcaggcgcctcattctctccatgaggtggaggaggact

SEQ ID NO: 43856 - DNA, 304 bp, Triticum aestivum
  unsure (1)..(304): unsure at all n locations
  Clone ID: PAT_TA_43856
tcttcccatcattgcaatgaccacttactcttcaggcacatggtcgattacgagttcgaggccgtggtcaactagcatataaatgaggagtaccctgtctcnnnctcagtattatgtaattttcggctacttacaccgctacattcgtggctgtaatggtatttgtcaagttctataacgaatcaatctatgatgagagggggcacgcctagaagctcattggagtaccatatcaaacgtttaggcagggtgtggcttccagtcaattgtcatacctttaacggatatcgaacattctgagaaa

SEQ ID NO: 43857 - DNA, 359 bp, Triticum aestivum
  Clone ID: PAT_TA_43857
cgttcggagattacattccgctcgaaggatccacggcatagcagtgaagttgtgcagcagatcaggacattgaggaggcaagtagcttcaagggagtcagagagagcttgagtgggccacccttgttacccaggagaagctccagcaggcaagcaacaaaacaaagcaaatgaggcttaatgatgtctggataaggccttcatttggtggtcgtgggagaaagctgacaggaactcttgaggcccatgttaatggtttcagatattccacttcacgggctgatgagcgtgtggatatcatggacgggaatataaaacatgctttttttcaaccagcagagaaggaaagattacccttct

SEQ ID NO: 43858 - DNA, 410 bp, Triticum aestivum
  unsure (1)..(410): unsure at all n locations
  Clone ID: PAT_TA_43858
cgtccnccaatcctcacagaaatacccatctcaaaaccctatccctcatccccgatcccggagagcgagatggccaacccgagggtgttctttgacatgaccnnttgccgcccgcttgtagtgcgtgatcgtgatggagctgtacaatgacgcggtgccttggacggttgagaacttccgtgcgctctgcaccggctagaagggcgttggcaagagcggcaagccgctgcactacaagggcagcgccttccaccgggtgatccccgactttcatgtgccagggcggcgactttaccaggggcaacggcaccggtggcgagtccatatacggcgagaagttccccgacgagaagtttgtccacaagcacaccaagcccgggatccttttcatgggcaacgccgggcccaac

SEQ ID NO: 43859 - DNA, 379 bp, Triticum aestivum
  unsure (1)..(379): unsure at all n locations
  Clone ID: PAT_TA_43859
cgtccgccaaggtctacatctggtcctgcggcgtggtgctcttcgtcctcgccgccggctacctgcccttcaacgacgccagcctcatcaacatgtaccgcaaganctacgccggccggatgcggtgcccgtactggttctcgccggcgctgctccacctgctgcgccgcatcctctaccccaacccggccacgcgcatcgacacggacggtattctggagcacccctggttccgccacggtgcgagcggtgactgcgagctgtaaaatctgatgcgcggccacgaggaggaggcgtggttcaagacggagttcaaggaggacatggccccggacatgaccgcgtttgacattctggcctttttcgcccgggttaggac

SEQ ID NO: 43860 - DNA, 435 bp, Triticum aestivum
  unsure (1)..(435): unsure at all n locations
  Clone ID: PAT_TA_43860
tcgtccggaccgctgatgttgntgagctcactgttgatgagcgcaacctgctctctgtggcttacgagaatgtgattggtgcccggagggcttccttgacgatcattttgtgtattgagcttaatgaggagagccgttggatctaggcctatgttgcttcaatcaaggagttccgtcccaggattgaaaccgagctcatcatgatctgtgatggcattctcaagcttctgggactcccaccttgatccctctgccactgcaacagagtccaaggcttcctatctggaaatgaagggtgactaccacaggtaccttgcaggagttaagagcggcgctgagaggaaagaagccgctgtaaacactctttgttgcatacaagtcggcccatgacattcggcctcgctggacttgcctaccacccacccgataagggtt

SEQ ID NO: 43861 - DNA, 234 bp, Triticum aestivum
  unsure (1)..(234): unsure at all n locations
  Clone ID: PAT_TA_43861
cgttcgnccacgtctacgttccaagctttttttgccaattgaggtctcactcaagtccgctcatttgccaaggaggcagctcctgtcagcgcataccacctattgaagggcatattttttgaggtgaagaaaaagtttgagaccggacttggggttcttaagaaggagaagatcacgattgaccccaatgacccatcagcatatgctaactacgcccaaggcactagggctgtt

SEQ ID NO: 43862 - DNA, 102 bp, Triticum aestivum
  unsure (1)..(102): unsure at all n locations
  Clone ID: PAT_TA_43862
cgtccgctaactcatggccnccctagcgcatgtccnccgtctctctctagtccgtgcgtgccctgaccttccagaagctgtcggtagcccatccctgtccac

SEQ ID NO: 43863 - DNA, 434 bp, Triticum aestivum
  Clone ID: PAT_TA_43863
cgttcggggaaagaaggcctctgtacgcatgaaccccaccttctccatccctacacgcaacctgttcctctcctccgcatcttctggcaggggcccttgtggctgcagcagagggcagtcaagggggcgagcaggatgggtccagccgatttcttcgccggatctggagcccaggggcgacgccgacgagcacgcagccacgccaacgtcgttgcctcgagagaggagtgggtgggaggagaaggcggcggcggctcgagggcaagggtcggatcttctcgcctgattcatggctatcaagcgggtttctcttgatgtgtacaatagtcgaacaaattttttatgcgtgttgatgctgcatggaagcattggaagcgaaaaaaacccttcacatacctaaatgtatgtgaatctccccgtcttaatttaggttg

SEQ ID NO: 43864 - DNA, 441 bp, Triticum aestivum
  Clone ID: PAT_TA_43864
cgtccgcttctatcggtggctccactagctatcacaaacttcgaggactccacactggttgcttgctgcacattcctgttggaactatgtggcatgtgtcctaacatgctccgtttagttattgctgctcttcagcgcatctcttcctactataacttggctcagcaaaataaacaaagtgagctatcttcaccaaggagcactgggttacatgtgctctcccatggagctgatattgctcctgctcttgctcgagcattagctgaagattatgtccagtcttatcatcttcagattttagagcagatgctaacctcgagggggcctaaaagggaacaaccatcacagccttttattgctatactggagcacctggaacgagcaagtttgccattattagatgaatgtagaacctgtggattttggcttttgagtggcatt

SEQ ID NO: 43865 - DNA, 198 bp, Triticum aestivum
  Clone ID: PAT_TA_43865
cgtccgcggacgcgtgggtcttgaccgtcggcgcgtccaccatcaaccgcgaatttccggccgacgtcgttctcggcaacggggagaccttcacgggcacctcgttgtacgccggcaaaccgcttggccggacaaaggttccactggtgtacggcgaaaacgtgggctcgaacatctgtgaagccgcgaagctcaatc

SEQ ID NO: 43866 - DNA, 440 bp, Triticum aestivum
  unsure (1)..(440): unsure at all n locations
  Clone ID: PAT_TA_43866
cgtccgcccacgcgtccgatcatctgttcccttcgcgaagatggcgccagctctgcggctcctcctcgcgttcctggcaattggatcctgcacagctgctgaccacntcnacctgtgggcgatgcccaagacggtgtcccacgggacgcagaggctctacgtcagcaacaacgccaccatgtcgatggcgggaagcaagtattccgacggcaaggcgatcctcaaggacgccttccagaggatgcttgatttgatgaagctgaaccacaacgctgacggtgcaaacccaagctcctccctgcttaccggtgttaatatcgtcgttctttcgacacaagatgagctcggctttgaggtagacgagtcatacaacctgactgttcccacaataggagagccactgcatgcgcagattgaggcttcaacagttttttgagcac

SEQ ID NO: 43867 - DNA, 313 bp, Triticum aestivum
  Clone ID: PAT_TA_43867
cgtccgagaagagagaaaccttaagtgagtcgcgcgcggctgctcgaggacgaagaaggtctgcgctgcaacaggagcggcgccaacaatttttcttcacaccctttttggtaatgaagtggtggcggctcggcacactccatgcgagatggaggccggcggcgcaaggaggaagtcggtcgcggctcttacggcacgaggccgttatgaggaggagatggtgcgcggggatcggcgtcgtgaaggcgatgtacgcgtcaagagaaggccgtttcatacggcatgacacagtggtgaccggcgttccggtagc

SEQ ID NO: 43868 - DNA, 407 bp, Triticum aestivum
  Clone ID: PAT_TA_43868
cgtccgcggacgcgtgggcacagcggctcgctgcggtcgtcggcggagttcccgacggaccggtgcctgatcgagctgtctgcgggctcgccggcttctacctaccactaccagagctagacgctgcgcgacctgatgctggactgcaactaccggtgcggcggcgtggaggtggtggactctctgcgcgtcggcgtttacaactgctacatcacccactttatgacagagggcatcgcggtgcgcgggtgtcaatagacgttcattctcaacaccttcctgggccaacacatgacccgcggcaccgaccccggtgagcgcctttttggcggcacggccattcggctcgaacggaacgacaactacgtcttcgacgtggtggtcttctccgcggcgaccgggatcat

SEQ ID NO: 43869 - DNA, 445 bp, Triticum aestivum
  Clone ID: PAT_TA_43869
cgtccgcccacgcgtccgcggacgcgtggggggtcatcgagctcgacatgtggcccaactccgccaaggacgacatcagcatcctccatggcaggactttgaccaccccggtttcgctgctgaaatgcttgaaatccatcaaagaatatgctttcgccgcgtctccctacccggttatcatcacactcgaagaccaccttacacccgagctgcaggacaaagttgccaagatggtccttgaagtgtttggcaccatactgtactaccctgaagaagaacatcccaaagagctcccttcacctgagtccctcaagggtcgcgtgctcctatcaacaaagcccccaaaggagtaccttgaagccaaggatggtggtgccgcgaaagacggtgatgcggagcagaatcctggcaaaggaactgacgatgatgcggcttggggaacaga

SEQ ID NO: 43870 - DNA, 353 bp, Triticum aestivum
  Clone ID: PAT_TA_43870
tcttccgatccaacaagctcaacacacacacctccgcccggatcttctaccctctcggtccccgtgggggtcgagctcattgagcgccagtaccactcgccagaaacatttatggttttatgtttccgcggtgcgccagatcttgcaccccttctccggcggccggcgcggtcagccaatctttagtgtcttctccttgccttgctatatttttgcgccaatacctaatcgacagtaggatgagtatgtcttccatagcaagacgactatgtgagccaagacagtgatccacaagtctactttcatgtattttgggatcgtatgcacaccacccaaagtctcaaaagacactt

SEQ ID NO: 43871 - DNA, 441 bp, Triticum aestivum
  Clone ID: PAT_TA_43871
cgtccgcccacacgttcggtgagatcattggggacatcaactacatctggaaaaagttgctggaaaacaagggcagacacatcaccttggtcgagcacattcatcattcatactcttgtagaagttgggctccaagtacagcactttagccacaaagttcatggcgcatcatagttacagtctgcaccatgttgtaaaaaaagcatgttggagtgtgatagtcagatagccggttcatatatagtagtacattagatttcttctgtattgttttgttaaaattcagttttgattgtattcgtgcggctagcaaacaagttaacatgggccgacgttttttgttgtatctggagcggatcgtcggaatgtcgtctgcgcggaggctaatttcttccaacaaggatttgtttgtcttctgctgaccatgcgcatgagcgtatg

SEQ ID NO: 43872 - DNA, 410 bp, Triticum aestivum
  Clone ID: PAT_TA_43872
cgtccgatgagttacacatggcttacaaggttaatgtccagatattgtgtagtctttgccccttgtctagaaggggtatatgctcgaaaattgtattatctttcgcccagactcaaattatatatggctgcttgatctttggttagaatttattcccggtgatcgtgtctcactaagttacctctgttgaaattgaaaaatgtatgaatgcaaaaatggtttatcaaatccatgctgattgcaagacatgcttgtatttaaaaagcaatcatcttttcacatatacaaaactttcgaagctttgagttgctgggtttggaaccgcttctgtttttggtttactgtacttctttcgatacagaggctacttcgaactcttaagtttctatttttgttgcatagtcaccgtt

SEQ ID NO: 43873 - DNA, 207 bp, Triticum aestivum
  unsure (1)..(207): unsure at all n locations
  Clone ID: PAT_TA_43873
cgtccgcccacgcgtccgcccacgcgtcctcccacgcgtccgggcaagctgcccgtgtaccagggtctcatggagggctatattggcgttgccattcctnccctgattcaagtgttggggccaccagaatcctcgtgtcgtgatgatcttgtagtgcaaacttgccccctggccgtgcacacgataccactagttgtgtgcgcccaa

SEQ ID NO: 43874 - DNA, 365 bp, Triticum aestivum
  unsure (1)..(365): unsure at all n locations
  Clone ID: PAT_TA_43874
cgtccggccgtccatgacggcgcangtgaccaggttcaagtgtggcggcttcaggctcgggctggccatgaaccactgcatgttcgacggtctgggctccttggagttcgttaattattgggccgagatggcgcgcggcgccacagagctcactgtgccgccgttccttgaccgctccgttctccgcccgcgcgatcctcctgtgatctccaacccgcactacgagttcgtggagatcgctgacgtatcggaaatggcggtgctctacggtcgtgaggagctgttgtaccgctccttctgtttcgatccggacaggctggagcgcgttcgaggtctcgcccttgccgactgggatctcgagaaat

SEQ ID NO: 43875 - DNA, 306 bp, Triticum aestivum
  Clone ID: PAT_TA_43875
tgtggtctccacgggttcgtctcaaatagcctcctacctctccattttcaacaagaagcccaccatcacctaccgcgagatccatgacctatcgttctgtctcgtttctaccccggcgaagactcgccaagcacttctgtattcgagggcaccaaggccgtcaccatgttcacttttttctaggcgctcgtcctccgtcttctctcgtttcgtcgagattgatgatcgccttggccccagggatcgaggctcgtagtttgtaattgttttcgtttgttacaatgaacaatggatgtcgaatggaat

SEQ ID NO: 43876 - DNA, 457 bp, Triticum aestivum
  Clone ID: PAT_TA_43876
cgtcctataaacgccaccttatccaatctcgagcccttctttcccgtacgcccgatcatcccgggcgatcccctacttcgtcggcatggtccgcaagttcttcgtgggcggcaactggaaatgcaatggaactgtccaacagggagagagtattgtcaatactctgatcgctggacagatcgcctctacagatgttgtcgaggttgtagtcagcccaccctatgttttccttcccaccgtcaatggctaagctgcgcccagagatccatgttgctgctcagaactgctgggtgaagaaggtcggagctttcaccggtgaagtcagttctgatatgcttgtcaacctttgcgtttcctgggtcattcttggacactctgtaaggaagagtcttatgggagaatcaagtgtatttgttggaaaaaagatgcattgcactccctcaaggcttgtaagtca

SEQ ID NO: 43877 - DNA, 462 bp, Triticum aestivum
  unsure (1)..(462): unsure at all n locations
  Clone ID: PAT_TA_43877
cgtncggcggttgcattaaccaccatctcctacctccagcattggacataccctcaccaaaaccttacttcttccccatgtccaggctgtccttcgatcacggtgcggtcgggatgtaaagtagcgctgaatggaagtgagtgatactactgcctaatcatagaatactagcagcaaagaaaaaggaatagtgcaacataggaaaaaaagagtgaagaagttgcagcatagttttagtttcagcagcccccccttttttaccttctttcccttcacctttcctcaagctgatggcaccgcaccagctgattcagaccacatgaggcgatagacaaaaaatactaccactactagcaaccccaaggcttcaaaaacagtgtcagatacttagggcccctccttttattaccattaccatatgcattagttactgtatgtcgatcagcgctgctatacacacga

SEQ ID NO: 43878 - DNA, 171 bp, Triticum aestivum
  Clone ID: PAT_TA_43878
gggaccgcacgcttcgtagctgttgtccttgcttctgcataaggtgcaaggattgctgttgcatcaaggatcatggggggtgtctttaactcctgtagatttcatttagcttgataatttagtttctcggaatttgtgaaccctattgatcataccaagccagtttaacag

SEQ ID NO: 43879 - DNA, 431 bp, Triticum aestivum
  Clone ID: PAT_TA_43879
cgtccgggcaagcggttccatagttgttgtgttgtcgtaaaaaacatgcacaggttcatatatgcgaatcccaagcagttcagtattcccaagggacacaatatcatggatagagaagaactccacatgttctgatgcttcgccatcacttcgagcaactttacatgagttgtcatttggactaaagattgaagtacctgagatgttgtctgacctcaatgtttcaaattttgtgatgactccaggcaagaggaactatgcttttgagaggaccgatgtaccaatcggtgagcagtttgtcccgaaaatcaatttcccatattaggttcctggggtaccagccgactctcagaagtgaacattttcatgtcgttcttgggacaaacaatagtgcactttgaactggtttttataaaaagataaaccaaggt

SEQ ID NO: 43880 - DNA, 380 bp, Triticum aestivum
  Clone ID: PAT_TA_43880
cgtccgtccacgcgtccgttcgccctttctggagcgccttatgaagcgcggctacgaggggctggggatggtggacgccatcgacgagtacgctgtcgggcagctcaaggagttcgacggtgagaagctcgtctcggccaccaaggagggcctcaagcttgactaggagaccgaggaggagatgaagcgccgggaggagaagaaggccttgttggatggcctctgcaagaccatcatggacatcctgggcgacaaggtggataaggtggtcgttttcggaccgaatctgggacttgccgttctgtctggtgtcctgcgatttctgttggactgtcaacattgagcggatcttgtatgctcatgcgctgttgggtcaatag

SEQ ID NO: 43881 - DNA, 146 bp, Triticum aestivum
  Clone ID: PAT_TA_43881
cgttcggtaaactatttgtcgaactgggaattcaggctgaagatttaccagttgaccaattcattgcactggggtatgatgctttatatgggtgcattttatggatattgtggcgaacatgatcttggctacggtctgttcattgt

SEQ ID NO: 43882 - DNA, 427 bp, Triticum aestivum
  Clone ID: PAT_TA_43882
cgttcggaaagatccaggtaccaatgggttcaaggttctccaaggtggagctggagtgtggaagaaagtggagtttgagaggcccaatgcttgttctcaagtcgttgccaaacatagcctgcctgcaaacccttggatccagcatttcagatcgcgtgattgcagcagcagcagcagtgcaagaggtgatggggcacaaacttcagtaggcgatctcgaatcgggtatccggactgtccctgggagcactccgttgtcacacggaagggaattgggaacttgcaagggagaaagccttcttgatgaaaattcagaggtctctgatcagaactttgttgacgacatctaggcagaatgttggcgcagtttttaagcaattgcttgcatggatttggtagattgttgcatgttctttcactttacttta

SEQ ID NO: 43883 - DNA, 350 bp, Triticum aestivum
  Clone ID: PAT_TA_43883
cgttcggctagaagaacggctcagagcatggcaatcgaccagcagcgccgcgtgaagctcatggggagctacggcgggaggatcgagcgcgcccagggtcggccgtcgaggtacgtcgacggtgagcacctgctcctcaacgtcgtctcgtccgtctcgacgaggggcttccgcgacctgctggcggcgcgcgcgggcttctccgacttctctgtcaagtactgctactccggcgaggggctggactcgctctgcgacgtggacacggacgaggacctgcgggacatgctggacatgctgctctaccgggatctgcatgtccggctgttcaacgacatgaacacgcgccg

SEQ ID NO: 43884 - DNA, 117 bp, Triticum aestivum
  Clone ID: PAT_TA_43884
gtttagatcatccaagctctcgaacgcttgcatgcaacgggatagcttcttaaatagtgatcacctacaatggaagagggcgtgtccgtttggtttacaactagctcaaactattta

SEQ ID NO: 43885 - DNA, 451 bp, Triticum aestivum
  Clone ID: PAT_TA_43885
cgtccgcccacgcgtgcgcgcacgcttccaccgaatgtgccacatgaggaggcctaggatgtggagtggcagctacagcgacagcgtcgggatgaacgtccaaaagcccggcgacgacgccgacgcgcacagcaagagcctgtacaagatattatacgtggtgagcacagcttaacacccggagatacaaaaggcgtttcacaaggcgtacttgatgtttgacccacatatgaatcctgaagatgatgaagccaatgaagaatcccagcaactgcagaaggtgatatatattgttggagaccattttaaatgcgacttgtatgatgagacttgtaaaacggtagtattacactggatgaagaatcggcagactaactccaagagtacttcaaaacatgcttcataaaggtctcagaaacggtcattgaagaattcgaagataatttcatag

SEQ ID NO: 43886 - DNA, 449 bp, Triticum aestivum
  Clone ID: PAT_TA_43886
cgtccgcccactgcgttcggttactctttcttcctatgtgtttcatccattggctccgataagacggagatcatcatggcggggatcgggcagagcgaccgtagccagaagcccatcactccggttctggtcaacgacgccaacatcttcgacggaagggccgacctcagcggagccataactgcgcagtcgcacaaagacaagaggacgtaagccaagatgcgcacgggggaagcgccccacacatcctcagaagccgacgagactatgtgatcgcctgccgaccaggaccacgccgacgacgtattggacgggaaggcgagatgtctgcacagcaccagtctatacacagaatgagatagagggcgacatccaagctgagccaggtccaagcatgattgcctctaatagtcgacgagctgacggagctatatgcgatgctaaagcgg

SEQ ID NO: 43887 - DNA, 367 bp, Triticum aestivum
  Clone ID: PAT_TA_43887
cgtccgcacgtcgccggccgcgcgagacccacagcctgcacagctacactcactcggccgccgccgtcgccgccagcccgcgatgtcgggcgcctccgggcccctggccgttctgctcctcgtcctggtcgcggccgtctccgcgtcgtcggcgggaaagggggagtcttggcgggcggagcaggagcgggaccgggtgccgtgggtgccggggcaggccttcaacgccagcttcgcgcactacgccggctacgtcaccgtcagcgaggagcgcggtgccgcgctcttctactgtttcttcgaggccgcacacgaccctgcctccaagccgttcgtgctttggctcaacggatggcctgattgttca

SEQ ID NO: 43888 - DNA, 462 bp, Triticum aestivum
  Clone ID: PAT_TA_43888
cgtccgattttacccataacagtcttgtggagcatctgtcgtagatatttggtgcaataactgatgtaccgttgtcataacattctaggcgttcccagctaatagcatagccatgaccctaatacggggaagaccccatgccataacttagttgttttttcgtcaggaaaatggatcagaatcggtagacttcatttagccagagctatctatggagtaggatgtccgtttgtttacatcctgggtacattccgtctggtcactagttaatatattaaatttatgggctaaataagttgggtatacaccactatgatggatggagaatcctttatcactgttacctacaaactcaatgtaaacctatacatcactagtttcctctagaaagttcgatactcaaaattctgtggttgaacgagcccaataataaactcataatttgcatatgcaaattattga

SEQ ID NO: 43889 - DNA, 289 bp, Triticum aestivum
  Clone ID: PAT_TA_43889
cgttcgagccaggctattacaaccacacctacttttctctgtttagaggcaggcattgcggggcgttcatctcatgacccagcaggagttacatttgacatttaagccgtatcagcttcccccaaggacaattattccagttaacgtaactttatttgttatcgtcttctattcattgcatgctgtagaggcaaatatcaggctggacaccatcctatcaaggcaagctgtagaggctaattttaggcgtgagcattatttcatctaggcatgctggataggtagattt

SEQ ID NO: 43890 - DNA, 374 bp, Triticum aestivum
  Clone ID: PAT_TA_43890
cgttcggatattattactgctgtcatgatcgccgttttgtttgcctttggctatgattgtaggggttgtgccaagggacttaagctcgctcttacccaggttatcgccacagagatcgacccaatttgtgcccttatagccctgattgagggcatgcagatcctcaccttgaaggatactttgtatgatgctgatatttttgctaccaccaccgggaacacgaacataatcatggatgttccacatggggaaccagatgaagaacatcattatctgcaccattggttactttatcatccagattgacatgaacatcctcaagatctaccctggagtctagcttatgaccatttatctcaacactgacccctata

SEQ ID NO: 43891 - DNA, 416 bp, Triticum aestivum
  Clone ID: PAT_TA_43891
cgtccgttctagccagctataagtcaatcatcttgctacaaaagtgtatttgcaagcttaagtgagagagtggtggattccaatatgcatgctagagactgaggctacttatgccaatcccgcttatgcttgcatagtcgatgccagagatggtcacaagcactactgattgacttaaatgcttctttaagatggtcccgttctagaagtaaatcatactgaatgttttgtcctgcttggcaaggggatgaaccttttgtgatgtattatccaacacacctgatcccccattagctaaggtcatgcctgacgagacgcatgttttatctgactttagggcatatgctggggggggcttcttaaaccagaacatggtaagttttcttctattgtattattaaaacgaaagacaaaat

SEQ ID NO: 43892 - DNA, 259 bp, Triticum aestivum
  Clone ID: PAT_TA_43892
cgtccgtctatattttgcgttttcttcttgagcttttacatcacactctagctgcgggtggtgtggtttcattcatagctgaggaattttttgtgtgccattcgcacagtatgagcctttgctcaagagccttatgagattttacgatttgtcgtcaatgttaacgagatactgaagcttgggctcaagcaagttttagttgtttgtctatttttcggagggcttaatgctgcatgaatccctgtagttttgctgtagt

SEQ ID NO: 43893 - DNA, 194 bp, Triticum aestivum
  Clone ID: PAT_TA_43893
cgtccgcttcgtcattctcccctagttctaagtcaggattcatcgctgtcatgtcaaatgagagagggccagatgcttcttagtgcaacatgttctacatattaccggaacggaagaacttatctatgcatcatgtgaagattgttgtggtgatagagcgttcgataggatctgaatagtcttgtgtttgtgaa

SEQ ID NO: 43894 - DNA, 381 bp, Triticum aestivum
  Clone ID: PAT_TA_43894
cttccgctcctttcataaccttgttcccgcattcccgcgccttgcctgtaatctccttcgccgaggccctcgaaatccacctcgcagccttagcggatcagaccgagaagcctttccttatgcagccaaaggttttcctcatcactaagataagctgacaaggcatttaggcctggcaaggctgacatccagcttcttgatgagcgtttgccttggtattaagaccccataggaagctatcgatgttacctacattgacaagaagtgcccattcactggaacttttgacatttatgtacagtatcatatctgttacccgcctcagtgccaagatgtaccgttccttttattgatcgtaggaactacctttattttgtgaag

SEQ ID NO: 43895 - DNA, 270 bp, Triticum aestivum
  Clone ID: PAT_TA_43895
gcggttccagacgctggtaccccctcctcgagcatggccgaagctgcctcgaactggtgttctgcgccagctccccgcattgagcctcgcggctcccggcataacgccacgcctgggcggtcgccgtctgccgtcgcgccggagtctgtatcagattaacaaattagaggtatcctgtaatgggtgccaaagagaatggtgtagtgagagatgagaagggagtttgatcagattatgaaccattcatagtgttctgttttagcacaaggt

SEQ ID NO: 43896 - DNA, 422 bp, Triticum aestivum
  Clone ID: PAT_TA_43896
cctatcctattctttcaccccctccccttcttcttagtgcatgtaaaaaagtatccaataggtgaaggataacaatttaatccctaacggacacttctaagaagctttgctcaaaactatttcaataccaatctcaaccactcctccctaaagtagattctccattttgctcctttatagaaggctgttaacatcttccttcgctcaacatattattcacttttctgcccatatttctctgcctaacacaaaattacatcattaattcatggtctctaagaggctttaccctttatgaactctaatcatacttcattcctaataatctatctcctactattgtcatttcttttgaccaccgacgtaaaaactcttcacttgaagttatgcattctatcactctactaactcaatactttact

SEQ ID NO: 43897 - DNA, 182 bp, Triticum aestivum
  Clone ID: PAT_TA_43897
ttgtaacaggttccattacatattaattacttgctttctcctctattgagaacatgtttaaaggcttttattacatgggggtgggctatcttattaaggttttggtgtttaatgatatgcttggttcattattttattttgctagattacatgttacgagttggtaatttttatggccatgt

SEQ ID NO: 43898 - DNA, 333 bp, Triticum aestivum
  Clone ID: PAT_TA_43898
cgtccggtccgaccagctccagcgcctcgtcgtcgcccagtgccgcctcaccggcgtcaacccgctcgcgcaggagatggctgctggtgcattgtctatcaagataggtaaaaaaccaagggatctgttgaatccgaaagcagttaattccatgcagtcactttttgctgtgaaagacactcttggcaaaagagaaacttgtgaatttagcgcactttgtgggcttactggttcaaaggttagggagttttttgcaagtcagcgtacacgagtaatgtaaagctgtccgtttgtcacgagagaaagctctcatattgtgtggctttcatgact

SEQ ID NO: 43899 - DNA, 160 bp, Triticum aestivum
  Clone ID: PAT_TA_43899
tggggggggatcctctcgtcctctaaccctaacacctatatccaccacttcccttctattccctctaccatgttaaggggggtaagacgattcttccgaggtcgagcggtttttcgagctcgtcgaactactctccttttccaaggacaatgtcccagca

SEQ ID NO: 43900 - DNA, 275 bp, Triticum aestivum
  Clone ID: PAT_TA_43900
cgtccgtggacgcgtgggcgcagttacatctctggataccaagcttccaaggatgactagggtgggtattctgtgttcttagttgctccaccatcgacctgcaccaatgttgcaaggtggttcaatcacattgatgcgctcctgaagcttttcggtgttattgtggtcggtcaaggtgtgaaggttctgtcattagttgtccctgtaacctcaactactgatgttgttgaggctcctgcatctgatgatgacgatgacagtgatgttgacctttt

SEQ ID NO: 43901 - DNA, 117 bp, Triticum aestivum
  Clone ID: PAT_TA_43901
cgtccgtgccaagctcaacgagccattcttgagtatgtgagtacaaacacagtccatggacgggggatggatccaaacgacttggggctccctctcgtggtcgcaagcctcgttcat

SEQ ID NO: 43902 - DNA, 448 bp, Triticum aestivum
  Clone ID: PAT_TA_43902
cgtccgccctagctaggctgccaaatgagaagagggaagaagtttaccatgggtcggcgctaccacctgaccctcctctccgtcttctccttcctgctcctcaccggccttttggctgctcatcagtcccgagggaagaaagccggtaagatagtgaccctgaccgtcctgttcccggccgcgggctcaccgccaggggagaagatcaagatctcagcgcattacgttgacgagcacggggcccgcgagcgccacttcaacctcgactgcgacgacgacgagcccctcgggttcggcatgaagtaccttctctcgaccctggaggggatacgagatgcgcgagagtctcgatccgagctctagtagtaggtggaccaaaggagtggtggatgtttgcattgtccagtgccgggtagagattggagaaggagctgctcttttcggtcca

SEQ ID NO: 43903 - DNA, 446 bp, Triticum aestivum
  Clone ID: PAT_TA_43903
cgtccgcaaatatgctgataaactgggaccaggttttcaggagtacagcaagacttacccagagaactattgcttatcacagcttatctattggtacagccagaatgcataacccgaatctagactgacaagagctagaaagggttgtatgtcattaccagatgtgtcctctttctatgtaaagtctgtaaagccaactcaagagcgagtttatggcaccagaactgtgagattcatgctatcacggatggtaagtgctacttcttcaagattaatgcatttgtctgatggcgtgtttttgagtggctgttgtggttcgacttggtcatatatgtaatgacgttgttgatggttgattgacaggagaaacaggcccaacgtccatgggcgaaggaccggatatgggtgttcaagagcgacccaagattctttggcactccaatgat

SEQ ID NO: 43904 - DNA, 452 bp, Triticum aestivum
  Clone ID: PAT_TA_43904
ccgcggggatccacgcgtccgtttgagcaatccccctctctcttcttgtgggctacgggtttccgcctaagatttcgagggtcgatcttgttccccagctatccccacctgcctatggcgacctagataccatcggcgcagaggcgccgcttttacctcttgttgccgcgaatcgagaatgagactttatagatccgagctagtcttattggtcggcaagaaaggagccatgatacctgctgtgtagctttatcctgccggctacgtgtgtcaccaattaacggactaaatcagttttagttccggcggggtacattctcaacatgaaataaatttgggatctgatcccttagaccactctaccttacatggttagatgacccacacactttcgtgctaatgcctggaatgcagctgtttactctccgggtgcagcttcagcgactgatgac

SEQ ID NO: 43905 - DNA, 155 bp, Triticum aestivum
  Clone ID: PAT_TA_43905
cgtccgtccaaacgtgctaccacgcatccgatacactgatactgcgttgattgagacggtacgggggcttcagactgtggctggagcattttgagctgttgctttggaatctgctactgcatgaggtgatcgggaccatttgtggaagttatcta

SEQ ID NO: 43906 - DNA, 428 bp, Triticum aestivum
  Clone ID: PAT_TA_43906
cgtccgcccacgcgttcggcaacctgttctcgatcagctggctcgattatttgcgcagctacacgtccagcaaaatggcgttcattgattcaacacctttcatcaagaccttggtactagacaacggtgtccagcaggacagtcacgaatttttcaccttgtttttgtctctgctcgagcggtcgttaagttactccaaggtcactgttgcgaaaactattgggcaagatttatttcgaggaagtgtgtcgcatgtgactcggtgttctatatggggaagggattttgaagcatcttcaaatatggaagacttctatgaactggaactgaatattaaaggtttaagtaattttaaaggaaagtctggatgactatttgagggtggaggcactgaatggggagaaccaatattcctgcgagtaatgtca

SEQ ID NO: 43907 - DNA, 430 bp, Triticum aestivum
  Clone ID: PAT_TA_43907
cgtccgttctgtagggaaggcgcgactcacataggtgttgagaagttgctcggagcagctgggggggtcggaatgcgacggattgacgcggctatgggcggtggccaacggcgaggaagtgatgcgcgcgttgtcggagaggcccccggggttcgatctaaagtagtagttgaaggagcggcgcacgacggaggtcctagacatactcgaggggccccacgagcttggtgggcacaacgactgcgaggtgggagcaacgagcccactcagaggtgcttgggagcgagcgagaggggctagggaggaggaactgcgaggtgcactgcggaacggtcgcgcgcgtgcgggtgcgtctcggaggacgagctccgacgctcgtccacggcgtttatgcggtgaactgagcgtgaggaggaagaaaggttgtgcg

SEQ ID NO: 43908 - DNA, 440 bp, Triticum aestivum
  Clone ID: PAT_TA_43908
cgtccggggggagcgcgtgcggtctagcgggggctagggtttcctcgcgtgtgagggacgggagaggaggagcagggatggcgcaggcggtggaggagtggtaccggcagatgcccatcatcacgcgctcctacctcaccgccgccgtcctcaccaccgtcggatgcaccctcgagatcatctcgccctaccacctgtacctgaaccccaagctggtggtgcagcactacgagatctggcgcctcgtcaccaacttcctctacttccgcaagatgggtatgccaatgaataacaatgaagctcacctcctatccctagtccaagtgcaaggccttgtgaaattcgataggatggcatggcgtagggctaggtttgcgtagattcgttgcgtacatgccactctattagtctatttgcaacatacatactgatacaagcag

SEQ ID NO: 43909 - DNA, 140 bp, Triticum aestivum
  Clone ID: PAT_TA_43909
cgtccgtagagagatccatggcggtgactgattaccgttgtttcgcgggcgatctgggctggggcgctgacgaccacaacctgcagcatgcctttatccagtacgggcagatcctatgtctccaatatcattaatgatcc

SEQ ID NO: 43910 - DNA, 433 bp, Triticum aestivum
  Clone ID: PAT_TA_43910
ggcgtccgaccacttcgagcgcctcctcctgtctcgtcctcgtcccccgtcccccgtcccctcgtcggcgcccgatctaagtcaagatgagtcgtggcggtagtgctggaggtggtcaaagttctctgggttacctgtttggagatggtgagcctgcaaagcctgctgcagcaccagctgcgaagccagcacctgctgagaaaccagcactggcagctgccgatgtaaccaagcagattccagctggcattccaggtagccgggcgaacaactactaccgtgcagatggccagaacacgggcaacttccttacggaccgttcttcaaccaaagttcatgctgctcccggcgtggctcgtccctgggctacttgtttggcgggaagggatctctgttaaggtgctgcgatgaaattgccctgtatctttgttat

SEQ ID NO: 43911 - DNA, 444 bp, Triticum aestivum
  Clone ID: PAT_TA_43911
cgtccgcccacgcgtccgcggacgcgtgggcggcgcaccgccaccacctcagccttctccacgttctactgtcgcccaagggatggattcacccgcccgcaacatgactgacagtatgccaggggagaagacggcggcgccggcggcaaggacggagcaggtgaaaagcgaggcgcacggcgacacgcttccgttgtccggaaacaagaggagacgggaggaggtgaccgcaacagacgggcatgacggcgccgccacggtgtccaacccgcgtgccccgtcgggctttgacccgcggtcaccgcgctcccccgtacccgacacacacgacggcgacagcgccgactggaaggccgcgcagaagattctagagggcctcgtcacgccgtcgcgggagcggcacttcgcggcgtcgaagccctccgacgtcgtggcgtcgagcta

SEQ ID NO: 43912 - DNA, 367 bp, Triticum aestivum
  Clone ID: PAT_TA_43912
cgtccgaaagaagttgattcatctgtgattcaggatgataactcgaggtttcaccttaacactgggtcatagctattggagtgcgattgcaataattcggagaaggcactaataacacgagaaatagttacttctgaagaaataattactagaacgcttgatcctgattcggcacttgctagtagagatgcattagccaaaacattatactcccgattgtttgattggatcgtggaaaaaattaatggctccattggacaggacccagactctaaacaactgattggtgttcttgatatctatggattggagagtttcaaaattaacaggtttgaacagttatgcatcatttatacaaatgaaatgc

SEQ ID NO: 43913 - DNA, 262 bp, Triticum aestivum
  Clone ID: PAT_TA_43913
cgtccggtcgttctgatttctgctggcagaggatgttgacactcatatcatgacaggcatggtgagtgatgctgcggccggaagctacgaacgtatcgtatcaggcggcgacgcaagaacgcttatggcatgctccgcctgtccaggttgtcgagggcagtcttatcggcgaagatagcagaaagcccacggatgaacaatcttatctcctgctaacctctgcgccgacgctaacatttgctccagaacatactcctggtgg

SEQ ID NO: 43914 - DNA, 252 bp, Triticum aestivum
  Clone ID: PAT_TA_43914
cttcgccactcttttttgtctcttgttcttaatattgtcttattgaacatttgaaattggggcatgttaaggtcagtcttacactaattacgtgtattggaaaaggatttatggtactgatttgcttaacttagtttcctgttttggggccctactgtctgtattgcttgctattaaccattgtgtcatatattggatttttccattgttttattttgtactataccattgatttttctttactatactatt

SEQ ID NO: 43915 - DNA, 286 bp, Triticum aestivum
  Clone ID: PAT_TA_43915
ggcgtccgttcctgaagatgttaaagcaaataagaggtacccggggtcctcaaaatggactgtgaaggaaggtgctgaaactgtgaaggatgattttcgcagcattgatatccttgtgcatttttcttgccaatggtcctgaggtaacaaagcccttgttggagacatctaaaagtggctaccttgctgcagtttcagcatttaagtactcgttcatctctttactttatcacttcctttccatcatgaatccatgaggtgctagtatctttttgtcattacattg

SEQ ID NO: 43916 - DNA, 387 bp, Triticum aestivum
  Clone ID: PAT_TA_43916
gcctgcggtaccgtggcgccgttccgggattgccggggggacccacgcatttcaggacgcgtgggcggcgagttccggttaatcctaaaagcagttatattaagttgactgcaaaggaggatgctgttaccggctttccaatggatcctctggtaggtgacaatggccatgttcgccgtgttcctttgatgaatgctaggcgttcatcctacactttggttcgatcaagtggcacagatcctaatgcccagagattctacacctctcatattgcttctgccgagatgtctaacccatctgttggaactgggcaagcgaggcaattactgggtagcttgtttaaccttggggacaggcgcctagtaaacaaggattttaagaagagca

SEQ ID NO: 43917 - DNA, 283 bp, Triticum aestivum
  Clone ID: PAT_TA_43917
cgttcgcccatgcgtccgctcaaagcgaggattgttttttttttttttttgcggggtgattggagtggagcatatgttggcggatcctcggaaccctaatccttctcctcctccacctcccggtttttcgtcattcgcgcttcctgcggggggcagctattttccgcttccttttcaccttgaagagcagtatccggtggcgacctaccaataccagcatgtttatcatgcgcaatcatcttttttcaggggacccgcaatccatttacccccgaggcgcctt

SEQ ID NO: 43918 - DNA, 281 bp, Triticum aestivum
  Clone ID: PAT_TA_43918
ctcccacgcgtcgcttggtcgtactcgtgggcggacgcttggtgaacccccttccgccgtcgagcttgcgtgttttcctgagcatttcggaggtgcttcttggtttccacgatgaagctgatcgctgcctacctccttgcctatcttggtgggaactcttacccaagtgccgttgttgtcaagaacatcctggactcagttggtgctgtggctgatgaagaaaagcttgggttctttcttgctgacctgaaagggatggacattacataagtgattgcatc

SEQ ID NO: 43919 - DNA, 414 bp, Triticum aestivum
  Clone ID: PAT_TA_43919
ttccgtttctctcctacttctcctgccaccgatccctaaccatggatgaacccttctcgaggagggcaaaagaagagatgaggagatcaccgagcccagttcgcgcacaggacagtaggcgctgcgatctcgcgcaggagcggagatggggctcacgttcacgaagctgttcatccggctcttcgccaagaaggagatgaggatccttatggtcggtctcgatgcggctggtaagaccaccatcctatacaagctcaagctcggagagatcgtcaccaccatccccacaatcgggtttaatggtcaaactgtttattacataaacattattttcaacgtttgggaatgtcggttggtagaacatgatcaggcccctgtggaggcactactttcattacacccaggggcttattt

SEQ ID NO: 43920 - DNA, 318 bp, Triticum aestivum
  Clone ID: PAT_TA_43920
cgtccgcggacgcgtgggcggacgcgtgggccacccatgccgccgccgccggagccacccaccgccccgcctgcctcacacagacctcgccgccggccatggccttccccaacagccgccgctccgaccctctccccctcccctccccttatcacaagacaagagaagagaagagggagggaaatcgatcgcgactgagcaggtcaggcggcgacaatggcgcgcccagacccgccagcgcccgcgtcgtcgagctgggctgggcggcgcagtcccgtatgagtaggaatgagggggcggtgggacgcctcccctgct

SEQ ID NO: 43921 - DNA, 179 bp, Triticum aestivum
  Clone ID: PAT_TA_43921
cgtccgcgacacttgaagccataccgagtaagcctctttttcaggataaacttcggggccagcggggattttgataagagcatggagcttccaatgagtaagactaggtacagattgttgcaaatccaaaggatatagacgacagcaggcaactcacatattataaatagtaccaggaa

SEQ ID NO: 43922 - DNA, 320 bp, Triticum aestivum
  Clone ID: PAT_TA_43922
cgttcgtcttcgcgttccgctgtccaattcccaattcttgaagaacattaacaaggggatccagaggaggagcaagaggagcagcagactcctgctcaacaaccaactaatcaagcaatcaggaaggcacgccgtgtggtcccccatgtgatcatggatatccagataatggtctcttgaaattgatataagtaatgattaaaggtcccattaagcctgatctctgaaaggcgtcaagtcaggagtattaacgatcctatttatggtattcttataggcgagcttatggacttgctaacgtctgtcctaatgtatttcta

SEQ ID NO: 43923 - DNA, 148 bp, Triticum aestivum
  Clone ID: PAT_TA_43923
cgtccgcggacgcgtgggcgggaacaaggcagcgtatccccagcggcttcagggggttccctcggtccatgctgtcgccaccgtacgcgggcaggctaacgccggcgtagcccagaggcaggccgatgacgccaccgccattccaggc

SEQ ID NO: 43924 - DNA, 437 bp, Triticum aestivum
  Clone ID: PAT_TA_43924
cgtccgcttgtttcagtttggacggtgcctcgacgcgctcatctcggtatcctcgccccgggtggtcatcttgcccatctccgtcgtggcgacgcggggcgagggcgacgagggcagtgccgggtttgacgccggacggggcggcaggggatgagggcggcaccgtgttcgacgccgggcttaagtaccttgaggccgtcaacgacaacgtgctcgtgtatcctaggttcatcacggatcctttcacgatttcactagacacgattcttcggcgggtagctgcacacaaccacaggaggaggtggtgttgtggaataatacgggctgtgcaaagccatactcttgcatttctttcaactggtatgacatggacatttgtatggaggtggacaggcaccttatcggaagtgacttattgagcctcgttgccacctgcc

SEQ ID NO: 43925 - DNA, 400 bp, Triticum aestivum
  Clone ID: PAT_TA_43925
cgtcctctgacgcctggggtctcgttttcttgcttgtttcccaagaagaaggagaagagcggcggctgatctggtctgcggcgatggcggcgattctgcttctgatcccttccttcaaccgggtgctggtggataaggtggtgcagcccaagaagagcgccggcggcatcctcctcccggtgacctccaagcagctgaactctggtaaggggatagctgttggccctggcagccgtgacaaggaagggaagctgatccctgttgctcttaagggaaggcgaccatgtgctcctggctgagtatggcggtcttgaagttaagcttgcttctgagaaagagtaccttctttacagagacgactacatttttgggacccttcacgagtgattcataatgtggc

SEQ ID NO: 43926 - DNA, 354 bp, Triticum aestivum
  Clone ID: PAT_TA_43926
cgtccgcggacgcgtgggcggggggttccccctctggtccgggcggtttgctgcttgggaaggagccgcgcgggttcgtggcgccggcgtcggtgggcgggcggtggccaagggtcctcggtccttcgttggttctctcgccctcggataaataaaatcggtcgatctgcctccggtgagggatttctcagattgcgccgcgcggttgggttctccggcggggcaaaggcaggattttgagccactttgcccctaacattaaatctgatttaatgggcgaccaatccaaaatgtgcctgtagcatcatcgggtgtgccgtttctggtggcgggctttttgcagaggggtttcct

SEQ ID NO: 43927 - DNA, 371 bp, Triticum aestivum
  unsure (1)..(371): unsure at all n locations
  Clone ID: PAT_TA_43927
ntcatccgtcattttgagtgcctgtgttcaatctccgctttgctgaccatgtcggatgtgagggtgggtgagccgttgtcgaagcaattgaacatcgatcccatagtccggactgaccattcgagggatctccctgcaacagtactctttccccaccgatgcgactgtccagaggacagcgttttggtgattccacgggaggcaaaccttccgattgacagagaagcaaagatggttgtggcacgggtgtcacatgcagtagtcggcgtcgccagcattaccgtttatggcgatcatatgtggagagctttcaggctttattgtcgaatttgatgaattcaggatggattgggacattatttttatgagca

SEQ ID NO: 43928 - DNA, 443 bp, Triticum aestivum
  unsure (1)..(443): unsure at all n locations
  Clone ID: PAT_TA_43928
cgtccgtccagactnctcactcctggcnctcattttcttcctcacgangccncacccgggggctttttttagggagccactaaggaaaggaagatggcttttttcgccggcaactgcggatgccgcgcccgctgcaagtgcggcaacgggtgcggcgggcgcaaatattttccccgacgtggaggccaccgccggcgccgacgccatggtcatgcccaccgcctcccacaaggggagctccggcgggttcgagatggccggcggagagaccggcggctgcgactgcaccacctgcaagtgcggcaccgcgtgcggctgctcctgctgcagctgcaactgagccggcgcccatgaggccgtccggcgaggcgagcacgaggatgaggaggacaactggacaagcaaccnccaccaccaccaccaccatcactagccgatgcatg

SEQ ID NO: 43929 - DNA, 172 bp, Triticum aestivum
  Clone ID: PAT_TA_43929
acggactcccatggagagcacaaacgcaaaggtgcgtctcgcccacactaacagaggcggcgacacattttcgtttcgcagaagaagcaagacgccacaccagaggcggcggaggccaccaacgaggcctaagggaccgacgaccacaacgccggaccgtcttccaaggttc

SEQ ID NO: 43930 - DNA, 413 bp, Triticum aestivum
  Clone ID: PAT_TA_43930
cgtccggagtccgagtggggctgccaccactttaactgaacacaccaccttcctggctgccctgcctcccctccttcctcctcacttcgcctctctcccttcctcctccccccttcggtgagcgcaggcggcgctaggtcttggaggcgggggagccatggcctgaccttcgccgctcctggggttccttcttcaaatctttcttcacgaggggtgtggggttgatcggagaagcaaggaggggtgtgttcgaggtgagagatagataaaggagcaaacaaagtgcagcgaaagaagacagagagagattgttcagagatgaagagcagcagcggcagcggcagcatcgtggtgcaagccgaccaggagcccgacctgacgctcagactttagccgtcatccgtacgcacgcc

SEQ ID NO: 43931 - DNA, 444 bp, Triticum aestivum
  Clone ID: PAT_TA_43931
cgtccgcccacccgtgcggttgctccgtgccaacggcagctccgcagatcaacccatcccaaccgaggccagccgggcccgactccgtgagaacctgctgcggaccacatgcccagaggaggactaccgggagctgtctccggcatgggcagctcatctgccgacccggataagctcatggccatggccgtcaaactaacctacctgctctttacaagacggtatgccggtcggaagagtgctaccgtcctgggccaacatgctgcaattgctcatagatccagaagggacaggtgagaaagccacagattcatttgggaaggctgcaagaggactagagacgatatgatcaccgcgggatgctgctaagcattcggaaaatgctggcgctacagcacaggagcttggactatggaatgcaatcccgaacttttatcgcatagc

SEQ ID NO: 43932 - DNA, 438 bp, Triticum aestivum
  Clone ID: PAT_TA_43932
cgtccgcgctcgcttccttgctgccaagccctctgtcttcctccccccgtttctcggtcacgcagtgacgccggcctgcttcgggatccatccatggctaggccagggctcgagtagatacatccacctgtgcgtccacctactacctgctacgcttctccggctggccagacggtgcacggatgggcagagaggacggctatgggatgggcagacgctagccacctggatgtcttttgttggggaacggcctggatcagccctctcttttcactctgggcgacatgcatctcgtggcgccaccgcgcgctgggcgggggtggccggcgcccggaacccaccatcgccgcgctcatgggcagactcgcctggctcgcgtacggattggaagtcatcgacgacacggtcgagccgctgtctgtcaacgcctggggcgcc

SEQ ID NO: 43933 - DNA, 300 bp, Triticum aestivum
  Clone ID: PAT_TA_43933
gcctgccccacctcatcgtcagcggcgaccagcggcactggggcgaggtcatcaccccgggcgtgctcttcctctacatcgcggggtggatcgggtgggtcggccgcagctacctcatcgccgtcagcggcgagaagaagcccgccatgcgggagatcgggttggcttttcctccccactcagtcctgggttcccggtccggttcggttccggtcggttcgtttgggtttatgtaccgcgaacaggaaggcatggcggacgtttagcacccgtttcttcttgggcgggcctccccctggg

SEQ ID NO: 43934 - DNA, 444 bp, Triticum aestivum
  Clone ID: PAT_TA_43934
cgtccgcccacgcgtccgcccacgcgtccgcccacgcgttcgcggacgcgtgggcgccaactcgtcgggctccggcgccgcccccgggtccgggtcggggcccctgtggtgggtgtccgactgccacggggcctggtacagcctggcggtgatgctgccgtcgctggccttcgtcgggttcctggcctggcaggcccgccgcagcttccgccgcctcagctacggccgctcccacgtcgtcgtcgttgcctactacgcgctcctctgggccgtcgccctcctcaacctcctctggtgctttctccaggcgtggcagtgtatgcctgatagggccttctcatggaatgtgttttcattgtttaccaaacctggaatgttattcttggaagttagtcttatagcaattttacttcaaggaaatagaaaccagtggttttaagtttt

SEQ ID NO: 43935 - DNA, 441 bp, Triticum aestivum
  Clone ID: PAT_TA_43935
cgtccgggtggcccgacctacggtcgacacatcacatcacggcccccttcggcgcagctcctccggtccggtctctccctccctccctcgcgtcgcccaccacagagcacacaagtcgccgcgccgcgacagctcagctctttcgtctcgtctcgtctcgcccccttccagtccctccctccggcgcgcgagcgagatcgatcgccgcggaccctagatcccgatggcctcgcgccgccgcaccctcctcaaggtcatcatcctcggcgacagcggggttgggaagacgtccttgatgaaccagtatcctgagattcgcgttgagatgcgataattgcgcccagtttagcttgtctcgttccggacagattggattttgtactggagtataagtagttgttttggcttgtgtttccttgagctttgatttaattcagatat

SEQ ID NO: 43936 - DNA, 376 bp, Triticum aestivum
  Clone ID: PAT_TA_43936
ggtatacatccctatctagacgcattccaccaccatcaactatctctgcccctttccagctcttctgcataagcggcttaatcgctagctgtagcctcattctcatcagcgtacgggaacaaggacgcttgccgaccgcaaggccctagtgcccaggaagaagtgcctgacgcggcccgtaaagtgccggtctacagtttcccgtgggccgtatcagtcgctacctgaagaactgccgatacacccagcttgttggatccggcgcccccgtataccaagccgtcgtcctatagtaccttcccgccctgcttgtgtaacttgccggaaacgcccccatggtcagctggaggagccggattattccgccccacctgct

SEQ ID NO: 43937 - DNA, 437 bp, Triticum aestivum
  Clone ID: PAT_TA_43937
cgtccggcgcacaacacgtgcctttggcaaaagtttttgcgtgtgcgtgttcatcgggatttgatgtgatcgatcctgtgggcagaattccaacaattggtatctagagcaaggttcaagacttgatcgcttgccccggggttgcgacccgactagcacctcggggcgggccatgatgctgctgggtgatgcagcaacaaggaggagagggcgatgttgttgctgggtgctgcagcgactaggaggatcatgtgatcgtcgttcggtggagcgacatggagggagacggctggttgtcgtccgcaaggcggcggatggagatcgttgacgggagcggtggtgcggtgatgctatgccggaaagtcgtcaagatcggcatccgggagttagagtcaaggagtcctgcggtttagtcgtctgtgaactcgttatgtcca

SEQ ID NO: 43938 - DNA, 439 bp, Triticum aestivum
  Clone ID: PAT_TA_43938
cgtccgggcagatgcccatcgtcaaggttggaaggatggcaggccaatttgcaaaggcaagatcgaacccaatcgagactagagatggagtgacactgccgtcctatcaaggggacatcatcaacaacgacgatttcgatgagaaatcgcgtgcaccaaaccctcaaaggttgattagagcctacagtcagtctgcgagcaccctgaatcttttgagagcatttgcccatggaggatatgctgatcttcagagagtcaccgagtggaacctcgactttctgaggcacagcacgcagggagacaggtatggggagcttgcccagagggttcatgatgccatcgggttcatgcttgctgctggtctgcctcctcagcatcccatgatgaccacagctgaattctggacatcccatgagtgccttcacttgccatatgagca

SEQ ID NO: 43939 - DNA, 354 bp, Triticum aestivum
  Clone ID: PAT_TA_43939
cgtccgcttatggtactcacactggaatggagttcagcttgtagaactctctcccctgtagctgattgcgaaatactagaaaacctccagccacatcaaatctcgatggaacttcatattgtaaggtatattggtacaacagctcccagttgggtacagttggcgtcgctgatggagctgaattccttgcaccttgttaactgcctgagtttgggaaaactacctgcactggtgcttttgtcatcactcaaaaaattacatatagaaggagctgtacaatggttgagcgtaattggtcattagttacatggtactggtgacatggcatttacctttcctaagggtttattgagc

SEQ ID NO: 43940 - DNA, 425 bp, Triticum aestivum
  Clone ID: PAT_TA_43940
cgtccgcccacgcgtccgtccacgcgtccggtgagcagcagcgtgagtcgtcggcggggacggaggggccggagatggggttcgagtcgtcggcggagacggagcggttcctgtgcgagcggctgctggacgcggcgcagcccatcgcggagcgcttccgcgcgctcttctccctccgcaacctccgcggcgacggcccccgccgcgccctcctccaagctgcaagggatccttccaacttgcttgcacatgaggctgcatttgcacttggacaaatgcaggacgctgaggctatccctgcattagagggagttctcaaggatctttcactgcatccaattgtccgccatgaggctgctgaagcccttggagctattggcttggaaaagagcatttccctgttaaaagagaagttattagctgat

SEQ ID NO: 43941 - DNA, 319 bp, Triticum aestivum
  Clone ID: PAT_TA_43941
tcgttcgtggactcatgtgctgacacgtggtttgttgtttaaaccctatcccattattccaatcagggcagccgcagctcctctccttctttctcccttcttccccctcctcccctcaccacagtcacaacctaggggcttcgccttccgtttttatgagattcaccacctcccgaggttcttatctgtcccatgttgcgaggaagccgcggtaggaggagtgacctctgtgcgtgatatgctcggaggaggagctcaaccagtgcgtcttctgccggtaggagggaagctgtcgatgagagcctagaggcggatcggg

SEQ ID NO: 43942 - DNA, 441 bp, Triticum aestivum
  Clone ID: PAT_TA_43942
cgtccgcccacgcgtccgcccacgcgtccgttgagaagaaagacggcgccgaaaaggctaatggcgaaggctaccatcgaacccacatggctgctggcactgatcataactggggacatgctgacttggggcttaaaaccctgggcctggaaaagcaagaaactgaatcagctggcaccttgaatggcaatggcaaaacagtaaacaaggttcctccttattctaagccgtacaaagcaacgagcgagaagtctgctgaagaagataataatggtttgtataaccgagcacggcatatgggagagtttggacagccggtgcaagataggcagcaaatgccagagaagctagtcaacatgcggcctccctatgtgaagccaaactctagcacgaagcccgcgcatgaaaatccaacagatcaagctgctgctaatggctaca

SEQ ID NO: 43943 - DNA, 330 bp, Triticum aestivum
  unsure (1)..(330): unsure at all n locations
  Clone ID: PAT_TA_43943
cgtccggtatggtcaagcnctgttcctctttgtgactcgtatctttgttgcgtggagaggccaccaaccccgtctacacttccattaaaaccccactcccctgcctcgcaccttcggttccgggaccccgacgaacgccgaggaagccattgtgagaggaggattgaagaggaaggggcagatctatgggcaactgcaagagttcatcttgtgcacgcctaggaaaggcccatgtcgttccggattcaaaatggaggatgcaggaactttggaaagacccatgttcctgatttagaatggaaggattaatgaccttctcaatggcgcttg

SEQ ID NO: 43944 - DNA, 225 bp, Triticum aestivum
  Clone ID: PAT_TA_43944
cgtccgcgctaaccctagcggtctgtagcatccgcctgcgtgcgtcttcggacctgggcacgccgccatgtgttggctggagatgtggctgccggccgcgggcgagggggcggcggcggggctgttcctcgacgccggcgacgcggcggcgcacggtgcgctcctcgcggccatgcccggctgctcggcctccttcggcgtgccgcgggggtggcctgagagggc

SEQ ID NO: 43945 - DNA, 234 bp, Triticum aestivum
  Clone ID: PAT_TA_43945
tcgtccgcggacgcgtgggttgaaatcgtcaatcatcttgatggttttgatgctagggggaataggaaggctctcatggccaccaacaggcctgatacacttgatcctgcacttctgcgtcctggtcgtttggacagaatggtggatattgggtaacctgtcttggaaggccgtactcagatattcagtaatcatacgcgcaccatgtacttggagcttgatatacttttatag

SEQ ID NO: 43946 - DNA, 280 bp, Triticum aestivum
  Clone ID: PAT_TA_43946
cgtccgcggacgcttgggggcaagaggatccacttgtctgttggtgccaatcccagtcatctgggggacgtggaccctgttgtgattggcaagacgcgtgcaaagcagtactactgcaatgatgatgacaggacaaagaacatgggcattcttattcatggagatgtgagatttgctgggcagggcgtggtgtatgagacgctccatctgagtgcccttccaaactacactactggaggaaccattcacattgttgggaacattgaagtgacctttataa

SEQ ID NO: 43947 - DNA, 429 bp, Triticum aestivum
  Clone ID: PAT_TA_43947
cgtccgcccacgcgtccgcccacgcgtccgcccacgcgtccgtccacgcgtccgatcgcctcctacctcactccctctcccctcctctctccccccgtctgccgccatggcccaagcttgggccttcctcctcccggtgctcgtcttcggctcctacatgaccagcctcttcttccccacctatatatccggccccctctgcggcggcgatgggggaggcagatccttgttcctctgcgcgcaggctcccaaggaccaggacccatctcctgctgtcagcaccatgtacaagaccgccttccacttccagcccgccaagaactggatgaacgatccatctggaccaatgtacttcaatggcttctaccatgaattctaccagtacaacctgaacggccccatttttggtgacatagtttggggccattc

SEQ ID NO: 43948 - DNA, 432 bp, Triticum aestivum
  Clone ID: PAT_TA_43948
cgtccgcccacccccacccccagacgaggctcgtaatcccgacccgaacccggcggaatctcgcgccggtcaaaccctatcgcacacgcgcgggctcggatcgggaggactaggttcgcgccggctgctgccctccggcggtctccacggggtcggcgtcggcggcggcggcggaggagaagagagatggaggggcttctgcacaagctcaaggggctcgacgcctaccccaaggtcaacgaggacttctacaagcgcacgctctccggcggcgtcgtcacgctcctctccgccctcgtcatgctgctcctcttcgtctcagagaccaggtcgtattattattcagcaaccgagactaagttagtggtagacacgtcaagaggagaaaggctaagagtaaattttgatattaccttcccgagtattccttgc

SEQ ID NO: 43949 - DNA, 248 bp, Triticum aestivum
  Clone ID: PAT_TA_43949
cgtccgcccacgcgtccgcccacgcgttctgtgactcgtgggcgaccccgccaccatgggcaagctcgagcgcctctgcaagaccacaacagtgaggacatggtacactgtcttgtcgaaggatctcctggatgaacacccagtattgaagactgacggcactacaacattggtcaccactgcttgacatttgcaatgccgcggtgcttgtactttgtgctgtttgtatgttcgtgcctgccttggtg

SEQ ID NO: 43950 - DNA, 426 bp, Triticum aestivum
  Clone ID: PAT_TA_43950
cgtccgccaagctcgccatggagatgggcgtcggcatgatcgccaagacagctgccgagtacgagaagagacgggagaacttcgtcaaagagattgacatcgtcatcgctgatgtggtcatggcaattgttgcagatttcatgcttgtatatcttccagcaccaactgtatctctgcatccaccacttgcaagaaatgctgggcttatcactagttttttccacaactgcccaaacaatgctttccaaattgctttggctggaagatcattctcatttctgcagaggctaggagctattgtgaaaaatggtgcaaagcttcttgcagtcagacctggtgcttctttggttggcactggtgtcacgaatgcaccgatcaaagcatggaaggctgttgacaaggaccttgtccattaaattgacgata

SEQ ID NO: 43951 - DNA, 207 bp, Triticum aestivum
  Clone ID: PAT_TA_43951
cgttctaaacaacagatatgctgacgttccactataatacttctttcacagccctggggtgggtattcatgtagaatattattggataagttatccgacaatttttctggtgccccgtttctgaaaatagattctgttactaaactagcaactgttaccatactaaatgtatttgtgtattcagtatatctacgagaagttgaaatt

SEQ ID NO: 43952 - DNA, 431 bp, Triticum aestivum
  Clone ID: PAT_TA_43952
cgtccgcggacgcgtgggccggaagcgggtgagttagcaaggagcacgagcacgggatcggagacggagcgctcgccgacctgaagcagcgctgctgatgtcaatgcggcggcgaccttaccgaagcagcactgtctagccggctcttcttcgtgctctgctccgaacccgtcgctctacagccaccaatggctgcctctgagctcccatgctgaacagcccatgacgcgccacgtgcatcacggatcggccggccccaggatacatgcctccgctgcacatgctgcagggaccggagcacgacaccttccgtcacggtggtgagctgtagcggcaaacgaggatcgatgcggccgatctggtgcagatgctggagagggccatggtgacgaacagagaaaaggcaatgccgtcggcgccgtgctactacc

SEQ ID NO: 43953 - DNA, 402 bp, Triticum aestivum
  Clone ID: PAT_TA_43953
cgtccgcggacgcgtgggcggacgcgtgggccgccgtttcttcctcacaatccccccgttcccaacccaaaacactcgtttcatccgcggcgattccccatctcctccgcgtgccgccgcggagcgctcgattccggccgtcgtggggcttgcttgatcttccgcatagcacatatatgagccagttagctggtgcttgcatcacgaaatgatccttaatcagttgcacagaagagaatcaacttagctaacgtggaattactatttctgcgaggaaagttccagtgttttttgctgctctacaaacagcataaaatctccacctcagtcagatagtcacccatctaaactgagatattatggattacaatgaagcttgcaagggatcatcccaatctgaaa

SEQ ID NO: 43954 - DNA, 372 bp, Triticum aestivum
  Clone ID: PAT_TA_43954
cgtccggcatgctctccttgctttcactcttggtgtgaaacagtagatctgctgctgtaacaagatggaggcccccactcccaagtacttgaaggcccgttatgaagaaattgtcacgggaggcttttcatacctgaagtaagggggtttcaaccataacaaggattccttaagtcccatccatgggttcgggggcggcaacaagatatggaggttcaccaaccttgactggtacaagggccccaccctttttgggggccttgaccagatcaatgagcccaaaaggcctttcgacaagcccctgggtgtttcccttttaggacgtgtacaagattgtcggcattggaaactgtgccgttgggcgttgttgag

SEQ ID NO: 43955 - DNA, 427 bp, Triticum aestivum
  Clone ID: PAT_TA_43955
cgtccgggatgcagcaaacgtgagcaactacaagcgatgcattacagattttactatttctgcgtgtgaccaaaggtccaaccatgatgagctatggtccatgaatatcaggggtagcgcctttctgtggcatcaagttcgttgcatggtagctgttctttttcttgtaggtcaaggccttgaatcaccttgtgtagttgattcattgctggatattaccaagacacctagaaaacctcaatatacaatggcaccagagcttccattgattctgcgatcttgtctattcgatggagtcagcttcatgtgttcatcagatgccagtcaggctttgattgaacacttgaaggatgaataccatcagtatatgttccaagccgctatatttgatgaggctttgacctgtttatctattccagagcctaat

SEQ ID NO: 43956 - DNA, 280 bp, Triticum aestivum
  Clone ID: PAT_TA_43956
cgtccgcggacgcgtgggttttttttttattttttctttattttttttcttttttcgcggaaggacacactaacttcggttaacctaaaactctcagtcccaccaccacaggtggagtattttatactgggggacggtgggagcacaaaagtctcactcatacagagtgatctcattgtcatactaaatgtggtgcgtaccagggggcaaaaaacaagtttggctcattacagttgtgcgtaccgttcaagacagccattgttgctgattacatgaaatt

SEQ ID NO: 43957 - DNA, 427 bp, Triticum aestivum
  Clone ID: PAT_TA_43957
cgtccggaggccgccggcgagcttcaggtggtggaatcctgaaaagctcctcttccactcccctatcctctgctcacccccaaggcacaatctctttgtacagcgaataaccaagatgatgtgtggcactctgctggattggttgcattgctggtggtgtgctccttatacttggtgttggagtactcttctggattgaccaagatgatgcaggcacccttttagtaattctggaggtattttaccattcttgctagctgagtatcaagtcatatgctatagagaccgccatgtgttgtgcttgggggagaacttcacaagcgagtctgtcggtatggggcttactttaaattcggaaggcgcagctttgggagacatccgatggcattttcgccgtgcacttgcagagcaacaaggtgaaattggt

SEQ ID NO: 43958 - DNA, 161 bp, Triticum aestivum
  Clone ID: PAT_TA_43958
cgtccgcagattttcacgacaagctatatgatctagctaatgtggtggcaacactagctaatgatgatgacaaaaccggagctgctgatgaacaacctggcctgctccatattgatgttcgtagatatattcaccttggcaaattactaccaagtatatgg

SEQ ID NO: 43959 - DNA, 196 bp, Triticum aestivum
  Clone ID: PAT_TA_43959
cgtccggtcttgatatccatggtctctatgattcatgacgagtacctcaaatatcctacatggtgcgggggttacactagtggcgtaaacctactttgcaaaagttctggaatgtgattctctaagggatcgcaattatggttgacgtaatttcacttggaagcttatgtgaggaagctttgaccttcctgaatgc

SEQ ID NO: 43960 - DNA, 276 bp, Triticum aestivum
  Clone ID: PAT_TA_43960
cgtccgcccacgcgtccgatcgcattactgcaacatttttcaccttggaccacgctggattgagggtgattttaccgaggctaaagccaaatgatgaaacacaggggacgctaagatcatgtgcttcgccgagccagcatgttaaggaaaaatgggcaaataatcagttcttaacatccatatgctatggaaggggggctgtcatggagaccatatacttactatcggctgtgtggaagagctactaatattggatttccggcttctatgagaaga

SEQ ID NO: 43961 - DNA, 327 bp, Triticum aestivum
  Clone ID: PAT_TA_43961
cgtccgctccattagaataactccattgaatcaatcaatttaactgacacttggtaggcgttgggagatagtcagaatgtactctacactactcgccatgtacccttgattaccattaccctgtcaaaataaagagctggattacatcatcatttgttctacctctaccgataccagcttgatcaggtcaggccaccaacagaatttgatcagtatgcataggacgtaccaagatggacttgaaagaggtctaggctccctggaaatggtcatggaaagaggaggtattaaatgatggaggggcatatgaatgatgatgagaatggt

SEQ ID NO: 43962 - DNA, 411 bp, Triticum aestivum
  Clone ID: PAT_TA_43962
cgtccgcccactcttacgcccacgtgttcgtccacacgtacgggcgaagatgacatggaggatggcgatggagaaaggaagtcccggatgctgcacatgttctgaaagacactaacggcctctgacacgagcacacacgggggattctctgttccccgccgtgctgccgaggactgtttccctccactggactaccagcaggtcatgccttcccaagagcttgttgcaaaggatttgcatggagcgaagaggaggctccgccatatctatagaggtcaaccacgtaggcattttttatcgactggatggagttcgtttgttaataaaaagaaactagtcactggggatgcaatccttatcccttcgtggggatgatggcgaactaccacttggtgcaaggaagagccattc

SEQ ID NO: 43963 - DNA, 395 bp, Triticum aestivum
  Clone ID: PAT_TA_43963
cttccgcggacgcgtgggctatgccactctcgtgccgtctcatcaacttcgccatggtggacggggggatttaccgctccggcttccccgccgacgccaacttccggttcctcaagtccctcaacctccgctccatcgtgtacctttgcccggtgccggacccggagaccaacacggggttccttgagaagaacggaagtaagctacaccatttcggtattgagggccgtaaggaaccatccgttgggatacccgatgagaaaaaccagggaggcgcttaaaagttgtcctatatgtaagataatattcattggttattcactggatgaaaggggagcaccaaactgtatgtgtcgtcgggtgcatgaagaagttgcagaaaagtgtcctgtctt

SEQ ID NO: 43964 - DNA, 432 bp, Triticum aestivum
  Clone ID: PAT_TA_43964
cgtccgggcacgcgtccctctcgctccctttgcccctcactccggcagacggcagccaccgtcgccgccgccgtcccgtcggacgccacgccacccgccttgccgcgcttccgttccgggacaatcatgtgtccgccacttggtacaccaacagaaatgaactacagtatcagtgattcttggagcgatgaggaactcgtgcgattcttagcagagaggaaggccgaggactccctgccagagaacgtacttgtgggcatgggccttactctgattcatccactcgactcctaccctgggaacatatgggacctgaaccagacggatgatcagcatccctttggcgatggccgaggcagatattagatcaggcaataggtgggtacctggaagtgcatagatgttcttagaacaccaacaaggaaatctact

SEQ ID NO: 43965 - DNA, 309 bp, Triticum aestivum
  Clone ID: PAT_TA_43965
cgtccgcggacgcgtgggccgcaatccacagccccgcccccgcccccggctgcggcgccgatggggtacgtgctgtcggcggtggcgagggtgctggagcagccgacggcgtggggcgcggcctgcgagatggcgctgctcgcggggccgctctgggcggcggccctcgtcggcctcctgctcggctgggcctggcgcccgcgctgggccgccggcatcgtcgcccccgccgccgacccgtcgcaggttgccatcgctcgacttctggagggcgcagatccccgcccgaattcgcgttccgttttgact

SEQ ID NO: 43966 - DNA, 381 bp, Triticum aestivum
  Clone ID: PAT_TA_43966
cgtccgcggacgcgtgggcggacgcgtgggcggcaagccgacacaaaacagtgactctggttacatgtcgggcataccgacctgctgccttctcagggcaatgcagccgacaaggagtttacttcactggaccaatgatctccatatgatcttcgtggaagcggtagagtatcaaggaggcccctatggtttggtttcttgaactatgagcagacaatgtcgaacaattctttcttttccttggatcggatatttctcgatgaatctggtgctgtgctattcaactgctgcaactccttagaggcattctatgcccaataatacattttctgtgtcttggatcagaaaatacttgatgaaactggtgctgagctgtttaac

SEQ ID NO: 43967 - DNA, 239 bp, Triticum aestivum
  Clone ID: PAT_TA_43967
cgtccgcccacgcgtgcgtatactcaagcgaccgacctgctgtatgatcacatgagcgggtcatggtgctctcctgcaattcctatggagcacgctgatgagctcaatgacattccatatgcgatgcttggatcttgctcatgtacactgctgaatattccaatggctggcagactgttgacatctcaaccgatatggctatcagagctgcatcgtccaggacccgggaacacgcttgc

SEQ ID NO: 43968 - DNA, 348 bp, Triticum aestivum
  Clone ID: PAT_TA_43968
cgtccgttcctggccaccccttcttatcttttaccgtatgaccgtaaggagcgaagccgtcgagccggtgagagccaccaccccatcccatcatccgtctccgattccgaagggttagagatgggggaccgagctatccacccgtctgtgatgcagaagtttgttggacagttccaccttgtctccagcttctctgaggttgttcgtgctcgcaacatctgcccttctgtgccatcctatgagaggcgctttacacaagcagttacatgactcagaaccgtctcataaatgccccatacatggcatctttttcaaagtttgccaatgcaccccctgagaagaataggt

SEQ ID NO: 43969 - DNA, 299 bp, Triticum aestivum
  Clone ID: PAT_TA_43969
tcttccgtccacgcgttcgtcatttatccttcttgatgtcaccacacccaattctcccgtgttagatgacttgccacattagattctttgtctactaggaatgcttatctcctgtacattgcggtgcattgggaggggtctaagaattgcatgtgacaatcgggtgcttcctataggtattttattttgcattctaatgtatagtatacctaccttttacgaccgcggaatctttttacatgatctagattggctctcttgactttttttctgtccatgtctttgcaaatatttcacat

SEQ ID NO: 43970 - DNA, 432 bp, Triticum aestivum
  Clone ID: PAT_TA_43970
cgtccgcccacgcgtccgccgaactccaaaccctagcagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgctgcgaggagatctgcatgtccggcggcctcgtccgccagaagatgaagtacctccgcttcctccgcaagcggatgaacaccaagccctcccacggccccatccactttcgcgccccggccaagatcctctggcgcaccatccgcggtatgattccgcacaagaccgcgaggggcgaggccgcgctcgccaggctcaaggcgtacgatggcgtcccggcgccgtacgacaggaccaag

SEQ ID NO: 43971 - DNA, 256 bp, Triticum aestivum
  Clone ID: PAT_TA_43971
cgtccgcccacgcgttcgctttattttactcctgcgctatcattccctgcatagtgatcgatatgattgggatacacgtagtgtggagtgaattattgttcagcaatgtactctaacggctctaccttgtggtggaccagcggcacaatccgacaatagttatttattggcgcgtgttgatcttgtgggggttattaaagaccactttcatattgtgagggtatctccatgtaaggcgcggtcttaaaggttgggc

SEQ ID NO: 43972 - DNA, 332 bp, Triticum aestivum
  Clone ID: PAT_TA_43972
cgtccgcccacgcgtccggggcgaccggtgtgggtgtaggtgtgggtgtggctcattccttccagatccggcagcctgctcctcctctaccctcaaaccccctttcttactttctaaccctatattcgagcctatcaccattcgcgcgctaagtaatctcctcgaggtcttcggcgaaggatcggtcgattaccagggatattatcaatcggtggattctggcttcacgagagggctggtggaaggaaaaagtctttttctaaatagcttgggatccctttgtagcgtcgtgcacagtgattctttgcatcgagcggagcatgggaggtctt

SEQ ID NO: 43973 - DNA, 401 bp, Triticum aestivum
  Clone ID: PAT_TA_43973
cgttcgcggacgctttttcaataacacctgtctggactctcagggttagaattggagctgctggtcctggcagggcgccttgtcctgggcgaaccagtgcccttgagaaggcaattcggtggtttggtgacaagccggggagcattgtaattgtaccagcactgggcacaagctttgatgcactcggggaggcctatgatttctacaatctctgctcgtgggagaagggatttggtataagatatgggaagagtaggctgaatgtggagagaacaaaatgcatgcaggaaattgtttgcggatgtgcgggtaaaccgggtggggaaaacacaatatcatgccgatgtgaatgcccgacattaataagactgtttctcacaaaggacattgtgtggttcata

SEQ ID NO: 43974 - DNA, 433 bp, Triticum aestivum
  Clone ID: PAT_TA_43974
cgtccgcggacgcgtgggttctgagagtgatgtttcttgggatagcgaccaggaagaggttacacgtatgaagcctgcacaaaagtgggatgacttgatttcacgtgttgtaaattcagggtcaggtttgcttctgactacatacgagcagctaagaatcatacgggagaagttgcttgatgtagaatggggatatgctgtattggatgagggtcaccgcataaggaatcctaatgccgaagtaactctcgtgtgcaagcaattgcagactgtgcacaggataattatgacaggggcgcctatccagaataaactttcggaactgtggtctctctttgattttgtgttccctgggaaattaggagtccttccagtgtttgagaccgagttctcagttccaattactgtcggtgggtatgctaatgcaacacca

SEQ ID NO: 43975 - DNA, 172 bp, Triticum aestivum
  Clone ID: PAT_TA_43975
cgtccgcccacgctttctcccacgcgtccgcccacgcgtccgcggacgcgtgggagctcaacgagccacgctagcgttagatagaacaaaatcagtccaccgactttcgatggtgcctagcacctttccgcgcgcgctcctggccgtgttcctcgttctactggtggtcggc

SEQ ID NO: 43976 - DNA, 361 bp, Triticum aestivum
  Clone ID: PAT_TA_43976
cgcgtgggcggacgcgtgggcacgaactgcgccggcgttatcctcccacttccccatggccacctcccacttcctggccgccgccgccgccgccgccacatcttcctccgccgccgccttccgcccccctctccgcttcctctccctgccgcctcctctaaccctcagccggcggcggccgttcccggtgatctgcgcggccgacgccgacgctaaagaaacaacgaatccgaaggtcccggagaaggcaccggcggcggggtccagccttaaccagctgctcggaatcaagggcgccaagcaagaagacaacatatggatgatccggcttcaacttactaagccggtgacatggcctccg

SEQ ID NO: 43977 - DNA, 268 bp, Triticum aestivum
  Clone ID: PAT_TA_43977
catccgaccactcatactcccacgcgttcgaaaacatttttaaaaacgccacctccgtcgactggtaccgtggacctttccccagcatggcgtacccctccgttttagacgggattgcgcagggcccggaggaccccatcctcggggtgacggtcgggtacaacaaggatcccagccccgtcaaggtgaacctcggaggcggcgcctacccggaccgaggaagggaagcccctctggctgaatgtgggcaggcgcgccgagcagatgc

SEQ ID NO: 43978 - DNA, 423 bp, Triticum aestivum
  Clone ID: PAT_TA_43978
cgtccgcccacgcgtccgcggacgcgtgggcttccaccccagcgggagcgcgagcgctgcgaccagcgtagcgccgccgcagcaacctccggcggctgccccgcaatggatctggtggtggtcggcgacggccctgggaggccgacgcggtgccgagatcgaggcggcggcgaggcatctcgcgtcttccccgcctcctcctccgaaggtgcccgacaggtctgttgcagtttctgaaactgctgcctgcagatcagagatatctcggaagctatctcctcggaagctcctgtaaactgaatccccactgctgctgctgctactgagctgcgctactgatgtgattgagtgtgaatttgtcttcagggttgtatcagcatggtaagagatctcgctgccagcactgcctgaaggggtagctcc

SEQ ID NO: 43979 - DNA, 412 bp, Triticum aestivum
  Clone ID: PAT_TA_43979
cgtccgcggacgcgtgggcggcgcgcccgccgagttccctctgcaggagctctaccagctgctgcttgccggtggctgcttcacctgcgtcgacgtgctcagatgctcccagcccttcatgaagaagctgcgtgatgttgttgctgatatgctgaacaggggaagctatcgcgaagcgattggtgtgatccttgcatttgacctgcaggaggcgttcccgctcgatggcgtgctgtcttacatcgttgacaaggttgtgcgcaataggaaggagcaagagagcgaggtggagtgtgatttggcgggatcgaaaaaacgtgatgaagaggagttgattctttggagatcaatatcgagatatgtgcaggagcgcacgccatctttttcagaaatgtcttgtcccagtttggct

SEQ ID NO: 43980 - DNA, 255 bp, Triticum aestivum
  Clone ID: PAT_TA_43980
cggtcaaaaaaatatcacacgatccttatctcctacaggggaaagcgcgccatggccaccggaggcgtgcacggcttcgaccacggccgcctacgccgctcgccggaagccgttgactctcaggcgtgccaccggccttccctcctccggtgacgagcgttcaagcaggaggccggcggcgacgacgagaagccgaacgagccgcggaagcgcaggaaggggcctgtgtacacgctgaaggaactatgcaggggc

SEQ ID NO: 43981 - DNA, 179 bp, Triticum aestivum
  Clone ID: PAT_TA_43981
gcgcccgatgatgacggccacgcccaactcgccgcaagactactcaatcctgacctcaaagccgcctaacgtgcaggcggctctccgtatcctgcagcagcatcaacagcagcagcagcaccagctgtgcatggcgcgcagtggcaccaagccgaccatggggatgggggggctgagcg

SEQ ID NO: 43982 - DNA, 241 bp, Triticum aestivum
  Clone ID: PAT_TA_43982
atccaatatgaccaatcgatacttacaaggaatgttgcatccgactaccatgttcgttcggggcaaggtcgggaaggggctgggcaagggcggcgccaaactccaccggaaggtgctccgcgacaacattcagggcatcaccaagccggccatccaccgtctggcccgcaagggctgcgtgaagcgcatcttcgggctcatctacgaggagacccgcggcgggctcaagatctttctggag

SEQ ID NO: 43983 - DNA, 423 bp, Triticum aestivum
  Clone ID: PAT_TA_43983
cgtccgcgcatctttgccacccttgagatccctgacctcatacgtgccggcgctgtctgcaccttttggcgctctgcctacacctccctgcgcacactcggcaagcacaagcagccccagacgccgtgcctgttctacacctctgaatcttccagcgacaatgttgcgtgtctctacagcctcgtggagaagagggtttacagcctaactctcccggagccgcctctccacactaggtttctgattgggtcctctctcggcttgctggtcaccgtcgatgagagatctgaaatgcacctcgtcaatccgatcactggtcaacagattgctcttccttcagtgaccacgatgcagcatgtgaagcccatttgtgatgactcgggtgctgtccacaagtatgcatactcaaagcacacggcaaag

SEQ ID NO: 43984 - DNA, 397 bp, Triticum aestivum
  Clone ID: PAT_TA_43984
cgtccgcttgcgagtcctatttatttgtcaagttgggtgtattagctttgcttaataagttcaggatcagggacccatgcataacctcgtatactggaatatataggtgtttcgcaacgatccttagtcctacttttgggtacctttttcattgtccagcatgactggccatttatgagaatgggttagataggtagcgaccttttggtctttgtgcgagttcacctgtttacagggtccaaagttgttgaagccatttaactttcacttttaagctatataggatttgcatttcatattgatgaaatcatttggccataattaacgtggagggcctcggtggaacttttttgattgtgttggaccacccaaccaagtgatgcataatctagcttca

SEQ ID NO: 43985 - DNA, 413 bp, Triticum aestivum
  Clone ID: PAT_TA_43985
cgtccggttcctgggtacagtattttgatatgggagattaggccctgttagaggtggtattaaaataaagttacaacatgaaaattttagaggctgttctgtagatacttaaacacatatcacttgtcaggtttcggtcgttatattaaatactatgaaattatcaaagtgggatgtactatgttggacagaattttatgtttggacttgggtgaatgtaaccagacttatactctcatattttgtcatagttgatggtgtgaggacttataatgtgataaagtatatacgttgttgcgacaccaaaatcattgaaatatatttcctttttttgctgccggtgacatctccataaagtaaggatttagataacatcatatgttcagagttcagtacttttcttatctgaaact

SEQ ID NO: 43986 - DNA, 429 bp, Triticum aestivum
  Clone ID: PAT_TA_43986
cgtccgataaactagaatattttcttctttgcattacgaaataaaagtacaaatcatttcctcgtcatattggagccacccaggagccatttttatcctttaaatgacaactcttgatgtataaaagaagcttttgcagattccattggtagtagattatattttcaccattcagtgcaattgtgttgtttcatgtgaactacgggagataagaaaaactttatagaataactgtgtttctagattcttttgaactggaacactgtgatttcattaacttgcaagcttggctggatcgccaggtgcatatacacatacaaagtcccgttcgtcctcacggcaaaagaacttggttcatgcgcaaccaatggtgctagggcgtgtgctacccttattacattaacggggacccaattccactgctacaga

SEQ ID NO: 43987 - DNA, 427 bp, Triticum aestivum
  Clone ID: PAT_TA_43987
cgtccgcagcaatggggagcgagtcttcctctacccgcagtcccagaaggtctcatccatcgtcagccagaggtaccggaccgcctaccacttccagccccccaagaactggatcaacggtatgctcttcatatgcctctctgcctcctcctcctcctcctctgcttgctttctttctgggccttctgttgactttctggctgtggccaatcacagggtgtggtctgtgatttggtttgcttttcttgttcttgggtgttactgaaaaagcaagtgatctgattggctggtgtgttgttcacttgtagaagctgagttaattatgttggtactagtattattgaataatttacctgctaaatataaatatacatgttgtgggaatttttttgaggtagtgttattaatatcgcatactggttttgct

SEQ ID NO: 43988 - DNA, 424 bp, Triticum aestivum
  Clone ID: PAT_TA_43988
cgtccggtcgatttggtgctcgggctcatctgcacctgaaatctgagcctttggttgttgccttgagatggtaaaaatcgtgtcagatgcgacagagctggaccgtggaaaaaagaggatacaggctatatactgtatggcacagtgcgcacgggtgggccagttgcgtagcttgtggcgtcgctccgtgattgcgggcgtctgagccgtggctcagaacttgtccgatgctaggccaggtcgtgaggtgccaaacgagccgtccctggactgcacgtctgtttgtggggaggtacctcgcggtaatggcgggcgtgttcaccgattccccacccagggaggagttcgcggacagcttggagcagccaaatcccgacactctagggttcctccgtctgtccatggccgctgggctgcatcgccg

SEQ ID NO: 43989 - DNA, 419 bp, Triticum aestivum
  Clone ID: PAT_TA_43989
cggtcccgatccgcaattcccaccgagacccacgcatactgtggatgttgcgctgaatctattctggacctgactagctaacattcatgtggtgccgtgtgacggtaaataaccgtggacatgcttaccgacttgctcgccgccaacttgggaaaccggttgtttatcggcatgcaaaacgccctccgtagggccatgaccctagccaacggcctctcctacggttaccacgccatctactgcccgtaacaaatgacatagtgttggccatcgtggagagcgccgaactgggcgaggttggcatcgacggctgccttctgggtagtttcttccacgactgctttcctgagggatgcgatgcggcaggccttctgacggtacccaacagcgagcgcaacctgactgccgaccagacgctg

SEQ ID NO: 43990 - DNA, 422 bp, Triticum aestivum
  Clone ID: PAT_TA_43990
cgtccgcgagaatgttacttggaaagcagtactttgggctgcagtcagcaggccctggtgaagcgatggagttcatgcacatcacccatgagttgttctttctgctgggcctgatctatcttggggattacttgcctgcctggaggtggcttgatccatatgggtgcgagaagaagatgagagaggttgagaagaaggtggatgattttcaccagaagataattgatgagcacaggaaggcaagggatgtcaggaagagtggtgcatcccttgatgatgatggtgatgatagcaaagaaggcatggactttgttgatgtgctgctctccttgcctggtgagaatgggaatgagcacatggatgatgtggagatcaaagccttaatgcaggacatgatcgccgctgctactgacacttcatca

SEQ ID NO: 43991 - DNA, 300 bp, Triticum aestivum
  Clone ID: PAT_TA_43991
tttcgcttttctttggatttttgttgtttcgatggtttatatttttaatttttttgtgacaagaagaagagagttcttaaggtgcataagaatgtacaactccaagacatatatcccatatttatgtaggagacgccacacaaggccatgctgcacgaattgggcgtgcatgcaaaagcgttaaggatagaaaaacttgcacaacctcatgcaagaggccagtttagtaatgaacgtgttctacaatctgggaccttttggttttggatagagagagaactggatctacaagggaagaat

SEQ ID NO: 43992 - DNA, 426 bp, Triticum aestivum
  Clone ID: PAT_TA_43992
cgtccgggctgatggctcccctgatcgctgatgacgtctacgagatcatcatgaagaatgctacacgcctggacagtgagataatttatgatagagactttgactacgatttctttggttttaagacacttgagaggtcttatctactgaaagttggtgggaaggttgtggaaagaccacaacatatgttaatgagggtttctgttgggatacacaaggatgatattgagtctgctgtcaaaacataccacatgatgtctcagcgctggtttactcatgcttccccaacccttttcaatgctggcactccaaggcctcaattaagcagctgctttctggtctgcatgaaagacgatagcattgagggaatttatgatactctctcggaatgcgcttccataagcaaatctgctggagggattggtg

SEQ ID NO: 43993 - DNA, 425 bp, Triticum aestivum
  Clone ID: PAT_TA_43993
cgtccgcccacgcgtccgcccacgcgtccgtggggctccacattggtgacaaggagatacttcagagtcaattgacccatcagaagaaagagacagaaattctggagaagcagtactgttcactggaacatgagatggaggcagtaaacagaagtgcagcagcactccagcagttactcgaggaaaaaacatgtgagatggagaagctgtcagacgagtgtttgatcttgaagaaatcattttcaaatgcaattgttgaaactgaagccctgaaggagatcataaaagaactgggagcttcacaaagctctctgaaatatgatgtttgcttgcatagttctgagaaggatgctctggcacgggaactacatatccttaataaaaaatatgctgctattttggagcaaaagtccatgttggagatt

SEQ ID NO: 43994 - DNA, 428 bp, Triticum aestivum
  Clone ID: PAT_TA_43994
cgtccggccggctccgcctgccaacccggcgacccggcgctcggccggctccgcctcgcctaccgcctccaccgcgctcggcctccccgccgcctactcgcgtgccggctcaccgccccggccggctcccagcctgggccgcctcgcatccggctgccgtcgcggcctcgccccgcgctcctctgccagcagaaaagagcatccggatccggctaaaaaaagaagaaagtgcgcgtccgagaaacgaagcaaaagaaagaaatgtgcgtccgactgccagatgtgcgtccgaccgctggctgcctggccggctacaaagagcccgactgatgtgtcggagtccgcctgcccagccgactgaagaataaaaagaagacaaactagtcgccgggagatccggccctcgtcccgaatctcgggggctacac

SEQ ID NO: 43995 - DNA, 426 bp, Triticum aestivum
  Clone ID: PAT_TA_43995
cgtccgccgccccctcctccttgacccgccgccgcttctgccaccccgaaagaaaaacacacacacacagtagagagcttcagcatcccctgagcgcgagagatggcggcgaagggcgacgggccggcgatcggcatcgacctcggcacgacctactcgtgcgtcggcgtgtggcagcacgaccgggtcgagatcatcgccaatgaccagggcaaccgcaccacgccgtcgtacgtcgccttcaccgactcggagcgcctcatcggcgacgccgccaagaaccaggtggccatgaaccccatcaacaccgtcttcgatgccaagcgtctcattggccgtaggttcactgattctactgtccagagtgatattaagctgtggcccttcaaggttgttgctggacctggtgacaagcccatgatcaat

SEQ ID NO: 43996 - DNA, 425 bp, Triticum aestivum
  Clone ID: PAT_TA_43996
cgtccggatctatctctcaaggatgatgctgatattgaccacccaagtttggctgttgagggagatgattgttccccgaacactgatactttggctcaagacacaggaacacttgttaattcagctggtcgtttctcactgttgcagaagtgttcaaggcttttcaagttctctcctaggacaaaggccgagcagtcatcggaacaggaagcggaaataaacattccttttggtgcgagattagaggaagcatcaccgagtgaagtagattatgagccaactcctgtctatcaggcagcaaataattcttttgatgctgagggtctcccttctgacagtggagcaagggggaatgaagaatccgaaaggcttgatatagctgatgatatccagatcgagtcttctgttggagtcgcagataattg

SEQ ID NO: 43997 - DNA, 428 bp, Triticum aestivum
  Clone ID: PAT_TA_43997
cgtccgcggacgcgtgggtgcggcgccaagaaggccgctacatcgttgccgacctcaacctctacgggaaagaaaatgccacaggcaattattacatgtgtgccgaactctgcatcttcaactccaactccaggtcacggatgtggaggctctctatccaggatgccccaaagccgcaggaccagagcaatggccagttccccaccctctggtcaaccgatcatgtgctcgctcttgatggccgtttcatgtgctgggttgactacttcagcggcgtcctgctatctgacttctgtaatatgcgcttatctcgggtgctccacttcgtgcctttccctggagaagaagagtacactgcagaggtacgtgaggaaaggtgcttcgcgcagagattccgtagtgtgtccatcagccaaggcaagatgcgc

SEQ ID NO: 43998 - DNA, 385 bp, Triticum aestivum
  Clone ID: PAT_TA_43998
cgtccgcggacgcgtgggccgcggcctgtgcgggcgcggcaggaccgataacgccctcgcggggctcgacgatatgctccgccgggggtgcgtgcccgacgtggtcacctacaccatcctgctcgaggccacctgcaagaggagcgggtacaagcaggccatgaagctgctcgacgagatgcgcgacaaggggtgcgccccggacataatcacctacaacgtcgtcgacaacggcatttgccaggaggggcgagtggatgatgccatggagttcttgaagagcctgccgtacaacggatgcgagccgaacaccgtcagctacaacatttgtgttgaagggcttgtgcacctctgagcggggggaggacacttagaagcttatggt

SEQ ID NO: 43999 - DNA, 229 bp, Triticum aestivum
  Clone ID: PAT_TA_43999
cgtccgttttttttttttttttataattttttattaatttttattaatttttttatttttacgggggtgtgggttgttaaaaattggggcagctcctctttaaaaacaacatatgcttgggttaaaaattgcttgctgcattatatattatcagctttatttcttagtgtgccttattttataaccttattaagggatttatcacgtgtttttttacatgaggtaaaat

SEQ ID NO: 44000 - DNA, 424 bp, Triticum aestivum
  Clone ID: PAT_TA_44000
cgtccgcggacgcgtgggtcgctcttcccgcttcccgaggcctccctgcgccgccccgccgacacacggggcccacaatggccgcccccgcccgcgcccgctttgtccacaaccgcagccgccgccgcgccgacgaggacgactccgacgacgaggaccagcggcggcaggacgcctcctcctcgtcctctgacgacgacggcggggaagaggaagaggaggagatggaggtcgagggttccgatgaggaggaggaggaggcggtcgccgactagccagcggccagggagtcccccgcggcagcggggaggggctggaggaagggcccgattaccatcagcctcaagaaagtctgcaaggtgtgcaagaagacggggcacgaggcaagggtttaagggcgcggtgtacatttgatgccccatga

SEQ ID NO: 44001 - DNA, 155 bp, Triticum aestivum
  Clone ID: PAT_TA_44001
gacagcgaccttgtgattggggaatagcatcaggctgaaacataaaatggattaaccaaaacaccaaacctaacttgtgcaccactactagggacaaacttatttcgggggcgacgtcccttccggcttcctaagtagacccttgatcaaccaac

SEQ ID NO: 44002 - DNA, 404 bp, Triticum aestivum
  Clone ID: PAT_TA_44002
cgtccgcccacgcgttcgattttaacataaaggtagtagtttgccagatcttaaattctaccgagggacacgcatctacttaataagaatatcttgacactccacattatctgaaaggaaaagcttatcagctgttaatttgcttaatttatcttatgcaagtcagggcttacttatttatgacaattataaaaaacattttttttacatgtttgaacaataaccttactcttttatcaccattcaaggtgtggcctcacactgctatatgcaagactcctggtttcgtgaagtcaatgggatgcaacgctatgcaattttttaactgtatattgctccctgttagcagaatgatctacactccgaacaaactcttcgacactgtagattaatgcatatgtccc

SEQ ID NO: 44003 - DNA, 376 bp, Triticum aestivum
  Clone ID: PAT_TA_44003
cgtccgcggacgcgtgggacagaatcgattagcaaccgatctcttccaagggaacaaatcaatgggcgagaagatctcggcgcgcgatgtctcggcggtgtttctgcaggccgacggtgagcaagaaggggccgccaccatggacatggagatacgtatgctgcgcgagcgggtgtgcgatcagatggacaaactggtgcggagtttgtcgtcggcagacagggaagacgagaaacggcaagcaatccccatgttgcagtccatgtccgatactatcgagcggctctgtgcagaccacggacaaccgccggccacggaggagttggatgacgaagaaggtcaggcgacggacaagcggaacctgaacgaggaggag

SEQ ID NO: 44004 - DNA, 414 bp, Triticum aestivum
  Clone ID: PAT_TA_44004
cgtccgcccacgcgtccgcccacgcgtccgcggacgcgtgggtgtagctcgaacactcatggtgcggtgcgtcaccttgccataagcagcaattggaaaggagatgagcgtgagttccagagcaccgtggagctgtcccgtataaggtcattgacggtgtatggcaagtacaggccattttacatttccaataagatgaggtttcttcgggtgctggaccttgaagatacaataggtctcactgatcatcaccttgagatcattgggaagcttattcatctcagattcctttctctaagaaggtgtttggacatctcctaccttccagattccgtgggtaacctgagacaacttgagacactagacatcaaatatacacgaatattggtgctgcccaaaaaccattaccaagct

SEQ ID NO: 44005 - DNA, 234 bp, Triticum aestivum
  Clone ID: PAT_TA_44005
acgcgtcccgggacccgtgggtccttgtacacgcgcgcggcattctccaatcggagccgccgccgacgaactcggaagtctagcgatggcagacgcgacggcaccgtgaccgctgctccgccgcgtgctctcggtccgggagccgctgctgctcatcccgcacctcctagtattcctaggcaccgtcgggtccgccttcttccacagctacgcctgcttcctccaagcctttgc

SEQ ID NO: 44006 - DNA, 427 bp, Triticum aestivum
  Clone ID: PAT_TA_44006
cgtccgcggacgcgtgggcggacgcgtgggccggcgtgtggtggcgcatttgtacggcgcaggaggctgggcgcgtcgattcgggtgaggggagtggggtccagatctggtcgaggacggggcaaccggcggcggcggcgtggctgacgctggacggagagagaggcagagcaaggcacgccgaatcgctggatggcgcacctcccctagcctccttcctctcccggtcgttggggaagcaggacggccacctctgctggacgcccttccctggtcgacgacgagcgatgcgggctgacacgatggcgcccttccgttgtggagtatcgtactaggacgacggcggttaaggtcaacgccctgctcgacgcccccatctgttgctcgatgcgcccatcccctcgctggatgagctcaacgccacctt

SEQ ID NO: 44007 - DNA, 310 bp, Triticum aestivum
  Clone ID: PAT_TA_44007
cgtccgcgatcctgtgcacctgatcagtggcacggacgatgcggacaactactacggccgagggggttacactattggcacggagatcggtgatctacgatttgaccgtatgaggagattatcaaactaatgtactggtatccagggatccttggtatacaaccatgctgagcacggaacttggatatggtcgtgggttgattcttctgaagcgcctatctgttgcttatggaaggatatcaaagcttatatttaaacgtgtacccatattactctatgtcgaaatctgatgttggatcatacaatagtg

SEQ ID NO: 44008 - DNA, 335 bp, Triticum aestivum
  Clone ID: PAT_TA_44008
cgtccgcccacgcgtccgcggacgcgtggggttccggactgtgagatgatagtttgccatctgaaggatcacgtccgtaatttgcttggtttcccggatgatgcatcggctatgctgctacacgaagcaccctctggcattgcaattttctcttttgatgagagctacctcaacggtctatccaaggacttgtggacatgcttgccaccgcttattctggtagaattcatggcatattatagggttcccaccctcattgaccttaattatggggcttttggcgatcgcctgactaaagagggtcatggaagctgtgtgggtcttgagaagtaatt

SEQ ID NO: 44009 - DNA, 437 bp, Triticum aestivum
  Clone ID: PAT_TA_44009
cgtcctccgtcattccctaatcgcaccactcacgcactggtcctcagagcaccagaggaaacggggccttcctggcgccgccggaggactaatgaggaggatggatggggctcgggaagatcgagatcaagaggatcgagtaccagagcatccgccaggtgaccttctccaagcgcatgaacgggatccttaagaaggccaaggagatcagcgtgctctgcgacgccgaggtcggtgtcgtcgttttcttcagcgtcggctagctctacgacttctgctcccccaagacctcgttatcaataatcttggagaagatccataccaactccgggaagatactgtgggatgtgatacacatgagcttcattgcggagattgatcgaattcaagaaagagtttgttagcatgcattacgagtctcaactcttgattggcta

SEQ ID NO: 44010 - DNA, 431 bp, Triticum aestivum
  Clone ID: PAT_TA_44010
cgtccgcgaagagtgccccgccgtgcgaatgccatctccgccgccttcattctcatcgctatgccgccgcctgttcttcctcctgaccatcctcttcctgctctgctccgcgcgcagcagcctggaggaggtcagggcccttagcgtcggcgatgagctggtgggcgaggccatcccgcttcgctacggccggaggctctacaggctcgccgggctacggccgcccgcgtggtacgaaatcaagatctcctacccgacctccataccgtccagcttctccattcgcctcgtgaacgatcctaatgccgttgaggatttggggagtaagaacaggaggttgctcaacacggagaagatagttttcaaggctgagagcaccaggccggtttatgttcttgtcatggtggagcctgagggtgtggttgcaaagc

SEQ ID NO: 44011 - DNA, 340 bp, Triticum aestivum
  Clone ID: PAT_TA_44011
ctgtccacatccattccccaagcaatagaggcggagaaaaagacagtcggcgttagaggatgggagggcaggccaaccatcggtcggagcggcggcggcgtctgtgggtatttgagttactggcatggcgggcctcgtaggtggaggtgcgcgggcctggaggctcagtgacgaggcggctaacggcgcaagtggaggaggggcggtgaccgatgcggactacatgcgtgtggctgcactggtcacgcgcctaggagagaacctattgcacctccgcacttcgttaaggcacattagaggcctctcgggcactctagtttgtgtctttcgagcggagctt

SEQ ID NO: 44012 - DNA, 320 bp, Triticum aestivum
  Clone ID: PAT_TA_44012
tcttccgctcctcttcaccactgtttccacagcctttttatcgggcttgtccttctcgccggaccaaggagtatctggtgcggctatttttttttcacgtctcagggtcagcatggagtttctatttaacaaattctatgaggcaatcaaatcacttgttaagaggccaagctttggttgagacccacgttatcttcagtttgatgctgacgtgaatctattatttttctatacgcatttttaatcgcttgggatagcattttgttgaataggacgtcttggtgattattgactctgttaggatagcattctgttattgt

SEQ ID NO: 44013 - DNA, 440 bp, Triticum aestivum
  Clone ID: PAT_TA_44013
cgtccgcccacgcgtccgcacctcatcgccttcttctcctacttcgcggcccgcaccacggcgccctcggccgaggacgacgccgagctccacagccgccttatccgacgggagatccaggcggtgctcgtgttcctggtgctcttcacggtgaagattgttaaggaggaacactgggagacattcatcgctgattcattgctctacgcaaagggtctcttgttggttgttacttttgttattgattattggttgactgtcggctacctactgggatttatcgttatatatgctatggctcaacagccaccttatgatggcctaggtcatttaaatcatttgaccccgttgcaactggaaagcctgctaactgaagagccaacaacacgattttggctggttgagttccggacttcctttttaacaccatgtatacaagc

SEQ ID NO: 44014 - DNA, 342 bp, Triticum aestivum
  Clone ID: PAT_TA_44014
cgtccgcgcacgtgttggttgcgataatgctatccttggagcccgtctagcggttggcgtacggtgctacggacgaaattatggatagttaggactcagaaaatataccgtgggaggggtttaagctcgagtggctgcgtgtcgatacatcaagttgttttcctagtcatggtgcacgcgctgatcgttcagcacgcttatgagtagagtggttagctcgtcagggaggtgatcattattactaacaaggtaggtgagttgtctgtcttcaactttctgattattgaagagtgataaaggatgcgtttggtggattgttagagctgtctatttatatttttc

SEQ ID NO: 44015 - DNA, 423 bp, Triticum aestivum
  Clone ID: PAT_TA_44015
cgttcggcaaatctctccgtacctacttctaccatatctcgccgtcatggacgcctcgtccagcggcgccgtctccaaggcgaagaagtacgtggtggggctgcaagctcggcggcggcctcaggaagaaggcggtggcgcggtccgtcaaggccgggctgcagttccccgtcggccgcatcggccgcttcctaaagaagggccgttacgcgcagcgcgtcggcatgggcgcccccgtttacctcgcctccgtcctcgagtacctcgccgctgagctgcttgagctggccgggaacgcctgccaaggacaacaagaagtcccgcatcatcccgcgccacctgctgctcgccattcggaacgaccaggagcttcggaagctgctcgccggcgtaaccattgcgcacggcggcgtgctgcccaac

SEQ ID NO: 44016 - DNA, 425 bp, Triticum aestivum
  Clone ID: PAT_TA_44016
cgtccggtgaaatcccaatcttcaaagccagatccctagtcttttcatcctaatggctcgtacgaggcagacggtgcgcaagttcaccggcggtaaggtgctgtggtagcagctcgccaccaaggcggtccgcaagtcggcgcctgcgaccggcggcgtgaagaagccccaccgcttcaggccgggaaccgtcgccctccgggagatccgcaagtaccagaagagcacggagctgctcatccgcaagcttcccttccagcgcctcgttcgtgagatcgcgcatgacttcaagaccgaccttcgctttcagtcctccgtcgtctccgcgctccaagaggccgtcgaggcctaccttgtcgggctctttgaggacaccaacctgtgcgccatccacgccaagcgcgttaccattatgcccaaggaca

SEQ ID NO: 44017 - DNA, 388 bp, Triticum aestivum
  Clone ID: PAT_TA_44017
cgtccgcccacgcgtgcgcgcacgattgagctgacgctgtggctcacgacccagcccgatggagcggagccggaggctcgggattaggcaccatatgatgcgcttggttcgcgaaggcgcagatataggcgcgcgaggtaatactccttgtgcaatgcagagtacctgcgcgcagtcgccattgggctgcaggacctctagcggcacgacacgtcgcgccatcatgaacttccttgccaagctataactggctcttcaggtccggcatacacgccagtcagaaccttcggatacgcgcaaccatgaggggatcgaggagattatgtacgaatggaccgattcataagaaaagccctttgatcttagcgagtagctccgttatgggacg

SEQ ID NO: 44018 - DNA, 425 bp, Triticum aestivum
  Clone ID: PAT_TA_44018
cgtccgccgaccttagctccattcattacgatctatttggggttcttcctctacaagcttcaggcgcggccatgggggcgactatccaatccgcaaagggccgccagatcttcgacagtcgcggtaaccccaccgaagaggttgatgtgtgctaatcaaatggaacctttgacaggggcgatgggtccagcggagcatcaactggagtacatgaagctctgaaactgagagaccgtggagctgactatttgggaaagggtgtgtccaacgctcgtgacaatgtgaacttgattatcgaaccagctttgattggaaaggaccttatcagttatactgatctccgataatttatggttcatcagcttgatggaaccataaactaatggggctggttcaagcataattctagatttaatgtaatcctg

SEQ ID NO: 44019 - DNA, 315 bp, Triticum aestivum
  Clone ID: PAT_TA_44019
tcttcaatatattatatctagttattacagcatatccatgtttaatgaggatgcactaggggtctggagaatgaaggctcaatcttatgttattatggttcaaggaacttgagtattatacttctcacagtggtgcgagcagtcataatgaaaagatcttttgatctattaggtgtaaaaggtgactcaagattatatagtttatagtaaggacatttaacatatagatagctgaagttacgtattttcctactatatctaggacagttccacagtttcttgaattcaatgagttttacacttattacgatggaa

SEQ ID NO: 44020 - DNA, 321 bp, Triticum aestivum
  Clone ID: PAT_TA_44020
cgcgtgggggcgaggcggacgaggtggccatttcttttcttctacagctgctggtggtagtacgttccaggatcgccggagccccggaggaagagcaaagcgtattgtatgagggagaggaagatagagatgaggtggacggctttcgcgtgggagagcgcgttccgtgccttcaacaaccgcctcaccttcaccggtcttttcgtcgtactttccgcatgtagtggaggaggcctcgtcgcatattgctgactctcagccagaccagccccagggatttaaaaagaggagaattattgttcttggtactggctgtactgg

SEQ ID NO: 44021 - DNA, 152 bp, Triticum aestivum
  Clone ID: PAT_TA_44021
tttttgcaattgacagaaaccacggaggaaggatggggtaatatacatactattatcttcagcaggcaaaacagaacaaagccctaagaatatatttctagattataacatactaaaattatttttaattatcttcaaaacaccaatcttct

SEQ ID NO: 44022 - DNA, 218 bp, Triticum aestivum
  Clone ID: PAT_TA_44022
gggactcactcatttttctacgcatacgcccaaacattcaatatcgtgtggttctagattaaccagacgggctagagtcttctcgacgacgaccatatgtgaggcatgtttggttgctcacctgtcatgcctacccaaagtcctacattgtaatcgagacccacaaggtggaggagctcaccgtataagctgttttacctaaatctctctgcaagata

SEQ ID NO: 44023 - DNA, 417 bp, Triticum aestivum
  Clone ID: PAT_TA_44023
cgtccgacccaaccccaccctcgattcccccggatcggaggcgcgcgagcgagatggcgaacatggacatggcggcggtgctggcggacatggagcgggacgcggtggcggacgcgcgcaccctgcggaccaagctggtgtgcacgctcggcccggcctcccgctccgtgcccatgctcgagaagctgctccgcgccgggatgaacgtcgcgcgcttcaacttttcccacggcacccacgagtaccacatggagaccctcgacgcccttcgccaggccttgcacaacaccgtgattctctgcgcctgcatgctcgacacctagggacctgagattcgtactggatttttggaggatggtaaaccaattaaactgacataagggtcattaaatcactgtttccacctgctattatttt

SEQ ID NO: 44024 - DNA, 353 bp, Triticum aestivum
  Clone ID: PAT_TA_44024
cgttcgcccacgcgttcgtccatgcgttcagatattgtcaaggaagtctcttcataccgggagagggtcggctacaaccctgacaaggttccttatcttcccatctctgggttcgagggcgacatcatgattgataggttcaccaaccttgactggtacaagggccccacccttcttgaggccctggaccagatcaatgagcccaagaggcccttcgataagcctctgcttttttctcttcaggacgttttcaagattggtggtattggtactgtgccagtgtgtcgtgttgtgactggagatatcatgcccggtatgggtgttacttttggaatttactggccctgaccact

SEQ ID NO: 44025 - DNA, 270 bp, Triticum aestivum
  Clone ID: PAT_TA_44025
cgtccggcttctcctccccttccggttcgggatctggttcggttcggatccgagagtaggtagcctagtctagggtttccgtagttcggagaggagagaaagggagagattcatggcggtgacagagtaccgctgcttcgagggcgggctagcctgggccaccgacgaccacaaccttcagcaggtcttcagacagtacggcgagatcctcgacgccaagatcattaacgaccgctagactggcaagtcccgtggcttcggatttttcac

SEQ ID NO: 44026 - DNA, 322 bp, Triticum aestivum
  Clone ID: PAT_TA_44026
ctttatatttttggttgacggcaactttaggaagtccgtagacgcctgctgtgcctctgtaagagttatcttttctgcttaacggcctgccaaccctgtaaacggttcatccggaggtagggtccattgtccgtaagagcaccgcacgtctcgcgttgtcctgtgcgccccctgctgcccatgaaaatcctgatgaccgagtaccgttcacgccctgtcgtactcataaccgcattaggtcttccaaggtgaacatccccttgcctacattgttccattgtccttataatgttcaaatagatcgtgactttactgtatatta

SEQ ID NO: 44027 - DNA, 402 bp, Triticum aestivum
  Clone ID: PAT_TA_44027
ctttcgctgacgcgtgttgctagctaaacaacatacagtttcttgtatcataattaggataggtgggtccaatacaaattattgggagatccacagcagactgatggcgctctttcgtcgcagggcctcttccggccttctcctgctggtacttcttgtggacacagatacgtcgcgctgccgagctctactgtaggtttgttccctcgatgatgatgctctgctgaccgtggtttggtttgatgtgcatgcagagatgggggcgacgacaaccaatgtggctgaggcgcgagactgcgtgttgcagagccacaactataagggcgcctgccttagtagcagcaactgctccgccgtctgccgcaccgagaacttcccccgacgagtgccacactccgaact

SEQ ID NO: 44028 - DNA, 178 bp, Triticum aestivum
  Clone ID: PAT_TA_44028
cgtccggacgaccagtcccttcagaacgccttctccaagtacggcgacgtcatcgactccaagatgcatcactgtcagggagacgggccgatcccgtgggttcgggttctgtaccttctcgttggacgaggcgatgcgccaggcgatcgaggtcatgaaccgtcaggacctgtacggc

SEQ ID NO: 44029 - DNA, 241 bp, Triticum aestivum
  Clone ID: PAT_TA_44029
tctttcgctgacgcgtgggtgcgtggcatctgttcttctgatgatgcacctgagcatagaatctggcgatgtattctgttggtttacgattggactgttatttgcctttgatgctctgggcctatactggatttttcagtcattccatatctggtttcggattctaaaagggaccttgctatcactctgttactttaatggtccctgggtgactcgtattgatttgattctgatcactttt

SEQ ID NO: 44030 - DNA, 421 bp, Triticum aestivum
  Clone ID: PAT_TA_44030
cgttcgtccacgcgtatcgcttagcccctccccacctgccgtcttccccgctcggcttgggctcggttctcacgtgccggtgctgtaaccctagcgcggcgccggcggccagcgtgccgggcagcaggcttcggcgccgcgtgggccgttggggcatgctgcagttgtcaggtgcgtgctggcgtcaagtgcaagcgagctgtggggcattgacaggcggatcggcatcattagtgaagctcaagttcaagctaaagatcatcttagggatctttggattgtctatatcatcttaggaaggagtaagccatggggagcatacatgttgacgctgttcttcaaataggtggagttatttacacctgactatgatggtgattaaaactattttggctgttaggcgcatgcgatgcttgtgaaa

SEQ ID NO: 44031 - DNA, 257 bp, Triticum aestivum
  Clone ID: PAT_TA_44031
ttcccggcgggacccacgcttccgctaaaccattgctctcctagcttgggtttgagtcctctgctcgcgcatccaccgtatgggtaccacgccggcgctccacgacacgctgctcgaatatacttcgcgggagaactggtacaagttctttgtcctccgtggggatggcgacagcttaaagtggcacgcggagtggcccctaatcaaggccccgattctgtcactcctccatggggaagaggggtcggagatccttg

SEQ ID NO: 44032 - DNA, 159 bp, Triticum aestivum
  Clone ID: PAT_TA_44032
tcatccgctcactccatccctggctcgatctcctgctgtacggatgagctcctgctcatggctgaggttccttacctgtcggcacgagaacatggatgcaccactcagactgtaccccagatcgagcctccctttctctttccttaattacaaatcact

SEQ ID NO: 44033 - DNA, 356 bp, Triticum aestivum
  unsure (1)..(356): unsure at all n locations
  Clone ID: PAT_TA_44033
gcgcgttcatntcattctcaaccccctctcccccgttctacttattgtacttannccccgctccactccgaccgcgagccgctccacacaccagtagcctgcctgcctgcctgccgccaaggcatgacggtgnnaacctgctgcctaggggctggctatgtaagtggcccaacaatggcgggcattgccctaagagccctgacattcaagtggtagtggtagataccaccaagtaccggaatgaatgcatggaacagagacacactgccaatctatgagcctggcccttgatgaagacccaaaacactgccgtggaaagaacccttttttcagcagtgacatcgagaagcatagtt

SEQ ID NO: 44034 - DNA, 102 bp, Triticum aestivum
  Clone ID: PAT_TA_44034
tcttctctaccacgcttccgtcctactcgttcgtccacacatctcggttctgctgaagaaggtgctggtggcaagtgatgatttggtgttggattctttatt

SEQ ID NO: 44035 - DNA, 122 bp, Triticum aestivum
  Clone ID: PAT_TA_44035
actatcctccctttatctatcgtcgattcacactgtctatatcttttgtgggcatggcagacctgtgggtcctggctgtaaggcgatgtgtgagtggctgtggacaatccccttggagtgca

SEQ ID NO: 44036 - DNA, 137 bp, Triticum aestivum
  unsure (1)..(137): unsure at all n locations
  Clone ID: PAT_TA_44036
acnttcgctgacacattcactcaacatcattctgtagataaagggatatatgaaatgggggctagggcaattagtctttagcttttgcccaaattacaaacttacatccacattttggattctagatgacaacttga

SEQ ID NO: 44037 - DNA, 405 bp, Triticum aestivum
  Clone ID: PAT_TA_44037
cgtcctttctccctgtgctgccggaccatctgatagaggacatcctggagcgattgccgtcgaagttggtgcacaggtgccgctgcctctcccgcgcatgggccgccgcgctgtcgttggactccttcgccgaccgctacctcaagctggccaaccgccgcagctgcccgaagatcctcttcctcaagactcggcgtaccatgggcccaagatgcacatgtggtcgccggagcaccctggcggcgcaccgctcatggacatcccgcgtgatctcgtgcgaaacagctttttacacaacactatacggcgtcccgcgcctccttacccaaccatgccgcgggcttgatgccctacaagttaccggcaccggctttgggatttactacgtgtgcaacccggccaccg

SEQ ID NO: 44038 - DNA, 349 bp, Triticum aestivum
  unsure (1)..(349): unsure at all n locations
  Clone ID: PAT_TA_44038
acatccttaccttcttcaactggtactacaccgggctaattatctttttcgtcggtggtgttctggtgatggtatacaaacaggagtacatggggtgggtcttaatcttctccatgcccagtgtgctaatgctcagcctatcttatgctctctcaggccggattgcctttgtacctcaagaccnttgccgacaggagcgtgcttgtgggcatcgtgcaaagtgctctacttcagctacaataaccggggcgagcttttggccacgaagtcttgtatagcgtcgtgctttcacatacaaagcttgtttcaggccttgagttcccacacaatgaagatggggtacatgaac

SEQ ID NO: 44039 - DNA, 424 bp, Triticum aestivum
  unsure (1)..(424): unsure at all n locations
  Clone ID: PAT_TA_44039
ncatcctccctaaccctcccagtgctccccccttctcaacaacctcccggcgcatctccgactccgtgggccgtaccaagcaaacgggtaggaactccaccggcggcaaggcgcctaggaagcagctggccaccaaggcggcccgcaagtccgcccctgccaccggcggtgttaagaagccccaccgttacgccccggcaccgtctcgctccgggagatccgcatgtaccagaagagcaccgagctgctcatccgcaagctacccttccagcgcctggtgagggagatcgcccatgacttcaagaccgacctccgcttccagtcctccgccgtctccgccctgcaggaggccgccgagtcctacctcgtgggggctcttcgaggacaccaacctttgcgccatacacgccaagcgcgttaccat

SEQ ID NO: 44040 - DNA, 133 bp, Triticum aestivum
  Clone ID: PAT_TA_44040
tcgtcctccaaatcccggcgttctgcgactggaacatgtgggaggagatgcccgtcaccttaacttctagccggcagtcacctttttcttcactgtgcaggcattggatgacgacctctacctcttcaagggg

SEQ ID NO: 44041 - DNA, 261 bp, Triticum aestivum
  unsure (1)..(261): unsure at all n locations
  Clone ID: PAT_TA_44041
acattctctccttcttaggtttcagctctcctccgtctccggtctagagagcttctcagagtgggggcccacatggaccagccgggccaggtggtggttctcgcgctgtcgacccccggcgatgagcatcccaagatctaccttatgaatctttgggccatcaacgagggtccgcccangccaagttctggtacttcctcaggaagcttaagaacgtgtataaagccaactgccgaatgctcgtcattaactaagattttt

SEQ ID NO: 44042 - DNA, 430 bp, Triticum aestivum
  Clone ID: PAT_TA_44042
cgtccgcccacgcgttcggaaataagtaaactggagcagtcagaggtttctaatgttgataacagtaccattccctactgtggttgggctcttggaaatcttataactctagccacggagcatgatgatttatccaattcgggttgcttcattcaagggctagattgttgcctatatgttgatgctttaactgtatttcccaaaacttactgaaatgttttgaagaaagcatgggaatgcttcattgtattgatgatagggccaccaataatacatcaattactgaagaagctgacaccaatgatagctgccgcacgaaaacattgtttatggaccttctaaagccaatttaccagcagtggcacctcaaaaagctattgatattggcaaaggaggatgttccatgcgacagggaaaccaaccatgacct

SEQ ID NO: 44043 - DNA, 333 bp, Triticum aestivum
  unsure (1)..(333): unsure at all n locations
  Clone ID: PAT_TA_44043
agaccgtccgtaatcccgggggaccgatcatccacntacacatggtctcgcccgccgccgtctacttcttctactgctatcggatacttatgggttgcttccagtatcagccatgggtaaggagaaaactcacatcaacatcgtggtcattggccatgtcgactctggcaagtcgaccaccactggccatctgatctacaagctaggacgtaagacaagcgtgtagacgagaggtaatagaaggaaaccgctaatatgaacaaaaggcacttcaagtacgcctgggtgcttgacaagcttaatgccgagcgcgagaggggtatctaccatttg

SEQ ID NO: 44044 - DNA, 298 bp, Triticum aestivum
  Clone ID: PAT_TA_44044
cgtcctctccgctccttctagtcggcggcgactcctcccccatctccctggtccggcggtcgatggtgagcatgaatacgaaggggcaggaggactatgcgcccgaggagcgcgtgccgtacctgccgtggatgcggcaccccgtcgacatcgactccttctccggttgccccgtcacgagcctccgcgtcttgacccctgattggcagaagtggtgcagcggattgggaatctaatctttttttccggtttatgtttttgacatggttggaaacaatttggtcctggtgctttacat

SEQ ID NO: 44045 - DNA, 314 bp, Triticum aestivum
  unsure (1)..(314): unsure at all n locations
  Clone ID: PAT_TA_44045
gcncntccnctctcttcttgctgagctgagcacgccccttcttttttaactaagggctcgtggcagtggcggggctcgctccgacggatatgctgtgcacccggctcaacttcgccggctccttcaggtacgcgacagcggctccaactggtggcgcacagaagatcgtttgcctctttgatcgcttcagaagaagcctgccctgaagccaaagcccgcccccgtggccaccttgagcgtaagcattgactacgagctctgcaaggggtacggccctgacaggagggtctactggcccaacggactttcttgac

SEQ ID NO: 44046 - DNA, 434 bp, Triticum aestivum
  Clone ID: PAT_TA_44046
tcttccgtccactcgtccgggcagctcggctgctcaactcaaccccaactcaacccaggccagccggcgtcgaccctagagaatctgcgaggagcagcatcggagaagaagaaggagacggtggtctctctccgccatggccagctcgtctgccgacccggagaagctcatggccaaggccgcaaactgcaagtcccctccccctctcctttatctcttcccccctcccccacaccgggattccccttgctccttccgatgcgcgcgccgtctgatcgcggcccagagggcggactagtcgaggtgccgctctcgaattagagttttctacagtagagtttttctttcccgatcgtggattggagcgttctggatctgtgcctgatcttaggtgacgcggagctagcgattttttttaatgaaaatatgtggcg

SEQ ID NO: 44047 - DNA, 218 bp, Triticum aestivum
  Clone ID: PAT_TA_44047
ggcgtccgttaacgcttgggttgactcccgattcgcctccccctacttcttcgtcgaccgttaaatgggccgggagccaggtgtttaggccccgatgcctgcgaagaacaaggcggcggacaaggtggtgaacccgctgttcgagaagatgccgatgcagttttgggatcgtgggcgcgctggcccccctagggacctccaccggttcgatatgtgtc

SEQ ID NO: 44048 - DNA, 232 bp, Triticum aestivum
  Clone ID: PAT_TA_44048
tcttccattaacatttctttttctctccctcgcttggggaagaagatgaagaagttgagggagggggggcgagcgccctaggctcccgactcctttatcttttgtcgtcgatctgatcttaggagccagggaagatgcattccaccaatttgctcttcgaggagcccatccggatggtctcagtggttgagccatgcaagtcgaacttcttcccggcgatgacgaagattgt

SEQ ID NO: 44049 - DNA, 428 bp, Triticum aestivum
  Clone ID: PAT_TA_44049
cgtccgcccacgcgtccgcccacgcgtccgcccacgcgtccgcggacgcgtgggcggtcatgtctgcatcacggtcggaaggcgatgaggccctcgtcaacgaggtgctcaccgacgatgagctccgtgcggtgctcacccgcctgaggcccgagtcggagcgcgacgcgttcgggctcgtgtgcagcgctggctccggatccagagctccgagcgccgtcgcctgcgcgcgcgcgccggtccgtccatgctgcgccgcctggcagcacgcttcccgggcattctcgagctggatcttctcccagtcgccgtctcgctcgttctaccccggtgttatcgacgacgatctggacgtcattgcaggggggttctgcaatctgcgagtcctcgccctgcagaactgcaaaggtatcactgatgttggaatg

SEQ ID NO: 44050 - DNA, 138 bp, Triticum aestivum
  Clone ID: PAT_TA_44050
cgtccgtgtagctaaagcatgcataacatatttgccctgcgaggtttttggaccttaggtcgaggggagtcgtagcgttattactgagtgtaatttgctttccatgaaatgagacaatgtggttggattcaaaaataa

SEQ ID NO: 44051 - DNA, 402 bp, Triticum aestivum
  Clone ID: PAT_TA_44051
tcgtccgcccacgcgtccgatcatgggaagcctgatcagtacatggtaaagccgcttttatttttggggaacccagagactggtggtcccccaccaatgcttgattgtaactaaccattatgcatatatttcttatactggtgatgcttatgctgtgatccttccaggatatgcctcgctcatgttgttattcccctattgaatgctgccacaaactctcgtgggccgctccctggtgagcctggatcagaagagccaatgtttttttatgctaagcatatccattcaattcttatgaggaggcagaatcgtgctaaattggagggctcaaataagctggtgaaaggccggaagccataccttcattaatctcggcacccgcatgccatgaagcgagctcgt

SEQ ID NO: 44052 - DNA, 216 bp, Triticum aestivum
  Clone ID: PAT_TA_44052
ctaaaataatagctccctgctcatgctccgcctcgcgtggcactctgtcgggaccttctacgtgtcttccaagacaggcgtcctgttcgggactatgaagaatcctgcggagcaagcgcactccttcaacgcgggcctggacatcgctcctcttagctcgagcccattaatgaggagatccccaccatcttctacgccgatctcttaccagtttgc

SEQ ID NO: 44053 - DNA, 319 bp, Triticum aestivum
  Clone ID: PAT_TA_44053
cgtccgcccacgcgtccgcccacgcgttcgcggacgcgtgggcggacgcgtgggcgcgcgcgtgtgatgcatcaactccactgcactagctacgtaccttgcgaccgagcagccagagagatggagaggatggtgatgaggctggtgaggaacaagcagtccttccttcagctgcaaggggccgcgtcggtggtctagctttgtagttcttcgcctactggaccgccggcgccgtcgcgttcttcttttacactctgtagtagcagcaggaggaccaccctggtgtgttaaacattagggatcaccgtcggtcatctta

SEQ ID NO: 44054 - DNA, 446 bp, Triticum aestivum
  Clone ID: PAT_TA_44054
cgtccgaaaaaaaaaaaaaaaaaaaaaaaaaaaaaaaaaaaaaaaaaaaaaaaaaaaaaaaaatagggcggacggtataaaagaggtacagggttcacgacccgtgcatgctaatgctatagcgttttctttaggggccccctaaattccattgcctggccctggttttaccgcgacgtgcctggggaaaccctgtggatcccattttaattgacttgcctttcgtctgcttttgggcaggtggcgtgacccggaccgggccccgtccgcttcgctttcccaacctgtggggcgactggaaggcgcccgggacccgccctttagccgcggattaagcgggggggctgtgggggttacccgctacgggtcccattcccttggcggcggcccaaggcccgttcctttcttttttttcccttcctttctcgggccttccccctgatttt

SEQ ID NO: 44055 - DNA, 429 bp, Triticum aestivum
  Clone ID: PAT_TA_44055
cgtccgcccacgcgtccgcacgcatctctctcggctccggcaagcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgagccggccaaggagaccaaggccaaggcggccaaggccaagaagccctccgccccgaggaagccccgcgccacccccgcccacccgacctacgccgaggtaaaccccgagtccttcgccgaatctagccccattctcgttgtatctcgtttgaattgctctctgttcgttcgtgtttgcgcttgatctgatggtgtttgcgtttgcgcagatggtgtcggaggccatcaccgccctgaaggagcg

SEQ ID NO: 44056 - DNA, 189 bp, Triticum aestivum
  Clone ID: PAT_TA_44056
cgttcgcccacgcgttcgcggacgcgtgggctttcattcttcccgttagttagttggcgatcgcgagcgtatcgtatcgtaaggggactcgtccgtcctgtcctgcctccttaccttgttttcgtagaaagatccatttgggtggactggcgggggtttccctgcatactgtatgcagcggttaagccg

SEQ ID NO: 44057 - DNA, 262 bp, Triticum aestivum
  Clone ID: PAT_TA_44057
tcgttcttttacgcttggtctgactcgtgtgcatcgctttgctccccctcttctctcatgggaagaccggaaggagcggatccgtcgatccgttaagagcctccacctccatcctatcgtccgtcttcgcttccgtagggtcagagattggcggacctgactaaccaccccgttgttatgcagaagtttggtggacagattcaccttgccttcagtttttttgagggtgattgcgctttcaccatctgcctttttgagccat

SEQ ID NO: 44058 - DNA, 257 bp, Triticum aestivum
  Clone ID: PAT_TA_44058
ctttcggttgtcttttcctccccacttagtcttttgttctcggtccggttcggttccggtcgggtcgtcagggtttaggagcggttaataggaaggcttggcggactgttgagtccgttgctttgtgggctgcctctcctgggccaccgatgaccagtcctctccagaacgccttcttcaagtactgtgacgtcatcgtctccaagattattactgatctggtagattgtctcgtctctgcggattctggttcgtca

SEQ ID NO: 44059 - DNA, 333 bp, Triticum aestivum
  Clone ID: PAT_TA_44059
cgtccgttgtaaagagagagttgatgtctggaaaatgtatcatgtcaagggtgttattcccatgagtaatgggacaagcattggtgtctctgaaggttggtcatcttctgacattgatgcatttactgaactaagtgttgcggtgggctctctgttctgttgaaattcttttcagccggcattgctccttatgttatggcttacggtagtctcctcaagtttctgaagagattgcttatttagacatcacatttatggactatcctttttgcaggttttagtgtaattagtatattgcctggcatttgtcttgtttactgtaaatgttcattt

SEQ ID NO: 44060 - DNA, 255 bp, Triticum aestivum
  Clone ID: PAT_TA_44060
ttctttcgaaggacctgtggaacacatacataaggggatattgttcatatatgatagggaggaggttgaacatgcagggtgcatttgtgcaaaagctacaatcgtgcattattgtcggtggatcgactgatggtcgtcgtggaaatggtgtggatgctgcatatgctaggatgggagtcttgagattccgaacaagtattttgtattcttcaggaatgttgtccccaagaggaccacatatgaactatggtggaa

SEQ ID NO: 44061 - DNA, 386 bp, Triticum aestivum
  Clone ID: PAT_TA_44061
cgtccgtgcatgcccgctatcaaattacagctgcgcaagaacagggggtgttctcaaccatcgtgcgctcaaaggatcttaaagctgggaaagatgatcctagcgtagtggctattaaaattattcgccagaatgaaacagtgtataacgccgctaagcacgaggcttcaatattacacatactggcaagcgcggatcgtgaggacaggcgccactgagagccgtacatttctagtttcatgtaccgcccaccatctttgcttagttcttgaatctctaaatatgaacctgcgagaggcactaaacaactttggacacaatattgggcttaaactcactgctcgtaagtcatattcaaagcatctttctctcgccctgaagcacct

SEQ ID NO: 44062 - DNA, 440 bp, Triticum aestivum
  Clone ID: PAT_TA_44062
cgcagaaagcattagtatgacgatcatgcggatgttcctagctctctgcgcccttgggttcgtcgcaggagtagtagaagatggatcgtcgtttgacgtcagcgcttacccggtcaagtgggacgaggacccatctgtgggatcaggtgacgtggccgctccaccgtctcccggtactgaggcgccggcaccgcctccgaagcatcacatgatggtgaagaagggcatgctgtttctggagcgcgacctctttgccggggcgctcctgccggcaaacacccggctgggctacgtcagacgcacgagttcaccaggcccagtcatttcaagtactacaagcccagtaccacccttcagggaggatctcggagactctccagttctgcgaggaggcaggagacaaggaaccacacgtgtgcgcaacgtctgtggcagccgcg

SEQ ID NO: 44063 - DNA, 418 bp, Triticum aestivum
  Clone ID: PAT_TA_44063
cgttcgattcaacgtctggtcgttttagcaaaacagcttgtcgtttgtagcttttcgttcccgggttgcagcaaaaatggagcgccactacgttttcccgtaccaatccctgacatgtagcaaaaataattacaggttccagctgttacagatgctgcttctagcaattcttctgccggttgcaacttttgtgttcttgatttcatcaaaaatgacagcaatggcgcaatccgtttttcaccctaagaacaaaagtcctggctggtttcatttatttgtgttgttggttccaactttttgttctgtcgggtgtagcaccgtattccatgtattgttcacgctggcttttggatgtagcaccattccatgtttggtgaagtttctgtgagcgctggtttcagttttttgttccgttggt

SEQ ID NO: 44064 - DNA, 287 bp, Triticum aestivum
  Clone ID: PAT_TA_44064
cgtccgccaccattgtagcttccgcaaactctcaccttattattcatagtgagcatccttgcattacaaaaaattggttcaattttaggcaacttgggtcgtttaggctgcatttttattttattatgcggggaactagccaacattgtaagtagaacttgggaaaaggatttgtgatcttgaaccaacagcagctcgcttctcgcgagttgagtatgataatccttctttatctgtgaaaaataaataatttataattgtttaaaaaaaaaattaataaataaaaa

SEQ ID NO: 44065 - DNA, 434 bp, Triticum aestivum
  Clone ID: PAT_TA_44065
cgtccggccgccccgacatcgacgggctcaccggcacggagtccaaccgcctcaacgcgtcggacccctcctccccggagatcttcgtcaccgacaaggccggctacgtcgactcggaccccggccacggcttcgaggacatccgcgagcagatcttcggctccgccgacacctccgccgtgccgcccccgatgtcgggcttcgcgcagaacgcgcgcggcatgggcctcggcatggcgcagaacgtcatgagcggcttcgcgcccgactccgtccccgtctacgccgcgctcgccgacgagttcgccgtgttcgaccggaggttcgcgtcggtgcccacctccacccagcccaaccggctcttcgtccactcggccacctcccacgggctcaccttcaacgcccgcaaggacctcatcaacggcttcccgcag

SEQ ID NO: 44066 - DNA, 341 bp, Triticum aestivum
  Clone ID: PAT_TA_44066
cgcctcccctccccttccctttctcatcaaaacgccatgtctttcttccctacccccgtgccagacgcttgagccggggcgatggcctgcgacgactccttcatacaccgaccagctctactccatgttcacggaggacatttttcgggtcactcgtctcctcgacaactaggttcgtgttctcaatgacgaactgcatcggaacaacctgtagcttgagaacgttaatgacaagatcaaggagtattaggagtaaaataaagttcaacaagcaggtgccttactttggttgcaacatcgtcgagatttcggaaaattaaccctgaaaatgatgcttacag

SEQ ID NO: 44067 - DNA, 381 bp, Triticum aestivum
  Clone ID: PAT_TA_44067
cgttcgaaaatgaatagttttacaacaagaaggaaggattatattttcttttccattgtccgtgaggggacaatttggtaactgttgttgccatcgacggatgcacaatctggaacgagtgcttaacccaaaaattgtcatctaaaggtcttactattttgatgttaaatgtttctttattgacatgtggtccttcttttttatctgattgcatataaaaaacagggccagagtactatttgtttactacacttcttgcctttggctcttgggctgacatggtgcattgatagttggttttttcaggtatggtcattacattcagtttgcttatttcatggatttgtacacacagtgggggactaatgctggatgacaaag

SEQ ID NO: 44068 - DNA, 418 bp, Triticum aestivum
  Clone ID: PAT_TA_44068
cgtccgcccacgcgttcgtaagcatatggcttgttcattgcatatttattaagttcaagaggtagctattttatgtcatgtccctatattcatgccatgcttggtgatttgctaacatcatttatttcattcatggcaaggagcaccattgtaggagctatgggatcatggattttcagacaatgtgttttgtagataatgcttatgactctactctggtggaggaatttattaccaattatacctgatcttttgagctgctagatatttgtaggttatgtgggcatgtttagttcggcattagtacattagtttttttatgcaatattaattttatacaattttttatgaattagattatcattgattttttcagttatgcttttctaatctctgaacttttattgactgttgtttt

SEQ ID NO: 44069 - DNA, 427 bp, Triticum aestivum
  Clone ID: PAT_TA_44069
cgtccggcccttgcagtcgcagcggcgcgcacacctcttcctccttcctgaagacagggccgggggcggccagagcacaggatggggaccgtccccgctcccgcagccgataccgcggcctccacggcgcgcaccgtgaaggatgtcaacccccacgagttcgtcaagggctactccgcgcacctcaagtgctccggcaagatggagcttccagagtgggttgacattgtcaagactgcaaggttcaaggagctgtcaccttctgatgctggctggtgctacatcagggctgccttcatgggaaggaagatctacctgaggcatggaattcgggatcggcgggttccagaagatctacggtggccggcagaggaacgggttacgcgcaccggacttttgcaagagcagcggagctggttcccccaac

SEQ ID NO: 44070 - DNA, 395 bp, Triticum aestivum
  Clone ID: PAT_TA_44070
cgtccggcggctactccgggccccgatctggggggtttggtttcagggcgccgacggctttttggttgatgacgctgggccgtgcctgtaggtgaagccttggatacatgcagaggggcttcccggggggcgcataggaaggggttggacgagggggtgaggattgcttaggccttattgagtttggggttttcagatcatcatagcccgcactggggctggtcatcgctagagcataagggaggaggtcgattcaggggacgctcacgatgggctggtcggtgagtttttttttacccatgccaccgttgttctgtgtcaactatgccgtcatggacttcttggtactgtcctctcaaggggtttttactgttggagttttttcttttcatgaa

SEQ ID NO: 44071 - DNA, 446 bp, Triticum aestivum
  Clone ID: PAT_TA_44071
ggtcgacccacgcgtccgcccacgcgtccgcccacgcgtccgcggacgcgtggggaggagttcgagatcgggggtcgcctcatcgccttcgagaccgggaagatggcgcgcttcgccaacggctccgtggtcatctccatggaggaaaccaacgtcctctccaccgtcgccgccgccaagtcctcggaccccgtccgggacttcctccctctaaccgttgattatcaagagaagcaatatgctcaaggtgttattcccacaacatatatgcgcagggaaggtgcccctaaggaaagagaacttctgtgtggtcgcattatcgatcgaccaatacggccattgtttcctcgtggcttttaccatgaagtccagatcacggtaaatgtactttcctcagatggaaagcaggacccggatgttatggctgctaatgcatcttcagctgc

SEQ ID NO: 44072 - DNA, 316 bp, Triticum aestivum
  Clone ID: PAT_TA_44072
cgttcgtcgagccgtctagcacccaccccagtgagcctgcccacccgaacgataaccgggatgggggctgcgctattcgggctgctcccgctcgccgcggcggtttcttatggtggtgccttgcgctcgccctgtcgtcgtcgtcgagttctgtctcctctgcgccgcggtggcgggggaggctttgagctctcccgcagtgtcgcggaggctggtgctctacaccaagcccgtgggctgtctttgtgacggccttaaggataagctccacgccgcctgtctgctttccattaccccctactcccttggcttcttt

SEQ ID NO: 44073 - DNA, 431 bp, Triticum aestivum
  Clone ID: PAT_TA_44073
cgtccgcccacgcgtccgtccacgcgtccgctagactctgcgcaagatcagtctgctggcaaagaagcgagcgagatggcccggctcctctctttcgtccccatctccctcctcctgctagctagcctcgccgccggcgccggcgccgcatcagccgcggatccaggggaagggggccccaggatcagcacacagtacgcgagcgaggaggagtcccggtggctggaccgctgggcggagaagcatctgccccacgggcacggttccggccaagccatcgagattcagccgggcagcgacgaggagtcggcgcaactgagccgcatgttccccggcaacgtctacatcggccacattgactttggcagaatcgtggtggatgccttccactccaaagctcgccaggccaagccgaacgatgattcgcagaa

SEQ ID NO: 44074 - DNA, 438 bp, Triticum aestivum
  Clone ID: PAT_TA_44074
cgtccgcggatgctctactacggctgctactccgggtcctcgtccaccacgccgcccgtctggacgcccgaccccgacgaggccgtcctgaccaatgttggccgcgtcctggaggcgcgcgggagtgagatcatcggccaagcgtacaaggacccaatcaccagcttccgggacttccacaagttctccaacgagaatccagaggcatattggaagatggtcttcgaggagatgggcatcacattcagcgtggccccatcctgcatcttgcgtgacagtgatgcgtaccccggtggcgaatggttgccaggggctgtgctgaatgctgctgcgaatagcctgactgctaaacctggaagaactcccagcaacgttgccattgtgtggagggatgaggggaaggattccgagcccctcaactttgtgactgtggaggag

SEQ ID NO: 44075 - DNA, 220 bp, Triticum aestivum
  Clone ID: PAT_TA_44075
cgtccgtaacttctatgtcaaagttgatgatgatgtacatctaaatatacacacccttgacgagatcgggtacaaacagaggtggagacgcaaagtctatactgcatgcttgaagtacgagcctgtgctatccgacaaggaagtcagatgttatcaaccctgatcctggataatgatgggataagtatctttccacatgctaccgcacagctatatgcta

SEQ ID NO: 44076 - DNA, 308 bp, Triticum aestivum
  Clone ID: PAT_TA_44076
tctttcgcgtcttacagacatatccaaatccatgacttagctctccatcgatccctactattggggggagctgtgatatcttgaaggagggtccttatccttctcttctttgtctatataaagctatatactctctatgacgcttttgatgcttttctgtaccatggcttcctctaactagctaccgtccgttcgttccacagttgaagaagctgttactgggctatcttcctaagtatacttcactttggtagcataatttttcaaaaaataagttataatatgaatccttcaaagactaatttctt

SEQ ID NO: 44077 - DNA, 339 bp, Triticum aestivum
  Clone ID: PAT_TA_44077
cgtccgtccacgcgttcgtccacgcgttcggggaagagatctaaacgttgaatattcaattgtgcaaaatgaacctggcatggtgtctactctggccacaagtgataaattggtgggcgatcctgcgtcttgagctgaagtctctgatgtcctggaatcaggatttaacctctagcaaacatgtttgaatggggagcattcaaattttcataaggtactgttcgagggagttactctggccacaagggataacatggcatctaatcttgccttctgggccgagttagtgcatgtgtcttgtgttctttaaccagcattcgatttggagaagacatattt

SEQ ID NO: 44078 - DNA, 416 bp, Triticum aestivum
  unsure (1)..(416): unsure at all n locations
  Clone ID: PAT_TA_44078
cgtccntatgccctgtgccttcttcgagcgggcccccttataaggctcgttctaggatctttaccttagaactgggcaaaggtggatggggagagcttaagcttactatagtctcttcttggaaagcaataacctttgaaccaataagattaacgacgataagaaagcggctcttgctatccaatttgtagccgaggctacgctgcggaaggttcatgctgcgcacaaagacgatgacatgccccccatcgaggccatccttagcgccgttgagagcgatctgaaactaacccggcaagagaatgcaaaacttccagataacaacagggcattggaccgtcttacaaaaatcaaggaaagctgctttgctgggaacatagaggacagttcacattgcattaacgaaagcttttttg

SEQ ID NO: 44079 - DNA, 364 bp, Triticum aestivum
  Clone ID: PAT_TA_44079
cgtccgctgacgcgtggtctaacacacaacatatactcttttagccatgagacacaggagtgacgccctctagaggcactgcaagctctgcgacaatgatcggggagatggacgcggacatggccgtaggatacttcgatggtgagagcatgctcatcaccggttcaactggggtcttatgaaaaggtctcgtggagaatatactgagggtgtcacccgatgttaagaagctcttcctcctgattcgtgcccccgacgttgaatcctcaaaggtttggattcatactgaggtcatagggagggagatctttttagttctgaaagaaaaacatggtatagtggttctacgatttcattgaagaaa

SEQ ID NO: 44080 - DNA, 175 bp, Triticum aestivum
  unsure (1)..(175): unsure at all n locations
  Clone ID: PAT_TA_44080
accggtcccgattcccaagtccgagccacgcctccgcctgccgtgaccacctctactacgtgacggntttggcccatccctgccatgccaccgtgggttgggggggaccttggagaattccgttgctcaaaaactacgtgggcttgtaccagtgtggaaggaaattcattttatc

SEQ ID NO: 44081 - DNA, 279 bp, Triticum aestivum
  Clone ID: PAT_TA_44081
cgttcgtcccgtccgccgtcgtcgtcgcacagtcgtaggtatagaaggcaaggatgaagggaagatgccgcttgtgcacgggctgcggtcgcggacgctcgacctgtttctgcaggcctttcgtaagaaggggtacattccgttcaccacctacctgcgcacctacaagattggggagcatgttgacgtttaagtgaacggcgccgtccacaaaggtatgccgcacaagttttaccacgggcgcaccggttcggtttggaacgttaccaagcgcgccat

SEQ ID NO: 44082 - DNA, 356 bp, Triticum aestivum
  Clone ID: PAT_TA_44082
cgtccgtttactcgttgggtttggtcatattcccaggattggttggcagatcgatccgtttgggcactgtgtagttcaggcttacctgcttggtgcataagtaggatttgatgctttatattttttccggattgattaccaagatcgtgacacgaggaatgggacaaaagaactcgaggttgtatggaggggctccaagacctttggctcatcagctgatattgttgctggcatctttccaaaaaattatgaaccactacctggtgagttttattttgaagtctatgatacttcccttgttgtccaggatgatccttttctttttgattacaatgttgaactacgggtgtatgttt

SEQ ID NO: 44083 - DNA, 448 bp, Triticum aestivum
  Clone ID: PAT_TA_44083
cttcctccgacgcgtgggcttgacacctccggccaagacgatctccccgccccctttctctcattagcctcagccagctgccggagcgttcgcgtgctgtctctcccggccagcgatcgggaggtgcgagggatggtctcccgtccccccaacttcatcgacggcaagggccccgcagggaataacgtggaattgccatccctgccctttcatggcgatactaaacgtactcaactccgagatgagttgattgagccctctgctggcgagatattggagattggatctgactgtgaatgcgttgacctttgccgtcatggcgctcttctagttcatgcagattagcattttcttgacgctgtttacttggtcgtagctattgagggtggaaaagaactatgtgcagtttgtaaacccgccctcgaggtcaattatatcacctaagtta

SEQ ID NO: 44084 - DNA, 235 bp, Triticum aestivum
  Clone ID: PAT_TA_44084
cgtccgcccacgcgttcgtccactcgttcgcttaaggatgtcaccatgtcctatcctgagttgcgtgactgtattgcggacattggtgagcttcagcactagttcattgtgcctctccgtgcttactactacagctaagatgagaagttgcttgtgttcgactatatgcccatggggagcctttctgttctcttgctacggcagcacaggttctggtcgtaccccacttgacttt

SEQ ID NO: 44085 - DNA, 272 bp, Triticum aestivum
  Clone ID: PAT_TA_44085
cgtttctcggacgcttgggaaagagcattcacatttcatactccacagcaacattttcaggctgggttgagtgttttttagggtgccattggtggacatttcgatgcatgtggcgtgagagcactagaagaggatgattcttggggcgcttcgcgctcttttcagctttgactaagaggcttcctgggggagggggaacttctgtgtcgtcaccaaggtgtggggcttctgtgtcccgttcatccccgtcctcgtgttttgggttatggtgc

SEQ ID NO: 44086 - DNA, 211 bp, Triticum aestivum
  Clone ID: PAT_TA_44086
tcgttctcccacgcgtcctaaaccctatctttttctgtttccctttaccccctgtcggcgatgacgccgagcgcgcaaggaacccatctccctccttcggttgtattaagcaatgaaggatgagttggttctggagccgcaccaattactttgggaatctttcaggggatatcatggagcgtgagggggaggatttcttcttcaattatgg

SEQ ID NO: 44087 - DNA, 544 bp, Triticum aestivum
  unsure (1)..(544): unsure at all n locations
  Clone ID: PAT_TA_44087
cgtccgcccacgcgtccgcacacattggaaggtcatacagatgttgttaagattgcctattgccatccggatcttccaatactaattacaggttcatgggacgggtcagttcgtctctgggactccaccacctaccggcttgagcgcatactggactttaagcttggaaaagtgaattctatagcatgtttcaagggatcgacaaggattgcgattggacatgataaaggattagtgctggcagacattggccttggagagttcagtccatgcatgataagaccatctctagtgctgcaagcgaattcgagcccgtctgttatactacaggatgcagcaagaaggcacattgagttgaaccgacaattgcgtttggtagagcatgagcatggcccaaccatgggaagaagatggagtatggggagctactatgcttaatctttttactagtatggttatgttagtactttggttagccgagcatgcanagtgaagtgcggcggcagaggtggtagagcgctgctatctggtctggtctattggg

SEQ ID NO: 44088 - DNA, 529 bp, Triticum aestivum
  Clone ID: PAT_TA_44088
tcacgcgtccgcggacgcgtgggcggacgcgtgggcggacgcgtgggaaaaaaaaccatcctagtggatccgtgtggtaaggaaaaactggtaatctattccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaaaaggggggggccctttaaagggacccaaagttaattcccgggccggggaaaaaaaaaatttttttaagggggccccaaaaaaaaaaccacggggccgggttaaaaaaaaggggggatggaaaaacccggggaaaaacaaaaaaaaagcgcttgaaaaaaaatcccatttgggcgggtggggaaaaagggaaaaggcccgcaccctatgcccttccaaaaagggggcgaatctaaaagggaaaagggaccccccctttaaccctccaataaacgcggggggggg

SEQ ID NO: 44089 - DNA, 320 bp, Triticum aestivum
  Clone ID: PAT_TA_44089
acgcgtccgcccacgcgtccgctcccacctctcgcccctccggccggatcggagaaaccccctcccccgcctcccgccgcctgcccgcggcgcccgctccgacctcgccgtccccgagcaacagcagcagcagcagcagcagcgctccgcttcctcccgcctggctagccccagcctagggcttcgcgggaggaacgtaaatttcactacagacttgaagatgtactccgccccaggcaacaattctttggctcttgcagccccacggccaggaatggagctgggcaacgcacagcaacattctaactaggcttatgggc

SEQ ID NO: 44090 - DNA, 650 bp, Triticum aestivum
  unsure (1)..(650): unsure at all n locations
  Clone ID: PAT_TA_44090
aaccggggcgagacaccacgcgcacgggaacgcgggggagaagaccgagaagcacgccagcgaacacccaagaggagaacaacggacggcgagggagaggacaggaaccagggaagagaggaggagaagctngcgacgaggcaaaaccccaccttttataaaaaacaaggggggggaaaaaccgccccccccggggcccggggggaataaaacccccgcggagtcccccccgggggagaaaaaaaaacaccccccgcggggggggtgggggaaaaaacacccaaaaaaagggggggggttgcccccccggttttataaaaatttttttaaattattcccccccccccccccggggggggggggaggaaccccccccccttntttttttaaaaaaaaaaaaaaaaaaccccccccccccccccaaaaatatacccggggggggggggggggcccccccccccctaatctctaaaaaaaaaaaaaggggcccaaaaaaaaaaaaaaaaaaaaaaagcggggggggtnnttttcccccccctcccccccccgcggggggggggggggnggggngnnanncccaaaaaaaaaaaaaaaaaaaaaaaaatcttnnnnaaaaaaaaaaaaaaaaaaaaaaaccncccttttttttt

SEQ ID NO: 44091 - DNA, 600 bp, Triticum aestivum
  unsure (1)..(600): unsure at all n locations
  Clone ID: PAT_TA_44091
cgtccgcgcggagttgagcacgctgtgcgacatgattcctggcatgcccagcgacgcggaaatgattcctggacctcgcaagcccaccgacatcgagatggttcctggcatgccctgcgaacggactgtttgcgtctggcccagcgacatggacgtcggtcgcacggggaaggtgttcatcaagacctggggatttgggcgctactcgtacgatatgtacaccggcaagctggagcgcctggcgacgaagcgtggcaaggaatatgggcaccccatgttcgcctacttcctggcatggccacccgccttcctcgctccagacccagagccgtttggtgatttgtaaggaattggcgcatctttgtttgaagtcagctcttcattacggtcaaaaaaaagtcagctcttcatttctgggtcactactttcgtgctaccacctcaggttgagctcatggggaacctctgattaccttgaccttcatgccagcatttaagcaatcttttgatgctatgtttatccaaacgtcatttggacttgatgatattcagcaaggtgtactgttaaattatgcttattntggacgatgcattggttttg

SEQ ID NO: 44092 - DNA, 498 bp, Triticum aestivum
  Clone ID: PAT_TA_44092
cgtccgcggacgcgtgggcggacgcgtggggtttattattcatcaattgatcctgtacttagctcgccttgctgtgtactggatatgttcaagaattagaagataatcatgataaagcttttcagtagaataagagcttggttttttgatttagtacacattattaatacttgatatatttataaataactggaggggtttagttatatgaaaatttcactttgtaaggctattttttgcatttcggtttggggcccagaattcctggaggcagccctatggcgtgaagccattaactgcggatgcgctccttttcgtggttgtgttgccacagccagcatccctccacgtcgagtcatgccatcactgggaatagcgcaagccgctgctgttcttcatgttgagctcgctctgcttcaggtcatgatagccatccagggaaacactgccgcccatcgtacatgtttccccagcaactaactcttgatcgaactcctg

SEQ ID NO: 44093 - DNA, 317 bp, Triticum aestivum
  Clone ID: PAT_TA_44093
cgtccgcccacgcgtccgcgcgtgctcccccttatccccttcaccatggccacctccgccatgacactcgccatggccgcggccacggacgcctccctctttcaccccacgttcctcgcccaacacaagctcgccccggcgtccgcctccctcccactcattttctctcgcgcgccgctcctccgctccacccgcccccgcgtcccccttacgcccctcgtcgcctcctccgacgccgccgaggcgggcctcgactgggccgacgctgaggaagccgatgagacggtgacggaggaggagcccgcggtgggcgcctc

SEQ ID NO: 44094 - DNA, 519 bp, Triticum aestivum
  Clone ID: PAT_TA_44094
cgtccgcccacgcgtccgcccacgcgtccggtcccggctgtcggcgacccgccgtcgtcgtcgtcgccatgactacctcaagacgtgttgctgataggaaaattgcagtatttgagaagaatatcactaagaggggttctgttcccgagacagtcaagaaaggaaatgattatcctgttggacctatcgtgcttggatttttcgtcttcgttgttgttgggtcatctctgttccagatcatcaggacagcctcaaacgccggtctcttctgagtagagtggtgctctgcttatagtgacgatgaatagggctgcaatatgcagttggttgtcggtttaaaattagaactgaatgagatagctggtactcttgtgatgcttgttatacctcttaccattgtacttggtggagtttaagttatatggaggtcataccattggactgctaatctgtgttgctcggggcctcaggcctttgaaaccgttcattttatatctggttatagaacctcttagatct

SEQ ID NO: 44095 - DNA, 471 bp, Triticum aestivum
  Clone ID: PAT_TA_44095
cgtccgcccacgcgtccgcccacgcgtccgcccacgcgtccgcggacgcgtgggggaagagcctgggcgcagcagtgccatgagcagcaacccgtgcccctcctcctgtcaccctgcaggccaccacgcgagactcaaagggacggcggtggatgtagagtcagcgatgccgcgtcgccccgccggctatcgtggccacaggatgccgtgcgccctcgttcggcttcccctgctacttcagcgacgtgggtcgccccgccggctaccgcggccatgggatgccgcgccccctccttcggcttcccctgctacttcagcgacgtgggcgcagccttgccggcggcgcacgctctcctgcggagtgcggtccgcacatatgcaagctccgcttcaccgccacggaatcttctccgccatcgcgagctgctgctgccgcggcccctcctccttcacggctcccctttgtaacgc

SEQ ID NO: 44096 - DNA, 528 bp, Triticum aestivum
  Clone ID: PAT_TA_44096
cgtccgatttagctggcgctcgtccgcatgcatttgctggccttacgagcctgcggctggaaaatatgacgagcggggaactggacattcccaacatcctcagcacttgcatgctcttggagcatttgcgttgaacccattgcgactcagggatctattctgagctgcacgtagaacacactcaacttgttgagctcgagcacgaccaggggaaattgcagagagtcgagctgatatgtctaccaaaactccaacggatgacctatcataatcggctctcttgggaggatccgatgtatttcggttgtgagccacagctgtcaaagctgagccttattaaaactgccacccggtcggacatgactctcaagttaagtcaactccttgctaatgtgccttccgaacgcgatctgcgtgtggattttggaagcgaacagatctgggatctaccagaatgcccaatactgctcatgcctgagctcagcaaactactgaatgcgaatctggaccatctccctgaaggatgtg

SEQ ID NO: 44097 - DNA, 616 bp, Triticum aestivum
  Clone ID: PAT_TA_44097
cgtccgattaaaggaatcatatcagtttattctcattttgattcaacagcagtcctaaactttattcttaatttgtcgattgaagaacaaaaccttgtgaggcgctcgctcaagcagtatactcctcgtattgaggtcgatctggtaaactacttgcagagcaagaaagagcgttcacgtcccaagtcttatgaatatgaacagattgattttggaacttctgaagatggttataatccgacatcaaggaatagctatccttttggaagggtctctgctagttcctttgacaatgaatctgggaagaggatgcatgcagttcaagaatccacatatcttactggtcgaacaacctctgatgtccgcactgatcatgctaatcaatgttttgagccttcttctgaagctgatatttttacagcaagtcgggaatcaaagagcaatgctcgctcagttgtagaagctgcacgctcgtgggcagattatcctgaaaaatcagatgccaccattgatgatgaaaattctattggcacccctcgcctggattttgtccgtcgtgtttctgatggacataataatgctgctgttacaactgtcgggaaaatatacagacatg

SEQ ID NO: 44098 - DNA, 526 bp, Triticum aestivum
  Clone ID: PAT_TA_44098
cgtccgcttccttctctctcagatttggtgcagcagccgctgtctgtcaagttcttggtggagatgccagctgatgctcaaagcgattcatcagggaggacccccgctagtagagggatggcttctatccaaaggcttaggtattgttattgaactacaagataatgttgttggtcttcccagaatgaaaaaagtgtttttgacactgccaacgaaggggtcttcagcgttttaaccactgaagaaaggccatccatggtttatggcaggagacctgaagaagaacaagcaactttatctaaaaatggaagagctagctagcaccatagagccccagtccacctccaagatcaagttctatacacaattcaccgatagtgaaagtagaggaatatgaagcagtaaatataatgttggtccatagagccctactttttcattcgttcactggctctcccatccctgatggtctagacgtgatcgctcagggatgaaaataaggccaactacaatagctgtcttacaa

SEQ ID NO: 44099 - DNA, 345 bp, Triticum aestivum
  Clone ID: PAT_TA_44099
acgcgtccgctgagatctatgctatcgaagagtcgattgccgacctgacaattaaacgtggaaagagagtttgtagcttcaagtaatggtacatcagttcaagaagctgaacagcgtacaattgaaagcatatgtaatcaggacaagacagcagcttcgcttatatgccagctcaagaaacgtcattctgcacaaatatcaacaatgccaatgatgaaagatatccttggtgttgtggctaccttaggaaaaacaaatgatgataatctaagcagcctactctcagagtacttgggaatagacaatatgcttggtcttgtttgcaagacttatgatggcataaag

SEQ ID NO: 44100 - DNA, 345 bp, Triticum aestivum
  Clone ID: PAT_TA_44100
cgtccgcccacgcgtccggcatttcttccccaccacttgctctcaatctcttacgggcatggcttccccaagctactgcgtcgcttccaccaaggcctcctgctctcccatagctccatgctgctgacctgcttcatcaattcgaggggctgatctgctacagtggcgctgccaatccactcatgctagcttcttttgtcttctggatgcaacgagggttgactgcgtgagctgccgctggttgttgctggaggtcaggtgtcgcgcggcaggagcaggagacgcggagttgcgcgtggcagggacgacgccgccgcatgccggttgaaattgcgggcgggggga

SEQ ID NO: 44101 - DNA, 566 bp, Triticum aestivum
  Clone ID: PAT_TA_44101
cgtccgcgccgccatcgcctgcgacctcctgctcgagtgccccccgccggcgccgaactccctgccctaggcagcagaatctctttgctacaatctgacaaagtggagggcttggaagtccaagtttctttcatgtctggacaacactcgctgtacttcgaatcagttggattgccgggagagtgttctcgtacaacaagaaaaagggataagcttctttcccctcacttgccactgttcaaggtcagctcaaaggcggctcttgcttctgaatttggacgaggctgataggatcagaaagcttgagccaagatggcgctgcagaacattggcgctttgaacaaggatgacgccttctacaggtacaagatgcccaaaatgttaacaaaaatagaaggccatggtaatggcatcaagacaaacatcgtgaacatggttggcatagcaaaagcgcttgccaggccagcttcctacacaacaaagtactttggctgtgcgcttggggcacagtctacatttgatgacaagacaggggtttgcatagtcaatggtgcccatgacactgc

SEQ ID NO: 44102 - DNA, 554 bp, Triticum aestivum
  Clone ID: PAT_TA_44102
cgtccgcccacgcgtccgcccacgcgtccgcgaagtcacgaagcaggaacttgagtttctctgtggtattaaaccatctgagaattctgacacaaaagacgagaaatctgaattcgcacactacagcccagaagttgttatgaaggtatggcatgacaatctgaaggtcctctttgtgaccaacgggacctcgaagatacactactacacagaaaaacaaaatggctcggttcgtgggacggaagatgcgccgattactcctttcaccagtgaaatgtcacagtcaggagataccattgctgcagccctgatgaatatgctgtcgatcaaccctcacctggtgacggacaaggtctacttgcacaagacagcgaagcacgccatcaaatgcggcgtcatcgatcagtggctggccgcacgggagcggggattccttcccagagggatagcagaaccaagcagcgaacatgaggaagcaagatttatcacggagagggaataccgtaccatccccgacgccatgcaacccgtgaacccatcgggcagcgagctcg

SEQ ID NO: 44103 - DNA, 601 bp, Triticum aestivum
  unsure (1)..(601): unsure at all n locations
  Clone ID: PAT_TA_44103
cgtccgcggacgcgtgggcggacgcgtgggcggacgcgtgggcgcctcctctctcgtcccggcgcgcttggagctcgacctacccgcgcgccgcccaccatgatcatctccaagaagaaccgcaatgagatctgcaagtacctcttccaagagggagtgctttatgccaagaaagactacaacctggcgaagcacccgcagattgacgtgccgaacctccaggtgatcaagctcatgcagagcttcaagtctaaggaatacgtcagggagaccttctcgtggcagcactattattggtacctcaccaacgatggcatcgagttcctgcgcaacttcctcaacctgccatctgagatcgtgcctgccacgctcaagaagtctgccaggcctcctggccgccctctcggttctggcccacctggtgaccgcccaagggggccacctcgctttgagggtgacaggcctaggtatggcgacagggatggctaccngtggcggtcctcgtggtgcacctggtgactttggtggtgagaaaggtggagcccctgcagagttccagccatcattcaggagctctggtggcggcggctttggccgtggt

SEQ ID NO: 44104 - DNA, 532 bp, Triticum aestivum
  Clone ID: PAT_TA_44104
ccgtccgcggacgcgtgggcaatttgcagccattggaatggaagaggcgactcagcattgcgcttgatgttgcaagaggtgttgagtacctgcacagccttgctcagcaaacgttcatccacagagacttgaaaccatcaaatatacttcttggtgatgacatgaaggccaaggtggcagactttggattggtgcggcttgcgccagctgatgggaagtgtgtatcagtagagacaaggcttgctggaacttttggatatcttgcccccgagtatgcagttactggtcgtgtgaccacaaaagctgatgtcttcagctttggtgtcattttgatggagctggtcacgggacgcagggcacttgatgacacacagcctgaggatagcatgcacctggttacatggttccggagaatgcagctcaacaatgatacgttccagaaggcaatcgacacaactatcgaccttgatgaggagaccttagccagcgttagcacggtcgcacagctcgcgggtcactgctgggctaggga

SEQ ID NO: 44105 - DNA, 570 bp, Triticum aestivum
  Clone ID: PAT_TA_44105
cgtccgcccggagttgctcgagctcgacaacggcaggatccgggccagaatcagcaatgtcggcgccgccgtcacgtcgctgcttgtcccggacaagaacggggttcttgcggatgtggtgcttggattcgactccctggatccgtacctgaatggcacctcgccttactttggctgcattgttgggcgagttgcaaatagaatcaaggatggaaagtttactttaaatggcgtgcaatatagtttgggcatcaacaacccacctaacactcttcatggaggatttaaagggtttgataaagtcatatgggaagtcactgaatataacaaagggaagaccccatcaatcaccttaaaatattatagtaaagatggagaggaaggtttcccaggtgatgtttctgttatggccagatattctcttccatcaagcatggagttgaagctagagatggaggctgcacctttgaacaaggccacacctatcagtttagcacagcacacctactggaacctggcaggccacgactccggagatgtgcttgcacattctatccagatacggggatc

SEQ ID NO: 44106 - DNA, 454 bp, Triticum aestivum
  Clone ID: PAT_TA_44106
tacgcgtccggagccggcatggcgaggctgtgagacgtgacgcatgctgctgtggtgttgccgagctgtggccgacgggaactccatggcgcggctggcgagcatcttcgacgtgcggtgtgaccgtgggctccggtgccagcggcatgccctggccatgccggtggcgcgcggcgtcgacgacgctctctggctcttctatgccgaggacgtgctcgcgttcctcatgcgtagttgccgtcgtggttggtcgtcctcgttcgtgagcctccgcgcactgctccggccggccgtcccatgcatcaggctcgccgcgcaccagaggtggggggcggagctcgccgatgcagggcaggggaaggagctgcgtcgtgggatccacctgatctagtgtgagacggctcggaacgggacgcagtgctgcggatctcgccggcactgggagggagaggag

SEQ ID NO: 44107 - DNA, 180 bp, Triticum aestivum
  Clone ID: PAT_TA_44107
cgtccgccagaccgggcagctcggcacgctgccgccggggcagaggacgccggaggcgctgcagcgcgcggcggaggcgatgaggcggctggacaggcgggcgttccggggcggcttcatcctggagaagatcctggggccggtgtcgacggggcacatcgagctgcgcagcaccgaccc

SEQ ID NO: 44108 - DNA, 638 bp, Triticum aestivum
  Clone ID: PAT_TA_44108
cgtccgcttcctgcatgcgcggttgctcttctgttctgttggtgccaactttgttggtccagaagtcaggtcagggagattctccaggccgaggagaactgctcccattttgttgcgaaatttcggcagattttggtgcgggggaagcggcacgatagctgcgccctttcgcgggttgttgggcgccatttccctgggaacggcaaggccgttgctggctgcttgttgctcggcatgcctgctccctttggatccttttccggtgcggggctccagggcatcatcgccaaagtgtgacgctttcttatccccttcttcacgtacctctgaaatctttacttagcaatctctgcatcagtgagattatcaagttaatttcatccgtgttgccattactctgcgtagctagcttcgtgtattactattgtgttctttagccctagcatagtagcattcctccccaatgggttccacggcgtacggaatgacacaaaatagatgtgatctcgccatggttcgggtccaccatggcgccccactatctgcacatgctcctgctgcactcaatctctcacgaaatcctgtggagttgctctgaaaatcaacctgggaaaaacttgatctagttgacatccact

SEQ ID NO: 44109 - DNA, 347 bp, Triticum aestivum
  Clone ID: PAT_TA_44109
agcgtccgcaccctcgccccctccccctccccctggggtccgggtaggtcgacgtctacagccatctcccagcacccatgaccggccgataaggatgagaacgttccttacctcctagtcaagtggccttcacgagggcaatcagtctatatgtgtgggttaagaagatttctataactaattcatgaggcacgttctaccgtacatatagtgacgtcaggaacgacttacacgttactatgggtcgcagcctgaccatcgtctatcatatgaataatatcacgcttgtctacatgatcaaaagatacaggcaagtgacatccaaccagtatgtcccttagcacatc

SEQ ID NO: 44110 - DNA, 558 bp, Triticum aestivum
  Clone ID: PAT_TA_44110
gcgtccggtcggggtctatttcctcgcctctctctgttcttctctctcatccgaagaactgtgctggataaaggagagctgcagagatccaaggttccttgaattgaagaaatcggctcgctcctgcacgcccagcaagaggatgggcgacgcttccggtggagagaacaaaagattgattaagccagtttaacccaaggagagacaagagaggacgagcagaaagagagagaatagacgcaaaggaggtcgcatcacaggggtgcgcacatcgaagatgtccgcggctgaagtcgtcggcgacgagatgcttagctaggccggcgcacctctaggctagtcccgccctgtggaccagcaatgcatgggcactgacacggatgacaaaggaagcaatcctgaaaacaacacagacaacagaaatgcagaaggcaaatagcagtgtcttgaagatccaacattagaagagcgaggatatcatgtagaaatcactgacacggaagtttctacaatggtttgtaaccttttcaataaatatccatattttttctgaagttt

SEQ ID NO: 44111 - DNA, 625 bp, Triticum aestivum
  unsure (1)..(625): unsure at all n locations
  Clone ID: PAT_TA_44111
cgtccgcggacgcgtgggtccgaggctgccctgcttgccaagctcggtatccgcccattctcctatgggcttgtgatcacaaatatttatgaaaatgggttagtcttcagccctgaggttcttgacctcacagacgaagacctgactaagaagttctcttctggtatttgtatggttgcgtcactgtctttggcactctcgtacccaaccatggctgctgcagctcatatgtttgtcaatgggtacaaaaacgtgcttgctattgctactgagacaaattactcctaccctcatgctgatcagatcaaggagtacctcaaggataatgcagaaacatgtgctgaacccggtgccacaaagacaggactatcagagttgccgttggatgtgatagagaagctgctgaatcatatttcttgccgtggggattgggctcgccttcgttgtgcgaacaagttttggaaggcaaaggtagatggtgcaaaaaggcccatgcagctgccatcggttatattgccatcaaccacgaaacctacctattacagcactgatggacangccgtacatcgacttcgcctcccggacagtgtcaggagagctaaacgaatcactggagcacatgaag

SEQ ID NO: 44112 - DNA, 271 bp, Triticum aestivum
  Clone ID: PAT_TA_44112
gtcggccagcgtggggcagaatctgtctggtgcgtgtgacctccctgcatctccgccgctggccgacccttctacccccttcccagccccggagatgggacctgaatgcaccaaccacaccctctcggtcgcgacctgctcgcgcgcccggccgggcgggggccgccgccgtgccgtcaggcgggcggagtcaagggttctctccggattgtgacgcgcggcgccccttgttttgacaagcctggaaccctgggcgaaccgaagctgctca

SEQ ID NO: 44113 - DNA, 613 bp, Triticum aestivum
  Clone ID: PAT_TA_44113
cgtccgcttcaaaccagcaatcattgcaggccccctctgccgctggttatgactactataaccaacagcagcaaccccaacagcaacaatctgccactggaactgctgcacctgctgatgctagcaactacaattacagccagcctcctgctagttatgcttcacaagggtatggtgattctacctactctcagcagagtggtgggcagcaagcttatgactactctggttaccagacccaggggcagcagcagtcttactcggagcagcctggatatgatcagcagagctatggatcagctgctaactcaactcaggatggtactgcacctagctatggtggtccaggtggtgctggtcaagcatctccagggcagcaagcttccactccatcctctggaggccaaccgggttatcctagccaaccacctactagtgctgctgcatcaagctacccagtgcaaggttctgcccctccatctggatacgttgctccacatacacagcctggttatggtacgcagccaccaccacagggcgcatacggtcagggtgcttatgggcagcctccccaggctcagaagccggcttcatctgctcctacttatggaca

SEQ ID NO: 44114 - DNA, 254 bp, Triticum aestivum
  Clone ID: PAT_TA_44114
tcctggtcgaccacgcgtccgcggacgcgtgggctcgctggtgtcccagctgtcggtgcggaggttcatgtactgcctgccacagctgacctgcaggacaacgttaaggatatacttcatcccaaaggttacggccattaccaacacgcttcaattcatgatcctgagctgatcacggaatacaatttaatggccgagagggggggtggatcaatgatcctaaatcccacatgttatacaaggggtagtaccat

SEQ ID NO: 44115 - DNA, 533 bp, Triticum aestivum
  unsure (1)..(533): unsure at all n locations
  Clone ID: PAT_TA_44115
gcgtccggttgcttttgggtttggaggaaagcttatagttatgaaagaaacaagctcaatggccacaaactttaacagtggaaatcaggggagttctattggaacagtgtcagttcttaatttatcagaggttgtcgcggataaagtcgatgcttcaaggatcactgatggcagtgctcttagttacttccatgttctatgccgtcaacctgttcctggtcctcttgttggtggaagtgctgcatcaaaggatgtaaacaaatggcttgatgagatgattacatggtatgaatcttccaccaatgaacaccagagaggtgatcctcgcaagttgcttatttcgttgctgaagatactatgtcagcactatgggaaactacgtgcaccttttgggtctgatccatcacaagaggatacaaacggtccagagatggcagtaaccaagctcttttcatcttgcaagagaagtagcaatcatatggnagattttgggtcaaatgttcctttcatgcaaaatatcccctctgaaattc

SEQ ID NO: 44116 - DNA, 582 bp, Triticum aestivum
  Clone ID: PAT_TA_44116
cgtcgggaccgtgggcgcccatcgacgtcgcaagctgaacaaccaggacgaggtcctcaagctgctcgagaaggacgtgttcctgtaaatcacttcacttggcccccatgaagagacatggacgtcatcatgctttggagagtgacagcagcgccgtgcttcaacagaagatccacacactctttccggccatagccagcagcgtaatgcagtggggtgttcttgttcttatccatggcatctacagcagcgcccgcctcaaggaggatttccgcacacttgaactcaccatatccacatgcaaagtgcaaggcccttcttccctcagagtcttcttcatccttgtctgctccaccatctagagccttcttcagaccctcaccgtcaccaacactggcagtgtggtggacaatggactcgtcttcatcttcaccttcttcttcagtttcttcagtaccagaaggttcagcagtagagacagtgctaaatggcatcgtagttcccattgcctggccaatcttttgaagagtttcagggtcattccagtactttatcattgcagcaggaccacctttctctaac

SEQ ID NO: 44117 - DNA, 286 bp, Triticum aestivum
  Clone ID: PAT_TA_44117
cgtccgcccaccgaccacgccactcgtcggctgatgggagttcgcccggctagtcaatgtgaggcaccaccacatgtgccatggccgttgcatttcgaagggcagagcagatgccggccgcgctctagcgcaggtgctggtatacaacaggtgccatcgagagggcattgaccgcatcatactgtttgcatgggagcacgctctgaattcggcggttcggagcgatgacatgaattgcattcgaacgctggttgcctgatgagctagtaccttgccatgggactct

SEQ ID NO: 44118 - DNA, 314 bp, Triticum aestivum
  Clone ID: PAT_TA_44118
cgtccgcctacgcgtaagcggcgtcgttattactactatagagtcgacaacagtttagtgttgagtcatccacaggtcatcgtaagggtcagtgtatattgcctgagagcgaagacatgtttatgtttgtgacgaatgggtgactaattaggtctactgatgagggatcaataattacgtcgaggtcagtgacattgatgtgcacgaacttcctaatatgttgctcaccgagcgctaaggtgaccatacactaacagtattagtacaaggtctagtatgagatcttgccacactacgagggtgtgaacagttag

SEQ ID NO: 44119 - DNA, 543 bp, Triticum aestivum
  Clone ID: PAT_TA_44119
cgtccgcccacgcgtccggttagtggggattggggattgtgatggtctcgaggaaactagagaggaaaaactgaccggctgctgtccttgtcggtgttaaaattaattaaataaagaatcgatatggattgcaccaatcctttgttggttccaacgtatttgatctttatcacatgggcgatcttgtgttgactatcttattaagaagcgtggcctggaaagcatacgactgtaagatcacctaggagatattagcttctccaacaattctgaatctatgttgtagacatgagtaattctagaccattgctcatggttatacttggtgggctactttgttggttccagaggtcatggtggggttggtattcttattttcatgggttgctggcaactcctaaggagaaatggtacattgtcactaaatttttgtattttaaattttgatagaaatcacaagcctgggaaatttctggtttcaggtataaggaaaattcacatatttgactcctatttgggctagcagccaagtattaatatttt

SEQ ID NO: 44120 - DNA, 451 bp, Triticum aestivum
  Clone ID: PAT_TA_44120
cgtccgattttgaggaggcgatccaggtattattcatctttcaatttttttatcatgatctgtctctttgaaaaagttgaaaacctaatatgatggtttacagagcaccaataagttagagaagttcgacctcaacctttccaggaattaatctattttggaacggaggtactaagcagtactaatacttgtctcttctgtttgtaacctaaagaagatgtataattgtgtctgtaagttagataaggactattggctttgtgatatttcattatctgatgtttgtaacctaaaaaagatgtataactgatcaggcaactgttttctgcagctccacctcagttactgattgaacaacaacgactaccaaataactagggaaaggttgttcaatgctcattattttttggttgattcttctattgactgtgatttttttttggggacgagg

SEQ ID NO: 44121 - DNA, 484 bp, Triticum aestivum
  Clone ID: PAT_TA_44121
cgtccggccgcaggctgttgattttgctccgaagccagatttgccaaagaaaatgcgttctaaagaaaaatatggtgtcaatcagtttcctggcttgactacagcagacaacgtatattcgacacaaacaacgcacttggctgcaaacaggcgcatagaaggttcaggtattaaggccaagggtaccagactcgagcgagctattcgtgaccttgaaaatattgttggtgaatacaaaccgcatactcttgatgttccgtacattgatccaaattgtcaaggagcggtcaaaagaagactgcctcaagaaataaaacaaaaacttgctaaggtcgcaaggttatcggcaaatcagggtaaaatctcagaagatgaattgatcaatcgcctcatgggcatagtggggcaccttgtgcagcgtaggacactgaagagaaacatgaaagaaatggtcgaatcgggtatgtgcgctaagcaagagaag

SEQ ID NO: 44122 - DNA, 344 bp, Triticum aestivum
  unsure (1)..(344): unsure at all n locations
  Clone ID: PAT_TA_44122
cgtccgccgccgccccggtacctcggctccggccagggccggctccgcctcgctccggccgccagccggcgtaacagcccgctcctccgctgctccgcgtccggcggtgacgggcccgacaaggttcttgagaagcgccgggccgagctcaccgcccgcatttcctccggcgagttcaccgcccagggccccggatggctcgcgcccgtcgcggcgaggctggccaagctgggcccgccgggggagctcgcggccgggctgctcaccaaggnagcggncggcgagcgcaggggcccggagctgccgcaggcggncggcncgctggccttcggcggcggggaggc

SEQ ID NO: 44123 - DNA, 546 bp, Triticum aestivum
  unsure (1)..(546): unsure at all n locations
  Clone ID: PAT_TA_44123
ccgtccgcaatcctgttctagcagctctggaagttccccaactcaccaattttcagagcaagctgagcaggtcagattaagtattgttacctcagagatcattccggaggcgcctgtgattggagatctgaaaggaaagaagaaattggcatctgcttcaggcttggatgtagtgcctgaagttgttactaagccaaatgaaactggagacacaccacttattccagggcgcccgttctcattgtcttcatctcattcttcgtcctttgcttcaagctcaagggcaccgttggcatatgtctcatcttcggatgtttcaaagaacaataattntggtgccgaatggagagataacaggtactcaattcaacgaaaaatgccaagagcctcaggacctcataaaagatgtgctgattactgaagaaaacatatgctcattggacacaccggttcatgtgcatgaattggccaccgtagaaggcgacgatgacggccacgtaatcaaatataatggagtatatcagcacagcgtactatgggacaggc

SEQ ID NO: 44124 - DNA, 211 bp, Triticum aestivum
  Clone ID: PAT_TA_44124
gagatggacctacccactgcgccgtccatcatgatcatttgcaagaagaaccagaatgagatctgtaagtacctcttgcgagagggagtgctttatgccaagaaaggatacaagctggccaagcatccgcagattgacccttcgaacctcgaggccatctagtttatgcagagctttaaggggggggggtcactttagggtagaccttatt

SEQ ID NO: 44125 - DNA, 522 bp, Triticum aestivum
  unsure (1)..(522): unsure at all n locations
  Clone ID: PAT_TA_44125
cgtccgagggtgttgacatgactgataagcaacttggagaggtttttaagaagttcggagtcgaaaggtttgatcccttgaatgagaaattcgatcctgataagcattttgcacttttccaaattcctgatccttcaaaaccatccggaactgttgcttctgttgtgaaggtggggtacatgttacatgatcgcgtgctccgtcctgcggaagttggtgttacagagggaggtccgtccgaagagcctgaggagaaatcaggtggagactagattaaaattggaatctagaagacgtagctgttcctgcttgacgacaaccggtacctcatcagcgaaggagcttggcgatggcagtgtttcggattgttttttaatggtaaaacacaaggttggcttgttgaaatcccatttgtatgggtgcacgtcacaccattccttagcagtacaacgtttcggagaattttgcgagggctttgagaccttaataagagtatttcttttcaaaaaaaaaaaaaanaaa

SEQ ID NO: 44126 - DNA, 558 bp, Triticum aestivum
  Clone ID: PAT_TA_44126
cgtccgctccaattgattaaaatattaaacatatggagaaatgtgtcaggcgagagcttccattttttttaatgacaatgcaaactcgtgatatgaactgtcgagtggtgtggagaaagaagtatcatccgtccgacagtggaagttagtcatgctatgtgctagcaaagcaattgtttcatttttcagattgttcattcctattctgatcggataatgaaaataatgagttttgcattctcttatttacaacttacaaggacaggtcttactagagatgctcccaaatagatggtttcattttactgacatttcttctaaaatttggagtaatataatgtggtaatgcctgcttaatgttcacagtgaatctaaatattacgaaccagatcattggaagtttgggactgcgggtaacaactactttaggcacgcaacacggcagctgtatgctataacaagggacttggcgacctatgtatcaacaaacaagcatatcttgcacaaatatacaaatggaagatgtatcattttgtttcttggttgattgggttggat

SEQ ID NO: 44127 - DNA, 454 bp, Triticum aestivum
  Clone ID: PAT_TA_44127
cgtccgcggcgctgctgcttccgcatcggagacatggggtggtcgatgcacatccagcagatcgccgacgcctctctgaggaaggccgacacggaaccggaaaggccgccgcgcccgcagcagcctcgctccggcggtggctacgccgcggcgataaaagaggagaaagacgccatcgtctcctgcgtgctcaccgtcatcagaggcagctgtgacgttgtgaaatctgacgctgcgcacgagggctacagcagtgcgtcgctggctagtaactgctacgcgatgtcatcaccgtcggtggccggaggtagccgtgagggtagtagcagctcttcggtttcgccagtggtgctgccggcgccagatgacatgggattgggactggacttcatggtggagtcccactggttcgagcctttggatttgggttggttcgtaaaatagttgagtacct

SEQ ID NO: 44128 - DNA, 663 bp, Triticum aestivum
  Clone ID: PAT_TA_44128
cgtccggcgctctggagctctctgggcagccgtagccacgagccttctctctctctctctctctctctctctctctctctctctcttagctgtgagtcagtgacgacgcagttacgcctctccctgtgccgggagcacgtacgtacgcgcccacgcgccatgcccggagcttgtgtgtgcgcgccgcaacctcggtggtgccgaaaccattgccaccagcatacagcagctagctaggattggattaactgccgccgcccaacaaacaactactactcgtatacttgtactggatcacgtactactactaggaggactacaactagattaagcagtattaatgtcactcgctaccacatcgatcccacttgtggtacctaggagtagttcttaaccgaggagagtaacattctttgctgtttttgtttcaaaaaaaaacattccttggtgtttcatcgcacagttttggagtagctggttcgatttgggcactccaaaagctcgaaaagtcgggatcttttggcgctaaaatttcggggccgacacggtcgtggtcccagccagtcggaactccgctgtcgtatttactcgtccatccaggagcagcagcagcgttccagagtccagagggcgcggcgtggggacgggacccacgggggcgag

SEQ ID NO: 44129 - DNA, 340 bp, Triticum aestivum
  Clone ID: PAT_TA_44129
cgtccgcatgaccttaacagtgcaaagctatgcatataaagttggcatgcttgtataagtgggaagtacataaagctattgttaagaccttaaccatccaaaactaatggaaaaattgtgatgtgctagtgtgtatgctatattggaacataatgcatggttgacataaatgctattggaagtatttagctgtcatggtgtttccaataacttaaaactgttgtgaagatgaactaaaccaaattactctcaaactagagagcaagaaattaggagatagtttcctgtagagtaatagttcctgtatgtgcagcaattcatttgccatgtgaaggaatag

SEQ ID NO: 44130 - DNA, 584 bp, Triticum aestivum
  Clone ID: PAT_TA_44130
cgtccgctactctagtgaaatctttgagatcaaggtgcatagaattgatcactgaaattgaggctcgtttagattttgaagatgagatgcctccattggaccctatgatgctgctcagcaaaattaacagcatgaggcaagaggttcaggatgctctggatactgcaaagtatgataagctgttgctgtctggtctacagatagcaataattggccgcccaaatgttggaaagtcaagcctcctgaatgcatggacttgcagagtgaaagagctattgttaccgaaatagctggaactacaagggacgtagttgaagcaaatgtctcaattcatggaatccctgttacccttctagacacggctggtataagagaaactgatgacattgtggaaaaaattggtgtagaacgatcagagactgctgcactgggagctgatatggttattatgacaataagtgcagttgatgggtggactggagatgacactaaacttatcaaacgtggcatgattgataagaaagctcaggttctgaagtgccaatgggtctgggtatcaacaaggtagactgcacaccatttgt

SEQ ID NO: 44131 - DNA, 534 bp, Triticum aestivum
  unsure (1)..(534): unsure at all n locations
  Clone ID: PAT_TA_44131
cgtccgcggacgcgtggtaatatgtgcaggctggggcgggagtgacgttcncaactttccctggtaaaggaggtagtagtttgagtctctcaaatgttcttcctcagaaaacagttgctccaagttataagaagaccttgagggggaatcaagggcaattcaaacttggcaccagtcgtaatcttgcttggttgaaacctgtgccaagtgataacttggtgataagtttctctgatgatgatattgagaccgaccctggaatgtcaaagcaagttggaggtaaaggtagcaaagccagcacacaagttacacataaacctgggatgagtgtgcaaactagacttatgagagaggaagcaccccaacaaaagatccatgctgcaaacataggatccacgaaatggtctgctaatgcacacacactcagaaactcgccggcaggtaggggctcaggcgctaccttttctacaacacacccacctattccccaagttacacctctgaactcttcccagaaggatggaactggtatgg

SEQ ID NO: 44132 - DNA, 562 bp, Triticum aestivum
  Clone ID: PAT_TA_44132
cgtccgcggacgcgtgggcggacgcgtgggcgccgatcgaaaattcagacacacactcgcaagaaggcgcccaccggcgcgaaaggcggcccgggaggtggtggaggcggcgccgacatgggccggatcccatgctgcgagaaggagaaggtgaagcgcggggagtggacggacgaggaggaggacaagctgctctcctacatcatgcagtacggcgcgcgcaactggcgcctcatccccaagaacgccgaacgaggtcgttgcaccgcttgccgcgcgtgacagggctgcagcggtgctggaggagctgccggctgcggtgggccaactacctgcggctcaagctcaagcacggcgagatcactgacgccgaggagcagtccatcatcaagctgcactccgtactgagcgacaggtggtcggtgatcgcggcccagctgccggcgcggacggtctacgacgtcaagaaccactggaacaccaagctcaagaagaagctgtccgggatggggacaccccgtggggcagcggcgttgcaggagcagcagcacaacagcagtag

SEQ ID NO: 44133 - DNA, 495 bp, Triticum aestivum
  Clone ID: PAT_TA_44133
cgtccgctcacacacgcgtttctagacgccttcctgctcgcgcttacgctctagactactgacgaaaccagcgatggagagcggtcttcatcgttgtctcctttcttctcttctctgctatcgtctggggcgtgcggagaactgtgcggtccattatgctagcctttccgacagatgtttgtagggaagactgtgaggcacacgattatattgaagcaccgatgctaaagcaggagcatgaggacgaacatggataatcatgcaatgaacgatgcatgggatggaaatggagggctatatgaaaggaaaatcagggagatcaaccccatgatccatgacataacctatgacatcaccgacatggacagcttaattgacagcctagctgtcgtcagtgcgctagaatatgatgatgaaatgcatgcggacctgccatatgaccggcagaggatgaagcagaagctgatgcagcaccttaagaggctgtctcagaga

SEQ ID NO: 44134 - DNA, 541 bp, Triticum aestivum
  Clone ID: PAT_TA_44134
cgtccgcccacgcgtccgggagccgtacatacaaaggatagttgcctggtactgcaatcaaatttcgtagtatcttcgttgcatgaatagttacttatgaagtaatggatgttgtggtaccagcaacacatgaatgtgcatgcttaagcttatatcaaatgctctgagatagaggacatgatgtggatatcggcagacattggatggcctggaagtacgacgtgactaaggactggaagtatgacgtgactaaggaactgacgcaattgtccatgtaaaaaatgagaatggtattactggccatgtgattagagtatgacattgcatgtgtgcatgtgtgcatgtgtggatgggaaaaaggaagatattacaaactgatttatggactaaaccattagggccttccatattccattttcattgaagttcatcgttagttttgtaagtcaagctctagtcatcggtaccgaagttaactatgttgatatcaagttgctatgtagcaacttttggtaccaacgcatagcaacttcatgagaaa

SEQ ID NO: 44135 - DNA, 537 bp, Triticum aestivum
  Clone ID: PAT_TA_44135
cgtccggctctattaacatgattgttgtgtgcgtttctgttacgtaataatattgttgacaagatatctgaaattacgatcggaagttgctgcccgccgggttggtctgcaagaggatgccttgctctctctctcttgctgcgtaattaacatgaattcagctaggcgttaatgtgcagtaagaggcaaggaaatagtactataatgtgcttatagagaggacaacaccaagcaagatgagctatattgaaaggtgtatgttgagctctaaaggcaagcacggccctgacactggcagtcggacaactcgagcgtggcctccactctagcgtgcagttcatcagagccgtcacgcagataggtgtgcttggtctgcagtgacgacctttgggccaacaacacatggacatttcagagataaactattgcatcaggtatctgaaaacctgatgggaaatgaggaggtgccctttgcaagtaaaaagactaagttggagaccaagtgcctttaggcaacgcgcccttttggatccgagc

SEQ ID NO: 44136 - DNA, 570 bp, Triticum aestivum
  unsure (1)..(570): unsure at all n locations
  Clone ID: PAT_TA_44136
cgtccgcccacgcgtccgccgccgtgtacgacgacgcggccgtgcgcctcaagggatcccacgccgtcaccaacttctcgtccagctccagctccgactccgactacgtcgcgtccgccaagccccgctccccgccgcaggccaagctccgtcctaccggggaagcggcagcagaggcccccgcgaccgttcccccttccgcgccgtcgccgccctcgcagcccgagcccgaggaggacgacgccgactcgttcaacccgttcgcctcgtccctcacccccgtcctccgtcgcgcgcccggcgaggcgccccgtccagtggaccacctgtacggggagctcagcgacctggcctcggccgctccgccgtccaaggcgggggagttcgactggcagcagccgtggtgggacagcgaaccgaaggcgacggagttcgactggcagctgccggggtgggagagcgaggacttcntgatgcccgcgggggcgagcgccgtcagcgtgatatgacgcccctgcccctacccccaccccctggcgggggggtttnggggctnggggcgggcagggg

SEQ ID NO: 44137 - DNA, 259 bp, Triticum aestivum
  Clone ID: PAT_TA_44137
gtccgcccacgcgtgcgtgcacgcttacggggaggggggggggtaacaatacaactctcaacaaaaatgtaacttcacctacccaatccataaataacaaacctacctaccataaaattaataatcatctacccccaatcaacatcctacatccatcaataacctcacataccctatttaaggggggggggcataaaacctctatttccactatcaacagttacatacacaccctactcttttacctcacacctctaaa

SEQ ID NO: 44138 - DNA, 437 bp, Triticum aestivum
  unsure (1)..(437): unsure at all n locations
  Clone ID: PAT_TA_44138
cgtccggcgggatgctctttgccccccgcgccacgaaatcgatccgcccggaccctgctcatataatgctcatgcggcacccttctggactgttgccatgtagctaggttggtggcgctggcatggcggcagcccaacaagggaacatggagcaggctgtgagcggagcgcaagaaccgggcaaggtcgacggcgaggctcccgaggcggcgtcgacgcccaaggccgcggctgccgccaccgctgctgcgccacatcaccggcgatccaagagtgcttcttcgggcaggaactcggagacttgcaagcatgtcaccatggagcaacgcctcaaccaagcacagaacccgccggacccgaggaagtcttcttgctcaacggatggttctttggttcaccgccccccgncgagggatcaacggacgagcgccggcacg

SEQ ID NO: 44139 - DNA, 496 bp, Triticum aestivum
  unsure (1)..(496): unsure at all n locations
  Clone ID: PAT_TA_44139
cgtccgccgccggcggcggagggtcccggcgacgacgggctccgaaagttggagtacctgtcgctcgtctccaaggtctgctcggagctggagacgcacatcggtgtaggcgacaaggtactggctgagttcattaccgagctcgggcgcgacgccccctcggtcgccgatttcgacgccaagctcaaggccaacggcgccgacctccccgactacttcgtccgcacgctcctcaccatcatccacgccatcctcccgccgccctcccataaccctagctccgccgcctcgcagtccaactccaagtaccgcgcgctctcgcgcccggacgacgcagatcgcgcccgcgagctccgcctcgagcttgagcgtgatgccaatgctgcagcggcgaccacccctgccccttccagggaccgcagtcgcgatgaccgctctcgggaccgggaccatgaccgcacgcgtgatgaacgcggacggnatcgggaccatgacc

SEQ ID NO: 44140 - DNA, 421 bp, Triticum aestivum
  Clone ID: PAT_TA_44140
cgtccgcccacgcgtccggaggtactagtaaaacatcacatagtcgcgaccgtgacggcgtgtcggacgagccggtcgatcgacacggcagccagcatgaaagcgtcctgcttactggtcgtgcttctgatcgccggcaccatggcgagcaggctctcgctcgccggccgcgagggcagcaccctgggcgggcagctcggcgagctcatcggcaaggtcgccagcttcctcacgtcggcacgccacgcgggagcatacggctggcactccgacacggacgcggaggtggacacctcgcacaagaatgcgcacggccatccggcgcggccgaggaagcgtctgaagaagtcgatgctgaactgcatcccccccgacatgagccggaagaagaaggtgctgtgctgcaagccgtgctacaaga

SEQ ID NO: 44141 - DNA, 479 bp, Triticum aestivum
  Clone ID: PAT_TA_44141
cgtccgcgccgccgcaccaccgtgagaggaggaggaggaagaagcagcgtcggccgaagatgaagacgatcttggcgtcggagacgatggagatcccggaggaggtgacggtgaaggtgtcggcgaaaatgatcttggtgacggggccgcgggggacgctgacccgcaacttcaagcacctcaacctcgactttcagctgcaggagggcgggcggaagctcaaggtggacgcctggttcggcacccgcaagaccatgggcgccatccgcaccgccatcttccacgtccagaacctcattaccggcgtcaccaagggcttctcgtacaagatgcgcttcgtctacgctcactttcccatcaacgcctccatcaccgccgccaaccgcggcatcgagatcaggaacttcctctgcgagaagaaagtaaggaaaggtgacatgctttgatgggtgacgatccttccgtctgagaaggtcaag

SEQ ID NO: 44142 - DNA, 690 bp, Triticum aestivum
  Clone ID: PAT_TA_44142
cgtccggaagctcaaaagttggattcaagaaagctaccagatcaaatgcagacagagccgaaactacagaagtagcagagttaccaagagcaaaaccagcaagcatatttgatcctgattccatagaaagcatgaaattgacccacaagtcttcttcaggtaatcttaaagcatcagctacaacaactcgcagcaaggtgaaaggagttcagaaagaaacttcggataccaatcagcttgaaagaacactaagcgctgaactgaaaaagcaatcaacatctgagcagaaagtcagtgactcttgtttggcgaatagagtaccgctgagagagttaagtagcacagaggcccaatctaaggcacatacatcaaagaagccactgaaaagaggccttctgaaatcaccagcttccagagagcttgctagtctttttcggagtgaagcatctccggttctgcaatcaagcaggcgaagaaagagaaatatgtccacagtccgtgttctgatcagccaaagcatggacagcgaaaccatcaaagatcaaacaaagatattgatgcacttcggattaccagtggcaacaactatttcagaggctacacactttcgtgctgaaaagtttgctcgtacaaggaacatgctagaagccatggccatgggcatacctgtaggcacaccatcatggcttg

SEQ ID NO: 44143 - DNA, 513 bp, Triticum aestivum
  Clone ID: PAT_TA_44143
cgtccgaccgcctgcctgcctaactcctccgccgacgcccgcctcgcaacgccgcgatggccaccccgacgacgccgctgctcaaggacgagctggacatcgtcatcccgacgatccgcaacctcgacttcctggagatgtggcggcccttcttccagccctaccacctcatcatcgtgcaggacggcgacccgagcaaggtcatcaaggtgcccgagggcttcgactacgagctctacaaccgcaacgacgtcaaccgcatcctcggccccaaggcctcctgcatctccttcaaggactcggcctgccgctgcttcgggtacatggtctccaagaagaagtacatctacaccatcgacgacgactgcttcgttgctaaggacccatcaggaaaggacatcaatgcgctcgagcagcacatcaagaaccttctgagcccttcaactccatttttcttcaatactctgtacgacccttaccgtgagggtgctgattttgtccggggtacccctt

SEQ ID NO: 44144 - DNA, 426 bp, Triticum aestivum
  unsure (1)..(426): unsure at all n locations
  Clone ID: PAT_TA_44144
cgtccgcccacgcgtccgcggacgcgtgggcgcgcagcgcgtcggcgccggcgcccccgtctacctcgccgccgtcctcgagtacctcgccgccgagaccctggagctggccgggaacgcggcgcgggacaacaagaagaaccggatcgtgccgcgccacatccagctggcggtgcgcaacgacgaggagctgagcaagctgctgggctcggtcaccatcgccgccggcggggtgctgcccagcatccacagcacgctcctccccaagaaggccggcaagggcaagggcgacatcggctccgcttcccaggagttctagattagattagttttcttgtgaatgtttgggtttggtgcgtcatcgatgttgggtggtggatctggttgggatggattgcccctcncaatctggttctcgttgttact

SEQ ID NO: 44145 - DNA, 534 bp, Triticum aestivum
  Clone ID: PAT_TA_44145
gcgtccgggaaagggcgaggttgcgtcccgctcatccacttggctctgctcgcatcttccttccttgtcgattccgattcccctcgctagctaagggaagggaagggaagggaagggatcccgacgacgatgggggaggacgggcagatccgccgcgacagggtcatcatcgacacggatcccggcatcgatgacagcatgacgatcctaatggcttttggagaaccaagtgtggagatcattgggctgacaaccatatttggcaacgtcactaccgagtatgctacacgcaatgcgctcttgctgtgtgagagagcagggcatcctgaggttccagtagcagagggcagcccggagcctcttaagggaggagagccacgcgttgctgactttgttcatggatcccatggtcttggtaacttgtctcttcctgcacctactactaagaagggtgaggaaagtgctgcccagttcatggttaataagggctctcagtttcctggagagatatttggacttgcattgggacccctg

SEQ ID NO: 44146 - DNA, 493 bp, Triticum aestivum
  unsure (1)..(493): unsure at all n locations
  Clone ID: PAT_TA_44146
cgtccgaatggatgcaaagcatgcaaggaagccancagtnntggttaccttgacgtctaactcggcgcggtcgtgcttgagcaggtagaggatggcgaagaggtcgtcggtgtcgatgtccgtgtccaccaggatccggtgaggcggcggcccgcccgtggcgagctgcgccacgagaaggagcgggggcagcgtcctcgccaccgcgaaccagcccatcccgagctgccggccggtcttctccttccctcatccccgcgtacgctacgctcgcacacgatggccgaatgaaatgggcctatggtccctgcgtgcgtgtatacacgcagctgtaataagtaggcgacctgaggaagtgaggagcctgaggtcgttactcgatcgctgtctccgggtccagggagccttgattggccatttcggtacgcgagggaacgagcgcgcctgcgtgtgtaaatagtgggaacgagcgagactatggtctatgttaaaa

SEQ ID NO: 44147 - DNA, 607 bp, Triticum aestivum
  Clone ID: PAT_TA_44147
cgtccgaagaaaggctcccaagcaagaaaaggcagacgaggagggtcggcctaatccgatctgcggtctcgtcaaaccgccgatttctattgtgtcaatattatcacggctcttgactttgaagcgtgcagaacctacgcctgctgcctttcgtacaagaatggctgcagaagttatatttgtaacacaagccatcgacactctaattgcctagaccggttcagagaaatgaatggagatagtaagacatttgttgagcccaagcctcagaagacacattgacaatgctaataaccaagaatctgctaattcaacaccattcttaggagaaagtagcattataatgcaagaatgtcatgatgctgtgcaaatttcagttgacatgaagtgtcctctctgtagaggatcagtatcaggctggattcctgctggagaagtcagaaagtatctggacgagaagttgaggtgttgctctcatgattgctgcaaatttgttggtagctatgagcagctgcgtgagcatgctagaacagctcacttgcttgcaaagcctgcccttgtagatatcttaaggaaaaggtcttgggatcgccttgaacgtgagcag

SEQ ID NO: 44148 - DNA, 535 bp, Triticum aestivum
  Clone ID: PAT_TA_44148
cgtccgcccacgcgtccgcccacgtgtccgcccacgcgtccgcggacgcgtggggtcagtctcgtttctgaacccgttggattctgcagaccaacaagcagcacaagatcacaaattcagaagacaatcttgcacctaactacatctcctcgagagctcgcactgatccttgtgtcaccgggaaagggagtaggagaggggactcttggctccgggacactagttcttggctaagatcttctccctccctcctttcctctccctccagctgataccttcactagctagcagtagccgagtcttcttcgccgtcgtcgtcgcaatggctgggggcctcttcgacatgtctcacccggcgagcgccctcgccggcatcgcaggaaacatcgtctccttcttcgtgttcctcgcgccaatggcgacgttcctgcagatctacaggaagaagacgacgggcgggttcagctcggtgccggacgtggtggcgctcttcagctgctcgctgctcatcttctacgcgctgctcaagaccgac

SEQ ID NO: 44149 - DNA, 193 bp, Triticum aestivum
  Clone ID: PAT_TA_44149
cgtacgcttaccgaccaactcgagcgtggcgttcacgccggcccgcggcggattaaagcggccctttccgccgccgtcgtacaacaagcacattcggcgcgctcctggcgcggcggaacggatacgccaagccgaacgaggcgctcatcccagagggcggagagccggagctggccctaccgatgagcttcat

SEQ ID NO: 44150 - DNA, 375 bp, Triticum aestivum
  Clone ID: PAT_TA_44150
cgtccgcggacgcgtgggaaaaaaaaaaaaaagaggagagagaaaaaaaaaaaaaaaaaaaaaaaaaaaaaaaaaaaaaaaaaaaaaaaaaaaaaaaaaaaaaaaaaaaaaaaaaaaaaaaaaaagggggcggccgttttagaggacccaagtttacgtccggggccttgcaaggtaatagtttttgtggggggccacctaaatccaattaatgggccgttgtttaacacggtaggagctgggaaacccttgccctaccccaatttaatcgctttggggcccttccccttttccccggttggtttattaggaaaaaggccggacccgtctcgcctttccaaacatttggaaagcttgattggtaatgggccccct

SEQ ID NO: 44151 - DNA, 125 bp, Triticum aestivum
  Clone ID: PAT_TA_44151
gtccgcggacgcgtgggggcatgatgattgttcgtataattaaattcagttggaagcactcgtggcactatattccctgaattctgtaatccagttaaatatgagaccggctatgcttaacagga

SEQ ID NO: 44152 - DNA, 430 bp, Triticum aestivum
  unsure (1)..(430): unsure at all n locations
  Clone ID: PAT_TA_44152
cgtccgcggacgcgtgggggaggggagtgaggatggagatcggnacctgcagaataaacgtcctaaagtgggtgctttcggcgaagaaagctctggtgttaatgcatccttctttggatatgaagcaccacatttgcatgcttttgctgaacatgaccatttgaagctgtcacatgctccagaagatgaattggattttggtttgtcgcttatctcaaatgatggtgggaatgatattccaagggagaccaacagtcatggtgtctgtgatgtagaaagatcaggtggaacaaatgcagaagatcttgaaataagaatggacctatctgatgatctcttgcacctgatattctccttcttatgccagaaggaattatgtagagcaggggctacctgcaaacagtggcagtctgctagtatgcatgaggat

SEQ ID NO: 44153 - DNA, 683 bp, Triticum aestivum
  Clone ID: PAT_TA_44153
cgtccgtgcaaattctggaggtatcagacgagggtattcgaagaagacaccatgaatggcagcagactctaccgcttccattacaatggtattcgaaaaagataccaccttgtggcctttcctgtttcctgtgactacgacttccaactctttaactgggatggtgtcaaaagaaattctgtaacagagacacaataaaataaattggtacagctatatggattccttggtaagctcatgattcatctggctaagcagtcttagtagaccgccaatgttgtgttattaagatgcaggtttcaataaccttcatgtttgcggctaaaataatgtagttatctcggtagtctaggtagattgaaataattgtttatccttgaagcaaatcaactaaacaactgccagtagatgatgaggtgccttctgcaaacaaaaaagctaagctctaagcgagtatttttaggcgacctatctttttcggtgatttgtttaatccttcctctgctcaattgatgtgaaccacaaaccttgctctgctaaattgatgtgaaccacaatccttgctctgctcaattgatcttcccagcaaatcaatgaacatgtgcccatagggacacagtcaaaggtgcgcttgtcaacttaatggttttcatccatagtgctttgcccattattttattttt

SEQ ID NO: 44154 - DNA, 546 bp, Triticum aestivum
  Clone ID: PAT_TA_44154
cgtccgcttctctgtcgcctctcctcccgtggccttcggccagccgccgccgccgccgccgcgcgacctctgctcctccccggcgtcgaactcaggccgccgctccgtcccctgtccccgtcgcacctcccctcaagccgccggctggccctctcccactcgtcctcctccctgctcccattcctcccttgtgggaaccctagccgctgcccactcccactcgtcctcctccccgctccccttcctggcggcgcacctgaccgccgcgcgacctctgctcctccccggtgtcgaactcaggtcgccgctccgtcccccgtccccgtcgcacctccccttgagccgccggctggcgctctcccttcaccggaggagttgggtgaggccgtgaggagcggaggcagtggcttgttgcagacgctgctgcggctcccttttcttcctcgccatcttcttcgcctccctcctctgcacccaagtaatgcggccagccctcgtcaaccccggctagcggattcattagccttttactccaatcgctacccc

SEQ ID NO: 44155 - DNA, 328 bp, Triticum aestivum
  Clone ID: PAT_TA_44155
acgcgtccgcggacgcgtgggtgccgacgccgactcacgaggcgcgatgccttctataagcactcgtggttgctgcctgtatactcgacatctacagttcctcaactgaataacaccctgtagccaagaaggaagagaatgaagccgggataaagaacttccacttagaccatctatgccagtaggggcacgatacacgacatgatagactacaggcggattccggggatgtttcacccaaatccaacgactgcgctacgtacacaacatagaacgatatttacacggttactatgacactggtcgaagtatttaatgcgattgaaca

SEQ ID NO: 44156 - DNA, 505 bp, Triticum aestivum
  Clone ID: PAT_TA_44156
cgtccgcgcccgcctgggaggaccgtgaaagttgcagcctctacctctctaataatatggggtttctgaggcgcgcgagttaaaccactgttagtgctcatggctcagactcagcagactgctggtaagtccactgaaggaggggctcgaaggaagcagttggccattaaggctcgccggcagtgtgctgccacacactggaggactgaagaaacctaagcgtatccgtcctgtaactgcagctcttcgagcgagtccacagtacccaacgagcactgcagtgttcatatggaacctttctttccagacgcttgcatggaagattgcccggtactacaagagtgacctgcgctagcagagccatgcggggctggccagttagaatgctatagaagcctactcgggcgactccttggcggacacctacctgagcaccatcgatgccaagcgcgtgaccattatgcgcaaggacatatagcttggataggagcatccatggatatag

SEQ ID NO: 44157 - DNA, 150 bp, Triticum aestivum
  Clone ID: PAT_TA_44157
cgtccgctgacacgtagcgttctatatgcagagggtgtgaggaggggtaggagatggtggctctgctttcctcactgcggatgtgtcgcccattgacgagagcatgttgcgaagcccgccagaggctggagctgagaaaacggataataa

SEQ ID NO: 44158 - DNA, 407 bp, Triticum aestivum
  Clone ID: PAT_TA_44158
cgtccgcccacgcgtccggtccttgcgagctctctttggtttcttgctttggagaggctctccttttcccgctgccgttgactcgcgcattgcgtcgagcaccttccgcgcgccgccggggctggagcggaaatccggagaattcacgctttcttcagtgagcgggcggcgtctgccggtcttgccggagcagcgtggctccatgccgtgcctgccgtcgtgggcacgggcttctcgtggatggactgcaacggttgctacatgttgaaatcaaggagtattggcgtcgccgatgttgcgtttgatgatccagcgggcggtatcaccgagttacctgactcgatagaccttgcacacaagcagaaggtcagcggggcttgggaagctaaagtgagagacaatatgga

SEQ ID NO: 44159 - DNA, 538 bp, Triticum aestivum
  Clone ID: PAT_TA_44159
cgtccggcgagatcgcacgcggtgcgcgaagcttgtcggcgatggcgcggatcgtcgagaccggacaccgaaggaccgtgaagcatgcgccgaccacgccttcctacctccatcaggcggcggccatcacgctgtcggcgggggtcgtcctcctgccgacgaacgccctgtgcggtagccgcacgcggtgctttgtccgtatatgcgcgtctgatgaacacgccggcggcgttgcgctcaccggcgtgtcagtatgaggagacacacatgtctgatgcacagttggaaagaccgagctgggacctggatgcgacggttgcatggtaggggcagctagacgatgctgaatgctgtgacagattcaggtaacgtaatacatgaccgttgagcatctgagaagcgtcttatatttgagatactagccatggatggatgtcccagtgtagaggcgactatgtgtcatcctcgttaacatatagatggtaactgattgtaagctcgccatggtatgttggatgggcagtggccgatgagaatc

SEQ ID NO: 44160 - DNA, 289 bp, Triticum aestivum
  Clone ID: PAT_TA_44160
cgtccggggactacttcggccaacgtcaagtgggagcatctgtatactgtgtaagatatatgtgtacgcgccatgctgtactttaaccattatggcgcgatatgatgcgcggactcagcagctttgtactccggacagtgtacctagggtgccgactgcttcagttaggccttcaggcgcgactccaacgtggtggcaaggtgcagcgactgctgttacttatgggactgcgtcctagagctgtatcatcgtagcgcaggtccgtcgatcccaagcagggctggagcgc

SEQ ID NO: 44161 - DNA, 482 bp, Triticum aestivum
  Clone ID: PAT_TA_44161
cgtccgcttctcctgatggagttgctgcccagcaaggccatggtgatgaaagcatgcaacaggaacaagcaccatcagctgtggctagattgtctaggttagcgaaaggagtcgcagcagactcccagaatggttcccatgatgcggatcgaactgctcgtagagatgaggaggcatcaaatgctgctgcactaaatgaagtgtctgcagtaagcaccctgaacatgcctaccgagagatcagcaggacaacatagccatatgaagggaaactctgaaactacgccaggagtgaatgcatctaaaagttcacatactggagttagcatggctgccggtgccagggctggccatgaagtattaccatctactgagggtggagagactggcaagtcaggatcatctttaaatggtggggctaccagcgagggtaacaagggccgcctatttaatgaagctgctgcgtcccacaacacttcgaaa

SEQ ID NO: 44162 - DNA, 490 bp, Triticum aestivum
  Clone ID: PAT_TA_44162
gcgtcgagcatattcgcatactagatggatcaggtctcactctattatacattggagacaggagtggtacttggacgccatgctaccaagacctgcgcacaggcccgggcggaggcactgaccatcatgcgccacctacacgggggccagcaggcacaccctgctgatggtcaccagcctcagggggaaggttaccgtgaacaggctgggtacgcgcatgcacatggagctcaccgacctgctcctggggcataccctcatgaagatggtgcatacggtggtgaaccaggagcggctggaagccgaccgcagaaggtcatggtcttcccatactgcagggacgagccggtgctgatcgtggagtccatggctacccatgtggtgtccacagttacccgtcgatcagcatggatacggtcagcaaggctaccatggtcagcatgggtaccgaccgcaacagcatggataccctgcagagcagcatggctat

SEQ ID NO: 44163 - DNA, 477 bp, Triticum aestivum
  Clone ID: PAT_TA_44163
cgtccgcccacgcgtccgcccacgcgtccgcggacgcgtgggtagcgacgaggccaccccgagttccacaggaaagaagcgcgaccggaggaggaagaagaggagcaagatgtcgtcggtgttcagcggcgatgagacggcgcccttcttcggcttcctcggcgccgccgccgcgctcgtcttctcatgcatgggggcggcctacgggacggccaagagcggggtcggggtggcgtccatgggggtcatgcggccagagctcgtcatgaagtccatcgtgcccgtcgtcatggcgggtgtgctcggaatctacggcctcatcatcgccgtcatcatcagcaccgggatcaaccccaaggccaagccctacttcctcttcgacggctacgctcacctctcctccgggctcgcctgtggcctcgcggggctcgcccccggcatggccattggcattggccgggatgctggagtcagggc

SEQ ID NO: 44164 - DNA, 577 bp, Triticum aestivum
  unsure (1)..(577): unsure at all n locations
  Clone ID: PAT_TA_44164
cgtccgcccacgcgtccgagcaatgacacgctaggcgtacaagtcttgaagtcgcgcggcatctttgtcgatccaaactggtactggatcggtgttggtgccttacttgggtacatcatgctcttcaatgtactcttcattgtgttcctcgacttgcttgacccacttggaaagggccaaaatgttgtttctgaagaggaactgatggagaagcatgtgaaccgcaccggagaaaatgtagagttgctgcttcttggaaacgattcccagaattcaccttccaacggaggaggagaaatcactggcgctgacaccagggagaggggaatggcacttccatttactcccttgtcaatcacctttgacaatatcagatattctgtggacatgcctcaggaaatgaaagacaaaggtattactgaagaccggctagtgctcctgaaaggtgttagtggagctttcaggccaggagttcttacagcattgatgggcgtcagcggngcgggaaagaccactctgatggatgtgttggcgggacggaaaactggcggttacattgaaggagacatcagcatct

SEQ ID NO: 44165 - DNA, 469 bp, Triticum aestivum
  unsure (1)..(469): unsure at all n locations
  Clone ID: PAT_TA_44165
cgtccggcgagatggggtcgcagcgagaggagctcgtccaggaacgagcgaacaggtacgcggggtgtgggctgcgaggcgtttccgagcctttccgagcttgtccgctcggaaacctcgcgcgagcggtgtaggtgcgctggtggatcgcttggaaggccaagttttccaagcccaaatcttgcaggttttctttctctgtgcctaggatgtgtttgatgaaaatccaagaaggctgacaggggaggattaatctatgtaagtcatgtcatttcattttttctgtaattagttgcctagcccaactttaagctggaataaattccttattttcactgaaaatgccctgtatttaactatttatttctcatgcttgggtgatggctgaccatggcattttcttgttggttcaggataatttctagctgccactttgttttaccaatttcaggttgcttctncatgagtt

SEQ ID NO: 44166 - DNA, 197 bp, Triticum aestivum
  Clone ID: PAT_TA_44166
cgtccgagaaaacacaacccccgcatccatcttccccaatcccgcatgggccgccgccctctgccccatcgcgccgccgcccccgtcgcccaaactgccacgacccatcacctccacgcgccgccgagctgcagcggtggcagctgccactgtcgcggccttgcggggttggggtcgaatggcacggcctagccaag

SEQ ID NO: 44167 - DNA, 520 bp, Triticum aestivum
  Clone ID: PAT_TA_44167
cgtccggtaataactctgcagactatagtgtttcggcttgggggccatcacacgggggttcaagtgtcgggagtaccggagctttcgtcgccatcgccctagcttttggtattcttgcatggtttgttgctccacatgttggcaagagagcggctgcgatcattcttcacatgcttctgggaggcctatgctcgttgactataataatctcgctgagatttgtcttcccgagaatccagtttgggtcgatgcggtactgggggatcctgttcgtgtcctggttccttgtgtttggagtgtgggcgtcgcgaacccgctccatccgccgcgcttcatgattacatcgagtgtgccctcagtcagccgttatgaggatttaggaccgcggcgtcgtaaagggtagcgtccacggcagcgttaggtattgtcctccttgtctatatccgccgctatatcatgggtgcgtttttttttttgtagctgaattatgttcagatgtataatgtggggccgagaaaac

SEQ ID NO: 44168 - DNA, 525 bp, Triticum aestivum
  Clone ID: PAT_TA_44168
cgtccgcggacgcgtgggttttttttttttttttttgtgggccgccgacgccccatactgcctagcgcccggatccggccatgggaggtccggacactccggatccggcctcctcctcgatggaccttgtacctcgggacggtgctcctccatgcatacttactctgtctttatcgagccaaggtggcagactgctgaatgccaggcagatgtactgatgatcatggaggccccttgctcatgtatggacgagcatggaagatacctctgctgatgacggatgagcggtgccgcgccatatgggccatctacgtgaggcgcacgaggacagatgagcttgtgcacggtcccaaggcgtggcacatgacgccgtaggctcttaaccggatggagaggaggacggaggacctcgtcgccgggcacctctatgagatgctcgacgccctgctctcaaacaccatcgacgtgttcctcatagatgtaagatagcggtcttgaatccctaaacgcttgaatctgaccaaa

SEQ ID NO: 44169 - DNA, 400 bp, Triticum aestivum
  Clone ID: PAT_TA_44169
cgtccggacacaaccaaaccaaatcaccaagctccgctccgaactgcactacagtggggaagatagagcgtacttgcgccggcctttcccgtggaaccttctagagtcttgactgctgggtgcggcaggttttctggtcgtcgtcgtggtcgtcggtgtcggcgtcatctctcctgcgagcgctgccgcgaacgctgccgctgactggtgtctgattggcggtcatggcggccggcatctcggcgacgccgtctgagatccggtctgcgaagcggtacaggccgctggatgcggcggacgctgcgggggaggcggaggaggaggagttcgaggacgacttcgatctaccctataatatcgcatacaacaacagcttgctccgatggtggcttgctggtct

SEQ ID NO: 44170 - DNA, 654 bp, Triticum aestivum
  Clone ID: PAT_TA_44170
cgtccgctcaagtatgcggatcgtgctaaggagataaaaacacatgttcataaaaatattggaacgatcgacaatcatgttgaagactaccagaggatgatagagaatctccagggtgaggtatcccagttgaaaaaggaattagctgacaaggagcatcagttgagcgtaaaacctactgaaaaggctgcagataatgagctatcttggctaaatgtcttgagccaggaaactggtgagaatgttcaggaacgtataaatctacagaaagcactgtttgaacttgaagaaactaacaagcgtaaccggatggagctccaacatcttgacggtgcaattgcaagaccacaggtgaacgagaaggattatacagttttgcaagcattaacatcaaggagacaagttattcttgacaacatccgtgacaatgatgaagctggtgctggctacagaaaggatattgaattgaatgagagccgtaggcgtcagctccaagatatgatcgaggaggctaccagtaacaatgggaacaggacttacctgcagattctcagccaatacaggcttcttggaatgaataatgctgagcttcaattgagatggctatgcgggaccaagtaatacataaccagagggaatctctaaggagcctat

SEQ ID NO: 44171 - DNA, 387 bp, Triticum aestivum
  Clone ID: PAT_TA_44171
cgcgtccgcggacgcgtgggcgccgccctcgacgtgccgccctacgccacgccgccgcccgaccccgacagccccgtcgcgttcccggcccacctgcagccgctcttcgacgcgttctgcgaccacgccgcggccccgctcgggcgcctcctcgaggacctcgccgccgagcaccgccgcgtcgtcgtcgtgcacgacagcctcgtggccttccccgcgacggaggcgtcgcggctgcccaacggcgaggcgtacgcgctccagtgcgtggggcagtcgttcggcgccgggttcaaggaccccagccaccggctggtgcgcgcgctcggcctgcccgtcccggcacccgagtccttgctcaccggggcgtggatggggcttgaggag

SEQ ID NO: 44172 - DNA, 342 bp, Triticum aestivum
  Clone ID: PAT_TA_44172
cgtccgcggacgcgtgggtgctgatgccgccgcctcccagtctcgtggttatatgaaacaacaatttgtaaacctgcagtagcctatgcagtcgcctcaagaacactgcatcctcaacccgatgttgcagcaacagatcttgcagcaagcaagccaacagcaaactgtcagtgctgatagtcagagtattcagacagtgctgaactcaagtgctatacagcaccaactacaacagctacagcaactgcagcaggtgcaccaggtgcagcaagcgcagcaggctcacattgaccagaagcagacgattcactcagatcaaacatatcatgtgcctactagagc

SEQ ID NO: 44173 - DNA, 606 bp, Triticum aestivum
  unsure (1)..(606): unsure at all n locations
  Clone ID: PAT_TA_44173
cgtccgattccccactggttctcctacctaccagcgaaaccccacctccccgcacctccgaccttcgtagcggcagcagaatccatggcgcccaaggcggagaagaagccggcggcaaagaagcccgcggaggaggagcccgcggcggagaaggccccggcggcgaagaagcccaaggctgagaagcggctgccggcggggaagtccgccgctggcaaggacggcgacaagaagggcaagaagaaggcgaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggccgccaagctcgcccgctacaacaagaagcccaccatcacctcccgggagatccagacgtncgtccgcctcgtcctccctggcgagctcgccaagcacgccggctccgagggcaccaaggccgncaccaagttcacctcctcctaggctccggtcttcttctctgagagttcccctctttcctggttcctggcggtgggaggggaattgatgttaccc

SEQ ID NO: 44174 - DNA, 667 bp, Triticum aestivum
  unsure (1)..(667): unsure at all n locations
  Clone ID: PAT_TA_44174
cgtccgctctccctccgccacaatggaaaccataggaatggcgatcgaggatgccgcatccggcggcgtcaagttcttggcagatcccgttgacaggtttccggtgccggatctcggcagcggcgaggctgtgcttgatgctgtaaccacccaaacactcgtgtgcgcagccgcgcagtcgagcgtcgccggtgcaggagacgccacgaccacggtacagctagatggggacgccagctgcgaaggggtcagcttgtcagcaccaagctcggagcagtcagccggcaaagacgaaagcaaggcctctggctgggcaaaaagagtacgtattggccgagcccctcttgagcgtcctccatgcgccggcagaataagcgcacttggaaaaacattgagatgctacgcagagaagaagagagaaactgttgtagttcctgttgtcggtgacagcttcgattcacttggagaagcatatgactactacaacctgtattcctgggaaattggtttcggtgtgcgatatggaaaaagcagattaaatgtggagaggacaaaatgtatgcaagaaatagtctgtggatgctcgggaataccgaagagaagtaatacaaggtcttgccgttgcagatgtncagctatgataaggttactacgttcaaaggacaat

SEQ ID NO: 44175 - DNA, 399 bp, Triticum aestivum
  Clone ID: PAT_TA_44175
cgtccgctccgcgcacccggccccctcctcccccgcggtccacctccgcgcctactccctcgcctctgctcgcttcgcccccgccccgctctccttcaagcgccacgtctcgcccaccgccctgcccctccacggccttccgttcggcctcggcgtccgcctcgcgggcggggtcaacgccgtggcgcttctctccctggccgccggccagatctgggtgcttgcaccgaggatggccgcggacgggcggacgcttgagctgcacaagtgtgcggtcatccagctcgagccaacgcggccggtgtatgccatggaggtcgccatggggaggctgctgctcggagaggctggcggcgtgcgcgtgttcccactgaggagtacgatgaagggtggcaggga

SEQ ID NO: 44176 - DNA, 502 bp, Triticum aestivum
  unsure (1)..(502): unsure at all n locations
  Clone ID: PAT_TA_44176
cgtccgcccgagcccaggcgggaaccggcggcggcggcggcgacggcgacggtgacggccgtggtcgcgcatcggcagtccggcgtcgcaacgagcctcagctctccctctctcccagatccggccgccgcgcgcccgaagaaccgcccccctactcgacggacgcccggcgagatgccgcgcgaccgcgacgagccggcggccgtgcgcgtctacacggtctgcgacgagtccaagtacctcgtcgtccggaacgtgccggccctcggatgcggcgacgagctcggctccgtgttcgcggcgtacggccccctggaagagtgcaagcccatggacgccgaggactgcgaggagtacaccgacgtctacttcatcaagttcgcgcaggtttcatatgcacctcagtttgaaagtcttctggataccaaggagaaactggaggtcaggagaaatgaagtcctnacacgaataagatcacctgtggaagcagacctgagggcta

SEQ ID NO: 44177 - DNA, 619 bp, Triticum aestivum
  unsure (1)..(619): unsure at all n locations
  Clone ID: PAT_TA_44177
cgtccgcccacgcgtccgtgtggacagtacttaccattgtttgaaaagaaagacattccggccatttgatgatggatttttcctgctgaaaaacaatgatatgcaatgcagcacctcttgttattatctttgcctataatacattttgaccatttttgttttgttttaataacttgattcagtttcttgagaggaggccaatatgcaatcgcactggcactgcttgatgagggcaaagttgttttgggcgtgttgngatgtccaaatcttcctttgacatcaataagcaacctcaatggtagctcatcaggagatcaaacaggggccctcttttcagctacaattggttgtggtgctgaagtagagtcattagagggctctccaccacanagggttattaccattttctagctcttttattttgatttgaaatagttaagcccatttctacctatgtgagatatttggtttttattattgactcgcttctggttaactttcattatagataagtggttgtaccattgacaatccagggaatgcctcgttttttgaatcctatgagggaccaccacaatgcctgatttaactggctctatagcggcggtttgatcttgac

SEQ ID NO: 44178 - DNA, 521 bp, Triticum aestivum
  Clone ID: PAT_TA_44178
cgtccgcggacgcgtgggcccaacttccgtgggtgtgctgctgaatcagccccaaagggaaccgcctccaaactccttgcccacggcccgccggctggcactgacctcccccgccgcccgcgactggagcgctgcgggcatccggtccgtcgatggcgtgctgctgcttccgcgccgccgcggtgccgcgcctcctcttccgcgccgccgcgcggcccctccagttgccgctcgccgtctcccgtaagggtttctcggggcagtcagtcttgccagtcactgattcagtcgagagttttcaaggaccgtcagtggatcatgccccacggattccgttgtatgacgacagcttgccctcaggcgtgtcgaccatattaacgaatcctggcgagaatgttgctcccgctgatccttcaaagagtagaatcatgcttgttgatggaacctcagtgatgtacagatcctactacaagatattagcacagctgcaacatggtcagttggaacatgctgatggcaat

SEQ ID NO: 44179 - DNA, 381 bp, Triticum aestivum
  unsure (1)..(381): unsure at all n locations
  Clone ID: PAT_TA_44179
cgtccgcccacgcgtccgacgatttcttgcccaaggacaggatcgaggacgtgatatacttctccggcaagtacttcgtgggcttctacgtcctcaccaacgaggaggacctcctgatgttccggccgaagcccgacggcgacggagcgcagctctccacgttcacggtgcgctacagcttccccggccaccgcgcggccgagccggcgccggggcagacggtctcccgctacctcgtcgtgtcccgcggagagctgctgatgatcgtgaggttcgccggccccgaggagcgcacgaggttcgacgtgctcgtgctggaggagaagaagatcgtngggggagcggaccacaacgacccgccccgagtcttggcttattgga

SEQ ID NO: 44180 - DNA, 368 bp, Triticum aestivum
  Clone ID: PAT_TA_44180
cgtccgaaaaaacgcttctctcgatcacatctcgatctccgaaagagcttcgttgcccctgccgacgtacgggagagcttccttgccgccgccgacgtacgatctgccgcgatctcgttcgatctacccgctgccgatgtacgagatcgccgacaccgagatacgggatcgccgccaacgtacgatctgccgtctctcgctgccgccgtggtacgatctgccgtctctcccagaggaggcgccgccgcggacgtacgggatcaccggcgccgacctgccagaggagacgccgcctgcaatctcctagaggagccgccgccgtcgccggtctccgacgggagacgccgaccgcggtctctgaccggaga

SEQ ID NO: 44181 - DNA, 548 bp, Triticum aestivum
  unsure (1)..(548): unsure at all n locations
  Clone ID: PAT_TA_44181
cgtccgcccacgcgtccggctggccctccctccgtccatccatccacctcattcgccccgtaaccgccccagcgattactgattaatcctcctccgcccctcccaggagtagaatcatgaagctgaaaaacagttttagggaggccgatccggtcacggtgcagaggggctatggtttcaggccaaaccaaccagctgttgttcatcagacaagatgcagatggatcattggagatgtgaccgaggtgtttgatcataacacatggaagcttggcaagattgcaaagattgtgaagaatgattactttgtcatcaggctcgccgactgcatccagttgaaagagttccacatttctagcttgagggttccacaaccacaagatgctcccacagctcctccttatggcaagcagttccctgcagctgataacaaggtgacccgaaggggcaagcagctgcctgctgatgtgctgagaagatcaggcaagaagaggaaatcgtncgaagttcttgatttctcttctcagccaagccagaggagactcttc

SEQ ID NO: 44182 - DNA, 257 bp, Triticum aestivum
  Clone ID: PAT_TA_44182
cgtccgcacagtcacacgctcgtctctggtcggctcgctgcagcggcttccttcagatccttatcttctcgccgctctggggccatttgttgcgcggatggggtccggggagcagcgggtgcagtcggaggcggcagcgaaccggacgtgatccgggccatggggtagagcgctgtgggcagtcgggcatggaggtgtcccgtggcggtgctgccgccggcggaggggcgcggaggggggaggaggagggaggagag

SEQ ID NO: 44183 - DNA, 562 bp, Triticum aestivum
  Clone ID: PAT_TA_44183
cgtccgaaggtcattcatattgctattttgaatgtaagggctggatcatcttttgcaacaattgtgaaaatttgagcgatccttggtcatgtatatgaatcttggcggataaaagtagatacagctgatgtacacatgacttcgtgagcgtctggataaaagtagatacagctgatgtacacatgacttcgtgagcgtctgtcgaggttcttagtgagtgcttcctcaaagatgctttcagatcattgattgctttgtgccctatatatgcccgcaaggtgtatctccttttagtttacaccctgaataggatacatggtgttcatttctgtttgatttattcattttattcttgtgtagtttggttttagaagtgaaatcatgatgtggttagttttgcatctagcacacttgccgctgttacacataattgtacttctgttttctattgtcgctttcccagtttcttaaggctaggacatttcttaaggatgaaatagtattggtctagatttttgagctgaaagattaatggaactgtttgaccaagtttcatttttct

SEQ ID NO: 44184 - DNA, 668 bp, Triticum aestivum
  Clone ID: PAT_TA_44184
cgtccgggaaaattattcttcattgccgcaccggaaggagaattctaatttgagcaaagcttcagacagaggccctcaggcacataaactagcgggaaatattgttaactcgccaccatctggcgctgctaggccatcacctgaaccgaaaatgtacccatggggcaatgaggcaagtcccaagataaatggtaaaccatctggcgctgctagtccatcacctgaaccgaaaatgtacccatgggacaatgaggcaagtccccagataaatggtaaaccatctggcgctgctagtccatcacctgaaccgaaaatgtacccatgggacaatgaggcaaacccccagataaatggtaaactgggagagaagtttgccagtccattggcagacagagtcagagacatgggagatgactttgcaagtcctacttttgcaactaatgtaaatggctaccacactagaagtaaagtgctacatgatgacacatacagccccaagtatccaaaaagtgtgaacaggtcaagatcaagttcctttgcttctgatccagggtctgagccatcggacgagatggataaaacctatgatttacctaaaagtgaatctcctaattcttcagaagaaagggagaaccaaaaacaaccagatctttcactcatttcgccta

SEQ ID NO: 44185 - DNA, 500 bp, Triticum aestivum
  Clone ID: PAT_TA_44185
cgtccgctttgagcagagccacctccatccagccagagcgcctgcctgcagagcgatgatggtttgtgctatgcacccgaagctggcctgagaaattaaccggtgcactgcttatgcgtgtgtgttttgtctgaatccaggcgctgagcgagaggcagccgcagtcggagaagaaggccccgcgggcgaggcccatgtcggggaaggccgtgttcgtgctctgcgccaccagcttcttcgtggggctgctgctcagcggccggatgacggtactgacgccgccggcgtcgggcggccacggcggctccaggatcgccctattctccgacgacgactgcgagcacaggcgtaagctggaagaagagagcaacccgaacgatgtcatgaacgaggtgtcacgaacccaccaagccattcggtctctggacaagtcggtgtcgtcgctggagatggagctggcggtggagcgggccaagaggaacggggggcctggcgcggcg

SEQ ID NO: 44186 - DNA, 476 bp, Triticum aestivum
  Clone ID: PAT_TA_44186
cgtccgcccacgcgtccgctctctccagagttaaatatgctttacttgctttggggtcaagtactgcaattcctacttggataactgaagtggtgaacagctacaaaggggatacaaaatgctttgatctacttgctaaactagcaatagacccagctgctcaacctccttacaccctaactagtggagtcctaagatacaaaggaaaaatcctgattggcaataacagtgcactgaaaaactctctgctcacttcttttcataagtctgaactgggaggacactctggtgaaagagcaacttatcacagattgaaaatccttttcacatggccaggaatgagaaaagcagtccaaacctttgtccagcaatgccctgtctgttagctaaacaaagctcaacatgtacaccctcctgggttgttacagccactgccagttcctgattttgcctggacccacattagcatggatttt

SEQ ID NO: 44187 - DNA, 227 bp, Triticum aestivum
  unsure (1)..(227): unsure at all n locations
  Clone ID: PAT_TA_44187
cgtgcgcccacgcgtncgcccacgcgtccgcccacgcgtgcggtaaaatataatgcgttgaaatttactggtttgaaggtaatcagggctttgttaatttggtttcactttctacacacaatgccgtgcttcctgtgaaattatttggttggattacttcaatattccaccatttatttgacagatgcaaagcaccgttcagctgtttgcatgatatttatgttaat

SEQ ID NO: 44188 - DNA, 385 bp, Triticum aestivum
  Clone ID: PAT_TA_44188
gcgtccgcggacgcgtgggcaaccggtgagcttccaaggaatgtgctgctttctgtagatagacatcttgtccagacaattgttccagggactagattaactgtgattggcatctacagtgtattccaagcatccgggacgaacaaccagaaaggtgctgttggagttaaacagccctacattagaatcgttgggttagagcagtctcgagatgacaacacaaatggcccctcacatttcacactcgatgaggaaatggaattcaaagaatttgcacagaggccagatgcatatgccaagatttgttcaatgataggcccttcaatttatggtcatggtgacgtcaagaaagctattgcttgccttctgtttgggggatcaaaaa

SEQ ID NO: 44189 - DNA, 287 bp, Triticum aestivum
  Clone ID: PAT_TA_44189
cgtccggggacacgatttgtacatgactgtgtagattcggattatatctgctcaagcgtactatacttgcatacgaaagcacagcgtgatgtcattgctgaacactggctacacagaaatgcctcatgctgataggcagttccttgactgtgggatgaggaggacacgatattcatttaccatggctggaatagggcatgggcacatgactggacacgcgacgctagccatactagaacgagagtgactgagaggatctcaaagcttgttgtgagggaaccttacca

SEQ ID NO: 44190 - DNA, 359 bp, Triticum aestivum
  Clone ID: PAT_TA_44190
cgtccgcccatgcgtccgagcaattccaaagaagagggggagggcaaagagagcaaggacctaactaagaatgcctcctaatggttgcaaggtccaactcgaacctaacggtgaaacgcaatttaaatatcttggtggcattcccaatggatacaaatatggttcacagttgggagtcattctcaagcgggaatatccaggtttagttaagtacatggacgatagtggtgtaactagaagccgcccagcactagaatgggaggactactatcttgtgcatgatgatgaaggtgtttccaatgctgaccgggtgaagcaagaattttggcgttgctttgaagttgctgaggcaaataggt

SEQ ID NO: 44191 - DNA, 427 bp, Triticum aestivum
  unsure (1)..(427): unsure at all n locations
  Clone ID: PAT_TA_44191
cgtccgcggacgcgtgggcggccacccccgcccccctctctgcgcgcgcgtccaggtcgttgtttcttttggtgttaccctgcgttcaaagggatcaagatggtgcctttctttgggtctgcatttcgtctactacttctcccacccagcaggaatgggtgatgctataccactaggattgtgtcatcaccacatacataattagtcccaggaaaaatataaagcataccaaggtgtgcttggtctgcagtgacgacctttgggccaacaacacatggacatttcacagataaactattgcatcaggctaaaacaacagagtttggtttgaggtgctctcacaagatatcagaaatttgcttggcgaagatctgngacactcgggtacattagacccacgaggcaacgcgacggaggccatgcactc

SEQ ID NO: 44192 - DNA, 104 bp, Triticum aestivum
  Clone ID: PAT_TA_44192
gcagccaagcaatccccacacacatgctctccactgcgccgattcctattcaccagcatggccatggaacgcactcagcacaccggagagccacacggagaagg

SEQ ID NO: 44193 - DNA, 606 bp, Triticum aestivum
  Clone ID: PAT_TA_44193
cgtccgcggacgcgtgggtgaacacttgcttgcgtatgcagtgggtcaaggtgcaaagctgcgacggcaccccctccaaggacgactaccatgtcgatggtttcaccaaaatgtgagaaatggtaacggagggacatgtctgattcaaaggaagcaaaaacaagctcatggatcatcaggtgtcatcggtcgagcaaagtgaccagaattgagctgtctatacccatttttagaggggatgatgattgtgctcactgatcaagactggcagtgagggctaccatattaatgttgggcagttgcaatgtagtcacattgattaatcatatggtgttcatactagagcgtgcctccctagtagatcataaatggcgagtcatcttcgactgaaattaggcttctctgatgctaatgccttttcggaaagcttcactacttgtagcagtggagacaacatgttggaatcgggcttgcttcaggggaatttgaaagctgtggtcctgattagatttaatcagcgtgctgctagtgatcaggaagaggatgattagtatcagcagtagcaggcttggaagcagaattttatggtttcacagtcaatgtttt

SEQ ID NO: 44194 - DNA, 391 bp, Triticum aestivum
  Clone ID: PAT_TA_44194
gcgtccgagcataccggcgacctatatgaagcggtaatgcgtacttgaatgatggggatggatccaccaccagactcaatgagaatcctatacctgagcagtagtggcgatattatggatctgggacgaaccatgaggatcctatcggtgaccgagatctatcgggcagcgtcttaatggtatgtatgcacaccgggttgttgacgtgagagcgcgctgctggtattcttgtggacagggaccgtgaggctacacatccgagcggatgggccggcagatacctatctggagctaaagacactctatagtcctcatattggaagttctgctgagcgtcctggtattgaggactttacgaggaggtccgtgcttatatggactggtggggcag

SEQ ID NO: 44195 - DNA, 525 bp, Triticum aestivum
  Clone ID: PAT_TA_44195
cgtccggccgccagtccccgccaccgctcgccgtcgccgtcgccggaggaggtgcaggagccatggcgccggagccagaggacgacttcctgaacgagaagaacccgaggccgctcgacgaggacgacatcgccctcctcaagacctacgggcttgggccgtactcgaacagcatcaagaaggtcgagaaggagataaaggagatggccaagaagataaacgacctgtgcgggataaaggagtctgatactgggttggctccaccaagtcagtgggatcttgtatcagataaacagatgatgcaaggagcagattgagaagatgcgggaggttgtggagcttcctatgcttcaccccgagaagttcgtcaagctgggtattgatcctccaaagggagtactttgctatggtcctccaggaactggaaagactcttcttgccagggcagtggccaatcggaccgatgcttgttttatccgcgtgataagcagtgagttggtccacgagtcttttgttgaaggggcg

SEQ ID NO: 44196 - DNA, 519 bp, Triticum aestivum
  Clone ID: PAT_TA_44196
cgtccgcccacgcgtccggtcatgattgggtattcagactcaggcaaggatgcaggccgtctctcagcagcttggcagatgtacaaggctcaggaggacctcgtcaaggtcgctaagcaatttggagtgaaattgacgatgttccatggacgaggtgggactgttggaaggggcggtggccctactcaccttgccatcttgtctcagccaccggacacgatcaatggatcactccgggtcactgttcagggtgaagttattgagcagagctttggggaggaacacttgtgcttcaggacgctccagcgtttcacagctgctactcttgagcatgggatgcgtccacccatttcaccaaagccagagtggcgagctcttcttgatgagatggctgtggtggcaactgaagaatatcggtcaatcgtcttccaagaaccacgcttcgtcgagtatttccgccttgcaacaccagagacagagtatggcaggatgaatataggaagcaggccgtccaagaga

SEQ ID NO: 44197 - DNA, 403 bp, Triticum aestivum
  Clone ID: PAT_TA_44197
cgtccgagcatacctgggacctatgtgcagctgctgatgcggtgcttcagtgctggtgaatagatccacgacagactcaataaaactcctatacgtgctatctgggcgatattatggatctgaactaaccattgtgtcctaggattaccccttctatggccagctcttcaggcatgcctgcacaccaagttgtgtacctggtgcgcgctgctgctctctttggtcagggtcctgaggctacacataggagggatgtgcggcagatacctatcggagctgaagtgctcttagtcctcatgttggaagttctgcatgggctactgttgtcgaggactcgactggctcgttgtgcttatctggcctatgtggggcaggccagatcacatattgatggcgtttattt

SEQ ID NO: 44198 - DNA, 114 bp, Triticum aestivum
  Clone ID: PAT_TA_44198
tccgctatccttttgctggctctatgcagctggcggtcatctcggttggagcgccctgccctcaccaaggcatacctgatcctttaaaatcctgcacgattgccaggtttccat

SEQ ID NO: 44199 - DNA, 540 bp, Triticum aestivum
  unsure (1)..(540): unsure at all n locations
  Clone ID: PAT_TA_44199
cgtccgatttcaatacaaagacagacggtctgttggatgagctgctatctgataggcagattattaagcagcatgatgacgagttcaagctactcttgaagaagtggattgagagttacacagaagaggcttgcactccagccaagtcttgtttgaaccccaactgttggtggggcagtcagcgccggtccctggttgcatttacttcaaaattcaacaagacgtttgatcgtcagaaaacttggaaggttcccgatgtcatgctacggcaggtactaaaagatcgtatacaggattgcattctgccagactacacaaggtgccttgagaactgttcgagttcaggactattttgttcatgtctgcagatagcttcaggagacatatataccagagagactttagaaacgacggggcagggcttctttgaaggataaactgcacatcctagctctctctctntctctttctntctctatctctctgtctgtgaagaacggtagtgatgtaggtcaccatcctaggaggaaatacctattt

SEQ ID NO: 44200 - DNA, 166 bp, Triticum aestivum
  Clone ID: PAT_TA_44200
cgcgtccggaagaacccaaaaaccctcatttccccctctttgttcctcattaatcgtgtgagatccgggcatttcttcgatggggctcctctgctcccggctcctgctctgctttttggtgctagcggaagtgatcggaagcctgccgtgtgggcagtttgtgctg

SEQ ID NO: 44201 - DNA, 595 bp, Triticum aestivum
  Clone ID: PAT_TA_44201
cgtccgccaccctcctacctactactccgcggctccgatcggcgacagcgacggagaaaagcgacgagcgactcctctccccatccaaaccccgaatcaaatgctcacttccgccaccgctcccccctcctcttcctcctgctcgtcccacgctcccacccgcttcgcctccgcgcgcgggcgacgcctccgccccgtgctcgccatggccgcctccgacgacccccgcgccaggtcggtcgctgtcgtcggcgccggcgtcagtggtctcgtggcggcgtacaggctgaggaagagcggcgtgcgggtcaccgtgttcgaggcggaagaccgcgcgggagggaagatacggaccaactccgacggcggattcctctgggacgaaggagccaacaccatgacagaaagtgcattggaggctagtagactaatcgacgatcttggtcttgaggacagactgcagtatcctaactcccagcacaagcgttatactgataagaatggagcgccagcactgatcccttcagatcccattgcggtaatgaaaagcactggtttttctacaaaatcaatgggcaaggtattggtggaacca

SEQ ID NO: 44202 - DNA, 521 bp, Triticum aestivum
  Clone ID: PAT_TA_44202
cgtccgttttgattttaggtatacttgcacagaagggctatatgtgccctctttgttgtcatgatgtgcctggttctttcagttcgcctcatcttggttttgctttgtcatacctcgcgtcttgttcaatccttgcgtacatgtatgctcatgtctctgttctcttgagcagttgtgtgttggccactacacagtgtcacatttctatagttgcttgctacaattttttaagtccttcacagctcacaagttctttctggatatgtatgccaacatgcaaaataggatacaatggaaaaggtttgtgaaattattaagaggcaacttgctgtttctgaaggcactgaagtttgtggtagcaccaacttctctgaccttggagctgattcactggacatggtaaatacccacaatattttttaccgatgtcatgcatgtttgttttgaactaagcggcacctaactaacttaacctggccaaatagctcaaggttccaaatgagtagttccttgttaggttt

SEQ ID NO: 44203 - DNA, 235 bp, Triticum aestivum
  Clone ID: PAT_TA_44203
aacgcgtccggccgcctcaacaaggtctcgttcctccctggtttgcacaagcttcgtcaggcaactgcagatcccgtacgaccatggcccacacccctgaagcttcccctgtccgcacaacttctggatcaaaggattgttgcttaatcccgggctgctctaccttcaaggaaaaggggtcctccttgagatcatacagatggtgcaaggacaatgttaatatggtcattgtggt

SEQ ID NO: 44204 - DNA, 562 bp, Triticum aestivum
  unsure (1)..(562): unsure at all n locations
  Clone ID: PAT_TA_44204
cgtccgccgggatctaccaactcagcgcgcgtgagatcccgccggagtccgcccaccccgctcgcggcagccgcagcctacctcgccgcccctgtcgctgcgccggttccagcacgggggcaacgcgtttctattccggaatctaattctgccttccctgcaaagagggattccgaaggactggtgacgctgaagttctcgtgatggctgccgcaaacggactagcccatgcatctgccaagaagcccttgttcacatttggcgtcattgctgatgtccagtacgccgatatcccagacggctgctcgttcctcggcgtcccacgctactaccggcacagcatcagcgtccttcaaagagctgtcagcacatggaatgagcaaggcaatatcaatttctccatcaactttggagacaccatcgacgggttctgcccaaaggacaagtcgttgtgggcaatgcagaaggtcattgacgagtttgagaagttcgatggcccgacctaccacatgtttgggaaccattgcctctacaaccttnctcggagcaagctggtggcatt

SEQ ID NO: 44205 - DNA, 515 bp, Triticum aestivum
  unsure (1)..(515): unsure at all n locations
  Clone ID: PAT_TA_44205
cgtccgcccacgcgtccgcccacgcgtccggcaggaacgtgtgcggggccacggcggcgatccccgtggtgtccccggaccggaggccgtcgaggatgtagagcgccgggaacgcggcgccgacgaggaacccgcccacgatgtgcgcggcgaggaggaggcgctcggggccgaggaagatgggcgcagacgggttgggcttcccggggcgctgcgggaaagtgattgtggccaggaggagtaggtaggggaggagcaggccgatcgatcgaaccgtaagaaaagaaatctaaattctgttatatttctgcggttattttcaattccgatggtggaaacgatttaaggataagttggaggaatgcctcgaagatgttttataagctttaaaaatagtgggtggtttgaggtagtgcatnatttgccttttatctgaacacttgcagccaaattttttatcgcactgtgagttgttttgtgcacatgctgcgttctgtgttggtatggatgagaaa

SEQ ID NO: 44206 - DNA, 504 bp, Triticum aestivum
  Clone ID: PAT_TA_44206
cgtccgcggacgcgtgggggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacac

SEQ ID NO: 44207 - DNA, 484 bp, Triticum aestivum
  unsure (1)..(484): unsure at all n locations
  Clone ID: PAT_TA_44207
cgtccgcccacgcgtccgctcaaggccaagggccttgacgccatgcttgagctgatggaggatgagacgatgacgtcgttctccctctcttcctcgtcgtcagacgacgacaccggccggccgcacctgaggcgcccgtcgtcggggagctttgggcgccggtcgaccgaggagcccgtggtgtgcagccccgcgagctcgctggtggccgtcatggtgcaggccctcgcccaccgcgtgagctacctgtgggttctcgacgaggaggacgactgtcgtctcgccgggatcgtcacgttcgccgacatcctgagggtgttccgtgagcagctgcagtgaggcggagatgaaaaaagggcttggagtttttgcagtggacctgaactccggagaggatttgctgttggtagagcgccgagttgcgcctgcctggttcgtttnctgtgaaatgggatgaagatgaactggtttctaatttggtctt

SEQ ID NO: 44208 - DNA, 644 bp, Triticum aestivum
  Clone ID: PAT_TA_44208
cgtccgcccacgcgtccgcgcattctcattctggaaaggccaagctcaagaagtacctctggggtctccacaacaccaacatcaacgggctggcttgttcatgttcttctggtgctgtcaatccgtcagttgcatctaattatgcattggacagctcaacaatttgattatgagtctattctggtgcacatccggtcgatgatttctaaggctatacagatcttctaatatttgtagagggctaacgaaaatactcatgcttgaagtgccaagaatatcatttcttgcaagataagtacttgcttgatcacatcgttgggaccggcatcctcgcgccaaggcgtgatcccgatctccatgtaaatcttcccctgcgcccccgccgcgtcaaatgcctccgccgcatccgcttccccagcgcctcctcatcagcggcggccgaggacagtgactgccagatcacaggggtggcgggccctaaccggcccaggggcgtgcccaggaagagggatgccagggtgccgagccaggtccatggtgaccgcgtcaagaccgttccaccgagggggaggctccctagggcggccaaggagaaagagagcaagttggccaaggagctcaggagggagctggagtgcaccttg

SEQ ID NO: 44209 - DNA, 566 bp, Triticum aestivum
  Clone ID: PAT_TA_44209
cgtccgcccacgcgtccggctccagacattgaagaaagtgtcgctgaaacacggcgtcccgatctcgaccgtcgccgtaagatacatactgaaccagacgtctgtggcagggtcgatggtgggcgtgaggctgggcctctcggagcacatcagggacaccaatgccattctgtcgctgctgttggacgaggaagacatgggcagcatcaccgaggcgtcgcagcggggcaggaacctgatggaggtcatcggagactgtggcgatgagtacagagcctagtgattttcacatggccggggatcgagtctcgatcctcgatcccccagcatgtgctcccacgatgatatatacataccaccttaacaaatgagagtgacaatcatggagaggaagaactttcagaggcatggagacagatagacagagaggcagagggacaaggaggatcatgtgctccaccgaaagcaagggtgaatgtggtggtggacagatctccctggccagcagggagcatatcccgggcttggagaccgatctgatcatggcatgatattggattttaatt

SEQ ID NO: 44210 - DNA, 562 bp, Triticum aestivum
  Clone ID: PAT_TA_44210
cgtccggcctcgttagggtttctcccagggtgtttcccccgcgccgccgccgccgccaccccgctcctccggatcgccgccatggcagccgcagccgcagccgccgccgaccaggctacgaatttgctgcagaagctatcccttgatgccaagactgaagccatcgacgccccggcggcgaaggagaaggcgtccggagggctgggcggcaagctgaatggtgtggcggccacacggaacccacgggcgtccgagcagtgggcaaatccacaggattacagcgatgcaagcatgtattatggcgcctaccctgctgcttactattgcgcaggttggggtgattattccatgtacttgaatcaggatggagtggaaacacctaccgctggtgcctatggtgacatgtactgctatcctcaatatgggcatgatggtcagatgtatgggtcacagcaatatcagtacccatcatcataccaccagccccagaatactgccaggtaagccacaatacaagtgtaaaactgacaggctagccccatcaaaggatatagcctgtact

SEQ ID NO: 44211 - DNA, 504 bp, Triticum aestivum
  unsure (1)..(504): unsure at all n locations
  Clone ID: PAT_TA_44211
cgtccggcgccaagccgtagatctgaaccgccatttacacttcggtttcgatcggtgcctccactcctcaccgcctctccctctctgatcttgtttgtttgtaggcctgggcttgtaggttatttgtcttctctgtctgtagatgctgttggattcagaccatagtcgaaagatgggggccttttgtgctctcaggtttggctatattccaagtatttggattttttgggtcaatggtctggctaggttccaaagatggccatctctctatggccttttgtgctgccttgcttgggctcgatgggagagaggtaagggttgggctaggttccaaagatgaccacttttctgtggctttttgtgctgccttgcttggacttgatgggaaagagagaagggtttggctaggttccaaatattgggatcttttagaagttaaggtacttttgggcagggttgttttggttactaaattctccagntattttgagtttcaattagcct

SEQ ID NO: 44212 - DNA, 534 bp, Triticum aestivum
  Clone ID: PAT_TA_44212
cgtccgcaagctcctgctggccattccaagggttcttgagcttgctgaggagctgtccctgccacttgctgctgtgaagtactcccgtgggacattcatattccctgaagcacagccttctccacacaagaacttctctgccgaggttgccttcctgaatggcttctttggtggactcaagtctggcggcaatgcctatgtcattggtgatcctgcaaagccaggccagaagtggcatgtctactatgccacccagcagcctgagcagcctgtggtcaaccttgagatgtgcatgactggtctggacaagaagaaagcttctatcttcttcaagacctctgatgatggccacacatcttgtgccaaggagatgaccaagctctctggcatctctgaaataatcccggagatggagatctgcgactttgatttcgagccatgtggctactccatgaacgccatccatggctctgctttctccaccattcatgtcacccctgaggacgggctcagctatgctagctatgaggtcat

SEQ ID NO: 44213 - DNA, 534 bp, Triticum aestivum
  Clone ID: PAT_TA_44213
cgtccgggcactcgcactaatgaagtccatcaacctgttgggagttcaacaaatatgcagaaactcgatagcactagaacaggcacttgcagccataccttccattgatagtgaggcagtccaacagagattagatcgtgttcggacattctatgagctactaaacctgcctttcgaggtacactaataacaataccacgcacccatagtcgtgtttttttttctttttttgcgaatgtagttgtgtttttctttgaagctttaatcaccctattcctcaatgtgcagtctttgcttgggttcattgctgaacaggaatatattttttctgcaaaagagtaggcgtgtcgaatatttttgatttacattgtcattttttttggttaaccatatttagtttgatgttactttgtttgtgtagatacttgagcatactaaaggtcaatgtacctggtagagagataccaatggatgctgaacgacgtatctaacagaatttgagtcattaaattgaattgggcaagatgattttag

SEQ ID NO: 44214 - DNA, 386 bp, Triticum aestivum
  Clone ID: PAT_TA_44214
cgtccgcggacgcgtgggagcatagtgagagtggcactgtgtgagtgactaatacactggaggacatgagatgctcgattgaaagcatctacatggcgatatgtatgtgcaaaatcagatagcattggtgatgctggagagatggtgtagggcgatgaatgaagtcattaggctattaaggcacggctgaaatgtgatgggaacagtgtgcgacttatgttacctatgcgactgtgtacggagcatgatatctttgctcaagtgcgacgatcacatgcagggctgcagtgctatgtaggacggtttctctagatagacattggactgaagataggacagggactacaagagtgataccagctactagagcctagtggggatggcaa

SEQ ID NO: 44215 - DNA, 208 bp, Triticum aestivum
  Clone ID: PAT_TA_44215
cgtccgcccacgcgtacggtcattaagagctgtatatggtgtcttggtttatagtgactaccttttctcgatgcggtgagtagccattgagtagaggagtttcgcgccaggagagctgattgggaaaactggatataaaggttatattaaggagcgggacaggaacctgacttagtgggcgtagcagcgtgctttgatgcagtgaatg

SEQ ID NO: 44216 - DNA, 617 bp, Triticum aestivum
  Clone ID: PAT_TA_44216
gcgtccggttttgtgcccttgatcttattgtcaactatgggttagaggacgtgaccctgctgacatttgggcaacctcggattggtaatgctgtgtttgcttcccactttaagaaatacttgccaaacgcaattcgagttaccaacgcacatgatattgtgcctcatctacccccgtactaccagtacttcccacagaaaacctaccatcatttcccacgagaggtttgggttcataatattggactcgatagcctagtatacccaatcgagcaaatctgtgacgattctggtgaagaccccacttgcagcaggtccgtgagtggaaatagcgtgcaagaccatatccactatcttggcatcagcatgcattccgagtcgcggggatcatgcaggatcgtcacggatgacaatatgctcaggcacaaagttgacactgtagacggtgctattgtcttctcgaagcagcctggtttatcagttgatcagctactcagtacacagtaaacaagctcaagattacatggatttattttgatggttcttttttgccaaagtacaatatttcttgttggcattaaagcactatcttatgtatatatacccgtgtgatcctgg

SEQ ID NO: 44217 - DNA, 208 bp, Triticum aestivum
  Clone ID: PAT_TA_44217
cgtccgagcgggcccccttccgatggacggaggtgccggccacgtcgccagctactcgagcgaaggccgacagggcctactactagacgtagactaccgactcggcctcccggcgctcccggacgcacaaggggattcaccacgccgcggagcaaccggacagtgacagctctaagaggagagggcggccacaccaaccgaagcccgg

SEQ ID NO: 44218 - DNA, 366 bp, Triticum aestivum
  Clone ID: PAT_TA_44218
cgtccggcgaccacttcggtcgacggcagagtgggagatcgatatactatgaaagctatatgttcacgcgccccggtgtactttacccggtatggcgcggaagatacgggcacggaggggccctgtacaccggaccgggacctagggtgcccccggctacagcgacgccttcaggcgctcctccaacggggtgggaagcatggaccactgctttcactcttggggcagcgtccttgagcagtacatggtacggcagggccggcgatcccaagcagggctggagcgccctgtaggacccctattctaaggtcactattgagtgcatatagtctagtacttcacaaagtagtctcagctactatagcc

SEQ ID NO: 44219 - DNA, 301 bp, Triticum aestivum
  Clone ID: PAT_TA_44219
cgtccgctgacgcgtgcggagcgaacggtcatccaattacacggcctactgaggacagctattccggcggtcctgcggcgcggcgcacatatattccgaactgtatcaaaagatattttgactgagaaggatgaatctgtgataaagaaggttcatatgctcgatagtttctttttgggtctgagagatgtgacctgtactggcacgagccttctatacaggatgatacttcgaatcatgcagacaggagcctggagctagtcctaccagtcgggaaggtagtgtatctgcacacaggact

SEQ ID NO: 44220 - DNA, 627 bp, Triticum aestivum
  unsure (1)..(627): unsure at all n locations
  Clone ID: PAT_TA_44220
cgtccgcggacgcgtgggttttaactaattatctgtgaattagatgcatgcatgccattaaatgttttttggttggcatgttcactagcattatttgccgtgcctggttttgtgtatgtttctgaaattttgtatgagattttgtgtttatgtaggagagagctgacgcagcacagaagttccactcaaaggaggcagaggaggcagcaaagaaggttgctgccaaagcttatactccagtagtgatggatgctcaaggtaccacaaaagaccagggccctaaagtagtcgctccaacgcctgcacaaatcacagctatcaaggctgctatcattaactcgcagacgcttgacgaagttacaaggcttgagaaggcgttgagcactggccaagtacctgctgagtttgcgctccccaagcctgatgccaacatggctgaggcgtcagaggaagctgaagctgagaagatggagacagatggtcaggaccaggaggaggatggggctgatgagcagaaacaagcagacgaaagcaccccaattcaggaggattgatgtcatgcatacacctgaatctgcctgtnctcgtggggggatgaaaccatgtgccggggactcggcgatctcg

SEQ ID NO: 44221 - DNA, 569 bp, Triticum aestivum
  unsure (1)..(569): unsure at all n locations
  Clone ID: PAT_TA_44221
cgtccgcccacgcgtccgtcttggggggaagggaggaaggaaggagctggggatccaacggaggcggaaatgagggaaacggagcgtccccgatccgtccttgagccgattttcttgattctctgagccgcggaagcggggaagctctggatctcgaggccgcccgagcgtgaatcctcggtttctccggcgcctcgttgccgcattgcctcctccccagatccgggccgccgggcgaggaaacgccggatcctcgccctcgccgtctcctcaaattccagcttctttgggtctctccggagccgcgtgcttcagatctttctcaaaaaaaatgcccatttgtttagctggggtggatgcgtgagtggcggcgactactttatgagctgtctcctgccatttttggagtagattcgcccgcaatggcggatcttgccatggcgcagtaaggnggccggcctctttccgcgagagcgacagcagctgccccgtaagtcgcaatgtctttgaagagcatcgtgcggaagctcaaggagatgaggtaccgcatcgggagcatgtccaggcgc

SEQ ID NO: 44222 - DNA, 122 bp, Triticum aestivum
  Clone ID: PAT_TA_44222
cgtccgacacgcgtccgtttctgagtgcccttgctacgagtgacgcatggcattgtcaatttctctggccgagtcccattccttatcagccggagcagtcacgcattacacatgttcatcac

SEQ ID NO: 44223 - DNA, 593 bp, Triticum aestivum
  unsure (1)..(593): unsure at all n locations
  Clone ID: PAT_TA_44223
cgtccgcggacgcgtgggttaacatcgattggcttcgccaaatgatctttcttgtttactgttaactgggttgttggctttttcacacataatactatgatctgtaaattctaccatcacactaaaattgtccaatcagcttttgacaatagtaagctctcactgagttctacaacacattaaacatttatcacacttacttttgtaatgcgtttgtattgacccgcatatcacctatactggtataattacagtaggatactggcctggaccgcaggaggggggatggtacctcgtcggcagtcgggcctcaggggaaggaggactcaaggagggagaattgggattagattggtttattttttgtttggttggtcctcatggccacgtcctattacgtagggatgtccacaaactcctttaatataagggaggggaagctgattgcacggaatcctagagatggcctaagagcatctccaaccggaccctccattttgtccctatatgtccggtcggaccgcccagacaggagagagaaggaaaaacgtnacccaaccgcacccctcaaatcngcctcatatgtccgggct

SEQ ID NO: 44224 - DNA, 650 bp, Triticum aestivum
  Clone ID: PAT_TA_44224
cgtccgaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaagggtccctttgtccccatctctgggttcgagggtgacaacatgattgagaggtccaccaaccttgactggtacaagggcccaaccctgcttgaggcgcttgaccagatcaacgagcccaagaggccctcagacaagcccctccgtcttcccctcccggacgtttacaagat

SEQ ID NO: 44225 - DNA, 553 bp, Triticum aestivum
  Clone ID: PAT_TA_44225
cgtccggttgggttgagtgagagaaattgcaacgaacagatgttcccgttgaggcggaggaacggggacaccactgaaactgttgagatcactgtctatgattactttgtgaagaacagaggaatagaactgcgctattctggcaatcttccctgtatcaatgctgggaggccaaagcgtccgacgtatttccccgtggagctttgcacactagttcctcttcaaagatacacgaaggctctgtcaactatgcagaggacttcgcttgttgagaagtcaagacagaagcctcacgaaagaatgtcaacacttaatgatgcacttaagcgtagcaactatgatgctgaccccatgctgaaggcatgtggcattcaaattgcgcaaaatttcactcagattgaagggagggtcctgcctgctcccaagctgaaagctggtaacggtgaagagttctttgcacgcaacgggcgctggaatattgcgaggaagaagctgattaggaccagctctgtcaagaggtggtctgtcgtcaacttctctgcacgctgtgatc

SEQ ID NO: 44226 - DNA, 553 bp, Triticum aestivum
  Clone ID: PAT_TA_44226
cgtccggaactcccccatcacgccatcgattgatccacccacggcacgaaagcgcgaggcaaaggtcgattcatacctaggcgaggcgagaagagtcgaagggtcgccgtagagctcgccggaacccaccgtggctgcgctcgccggcggggaagagggctcgcgggttgcgcgcttcttctcctcggtgctctccgggatctttggccagggcgaggagggggacgcgatggccgcacgcgcgcacaacgtcgctgccgctcagcagcagaacagagcgttaggtggtgtccccgccatgggcaagcagcagaaggcggccatggccggcaggcccgaccccaagaacacccgccgcgccctgggcgacatcggcaacgtcgaggccaacaaccggcgcgcccccctgggcgacatcgccaacgtcgtcaacgcccgcgcggccgaagggaagccgcagccccatgagccggtgaaccgccccgtcaccaggaacttcggcgcccagctcctcaagaacgcgcaggagaaagcaaagaatccggcggcgagg

SEQ ID NO: 44227 - DNA, 589 bp, Triticum aestivum
  Clone ID: PAT_TA_44227
cgtccgcggacgcgtggggttccgatgctcccccttccggatggcgcacgcgaattcaaggatccactggctccgacctttacccgctgtcgtgcacctgggatccgcaccctctgacctcaccgtggggtgcgctccttctcggatgaaaccgtttgctaaaaaagatggtgctttcttgtaacaagttgtggggttgcagcaaaaacaagatgcacaggttcctcttttgtatgcttttcagttcatctacttccgatggtcagctgcccaacaatcttgtaccgctcagtgcatgtattactaagttcaaaaatcagaactcaacaagttcaacatggtgtacgacacggaggagatcatcgagagggcacaccgtggcatcttggactacatcaagcacgcgcttaccctcttcaccaacttcgtcgccgtcctcatccgagtcctcgtcatcatggtaagcagcctagccaccttggccgcctactcatcatgtgctattcattggtacagattggcatcatgatacttgaattgggggctggagctcatgtattactccccgataaggtcaacatttcatgta

SEQ ID NO: 44228 - DNA, 527 bp, Triticum aestivum
  Clone ID: PAT_TA_44228
ttttgtccttcttctccttgtgctcgccgtccttcttgccgtcgccgaggccgtcgccgctgatcttgtccttgatcttctccatcatgccctccttgtgctccccgtccttcttgtgctcgccgtccttcttgtgctccccgtccttcttcttgtgctcctcgtccttcttgtgctcgtcgctgccgccgcccatgtggagcttctcctcgatcttgtgcatgatgccggccatggcgctgctgtttctggctacttctctccaaggaaactggcgatgctaatgggatgcgatctcgggtgcagaaagcgtggcacaacaatgtactccacagcgatgtgaaggtccatctgatgcaccgacaaattgtggtgatgctactcgccaggaaacacctcaatctacgcttgtgagaagaaatgtcgagggggcagggaaaacaagtggaagcgatacagacaaatctagaggggaccatcagcaggtaaatgtgcttaccaggggagcagtaaacattgacaggatt

SEQ ID NO: 44229 - DNA, 266 bp, Triticum aestivum
  Clone ID: PAT_TA_44229
cgtccgggcgggtcgagcaccgtcgtcatcgccaagtacatcgaggacaagcacaaggcgcacctgccggccaacttccgcaagttcatgctgacgcagatcaagaagctcgtcgtcgacggcaagctgaccaaggtcaaggcctcctacaagctcaccaaggcctccgcagtgcccaagatgcccaagaccataggcgccagcctagaagaagcccgcggcgaataaggcgccgaccattattccttttgctagtaccctatcca

SEQ ID NO: 44230 - DNA, 388 bp, Triticum aestivum
  unsure (1)..(388): unsure at all n locations
  Clone ID: PAT_TA_44230
cgtccgaggcaagaccatcacccttgaggtggagtcgtctcacaccatcgacaacgtcaagcccaggagccggcacgaggatatcattggtcaccaccagcncncccagcacaatccttcaattgaggagcccgttgctttttatntncntaccgtgaagttccgaaggatgctctggtgatttgcgggatgttgtgtatcgattgaaggaacggtcaaggaatgaaaatggtctgctaaatgccagcttggcgaagaacatgatgctagatgcgtatgtgtgtgatttagaagtcagcatcgtggagaagttgatgtcctgaagaagaggattcagaaactgcagttgtcctttgtgcttgctctgttctgctttgtcatttcacac

SEQ ID NO: 44231 - DNA, 372 bp, Triticum aestivum
  Clone ID: PAT_TA_44231
cgtccggggcatgcctgaccttcctggcccgcccaaccgcgtgctctacatcatgctcggccaggcgtggcggctgatcgtgttcgtgcgagcgaccgccgaggggttctacggcgaggacggctggttcttgttccctttcagggggaggtccgtgaactacctgagggacgagctggccgacggcgtcgctttcatcgacggccagccccccgccggcatagccatgtgcgtccgagcggtccgctacgggaggctgactccactcgttgtcgacctgacccgctacgctggccacgccgagacccttcagattgtcgtgatgctgtccgggacccctgcgtacgatgatctgtgatatccagatgttgg

SEQ ID NO: 44232 - DNA, 372 bp, Triticum aestivum
  Clone ID: PAT_TA_44232
cgtccgtcagaattcaggatggccaaatatgctatgcgtttgttctgtattttcatcagggtctggtcagcttcattggtcacagtggcctcctcaaaactcagcacaacctagatggttctctactagcaaagggcttcttggggcaggccccagcggcataatggctgctgatgccattattaccgagtctggagctttacatgttgctggtgttccccttgttaatccatctactgtagtagtttgggaggtgatgccaggtcttggtaatggcattcaggcaactgcgaagataaatgcaacaagccctcttcctccatctctgaaccccccctcctggtctggttttgctccattagcagcttatct

SEQ ID NO: 44233 - DNA, 130 bp, Triticum aestivum
  Clone ID: PAT_TA_44233
cgttcgttacaagagcgtgtgcgtgatggacacatcctttccgttgggccaggcgctcgtgcacggatctggtgggactggctacaccgttcactctgtcacctacggccgttcgcatcgtcgcacttat

SEQ ID NO: 44234 - DNA, 315 bp, Triticum aestivum
  Clone ID: PAT_TA_44234
cgtccgggccgccgccgcaaggcagacagacgcatccgcgctttcccgatgtctggggccaccggcgcgggcgcgatcgccgctctcctgcgtgcccaccgcttgcccatgctgcattcgccgttcgcgtgctcgctcgccgcggtccgctccctgggcgcgcatctccctccccgcgccccggcggctgtcgcgccgttcttctcccgcctctccctcgcgcgccttcggtccggcgctttgccgcgctttttcttcttctcctgcggcgcccctggctgcgctgtttctttctcggcggcgtagcacgaggag

SEQ ID NO: 44235 - DNA, 275 bp, Triticum aestivum
  Clone ID: PAT_TA_44235
cgtccgcggaatgattcaccggaggcgtgacgactaaccagttctcttattcttcttgatgctgcgtaggcgggtcattgttactggtgctcgacgtcgtctgagaatcaccaccggcagcgggaggaggagagccgactgcggcatgcggcagtagcagctacaactacctcggcgcgctgctgcggctgatgatcccgtgcaaggcggtggtggctccctttagtccggcgtctcccaccgactagttgctttctggtgttgctctagttttt

SEQ ID NO: 44236 - DNA, 310 bp, Triticum aestivum
  Clone ID: PAT_TA_44236
gcctgcagtaccggtcctacatttcccggaatgtcccactcgtctctacgtcttgagtgcctgtatgttgtaaggtcattgaactatgggctctacttaatgattgcgttacaagaggagatggggaataactgcggtttgctttattacacctgtgatgggcagtttaagataccactttaaacttctggtgttggtgaagttgggcatccaattgaagggcgagcatttgatatgcctggaggtgtacttccagccactttattgtgtttaggtgattgcttgttccactgctttccatgccaagggt

SEQ ID NO: 44237 - DNA, 251 bp, Triticum aestivum
  Clone ID: PAT_TA_44237
cgtccgcgggcgcatgaggcagcgactctccccttgcatactggtgctacgacctttcggcgcaggagcaggataactgtcgcgcttctcatatctgcctggggatccagcataactggcagaagcttggccggcttgccataatgataatacatacatatgatttgtagaccgtacctaatcaatgcatgaagtgtctgcacctaatgagaaggacattgatgcttttgataatgctgctatggacttac

SEQ ID NO: 44238 - DNA, 382 bp, Triticum aestivum
  Clone ID: PAT_TA_44238
cgtccgcggacgcgtgggcggacgcgtgggggaatttggtggtctggaactactcttgtgggagccaatcacgggtgccgagcagcgcataccgcttcccgccgagttcctgagcgactgcccgaccgcagccgtgttctgcgcggcggacgggtgcgaccaccgcgactgcctcggcggtcctttccgcgtggccttcctcttcgtcgacttgttaaacgaggagacacacgtcacttgggggcgcattaacatcggggagattgttgcttgtggtgagaatgacctctattcactgcaacatcgagttctccatgggattcacaggaagctccagcgtgctcgttgacagatctgtgctctacttcatgtacgacggcaa

SEQ ID NO: 44239 - DNA, 312 bp, Triticum aestivum
  Clone ID: PAT_TA_44239
cgtccgggcttcacctacatgttcactagcttcaacggtgagtcgtgtctgtattggacgactgggccatcgttaacctcgaggacaatgatgccctcatgatcaaaacatgcgtcgtcatgaagtgctccggcgctgaggaagccatagcatgtggccgctacaagcagtcctcgtttgcaataccacggccgacagagacattcatcaacagtcgtcgacccagatggaggctcgaagttcacgtggaagcacccgtggtctttcatggtcgttgccagcgccttcttcactaccgtgtcggctgtcggg

SEQ ID NO: 44240 - DNA, 351 bp, Triticum aestivum
  Clone ID: PAT_TA_44240
cgtccgtccaaggcgttttcctactcgcctctctccgcacaaccgatcctttcgcccaccttctggccattgggccagcggcgcacccaccaaccacccccaccctccgccatgagggagagcatcttgatccacatcggccaggccggcattcaggtcgggaacgcgtgctgggagctgaactgcctcgagcatggcattcagtcagatggccagatgccctgtgacaagaccgtagggggaggtgatgattctttaaacaccttcttcagggagactgggtctgtgaagcacgttcgtagctctctgttattagatttttagcccactgtgattgatgaggtgaggact

SEQ ID NO: 44241 - DNA, 409 bp, Triticum aestivum
  unsure (1)..(409): unsure at all n locations
  Clone ID: PAT_TA_44241
acgcctgcacgcacccagncccaattcccgaatcgccgcacgcgtccccccacgcgtccggagaaccaaatgcgagaagcgaaccaatcgtgccggaatagaagctgaccctggaaccctagcagactcaagctaaccccagatcggggtgagcaccacgagggggaattcctagggcagtggtggcgatcgacatctcgaagccctcggcgctgccggcgagcgtcgacgacccgtcggcgtcatttgtcaagggcaggtgcagaaattacaaggggcttggcctgaactacctgcaagacatccacgccgtgacaaggcacatgcccacctggaccacgagcgtctggctgtctacgacaagaacgtcgaccttaactcccgagttagaaagctccttgaagaggtg

SEQ ID NO: 44242 - DNA, 215 bp, Triticum aestivum
  unsure (1)..(215): unsure at all n locations
  Clone ID: PAT_TA_44242
cgtccantcttatactccccttccggttcgggttctggttcagttcgtttacgttcgaaagagaggccgtggagctagcctagtctagggtttcagaagagaggaagggagatccatggtgtaaacagagtaccgatgcttagagggcggactcacctgggccacctacaacagcaaccttcagtaagtcttcaatcagtacggcaagttacttt

SEQ ID NO: 44243 - DNA, 332 bp, Triticum aestivum
  unsure (1)..(332): unsure at all n locations
  Clone ID: PAT_TA_44243
ctgcagggaccgcagcctaattcccggnttcgacgccacgcgttccactccgttctgcagtggttcatcgtctccaatgttaaggtcacccccggcgcctcctccggcgtcggcggtggtaagaacggctacggctactacctcatcgaggaggaggagggcctcaacgaccacaacgtcgtcgttaagtgcgccgagatccagaccgccatctctgaaggagcaaccttatttctttttcaccttgtaccagtttgtaggtatgttcatgggcgtcttatgtgcggttatatcatcatccctttggttggttgtggtgctgacgctccacg

SEQ ID NO: 44244 - DNA, 384 bp, Triticum aestivum
  Clone ID: PAT_TA_44244
cgtccgcggacgcgtggggagagagagaaatggcgcagccgccgccatggaaggcgatgtacctgcctgtgacgagcgacgcgatccgatccgccgccgccttcaagcgaagcgtcgccgccgcgcgtcgcgatctggcgtccccgctggtgctggacacccgcgacgccgaggggcggtacaccttgctggagtccgcgctgacccacatcgaccacgcatccggctccctctccgctttcatcatcaacacggtggtggccgagcgcctgacgctccacggctgcggcgccgtcccatcggagccggtggcccgcatcggcgacctccgcgacggccacgggcgccacgacgagtggcttgctctcgtcaggctccaggccg

SEQ ID NO: 44245 - DNA, 338 bp, Triticum aestivum
  Clone ID: PAT_TA_44245
cgtccgtttgtttcggtgccttttgtttcaagagcctttatggattcataccctttttttcagggggggagctcttggtttttgcaactcatgctccagtaaactacatatgccttcattctgtgaaaccaagtttgcggccattatcaatggctatgtctactgtttcaatccatatattgggtgatgggccttcttcacccattggtgggtttattcaggtacttggtcttgtgcttggtttcaatgaatcataggcaaagaattacttgctcagcaacttaattgcccatgttctctgtatggaatcaggttcattttttttatgtacggagtaa

SEQ ID NO: 44246 - DNA, 388 bp, Triticum aestivum
  Clone ID: PAT_TA_44246
cgtgcgttcatcctttcattattaatatcaaaagtactattacacgaaccatgtaaggcccttggggatgggggtgcattcccccggtgcgcctctaaatacacagggcgtattcaggtgcatttgtgagccacatatctcagaccttgctgtggaaaagccaaaccccctagcccatttgcaggaccaccttaaggacgctcgccactacgccctcctgggcctctaagacacaaccaatattttctgttacggaccactttaccagattaaacagcatatactttacttaaatgacacgcttatccccacaaaagggaggtacatctatacagctatctttttacagggggagactgttaaagggcttcctaaccaattgaacgga

SEQ ID NO: 44247 - DNA, 377 bp, Triticum aestivum
  Clone ID: PAT_TA_44247
cgtccgcccacgcgtccgaaagaagcagatttgtccaattctgaaactagatttagtcaaggaaggtgcagttcatcacaacggcaattatggatatggattcatccttctatgctggatgaagggctggatgcaataagaattgcatgtgacaaacagatgcaagattctggtgttctggtcaactgttgttcactagagggaaaaattgcaagattggaagtcatgggatgcaaggctatgcaatctcttaagagtatattgcacccagttagtaagatacttgatacaagtgatatgtgtaaaccaactgatcattctctgtattcctctactggccctcatgttttggaagcatctgtcatcgatcatgctga

SEQ ID NO: 44248 - DNA, 365 bp, Triticum aestivum
  Clone ID: PAT_TA_44248
tcgttcgtggacgcgtgggctaggatgcacaattttctattcgaatagtcatttataaggggagcggggagcacaaggtttgtactcatatgcattcatgtgaacaaaatcatcctggcactgcaatcaaggtgcactaggtttaggttttctccacttgatggctctcatgttactgagcgtgttcgacatataataaaatttgaggggtttgatttagaagaaggtgctttgactgtcctttttcggttatagaacggtgacatgaggaactatttgaatatattgcatgcatcacacatgggattctagcatataaacataagaatgctttttacctttgcacggaaatccccatgcctaaa

SEQ ID NO: 44249 - DNA, 385 bp, Triticum aestivum
  Clone ID: PAT_TA_44249
gctcgccaccgcctcttcgttaatggcgccctccctcgctcacctcgtgtgccttctcctccttcttctggggctggtgtccgttctacccctctccgcagccgccttgaccccccggtccgcgccgccgtttgcgccgtccaccccggtcgttctcgcgctctttgtcattagcgacttcacgttcgacgtttgctccaacaactacctcggctcgcttcgtcgagccgaccgcgagccctatggccgggtctttgacacccaccgccccaccggacgcttttccaacggccgtatcctcgtcgactaccttgcggtgaaggtggggcttccctttgtgccttcgtacctctagctgagcatgcgcttgggcgttggcggtgct

SEQ ID NO: 44250 - DNA, 267 bp, Triticum aestivum
  Clone ID: PAT_TA_44250
ccttccgcggacgcgtgggcggacgcgtgggaactgctgcccttttgtcaactccagggctcccgaccgccgccctccgtgctgacgcctctcgctccccggagccaccgcgacaagctcgccgcgccgccgtcatggatgaggagtacgacgtcatcgtgctgggcacggggctcaaggagtgcatcctcagcggcctcctcttcgtcgacggcctcaaggttttgcccatggattgaaatgactattaatggcggaggattccac

SEQ ID NO: 44251 - DNA, 380 bp, Triticum aestivum
  Clone ID: PAT_TA_44251
tccctcctcccacgccgatgcattggtgtaccttgacatagtatttctttcacacacggcgggcaatctgggggcctgctaaatcaaatgccttgaacttgatctttcgctgaaagcagtacagtatgacgatcatgcggatggtcctagctatacgagcgcttgggtttgcaaggaatgacttgtataaaacggatcgggaggtggaactagctcttaccctggcaaggtggatgaggacccattttctggatcatgtgacgaggacgctccaccgtctttcggtactgaggcgccggcgccgacttcgaagcattacatgatggcaaacaagggcatgcttgttatggagtgactccttttatacactgatgttttta

SEQ ID NO: 44252 - DNA, 380 bp, Triticum aestivum
  Clone ID: PAT_TA_44252
cgtccgataacttcttattttataccaaaatctaacaagctaattattatttcgttggtttatggctttcgctgcatactcgtataaatcttgctctttctaaagaaatgcagaagtttatatgtgcatgcttgactaaatagatattagccaaatacaaggtggacatgcttcactatgataagcggtacccaactgattgtcgcctccatagcttccatcatggacgactggggtggcgaaccatgccactcaaggcatcacttttcagttgattgccttagtcatgtttgaagataggggcaattaggtctttatataatgttgtgaaactagcacagatgatgaaacactgtagggtgatatacttaatttacctg

SEQ ID NO: 44253 - DNA, 386 bp, Triticum aestivum
  Clone ID: PAT_TA_44253
cgtccgcccacgcgtccgcccacgcgtccgggttcgtcagcgagggcgaccaagtagatgaattgcagcaggtctgtgaggtacagagcgacaaagcaaccattgaaattacagggggtttcaagggaacggttcatcagattcagtttgcccctggtgacatagtaaaggtcggtgaaactttacttaagatgattgtcaacgacagtcaagttgtacctcatgatagcctggggttatcctctgacatttcaattggagtgggtacttttacaagttctttaagtcaaggcattgcttctttgggggtctatttttcacaccagccgttaggcatttagttgaagcaatatgggctttacatatatgttatttaaggtacaagg

SEQ ID NO: 44254 - DNA, 124 bp, Triticum aestivum
  Clone ID: PAT_TA_44254
tcccacgctttctccatacttccaaacccttgaagcgccgtctcctacaggtaagatagcgagatggtgtccggctccggggtgtgcgccaagcgcgtggtggtggacacccgtcaccacatgc

SEQ ID NO: 44255 - DNA, 259 bp, Triticum aestivum
  Clone ID: PAT_TA_44255
ccttccggctgtctaaactagcgctgatcctatcaaggattgcccgacaagtagacggggggggggcagtaattatcagaggccgtctgcggcaactgaaccagacaggagcgaccgggatgagcgtgctcagcctgctctcccccaggaggcgtcgtgctatagcacgatacttattcccattccgcaatgaagggcctcctgcacatgaagcttcgtactttccgtcaggaggctcccccttgccactgcgccaaga

SEQ ID NO: 44256 - DNA, 324 bp, Triticum aestivum
  Clone ID: PAT_TA_44256
cgtccgcagggggcgagtaatcctgaaccataggcttacaggagatcagccatcccttgaagcgcgagaaggcggacagggaggccgctatagccttcatgagtgatacagagggagctcagggatctgcagaaggatcccgccacctcatgcagggcaggtgctgtgggtgaagatatgttccactggcaggcaacaataatgggcccatctgacagcccatattctggtggagttatcctagatactatccactttcctcctgattatccttttaaaccaccaaaggtggcattccgcaccatggtgttccattccatacat

SEQ ID NO: 44257 - DNA, 209 bp, Triticum aestivum
  Clone ID: PAT_TA_44257
cgtccgctccagctcatcaacggcaagaccctccgtgagaagatgaggttcgtgcagcgtatggagtgggacatgaacaccaacttccagcagtgttcgacagatcctccgacggggggagcccgctgcgccagaagatgatcaggactggttggacaggacatgagtcgacagcgcggccgagtcgacacatactacttgagcacata

SEQ ID NO: 44258 - DNA, 284 bp, Triticum aestivum
  Clone ID: PAT_TA_44258
agtttcgacccaggcgtgcgctcacgcttatcaacagttctaccctacgggagaagacgaggtccgggccgcgcatggagcggggcgtgcagaccaacttacaagcatactacaacccatttcttcgtacggacgggtaagctcggctggagcagcgaagatgatcaggacatgagtgggtgacacggacattcagatcggcgaggtcgactcgcacgagagagagtacgacggatcctaatttgaggacgacagtgagtaggactacaggtgggaaaggcaca

SEQ ID NO: 44259 - DNA, 320 bp, Triticum aestivum
  Clone ID: PAT_TA_44259
cgtccgcccacgcgtccgatcttgaggtgttggccctggtgggatgtgttggaatagaggatgatgcccttagtggccctgagaatgaatgcagcaaatcactacgggtgcttgatatgtcaacctgtcgaaatgtcactcatgcgggagtttcatcagttgtgaaggcagtgcccaatcttttggagttgaatctgtcggactggtgtcatgttacttcatctatgggaagatgcttccaaattcttcctaaatagcagaccctgaaattgcaaggctggaagtgcatggctggtgggctcaactacatttggcatttc

SEQ ID NO: 44260 - DNA, 418 bp, Triticum aestivum
  Clone ID: PAT_TA_44260
cgtccgggacgacccgttccgcgggttcggcgcgctgccgcccaaggagcgggcgtggggcgcgctcaagtacttcgtgccggcgctggagtgggtgccccagtacggcatcgacaagttcaagttcgacctcctcgccggcatcaccatcgccagcctcgccatcccgcagggcatcagctacgcgcgcctcgccaacctcccgcccatcatcggcctctattcgagcttcgtgccgccgctgctgtacgcggtgttcgggagctccaacaacctggcggtgggcacggtggcggcggcgtccctgctgctggcgtccatcatcgaggacgaggtgtcgcccgaggacaacccggagctctacctgcacctcttctacaccgccgccttcttcaccggcatcttccagacggcccta

SEQ ID NO: 44261 - DNA, 210 bp, Triticum aestivum
  Clone ID: PAT_TA_44261
cgtccgctcgtttctaatcatttctttggcttgtttacccccatggcaggtacaaacattgaagaagttggtcaacatgttcaactgcgagttacacccgaaatgaacactttttttcggattgaatacacagcccaggagataaagagtgcacttggatgatatgggtgacctgaaagccccaggggctgatggtatgcctgcagtatt

SEQ ID NO: 44262 - DNA, 274 bp, Triticum aestivum
  Clone ID: PAT_TA_44262
agcggatccacactcgcggcggcggctgagagcgggaagcgaaaactcgaagcagcccccgagcggcgaggagcatggccagcgaaggcgagcacgctgcggttgtctagcatacgtcgttcaatgaaggcgggcgaggcggagcatggcgaggagcttcaggtccttttcggctggaccaagaagtttaatcccacttggggtgggaagtttgtggttgattttttttatttctttaaattgtgttatttttttttgttttatttattttttt

SEQ ID NO: 44263 - DNA, 359 bp, Triticum aestivum
  Clone ID: PAT_TA_44263
cgttcgcccacgcgtacggacaactaagtgctggagatgactttgttcttagagaatatggtgaagagtatgacacaattgattgcccaccaactgtctacggcaattgtactggaaatgacggtggatattcttttgccactattgatgctgggattacaggaagataccaggaagattctggtggcggtactagtggtctgggattattaagcaacatacgctgatgattatgtgatgattaattggttatcgcccgattctcaactggtgtaaggttatcaattatacggggatggcacacggttatacttatgttggcttgtacaatttcttcagtattacattatacgactttt

SEQ ID NO: 44264 - DNA, 364 bp, Triticum aestivum
  Clone ID: PAT_TA_44264
cgtccggtcgctcaccgtagttaaggaggagcatccttggtagctttcgtggactatttaagaggggggggctgagctcactccactggttcataaattaccctgaaacaccatactatcctctcaccaacaattacaggcactttcctgcgggcctgtttctataggaggagaatcggaaggagttgcttcgtttgcttcgtgagatggacgattttcaagctgaaagattcgccatggagatcaagaataacacctaatctctccagctttttgtgcgaccccttttaaaaccaatctcatcttaagattgtcaaactatacttttgtagtttgatcacttttataggacttatttgctatt

SEQ ID NO: 44265 - DNA, 187 bp, Triticum aestivum
  Clone ID: PAT_TA_44265
cgtccgggacgttcttgcatttgttttgcttattgtgatatgttatttgcgggcaccttgtgaaagctcacaaaggtatgcatattcaggcgaagctgtcgacgatgaggaggagtctcagtctctgacaaaggggtctgatggtgatgtagggatggtaaagattgacatagacagatatgctggt

SEQ ID NO: 44266 - DNA, 415 bp, Triticum aestivum
  Clone ID: PAT_TA_44266
cgtccgcggaaatacatattccagcatggatttgcaactgatccatgggtgaatggtgttgtgccacatcggccacacatgccaacaaccgaccttattgttgcccacttcacacagctgccaacgcaagacctacagagcttgtcgggatgcagcaccttcaccacgagcttgtttctataatcatgaggaggtattcccagtccgaccaggaagcgaattcaaagtgtccatacatgaactggaggcacaatatgaaacctgaatttgcgaccattgtccttgcggaccatgaatatttgacgaacatctcgatccagaagctgctggttggcaacgagatcccatatgacataaccttctgccagatgttcttcttgccaataccatcagaggatggttggataatactgat

SEQ ID NO: 44267 - DNA, 320 bp, Triticum aestivum
  Clone ID: PAT_TA_44267
cgtccgcccacgcgtccgcccacgcgtgcgcgtgacgccaaatttccggcagcttccttcagttttcgcgcccaccgaggcggcagattccttggccaattttttggcgatccctacattgacggggcggactggggcgtgatccaaatcggtggaaagagggaagaaaaaatacataacagatcgatcaagcggtcgcattagcagctagagaggaaaccctaagcaagaaaccctgattggtctagcggcgcgccggagatggagctctatgacagcgagctggcgggggtgaagagctacagagagtacattgagtt

SEQ ID NO: 44268 - DNA, 203 bp, Triticum aestivum
  Clone ID: PAT_TA_44268
cgtccgcggacgcgtgggcggacgcgtgggcgccgcgcgcctcgagtccgcgctcgaggcaagaaaggcagttcttcagcaggataatgagttggctgagatgaggcagagattgcaatctcatgctgattttatgggggaattgtggatgcaaacgaaggaagtgtctgtgaatgttgatgactggagggagcaactttgtt

SEQ ID NO: 44269 - DNA, 415 bp, Triticum aestivum
  Clone ID: PAT_TA_44269
cgtccgccgcccgcccgtgccgccgccgcctcctccaatcgttgagctccctcctcgcaggcgcgatggtgtacatcaagaaccagaacacaccggcgtactccaagcgttttcaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgagtatgctaccattgctggtgatatagtgatggccgatgcttacttccatgagttgtctagctatggtcttgaagttggcctcaccaactatgctgcagcctaatgcactggttctgttttggcccgtcgtgtgcttaagaactgtgatcttgatga

SEQ ID NO: 44270 - DNA, 115 bp, Triticum aestivum
  Clone ID: PAT_TA_44270
cgtccgggcatggccacgccggaggcagacgttggcgcccccgtgagcgagacggctcctatgatgctgcgacgggcgcgtggcgatcgttacggccggctccgtctttattggc

SEQ ID NO: 44271 - DNA, 177 bp, Triticum aestivum
  Clone ID: PAT_TA_44271
cgtccgcccacgcgttcgcccacgcgttcgtggaaacaaagagaaaccattggagggactggacatagttgttgatgcagggaatggagtcttgtgctcttttgtgtgtctaaatccatttggagttgttactgttggtatctatatcctggtgcttgatggtttgtttctcaatta

SEQ ID NO: 44272 - DNA, 211 bp, Triticum aestivum
  Clone ID: PAT_TA_44272
tcttccggtggtggttgccaccattaataccatgctctccatttcagagtgtggactggtgtggtagggggtttaagtgctggagtaactacctgctcggccaccggggggtctggcggatatctggtttttgtgcatgagggtcgtatgtatgatttctaaatgtcatctgcgttgttttgggttttttccttattgatctctagtttga

SEQ ID NO: 44273 - DNA, 137 bp, Triticum aestivum
  Clone ID: PAT_TA_44273
cctgaatcccgatcttatcatacaaatatgtcgtatagcactcaccaaatgtacccctgagtgcaacgcactactgtgtggatacagtatggcgtcttgatgcgatttcttacttcccctaacccttactttgccta

SEQ ID NO: 44274 - DNA, 287 bp, Triticum aestivum
  Clone ID: PAT_TA_44274
cgtccgcggacgcgtgggtctcggacgtcttctccgtcgacaaccgcctgatcgtatccgttttcggcgaggtcaccatcaagctctggtacaccctttgcgagtgcaagtacaccatctgcggcgacatgggcggcggctagggcctcaccggctgagtctcgtgcgtcaggttctcccccaacattcagcattccactcattggcttcgtcttctgggacatgaccgctaaggtctggaaccacaccaactgtaagctctgttccactttcgccggtcactggtg

SEQ ID NO: 44275 - DNA, 416 bp, Triticum aestivum
  Clone ID: PAT_TA_44275
cgtccgcccacgcgtgcgcctgatccaatagaacaccgacgctcgctgtgaacctgacagcgcagcctgcacaattgctggctgccacaactcaaaacgctcaatgctatgccactccacctataaagaagccaaagctttaccagctgaagagagtgcacggggtggtccaatcggaggccttctgtaaccgatgacgagggaaagtaacccaggacacacggtagccctgcatgcatggacatagtaccagacgcaatgccatgacgccacaaacggtggggtgaaccaacagaatcttggagcgcttacacatgtgatttgagtcaatcccatcaccagttaggacaatcattgcccgttatgaaagccacttgcctagaaccctacaaggtgtgtgcgatttattatccact

SEQ ID NO: 44276 - DNA, 281 bp, Triticum aestivum
  Clone ID: PAT_TA_44276
cgtccgcccacgcgtccggaaagggcacgacaaggatcccggctacgagtttcttgtgtctcgtgtttgggggacaagcgattgatttcgttgttaaccctatctaacgccatggggtttcttacacacatggaagcgttcaatgcagtatgcgaagcataaaaggctggggccaggtgcaactagaggctcgtcattcatcgtgtgaccaacggagggtgctttgacaaatttaataaggtgattgactagtgccgcatacattacagtcccgaaacgtt

SEQ ID NO: 44277 - DNA, 237 bp, Triticum aestivum
  Clone ID: PAT_TA_44277
cgttcgcttcagttggtctcctactgatcctatcatattactctttgtgcctgaattaggtggaggaaaccagcctgccagggagagtcttgtgcaaattccgggcaaagaggagattcggcataaaaaccttttcagtgttagttgactgcataatgtactggtagaacattggataatatctggctgtccaggtagacaggttcactaaaacatagtatagcatttacactgggt

SEQ ID NO: 44278 - DNA, 358 bp, Triticum aestivum
  Clone ID: PAT_TA_44278
gtggccgcctgcagcaccgcttctaaatacccattacgaaccaatctttcacaccgtcatatctttctcacccaaaccttagactacggctacgatggtccgaacgaagcagacggggcgcatatccaccggcggctaggtgccccgcatgcagttggctaccaaggcggcgcgcaagtcggccccggccaccggcggagtgataaagccccaccgattccgtctggggaccgtagtgctccgggagatccgtaagtaccagaagagcacggagctgctcattcgtaaagctccctttccagcgccttgtgagggagatcgagcaggacttcaagaccgatctaatgttccagagctt

SEQ ID NO: 44279 - DNA, 237 bp, Triticum aestivum
  Clone ID: PAT_TA_44279
tgctttcgttgtcgcgtgggcggcgctgcagtttctcaacctctccaacaaccacctcgacggccccgtgcccaggtccctgctcaggttcttggacgcctcctttgccgggaacagcatgacgcggccggcgccggtgttgtcagcggtttcggcactgtctctcgcctcgtcggcggccggtgcgtctgcttagaaacggtggtggcttagtgaggcggttgtttttcgccttta

SEQ ID NO: 44280 - DNA, 357 bp, Triticum aestivum
  Clone ID: PAT_TA_44280
cttcaccaccccacttgcccccggacccaggagggtcgacggagatgtcggacaccgatgagcaccacttcaagtccaagggcgacttctgcgcctacaaaacctaccctcagcaggccggcgccatccgcaagggtggacacatcgtcatcaaggcccgtccctgcaaggttgttgaggtcaccacctccaagactggaaagcaatggcacgcatagtgatactttgttgccattgacatttttaatggaaagaagcttgaggatcttgattcttcatacaacaactgagaacgttccccatggtgaccgtcaagattaatcagctgtatgacataactgtaagatggatatgtca

SEQ ID NO: 44281 - DNA, 117 bp, Triticum aestivum
  Clone ID: PAT_TA_44281
tcgtccgcccactcgtacgcccacttcttcattcacatgggctttatgagagatagatactccctgccataattgatggatatacgggaaaatgtctcgttatactagcatgcttat

SEQ ID NO: 44282 - DNA, 224 bp, Triticum aestivum
  Clone ID: PAT_TA_44282
tgcttccgcccacgcttactagaacgcttgggggagctcaaagagaggtcaatcagagaggaacagtgagatgaaaacacaaaaaggcctttgttgaccaactgctttccatgtccaggtatacaaccagagtaattttattccactctctgcaaatcagggaaccgtgcgcacaatgacgatagagcttttgtagtagagcaaaagaccggcaccaatatgga

SEQ ID NO: 44283 - DNA, 253 bp, Triticum aestivum
  unsure (1)..(253): unsure at all n locations
  Clone ID: PAT_TA_44283
cctgcagnaccgttccntaatcctcgttcgacccacgcgtccgcgctatttgaatctgaccatggttgtacctgaactcgatatgcaatccttttgggctgatcctagagatttagaagatatattatatgtgaataattttatctattttctaagagatgaggtgttggttatcagttgaacatccacagatgtttaatgggtttgaattattaataatgcaaatagttagctatatctagtgagattatac

SEQ ID NO: 44284 - DNA, 126 bp, Triticum aestivum
  Clone ID: PAT_TA_44284
tcctcgcgtccgttgttctaatgtttcacgtaaggtttccggttgctttcttattattctaatgcccgtatgagtttgttgggaattcagcagagttttggcttcctgaagttgtctctgatattt

SEQ ID NO: 44285 - DNA, 219 bp, Triticum aestivum
  Clone ID: PAT_TA_44285
cccagcttccgctcaccccatccacccaccgtatctcttgggctagcgtgcgttagcatctaacggcggggcgtcccggattgtgagtcgcggaggcattcctcggcgcccagatgagctcccggttggccggatcggtcctccttcgtcgcgccggcgccggcgccggccgtctctttggcaccaccgtgtccccggcgggcagtaccgcccttgttg

SEQ ID NO: 44286 - DNA, 300 bp, Triticum aestivum
  Clone ID: PAT_TA_44286
cgtccgcccatgcgtccgggaaaggcgtcttcttactcgcctctctccgcgcatcctagccttcgggctcctccttccccatttcgccagcggcgcatcccaccaaccacccccacccgccgccatgagggagtgcatctcgatccacatcggccaggccggcatccaggtcgggaacgcgtgctgggagctctactgcctcgagcatggcattcagcctgttggccagatgcccggggacaagaccgtttgggggaggtgatgattgctttaacacccttcttcagcgagactggtgct

SEQ ID NO: 44287 - DNA, 329 bp, Triticum aestivum
  Clone ID: PAT_TA_44287
cgttctcatccgcgttccgttccgtcacatcctcgactccgagatggagctcgacatacttcaacagcaccggaagcgactccgcgcggcccaaggtggatcatggcatcttcgctattgcggtttatggcaatattaagtgcgcgcccaagttgtaggttggtgctagcctgcttggtcgtcgccgtattgcagttcggctgatctcttgaactcttcattctaaccctttaaattcattctctatgaatttaccatgccttggtgttcttgatttggctttgcgggcccataactgattttcgggttcaaccatttttttggtgtct

SEQ ID NO: 44288 - DNA, 125 bp, Triticum aestivum
  Clone ID: PAT_TA_44288
cgtccggtcacacggggaaagaaacaccaaaggtggggaagagccctcttccagataaacggacaagagtacacccatgtgaagggtatctacattattagcacagacgttcaaacgggttgaca

SEQ ID NO: 44289 - DNA, 416 bp, Triticum aestivum
  Clone ID: PAT_TA_44289
cgtccgctgtgaggtgctatgctagccccctttcaaatgttcgagtttcggccgtgcgtgatttctgctcagggaaaggcgagaaggaaacccgaacagcatataaaaaggtgaaaactgagaaggatgatgataatcagggaatgccaaaaaatggagttgcccttgctagggagaaagccatcagatccttgcaggatttccgcttaatttacaagaatcttttgaataaacttgaagacaggtcacgggaaggaggagccgatctacaagcttacaaaatcttcagggacaggttccttgcacaggggaatgacgagagatttgttggcaatgtgcctggaatccatgttggggatatcttttatgcaagggttgagctttgcattatcggtcttcatcgcccacaccggttt

SEQ ID NO: 44290 - DNA, 385 bp, Triticum aestivum
  Clone ID: PAT_TA_44290
cgtccgtttggaaggaagcctcttttggaagtcgccgaggaggccatggcccgtacgaagcatacgcggccgcaagtccaccggtggcaaggccccccgcaaacagctcgccaccaaggcggcgaggaagtctgcgccgactaccggcggagtgaagaagccccaccgctacaggcccggtaccgtggcgctccgggagatccgcaagtaccataagagcacggagctgctgatccgcaagctgccgttccagcgcctggtgagggagatcgcgcaggacttcaagacggacctccgttttcagtcccacgccgtgctggcccttcaggaggcgtgcgaggcgtacctggtggggctgtttgaggacaccaaactgtgcgccatt

SEQ ID NO: 44291 - DNA, 421 bp, Triticum aestivum
  Clone ID: PAT_TA_44291
cgtccgcccacgcgtccgcggacgcgtggggtcggccggccttcagtggcggcggcgctggccttgctctggcgacggagctcgagggcgtgccggctgctgttcctgctgttccaccaccgtcggctggccttcagtggcggaggctcgagctcctgggcatggccagcaactgcttctgttctgggcgcggcggccagagcagcacgcaccagttcttcctgcagccgcgtcgtcacgtttctgaaaaccaccgtacgtcatggccaatgaacccagtgctcttgagcccctctgcttgcttccgaggcaccaacatgcttcctgatcctagaagaattgcccacgcgttcagggtgggactggtcttcaacatgggccttcatgtcattctttggatggtaagaattccagatagggg

SEQ ID NO: 44292 - DNA, 374 bp, Triticum aestivum
  Clone ID: PAT_TA_44292
gattccttcagtgttagaagggccttggatacacacgcgtctaaggagagtccagcaagtgctgttgctagtgataggggtactcccgtaccttcgagttctagccaggagaagaattcactgaccaaggcaggacgagagaaagtgaaggaaaacagtgattccaaggataagccgttgcctactgagctaaatggaaaaggagaccaggcagcgaattcgaagagtgagaggtcagaacctaatgtcgaccgtgctgaggaaagagaaagatgtagatcaagaggccgtgaacgtgaccgtgatattatgggtagtgattctgatcaccagaaggagcgtgttatagccaagagacaccggtcgggagacaa

SEQ ID NO: 44293 - DNA, 301 bp, Triticum aestivum
  unsure (1)..(301): unsure at all n locations
  Clone ID: PAT_TA_44293
gcctgcagtaccnnnccnnntccccgctcgtttctacttttgtggcatcgattatggctttctggttctcatggacaacaagacattgctgttgatcttggaggaactgaactcgtgtgtgtaagatgttatgacgttgggcgcccagatggcatctgcaaaaatgtgctgctttgccgttctcacccatcagtgttacaaacacatagtctgcacatcatctgcacaggacacctatacatttatcacatcttaaaatgcaatacctgttatttctttatagtgccatgcaagtttgctt

SEQ ID NO: 44294 - DNA, 248 bp, Triticum aestivum
  Clone ID: PAT_TA_44294
cgtccttttaaatctctgattgcttactctgaaaccggaatgcatcttttatcgaccacatatcatctatggagctagggtgaaactgttggctcgttatggcatcgatgtagatactagaggaaactaacctgctcacacactaccttcagtcccatgactgatatcttcaatgggttttcaataccttgaagcaggagggccatacatttactttatttttcatagggattagttctcacacatgc

SEQ ID NO: 44295 - DNA, 178 bp, Triticum aestivum
  Clone ID: PAT_TA_44295
tacccatactatcgtttggatatgatttctaagaccttggacctctctttgcatacaacattgcaaattttcctactctggcttattaagagtgatatgctgttaaatatacacatgggccccattctggatattctgcgaagtatctgaaccattgcgcacatccattataccccca

SEQ ID NO: 44296 - DNA, 222 bp, Triticum aestivum
  Clone ID: PAT_TA_44296
cgttcgtttttctctgtcactcaaggagggtcttaatcttgatgagagcgaggactagaagaggaggcaggaggagctcaaggtgatattcttgggcctgtgcaaggtcttcaaggtggagctgtactgcaaggaggagaaggatattgtctctgtccgagtttgtggactctccctgctgtctggtgactgctgattttgggcgatctgccaacatgtaaa

SEQ ID NO: 44297 - DNA, 201 bp, Triticum aestivum
  Clone ID: PAT_TA_44297
tctcatcctctcttctcctagctagtctgacaaactacaagagtgctgcagaccaccctgagtcagcggtacgaacttaccctgctatcacacacttcactgctgaagaggaccagacgaggatccagtctttactgcggaaggacattagcagtggagacacagaccatgcccttacgtgcctacggcagctgctccccc

SEQ ID NO: 44298 - DNA, 404 bp, Triticum aestivum
  Clone ID: PAT_TA_44298
cccacgcatcctaaagctgtggcggcgcgcgcataggaggcgaatcatcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggtgtagtgaggctgtgacccgcaagacccgtctcctggatgtggtttacaattcgtcaaacaatgagcttgtgaggactcatacccttgtcaagaatgccattgtgcaagttgatgcttgccccct

SEQ ID NO: 44299 - DNA, 169 bp, Triticum aestivum
  Clone ID: PAT_TA_44299
cgtccggttctctcacgcctaaactccggaagcgtgcttaataatgctatgatgatgggcgcggactctggcgagaccgaagacgagagctcgaggctgatgtcggagggcatggtcctcatcggcgttggggagaacacatagatctgcaactgcttcattcgacatt

SEQ ID NO: 44300 - DNA, 380 bp, Triticum aestivum
  Clone ID: PAT_TA_44300
cgtccttgtacgcgttggcagactcgttttttttaacttttctatttgttccccctcatttccggggagtggatgcctatgtgtccccttctccgacttgcctctcaccgtcgtcggtcgtttcttgttgtaattcttccctaacctttttcgcgtcgtccaccgtcttaactgtttgcactcttccctcccctgcattgcgtggtacccaagcgaccgtcccctttccgacccccccgtggcggatccggtgagcggcggtcttctccgacgccttgttcgcttcctggttcagtttggtgattcacaaattttgcaggcctgaggctttggtgtcattaaagggttcatacaaaaataagtctacagcttgcgagcac

SEQ ID NO: 44301 - DNA, 425 bp, Triticum aestivum
  Clone ID: PAT_TA_44301
cgtccgcagacgcgcatgacaactcgtgggggcagcgccaactatcacactcgaacgccgggtagccgaacgcctactcccctagccgccgcggcgcatgcctcctaccgtgcccgatactttagacctagcctgctcccttaaaagcagtggagtggggtggtgaaaagggcaacctcatatgcagaacagcgtggtcacaactatgacactgcgagtatcgagggtgcatctggatctttcactgggatcaatgagcaagtgttcgctgactatatcctgcacacctgtacatttgtggaagggcctcactacaaagcattgcctgcaggcgacgaagggaaatgcaaggttgataacacacggagaaggctgattgatacaaaccacacatgtacccatatgctgaactgtgctataaagga

SEQ ID NO: 44302 - DNA, 185 bp, Triticum aestivum
  Clone ID: PAT_TA_44302
cgtccgttattcccaggtatatactcctctaaactactcctcctatcacacatttacgccgggggaggggagactactaccatgccgccgtggataataccatctcccgtgcccgatactttatgactagcctgttcacttaaaagcagtggagtggtgtggtgaaaagtacaacctcatatgca

SEQ ID NO: 44303 - DNA, 428 bp, Triticum aestivum
  Clone ID: PAT_TA_44303
tcgttcgctcatggacacccagattttgtatgcaattttctcaacacccagattggagcctaaggttggacattttgatgggactgtggatcttcggatgttggtgctgagattgatgtggccctagctacatgtaagcgaagcttatgatgtcgatcctccaggctgcactgccatcgttttaccttagaaactgttggtcgtaattttgcatccacttgttaatttatttattatcgttcctatcaaatgctaattcttgtcaactagtaatactttagctgtatgttgatgatctcttatggttgcaagtgaaatgcatccttgggcataatgaccacattcttagattggtctattactgtctccttcatagccttctggttttattttcactatatatcttttttggtctaagtttcaactgt

SEQ ID NO: 44304 - DNA, 436 bp, Triticum aestivum
  Clone ID: PAT_TA_44304
cgtccgcgcaaccaaccccccacgcacgcacgcgcgccgttccgatcaaatctccgcaccccaccccgcaaccgcgtcgcccaactcgaagcatccccgctggcccgcaccgcgccgacccccactgcgatgaccagtagaggcgccgccggggaccggagccgatgaaggcgacgccgccgcagaggcggaggggcccgcgcctggtgctgctcgcgctcgtcctctgctccctgctcgtgcccctcgccttcgtcttcgaccgcgcccccaccggctacgtgaccaccgacgagcggcgccgacaggaggtcgtctttcatccattcgatcccgtggagccgattgttggcggtggcgctgtcgatccagtccctgtcaaacgagcgatacaggatgcacccaggaagatttcgaatggcagcagtggggtgcc

SEQ ID NO: 44305 - DNA, 281 bp, Triticum aestivum
  Clone ID: PAT_TA_44305
cgtccgttcaccacgtgttgaactgctttgtaaatttgtgatatagtattaactgacgctgattgattgagagattgcagggggtgtggtcagacaaagtgcaggaatgggaggtgtgcgccatgaatgagacggcgtgccctgacatgtacatatgcttgttctttttttcattttttcaaaggaaaaggaaaaaatgttcactaattattcggctgtgtataattaggagcgcttattaccttaaaaaaattggatcgggtatctgttatttattgtac

SEQ ID NO: 44306 - DNA, 286 bp, Triticum aestivum
  Clone ID: PAT_TA_44306
cgtccgcccacgcgtccgcgaaatctgaatccaaatctcggccgactccgccgccccatgcctccctcgccgtcgcagccgccgccgccggccacggaggaggtcgaggtggaggacgtctcggacgacgagacggtggagggagaggcgccgccacttgccccggccccggctccggctcctgccccgccggccggcggaggtgccgaggcgagccgtgccgcgttggggtcgggggaggcggcgggcggagaaggggccgactaggaggaggaggacgaggatt

SEQ ID NO: 44307 - DNA, 391 bp, Triticum aestivum
  Clone ID: PAT_TA_44307
ttttcaagaacaaacacgaactataaagtgatctagaagcaatacaaacatggtacgatggtaacaacggacgagcaacgtccatggcgaatcgatcaacaccctctccactctgcctacatatacgagtttatcacagttgccaagctaaatcgagcctgtcataacgcgccggccgtccggccagccagccaccggagcgtccatcaccgtcgccggaaccaggtcaagatcaggcgagcggcgccctggagacgcggaccttgaggccgtgcgccatggagaggatggtcatcatgcggtacttgacggggtggccctccacgagctcgaacctgaagaacctgcacaggatggccagcgccatcttcatctgcaggtacgccgagtc

SEQ ID NO: 44308 - DNA, 438 bp, Triticum aestivum
  Clone ID: PAT_TA_44308
cgtccgatcctctcctctcatcaccacaacacagccgctgagtccacagcactcttctcttccattcaactccacgcaaagtctctctccctcagctacgtttgcttcgttgccttgtgtcgcatcaaatcaaatcgagcgctaggctgtaagatccatccatggctccttcacagcaagtcgccgccaccaaggagccatccgccaacggcacggccgcaccagcccccaagaccaagaccccggcgctgaacgagcggatcctctcctccatcacccgccgctccgtcgccgcccacccgtggcacgacctggagatcggcccggacgcgcccacaatcttcaactgcgtgatcgagatccccaaggggagcaaggtcaagtacgagctggacaagaagacggggctcatcaaggtggaccgggtgctctactcct

SEQ ID NO: 44309 - DNA, 429 bp, Triticum aestivum
  Clone ID: PAT_TA_44309
cgtccgcggacgcgtgggcgtgggccagcgtcaaggacatctgcaaggacggcggcatcttcaagaaggtcctggtcgagggtcagaaatgggagaatcccaaggatctcgacgaagttactgtcaagtacgaggcgagacttgaggatggatccgtcgtgtccaagtcagagggtattgaattcgcagtgatggatggttacttctgccctgcactttccaaagccgtgaagaccatgaagaagggcgagaaggtcctcctgaccgtcaagccacaatattggttcggcgagcaaggaaggccggcttctgaggttgaagccgcggtgcccccgaattccacattgcacatcgatcttgagctaggcttctggaaaacgatcaccctcattggtgactgacaagatggatctgaagaatgggctcaag

SEQ ID NO: 44310 - DNA, 188 bp, Triticum aestivum
  Clone ID: PAT_TA_44310
cgtccgccgaaacgcgccggccgctcacgagttccacaggcgggaacaaaactcgaaagggaagcggggcttggcgcctcgcggatgtcggagggcgacagcgacgggagtcgagaggccgtggccacggtcacgtgcggcgtccagcccgcgccgtgccgggacaaagggtgctcgcgggacccccg

SEQ ID NO: 44311 - DNA, 415 bp, Triticum aestivum
  Clone ID: PAT_TA_44311
cgtccgcccacgcgtgcgctggcactagatccacaactacatccactttgtcgtcgtctttctacggctgaatccacggcagcggcctccctgaccccctgattcacccctggatccacctcattggcactgtaatcacgactggctccacctccgtcgctgtctactttgatacgaactcggtgacgcgagctgttgcgagagcagttgtcaaaccattctgctgctcctgctggtggtcgtgggtggcgtggatggccgccttgatgagcctcgtggatagcctgctcgatgtctcaagcgcattgtcaagtgcggtgaaaaggccgaccaacgggcgatcacaaggacactataccacactgtataacacgttgcaggggttggcagcgggcaaagctactagccacatttt

SEQ ID NO: 44312 - DNA, 311 bp, Triticum aestivum
  Clone ID: PAT_TA_44312
tcgtccgaaaaaaacccgagatagagaacgagaccacgccgcattccccctccaccctgcgtggggatacccgtcgattgctcttcgattccgccgactatccgcgccagatcccatcttcatctcaggttgaggtgagtagtagagggagcggagagctagggtttccgcgcgcgcgcgtgtgtgggaggggagaggaggagcagggatggcgcatgcgttggaggagtgttaccgttagatgcccatcatcacgcgctcctaccttaccgctcgcgtacttaccaccgacggctgcaccctcgagatca

SEQ ID NO: 44313 - DNA, 414 bp, Triticum aestivum
  Clone ID: PAT_TA_44313
cgtccgcccacacgttcgcccacgcgtccgccgacgcgtgcgggaggaggccaagactaagggcgtcctgatcaacagcttggagtggtggttcacgccacgcttgtacgagctcgcgcagacggatgttcagaagggctaggtcgtggtgtacatcccggcgtgggctatctaccacaatcacaccccctgcctatactggctggggtaacttattctgccctttggcgaccagctctgatccaggttgctgtacggctggcttatgcggcataaggtgtcgttgctataggccaccctgagggatgccgttagaaactaattccatgacaacgatgtgatgcatgacatgctgtggcccctagtcgaggtcggagaacgcctccagttatggcacgctgaaatggatgtgct

SEQ ID NO: 44314 - DNA, 434 bp, Triticum aestivum
  Clone ID: PAT_TA_44314
cgtccgcggacgcgtgggccgccgcctcccctccgttcgttcttcttcttcgagttgggtaggttagctctacccaccagccatgggttaggagaagactcacatcatcatcgtggtcattggccacgttaattctgtcaagtcgacgaccactggccacctgatctacaagcttggaggcattgacaagcgtgttatcgtgaggttcgagaaggaagcctttgatattgaacaagtggtctttcaagtacgcttggttgcttgacaagctcaaggccgtgcgtgagagatgtatcaccatcgatatttgtctctgtaagttagagaccaccaagtactacttgctccgtcattgatgcccctgatcatcgcgacttcataaagaatatgatctctggtactttccatgctgactagtgcttgttttataatcg

SEQ ID NO: 44315 - DNA, 427 bp, Triticum aestivum
  Clone ID: PAT_TA_44315
acgcgttcgtccacgctttcgctgaggtccacgacggttgtccaggtcgtttcgtaaacctgagccatggctacacgagaaccctgggtcccgtgctttctgcggcggcgcggcaatgtcggccgactggctggagttccgacagatcccgtagaccggtgagttttcctttcccggtgttcgtctttcgattgcttgattgtcttgggggcccggattttcggtccatgattttggagaccgaccacagcatattaccaccggcggtgagcggtgactatgctttgactctgacgtttccttctagggaggagcttgcggacatcctggaacattatgatccggtctcccccatgctgatgccgtcccgtgtattcatttcggctatgccgtatgattccaatgttgggtcatgctgctcgcggca

SEQ ID NO: 44316 - DNA, 157 bp, Triticum aestivum
  Clone ID: PAT_TA_44316
cgtccgttcccttttcctcccacccatagccactaatgcctcgcttggcacgcccgttttcccttccatggcttccgtttttaacaaggttggtaaattcccttacactaccttcaatagtgctgttcctaataagcataaccttgcatagcccttc

SEQ ID NO: 44317 - DNA, 137 bp, Triticum aestivum
  unsure (1)..(137): unsure at all n locations
  Clone ID: PAT_TA_44317
gcagccccggtcccnaattccctgttctacccactcgtccacccacgcttccgtacactccagcgcctgccgttccatttcgctccggcctcccgccttgagcggttgttgtgtgcgcgtgacgctcgccaggagga

SEQ ID NO: 44318 - DNA, 263 bp, Triticum aestivum
  Clone ID: PAT_TA_44318
cgtccgctatatcctaattcggagtcatcatcgtacgtctgcaccgggtcattctcattctgttggctgtaagagcctcacgagtggataaacaagatgccttctacttggctcttcataaatataccgtctgtttccacagaggcacccgcgaacatcaccgcggatcactttctccctttcaattcggttttcatgaagactcccataacataccttgtttttgccggcaattgctcctcggtacatcattggatctcctg

SEQ ID NO: 44319 - DNA, 226 bp, Triticum aestivum
  Clone ID: PAT_TA_44319
agggggggccgtagttttcgagcgctaggcggacatgttctaccttttgtcacatttgcactcgggatgggcggtggaccagtgccatccttgccgaggaggagcggctagtcataattcgttgcggccacgatcgggacaagacatgcatgcatatggatgaggtgctatcatggggggttgagaccataaagaactttgcggtgatctaccttgttgtcatcac

SEQ ID NO: 44320 - DNA, 360 bp, Triticum aestivum
  Clone ID: PAT_TA_44320
cgtccgctgacgcgtgggctccggctggacgaccatgctggtgttcggggactcgacggtggaccccgggaacaacaaccggctgcagacggtgatgagggccaacttcctgccgtacggcgcgggcttcctcggcggcaggcccaccggccggttcagcaacggcaggctcatcactgacatactcggtacagacgcactcttctttccttgcatctgtttcgctggtaaatcatgcgtgcacaaggtaccaactgggcttctctttcaagcaaatggaggtggtgcttatgtgcagctacaggattgatgtttttggtcgataggggagtgacgctcaccgtaggtcatgtatggtat

SEQ ID NO: 44321 - DNA, 395 bp, Triticum aestivum
  Clone ID: PAT_TA_44321
agctccgccatgtacaacgtcgacccggccaccggccagcgggcctacctctccgtcggctcctccgcgctgccctccatctacttcctcttctgcgtcgtctacgccgcgctcgctgcgggatgggtctccatcctgctgcgcaagcgcaccgccgtcttccggatccactacttcatgctcgccgtgctcgtgctcaagggcttcaacctcctcgccgaggccgaggacaagtcctacatcgagcgcaccggcaccgcccacggctgggatgtgctcttctacatcttcagcttcctcaaggggatctcgctcttcacgctcattgtgctcatcggcaccggctggtccttcctcaagccctacctggcggaccgcgagaagaaagtgctcat

SEQ ID NO: 44322 - DNA, 459 bp, Triticum aestivum
  Clone ID: PAT_TA_44322
cgtccgcccacgcgtccgcttgatgacaatttggcacccaaaattacagattttgggctgtcaagacagtttgatcagcgtcaaactatgtcctctccaaatcgtgttggtacattaggctacatggctccggaacgcatcgatgaaggcataatcacacctaagtcagacatattcagtttgggtgtgataataatggagataataacgggacacaggcactacccaggtgtttctggaacatcttccgaggactttattgagcttgaacttaaaaaatggagaaacacattggagaaagcacaggggtacacaaatctagaaatggattgcgaacagaataaaagatgcattcagataggtctaatctgtgtgaatcctgagtggaccgaaaggcctacaacaacaaaaattatcaagatgcttcaaggattggaaagtttggatcgtaacattagc

SEQ ID NO: 44323 - DNA, 465 bp, Triticum aestivum
  Clone ID: PAT_TA_44323
cgtccgtgcagattgaatttccaattccccactatagtagattctttttttttgggtattacctcagtaagtcaagtataaatacactgcaaagctggaactctgattgtaagtggtaggttggtggtgagcccctgagacttccgccagcggattggttgatgagcataataactaataggttcctgtttggacatatgttggtgcgattaactgagtattagccttttaaattgttattatcccctggcagatcctgtagaattagaacaactgctggtcagcagcttttggtttgtgtgtgacaagaaacattaagaacttgagattttagtcacgtctcaactgcatttagctatagtttacctaggaggctgagttcacttgaatcggagccttctgagaattcatttttgtacttgaccttatgtgttggatctttagagttaaattgcagttcagttt

SEQ ID NO: 44324 - DNA, 106 bp, Triticum aestivum
  Clone ID: PAT_TA_44324
ctgtacaggacccaagcttacgcacgcgtgcatgccgacgccagcggtcaccataagggcaacataggacaaggggtctggcatgtacaataccaacccggccacc

SEQ ID NO: 44325 - DNA, 260 bp, Triticum aestivum
  Clone ID: PAT_TA_44325
tctatttacctctactaatccttatcaatattcacctacatccgtcctcatgggctgttatacttagacattctcctacacttccaacttctttcattgcccctatcacctcattcatactctctttactatctatttcaatgccttgctcgacctatataccaccgatcccatatgtatttcatgaacattcaactgcatttatctacttctttttcattaccagtttagactctgaattctctataatctttcatttt

SEQ ID NO: 44326 - DNA, 463 bp, Triticum aestivum
  Clone ID: PAT_TA_44326
cgtccgggcggcacggcaccggtcagcgagctctggtgcctcctccctctggcgcctcctccctgcgacgcctcctcactccgacgagcagcgcgacgcggcctcctccctctgacgactcctccctccggcgcctcctccctccggcgagcagcatggtgcggcctcctccctctgacgactcctccctccgacgcctcctaactccggcgagcagcacgggcggcgcggcacgggccgttgagcagcgcggcgctgcctcctccttctgatgactccgccctccggtgcctcctactccggcgagcagcttgggcggcgcggcacgggtcggtgagaagcgcggtctcatccctcaggtgcctcctcactccggcgagcagcgtgggctgcgcggcgcgggccggtgaggagcgcagcctcgtcccttcggcgcctcctcactccgacgagcatcgcgggc

SEQ ID NO: 44327 - DNA, 470 bp, Triticum aestivum
  Clone ID: PAT_TA_44327
cgtccgcggacgcgtgggaccgtatctcgttgcctctcgccgagacgatcgtcgcgagcagcaagtagttgagatcaagccgccgccgccgccgcagtcttcttcttcgtctccgacaggaggagcggccggagctggctaacctggatcagctggagggcgggttcgcctccgcgcgcgggcacgagaccgaggagcagcgcaacaagttcctcgtgctccgcctctacgaggcgctcaacggccgcgaccacgccgccgtgcactccctcctcgcccccgacctcgagtggtggttccatggcccgcccgcacaccagcacatgatgcgcctcctcaccggctccagctccccgtcctcctcctcctccttccgcttcgagccgcgctccgtggacgccttcggctccaccgtcatcgccgagggcgtctcggccgccggcgaggacaccaaggcggcgtactgggtg

SEQ ID NO: 44328 - DNA, 312 bp, Triticum aestivum
  Clone ID: PAT_TA_44328
cgtccgggggaatgttgccaaatcattggatccaaaagaactacacaaactcctggaggcgtgtgagagcatgcaaaagcgatcaaatgctggcacctctgaagcatctaatgcttcggggaatacagctgcagcagacgctgcaggaccatctaactgtaaggctcctttcgcgaacggtggaaactgctggcggacgtcatatcgtgttttaccagcacagtcaaatgctaccatggcggcagctacagagacttcagcgtgcaagactacgaatgctcattccaaagacacttgcaatgatatggacag

SEQ ID NO: 44329 - DNA, 367 bp, Triticum aestivum
  Clone ID: PAT_TA_44329
cgtccgcaaagattgaagcttacagatccaagtcagagaaaccgaggagacgtaaaaggccaggagagatcaaatactttggtctctcttggaagaaaaatattagcgacagaagtggaagtgacttcacggcgaatgatgtaatcctaaaatgcaaggatggtataggatcagcaatacaaccgactcgttgtctctgacagaaaccttattgcccatatttcctatatgtccgctgtgagcagtgttaagcttggtttcatggcgtagccttgcgacttgaggatacaaagaacacttgtcgtggtttaataccgatgctttcaaaagcccaaggagagcccacgccaaatgttcccccattctc

SEQ ID NO: 44330 - DNA, 457 bp, Triticum aestivum
  unsure (1)..(457): unsure at all n locations
  Clone ID: PAT_TA_44330
cgtccgcggacgcgtgggcggacgcgtgggaaaaaactccgatccccaccgccgccgccgccgcctttccccgtctcgctccgccgctggagccaccaccctcctcctcgaccggctcttccccgcacaactcctccctcgaccgtctctgtgccgacttggcccgaagccaccgccggatctgctccccgccgctgccgccggcccatagaggatctcgtcctcgtccggccggcaggcggcgatggcagcgagggccctcgggctcgccggccgagcactcctgcgaccgctcgcctcaccaggcgccccgcgcctgctgtcaactgacaagggcccactgcagggcctcacgaacgccagtgatccgatgagccgcctcatcatgcaagcacggaaccagactgatggcggttntccccgtcattttgctgagaacggattcacagccggtgct

SEQ ID NO: 44331 - DNA, 298 bp, Triticum aestivum
  Clone ID: PAT_TA_44331
cgtccgccgacgcctgggaccccatcgtgttctgcctcatattgaggtagttcgctctcgacgggggcgacagcgaggacgggaggaagctggttctctacgtctactgacctaacgggctgacgatcgagagcctgagcgtggacaacaagcagagctccgtggcgaacctgacggagcttcctctgcatggtcctgttggaggagtagagcctccagtgcgacaccttctcaggctacgtgcatgtcaacctgacgggcacgcaacgttgagttcagcaggagttctaagagcata

SEQ ID NO: 44332 - DNA, 429 bp, Triticum aestivum
  Clone ID: PAT_TA_44332
cgtccgcccgagctctgctgcgccgccacctccccgcgcggcgcccctccacctcgagcaggccggaggcggcgccgatgggtcgagccccgccacggtggtggacccccggaagggcaagggaatcgccgccgttccgccatctttttccccaagctccgcgggcagcatccccgactccgcctccgccttcgaagccggggggtcaagctcctcggcggggaggaggatggtggtgccgagggacgcgacgctgcagttcgactacacgcgggtgttccagcaggtggtacgagcggggcagtcggttatcatcgaggagtgcgaggaggagcaggtggaatcgccgcacgccaaggacgcgctcccgggaaaggaaaaggagaagaaactacctcaagttaaggtgagacccaagcctgaaaaggg

SEQ ID NO: 44333 - DNA, 464 bp, Triticum aestivum
  Clone ID: PAT_TA_44333
cgtccgccaacgcgggggcggatgtcgcagagacgagtgtctggctagacaactagatctgcttcggcccacctatagacgagagctaggctacgaccagcacgcgcagccacgtgtaggtagacccgtgctccctagtcgtcgatgagcatgccgcgcggcttcatggggccgaccgatgaccacacggatacggtccttcctatgctcgagacagccttgcgggaccgatgggaacgatgagaaggactaagatgggcagggctatcatgaagcgtgagatgcaaacttggctggctgccagtcgtgctctcgttgagatgatgatattcattgttccttgtccttcaaaggaacaggggtattgtggggagaacttatacgagggccccctcggtgatttatatgccatagctatcagagaactggaccctgaagggccttttatgctggatgttttcaag

SEQ ID NO: 44334 - DNA, 392 bp, Triticum aestivum
  Clone ID: PAT_TA_44334
tttttatttttgaaatatattatgtgcaggatggaggggcaaaagtttattgcacaattcaatctctaccttttttcatggtatcactattagggtacatgatatacataaggcattcaactttacaatgaaattcttggcttgaaaaaccatgtagcaggggaaggggactctcaacattctagcttccttgagtgatttgcaagtaggttgaatgtggatggagattttgcaaaaataactgcataaccatcgttcatgtgttctgcgccttcagggaagagctgccatagaaggcagccttctccaatcattccactctcccaagagcccaagaaattgttgtacactgtctgcatgaaagtgtcgcggtactcgttttcaaacttgcc

SEQ ID NO: 44335 - DNA, 197 bp, Triticum aestivum
  Clone ID: PAT_TA_44335
cgtccggctctgcaagagcctgacccaggtgtaagtagcaccagaaagtttcagttgttgtatggcactaattccttggacttcaactcaatttagtattttttttcattatagccctccaatgtttccagaccacaatgatgctatagtattgcctgtgccggtgtgtaataaagataacattttgagtttcaaaa

SEQ ID NO: 44336 - DNA, 345 bp, Triticum aestivum
  Clone ID: PAT_TA_44336
cgtccgtgtaaaatctacaaggattggaaaggcggagcactttctgattatgatggaaactttgtggggatgaaccttacttccgttgaggaaagaacatcttttttgccgactagtattattattaaacatttgcgacagtctgtgccaaacatggaagttgagggagtcacgcctgttacactaccgagatttgaggtaatacaagccacgccctatatgcactatccaagagacatgtattgtggactagattccgtgggctatccaaagcatgcaacaactactatcagtgagggcttgaatcttgggaatacttttcaaaagacttttgggcaaatatat

SEQ ID NO: 44337 - DNA, 274 bp, Triticum aestivum
  Clone ID: PAT_TA_44337
cgtccgcacagtttatctcccacccatctctaaacgtctcttgccggagcctcatcaactctttggcgagcatgatggacggtgagtaaggctaacaacgtggcatcttaagaatatcggggggccgaggaagatgttggtgaccaagtccatcaaggccgggctccaactccccgtcggccgcatcggtcgctactctaagaaggggcgctacgcctcagcgcgtctggctccggcgccctcgtctacctggtctgtcttcctcaaatacctt

SEQ ID NO: 44338 - DNA, 460 bp, Triticum aestivum
  Clone ID: PAT_TA_44338
cgtccgctgactctatgctatatggtttcccttttgttgttgagcaagcaactaactgtatctctcaagcaatttattcatacattttgattggaaagagacaacaaccatttgttctgcgacactactatctgacaagtactcaatattatactaatcatcaatgctatagaagtgttcatccatgaataatgagactgaagcccattttaggttatgagactttgtcctgattccagagatgtactaaattctgaagtttgttgtatgacactactatctgagaagcagatttttttgacacttacttgagtgtattggattgggtaaactaattagccctatctatcagtttgtggtgtgcggttctaatgtgtgctttttctgttgttgtcattatcctcaatagatcattcaaatgttggattcatggcttgctagaatagatgatttgtgaatc

SEQ ID NO: 44339 - DNA, 454 bp, Triticum aestivum
  Clone ID: PAT_TA_44339
cgtccgctgactctatggtacataaacgcgcagacggagatacttctgcagaaggacccgtagaccttgaccttcaagaaagggtggggcttgccgcggcgcgtctacttcaatggcgacaactgtgtcatgccgcctgccgatgcctatccgtggctgcctaacgcgagccctccgatgaagcaaccgtggacgctcaagctcttggtgttctggaccgcgttggccaccctgctggcctattatgtttgatgaacgatgtcggcggtcgagattctgccgggttccccgtggtgcgcggcgaatggtcggctgttcattcgggtccacagctgcatatatcaaactgggtgaggaaagctgctgggtctatatgtggccttgttagttaaagagggtcaaaaaagtagagcccgcgaaggtttggtgaactgattaattgaattgtatggct

SEQ ID NO: 44340 - DNA, 184 bp, Triticum aestivum
  Clone ID: PAT_TA_44340
cgtccgctcaaaggtagcccccgggttccgggtgatgaggcaggaagaagatgttgatgacctggacaatgagttcaactataagcaagggaatggcaaaggtccagagtggcaaggggaagacttgatttgtcttatcttctgcatgaacctaaatgatccttggtaaagggcacaatgtcgg

SEQ ID NO: 44341 - DNA, 333 bp, Triticum aestivum
  Clone ID: PAT_TA_44341
cgtccggtcaatgtgtggaacacgtgggacagcgtctcaccggcccttccgcactggcctgcttgctcggcgcccgccgcctactatgccctgcctgcggccggcgcctcctcccatgcacttccccgccaccttctgcccccgctgctctctgctggctgtccaccgactcctcgccctcaccgcctcttcccgtcccccctctggagcccacaggcgacccttccaagacggatggcgcctcattctccgccggctccggctctggaggggcctaccggactggacagggagcttcatcggagggtcgccgaactggcgccgcgtggtact

SEQ ID NO: 44342 - DNA, 375 bp, Triticum aestivum
  Clone ID: PAT_TA_44342
cgtccgcccacgcgtccgcgcgcctctacgacgactgcgccgccatcccggcgctcctcgactcacctgttcgacgccgacgcgctcaagcgcctcctcctcgtcatagcgcatggcgtcggcgtctccccaatctccccgcaggtggtcaaagaacgtggtggcgtaatcgtctgcctttactccctgcgccgtcgctggaggcgaagaagctagtctacctctaccagagtcgccggattgctaacaagagaagcaaaaaggggcctggaagcttgtctcgctctctcgccgttctatggcccgtcttctgtttgacgaaatgccgcctaccctccttcttcggtggctctgtacccaccggattaagagtat

SEQ ID NO: 44343 - DNA, 467 bp, Triticum aestivum
  Clone ID: PAT_TA_44343
cgtccgtggagctgcgccgaatgacgttccggatcatcgtgcagatcttcatgggcggcgccgacgagcgcacggcggccgagctggagagcacctacacggagctcaactacggcatgcgcgccatggccatcgacctgccggggttcgcctaccacaaggccatccgcgcgcgccgcaggctggtggcggcgctgcagtgcgtgctggacgagcgccgggccaggggggcgaagaccgccggggtggacatgatggaccggctgatcgccgcggaggacgagggcgggcggcggctgcaggacgacgagatcatcgacgtgctcgtcatgtacctcaacgccggccacgagtcctccggccacatcaccatgtgggccaccgtcttcctgcaggagaaccccgaaatcctcgccaaggccaaggcggagcaggaggcgatcatgaggagcattccctcgggacag

SEQ ID NO: 44344 - DNA, 380 bp, Triticum aestivum
  Clone ID: PAT_TA_44344
cgtccgcgcacgcgtgggggaaacaacagtcttgcacgctaataaagaagcagtatcttgctgacaggatttgcatgaatggcagcgcttttattcacacatataagccgatttccaccactacaaatgagaaactacaggattgcttacgcacggtccttacatcctggatcaggtgcttattgtgggaggaacacaagggacttctaccttagttatgccagttgtattttctttcagaaaatgcattttatggattgatggtgggacatgggattaacaaataccatggggggaggcttctctttgctgatatttgtcccttgatgcaattataattattcttcttaactgggggttcttttaaaaaggaagccccc

SEQ ID NO: 44345 - DNA, 446 bp, Triticum aestivum
  Clone ID: PAT_TA_44345
cgtccgcgacttcttcctgataacctcaaggagcgaatacgacgttatgaacaatacagatggcaagagacaagcggggttgatgaagagcatctcctgatgaacctccccaaggatcttagaagggctataaaacgacatctttgtttatcacttctcaagagggttccaatgtttgaaaaaatggatgatcagctcttgaatgctttgtgcgactgcctaaagcctgttttgtacacagaaggtggctacatcgttcgtgagggggatccagtaaatgaaatgatctttatcacgagaggaaacctcatgagcatgacaacaaacggtggaaaaactggcttcttcaactctgatgttctgaaaagcggagatttctgcggcgaggagcttcttacctgggctcttgatcccaattcatcatccagtcttcccagcttaaccag

SEQ ID NO: 44346 - DNA, 413 bp, Triticum aestivum
  Clone ID: PAT_TA_44346
cgtccgctcaactaaggtaatcgatgggcaacagctcttgtgcaagctagccatcgaggggaagaaggggaagcagcaaccacaacaatctgggcctgccgggcaacagcaaccacagatgctccagggtggcccgccggacatgacgggttctgggcttgggctaggtggaccacagatgggtgggcaatatggtggccctgggaatggtatgccatcgtttggtgcatttggtggtcccaacccatatgctaacatgccatcgtccatgggtggcggcggtggagctggtttgggctcaatgggaaatcagatgcattccgggatgggttctgctggggctggtgcatttggcaccggcgggctgggtgggggatcatttgggggctcaatctaatttggtgctgtggtat

SEQ ID NO: 44347 - DNA, 185 bp, Triticum aestivum
  unsure (1)..(185): unsure at all n locations
  Clone ID: PAT_TA_44347
aaccccccaccaacaacacctccccggaacatagaatggcaatcgaacccctgctggctgaagtgatgtcgcgctaactaagatagcggcntttgccagggccgctgttcccagcggagcattaactggactttctaaagccttatacctacacatatcgaatcccacaccttctgggaaaggaa

SEQ ID NO: 44348 - DNA, 409 bp, Triticum aestivum
  unsure (1)..(409): unsure at all n locations
  Clone ID: PAT_TA_44348
tggagggncgacccacgcgtccgcttctccccttcctcccttccatccttccttcccctaaccttccattccatcaagaacccgagggagcgagagagagcggccatggcgccagacgagagacgcctccctgatcaccaccatctcccctccccgtcgggctcttccgagcaggcaggagatgccgccgcgccgccggctgcctccctcgaggatctccaggaagcctcccgcgccgccgcgttagcgggcggtccggtggacatggccacccgccccgtcatctttcccgtcgtctgggagctggctcctattgcgtacctcccgcgcggagacgtctccggcgacaccgctactgccgcggttctttcgggccctgctgctgctgtcaccgcgggcgcaccggtga

SEQ ID NO: 44349 - DNA, 439 bp, Triticum aestivum
  Clone ID: PAT_TA_44349
cgtccgcccacgcgttctcggacgcgtggggccgccgccagcagctgcgcaaaggctcgacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcggcaacgaccagggcaaccggaccacgccctcgtacgtcgacttcaccgactcggagcgcctcatcggcgatgcccgccgagaaccaggtcgccatgaaccccatcaacaccgtcttcgatgcgaaacctcttatccagagaaggtttgctgatgctgctgtccagagtgatattaaaaagtggccgtacaagggtattcctggcccaacagacaagcctatga

SEQ ID NO: 44350 - DNA, 446 bp, Triticum aestivum
  Clone ID: PAT_TA_44350
cgtccgcggacgcgtgggaaaaaaaaaaaaaaaaaaaaaaaaaaaaaaaaaaaaaaaaaaaaaaaagaaaaaaaaaaaaaaagatcacacaaaaaaaaaagggaagaatagctcccgttcatttcctattgatcttgtccgggagtttgccagacaaatattagagtctgttacatttatgcatgacctgcggcttattcacacagattttaagccagagaacattctccttgtttaacctgatacaatcagggttcatgattataagattcctatacccccacccaaggatgggtctgttttcaagaaccttccaaaatcgagtgctatcaagcttatcgattttggaagtacaacattcgatcatcaagatcacatttttgttgtgtcaacaagacattaccgggccccaaaagttatccttggtcttgggtggaaatatccat

SEQ ID NO: 44351 - DNA, 444 bp, Triticum aestivum
  Clone ID: PAT_TA_44351
cgtccggcgccaccggcggcgccggcgagttcgcccagtacgacggcgagaccaacacggtcgccgtgaccttcgccaactacgacgtcgccggcaacggccgctcccgcgacttctcggcgtacacgcaggacgccaactcaggcgtcgagagcttcaccgggtacggcaggaccgccaacagcgtcggcgagtccttcaactcctacggcaaccacaccaactccatcatgtccgccttcatcaactacggcgacaaggccaacagcgccacggacaccttcgactcctacggagtcaacgggaacaccccgcagaacaccttccggagctactcctccggcagcaacggcggcgccgacgacttcaagggctacagggacaacgccaacggttgtgacgacaggtttaccttctacgccaacgacgccaacggcgccaccg

SEQ ID NO: 44352 - DNA, 425 bp, Triticum aestivum
  Clone ID: PAT_TA_44352
cgtccgctggacttacagcttataatcataacctagatacatcaagggaatattaccccaacattatttctacaagatcgtacgatgatagattacagactcttcagcacgtccgtgaagctggaataagcgtctgctcaggtggaattattggtcttggagaggcggaggaagaccgtgtagggctgttgcatacactggccactttgccaacacacccagagagcgttcctatcaatgcattgattgctgtcaaaggcacgcctcttcaggatcagaagcctgtagagatatgggaaatgatccgcatgattgccagcgctcggattgtgatgccaaaggcaatggtgagactttcggcagggcgagtacggttctccatgccagaacaagctctctgctttctcgctggggccaactcgatc

SEQ ID NO: 44353 - DNA, 435 bp, Triticum aestivum
  Clone ID: PAT_TA_44353
cgtccgcgatctccgcctcccagagctccctcctcttcctgcgcacccccgtccccgccctcctctcgctccgctccgcctcccccggcgcccgcctcgtcacggccgtcgcgtccaaggggcccgagctcggcggcggcggatcgggaggccgcgaccgtgcgggatctgggggtggagggagcggtggaagttaccgtcatggaggcctacacgagggggaggaggacaagatgggggagggcctctccatgtcgcatgagcataccctactctacgccgcgctcgtcggagctggtggagtgatggggtacatgaaaagcggaagccagaagtcactggctgcaggaggcatatctgctctggtgctgttattcgctcacactcgactcctaatgagaccagtctttgcatcagcgatcggtttatgtatat

SEQ ID NO: 44354 - DNA, 428 bp, Triticum aestivum
  Clone ID: PAT_TA_44354
cgtacgcggacgcgtgggcttcagcccagtctaacttgtcttgacctcgaaacatatggcgtcgtatcatggccccgaaggcaatcgataagaacccggtggagaataccctcgtggctcataagcccaaggcggttatgaatgttccggcgtccaaggagggcggcgactagaacgggaagaagaaggccatgaatagcgtggagacctacaagatctacatcttcaaggtgctcaagcacgtgcacccggacatcggcatctcctccaaggccatgtccatcatgaactccttcatcaacgacatcttcgataagctcgccagcgagttcgccaagctcgcgcggtacatcaggatgcccaccatcacgtacggggagatccataccttcgtgcgcctggttctgcccggcgagctcttcaagcac

SEQ ID NO: 44355 - DNA, 350 bp, Triticum aestivum
  Clone ID: PAT_TA_44355
cgtacgcggacgcgtgggcggacgcgtggggcggcgacgtgtggtgcgccccggtgataccgttcgccgcggaggcgtcgtccgtggactgcgtggtggcgcgccaccagatgctggggaggggccgcggttgcaacgccgagaggccgcacagagagcggccctggctggtccggagggcgagcatgcaggagcagatgtcctcgttcttcatggagtcgccggcggcgacggcgctgcatcaactggacggtcccttcttcggcgccgacctgctacccttcgcgcgcctccgccggatgcgcggctaccggcccttccccggcggactcgaagaagagatcatgatg

SEQ ID NO: 44356 - DNA, 425 bp, Triticum aestivum
  Clone ID: PAT_TA_44356
cgtccgcggacgcgtgggggcgtgcctgccgggatggccggaagtagcctctgggtaggtcgattggcttcccttcttgcagtcggattcgtggtcggctccgtcgaggccagcccgggagatgctcatccgcagtacagaacttgtgtgaaggagtgtcagaatacagggattattggaagtaacatcatcagccactgccagtcccgggataacgacagcacatctgctggaagttcatggtacacacaggggcccctttacatgcagttaaaacaacaaaactgtatgtcagactgccgctactactgcatgatacgaagagaagaggaacgacaattaggtggcctgagccctgttaaatatcatggaaaatggcccttcaaacgtgtttctgtcttccaggagcccctattagctggact

SEQ ID NO: 44357 - DNA, 344 bp, Triticum aestivum
  Clone ID: PAT_TA_44357
cgtccggcgacccatcctcccacgcaccaagtcaccgaccgagatgacaacctttctcaaggcggcggccacgctgatgcacgcacaggatccggggccggtccgtcaaccagcggacggccgaggacgtgtaccggccgtgtgggcttgactctggggcaatgatcacctgctgcctgaaggtcgacatcatggaggtcggaagcaactgctcagacgccgccaagatggacggcttcaagctcgccatctttacccacctcgagtgcgggtggagcacgcagggggcgcccaaaaagatgaacttcgacgagatcctgagcaagaactacattgaggggaag

SEQ ID NO: 44358 - DNA, 430 bp, Triticum aestivum
  Clone ID: PAT_TA_44358
tcgtccgctgacattttgactagatgagtgcttaacacccgggctcaacattgaggagtatgaaggcaacgctgaggccactgatgacaacttgtctgtccagccttataataagaggaggccttacactgcgctcttgcacggtgcatcttatcagcgaccaccactgaataccgagtgaatgtagcccttaagggagctgtggatggagaccttgacatctaccacagtgatacaagatacgctggtctcaaaaaggacgagacgtctatggatgctgagattcacacgagtgccagtccaaggaggacatgtacttgactacatgaggtcgatagcacataaggaaccagacacatgccaaactcactttagcgaggacatcacgagaggaagctacggtgctcacatggcagcagccaacaagaag

SEQ ID NO: 44359 - DNA, 180 bp, Triticum aestivum
  Clone ID: PAT_TA_44359
ccgcaatgtccggccacacccacgcgttcgcccacgcgtccgcccacgcatgcggtttgagtcctttaagaaagcctactatggggcggttaaagatgctatcggcaacgatgtcaaggtcctaattgctgaccttgaagcgagccaaggcgctttccagaactatgggctggaagagga

SEQ ID NO: 44360 - DNA, 304 bp, Triticum aestivum
  Clone ID: PAT_TA_44360
cgtccggcggcgccatctgcctgctgatccacctccgcacgccgccgggggagtgggcggtggccgtactggtggcgcccatgtgcaggatctccgaccggatccgcccgcgctggccggtgccggagatcctcaccctcgtgtcgtggttcgggccgactctacccatcgtgcccacggtcgacctcattgagaagtcctggatggggccctgcgagcgcctgatcgtcgcgcgcaacccattgcgctacaacggccggcccaggctcggcaccgccatggagctgctgcgcgccatcgacta

SEQ ID NO: 44361 - DNA, 438 bp, Triticum aestivum
  Clone ID: PAT_TA_44361
cgtccgcccccatccatccccggcgggggcccgagggccgaccacctaccatggccgcggcccgccggcgccacgccgagccccgctcaggacgaccgcgccgaccgcaccccaccatacggttgtagtaaatcctcggcagctactgacttgggctcttggagagaaattctggcaacgatcgatctcgcgcagcaaagggctgggctcaccgctttgctgttaggaaggggggagcaaagtgatttgctgtctccttgtgattgtggtccgctgagtgatggcagatgctagctcaaggactgacaactcaactgttctagacaacgacggcaagatctataggttagaacaaggacaaagtggtggggcaatcatggcttctaattcttcggataggtctgacaggtccgacaaacccttggaccaaaagacatt

SEQ ID NO: 44362 - DNA, 365 bp, Triticum aestivum
  unsure (1)..(365): unsure at all n locations
  Clone ID: PAT_TA_44362
cgtacgcgtacgcttangcttgacctcttctatcttttaaagtcttgtacaaaccaactaagggggtggtaccagaagggatcggaaaccatcaatatgggcaatctgcagtggtgggcctaagcagaccagaataccgatgccaatgacaagacatacaatcaggagctcagaaggattccacgcattaagcctacggcattcgtgtattattggtaatcaaatgtcggaccggctgacattacagttgcaaacagttcacaggggcatgtaaagcaatacaaatggcaaggggtgcttcaccatgacctgacaatatcattacctgagaacaggctgaacaccgaagggaatacttctgcaaa

SEQ ID NO: 44363 - DNA, 167 bp, Triticum aestivum
  unsure (1)..(167): unsure at all n locations
  Clone ID: PAT_TA_44363
tcccgatcgacccacgcctacgtttcttccctnncttatctattacattttcccccactgagtcagcgtcggctttatgagtgggggggtctgacaaatgcgatgtgttttcttttggtgtggtactattttaacttatgattgtttgcaagtgtgttcatgcatta

SEQ ID NO: 44364 - DNA, 392 bp, Triticum aestivum
  Clone ID: PAT_TA_44364
cgtccgcggacgcgtgggttttttttttttttttttcttttttttgagacgggaagggcatactaaggagtaactagcacaatatatgaatactagagatcaaagaaatgataggctattttttcctgctgaatgaccttatttctgccaggcaactgctcatgaatgacagcaaaagaatcgagaaaatcaattcgatcctgtcttttaaagagcactcgatcccttgtccacatttacttgtgcctttctcatgggccatgcgctgcgctgcgtcaccctggccgaggcacttccattgatgaaagcgtaaatgtgggccctggcgacctcgggcaccacctccggattaactctggatgtgatgcaaaccctggcaccaacggcgaagc

SEQ ID NO: 44365 - DNA, 437 bp, Triticum aestivum
  Clone ID: PAT_TA_44365
cgtccgccaggccgccgcttgccaccccgctcccaccgctcccccccccgcccgccgtcgtcccgcgagcctcactctcagagaagaagaagcgacgatgtctcctgcctccgcgcgcgccctcaccgtcgactccctaaacccaaaggtgctggcgctcgcggatcacctccggggcgccgtggccggccgcgcgcagcgcatgcagaaagagctagaaactaatccgggtctataccctttcgatgagataatctattgcaaccttagcaatccacattacctcggacaacagccaattaagtttttccgtgaggttcttgccttgtgtgattacccgcatcttctgaactgcagtgtaactagttccatattcagttctgatgcaataacaagggcgagggagattctagaccttattcctgggagagcaatgg

SEQ ID NO: 44366 - DNA, 441 bp, Triticum aestivum
  Clone ID: PAT_TA_44366
cgtgcgtcctcctttccgcgccgccgcggattcgctcggatctgccccgcgcccggcgctcctgcgaattcggcccccgttacgccgtttgatccgcgccgcgcgcgcgggcggggccgctccggcggcgcggaaattaggtcgcgcggatccttcgctggcgcgcttacacggtggtatttacttgactttgagcatggttcggtcaaggatgattattgtggagaaaggactggatacaactcggaattattgaagatcatggaagctaaccaatctcctcctcgcaagcgaccacgcagagacagaaaccgagagaaagcatccttcctgaactcggctgaagcaatgaagctagatatttggagcgagttccctgaagacctttttgaaactgtcattgcaaggcttccagtggctgcaattttccgattccgctct

SEQ ID NO: 44367 - DNA, 343 bp, Triticum aestivum
  unsure (1)..(343): unsure at all n locations
  Clone ID: PAT_TA_44367
cccgttacgggccacgacgtacgcccacgcgcncnntctggtgacatgggaacacacgcctccggagcatgcgttgagcggggcggtgactgagaagatccttgtggtatcttatggtgtggtgctataatagcttatgactgcactgaagccgtgcaatgcatcaagaccattgggggatgtgagactcggtaagtggtccatacctttgtttaagttaaccctcgagacaggaaagttggaagagttggttgacccctggcttgaaaggaacttcaacgcgggcaaaatgtaacgtatgaaatgaatatgaagccgcctgcttattgacaactatattata

SEQ ID NO: 44368 - DNA, 230 bp, Triticum aestivum
  unsure (1)..(230): unsure at all n locations
  Clone ID: PAT_TA_44368
cgtccgcacgggttatgtgacattngatacatggctccggagtatgcgtcaagtggcaagcggactgagaaatccgatgtgttctcttttggtgtggtcctattaaagcttatgactggtcgaaagcctgtcgatgcatcaagacccattgggtggataaaagcccttgttgaggtggggctagacacgttgctttaatcgaagctttttgaagaacgggaaaagcttgg

SEQ ID NO: 44369 - DNA, 162 bp, Triticum aestivum
  unsure (1)..(162): unsure at all n locations
  Clone ID: PAT_TA_44369
cctccgcttgcatcgtcnctttcgatatttggcctctactcaccccttcatatccctacgacgcgggcggggggcctatgcttacgttgcacgcccacaacacttggaacgggtctcagaggatgccaaccttctacccctaagaggaccagcgaccgttct

SEQ ID NO: 44370 - DNA, 169 bp, Triticum aestivum
  Clone ID: PAT_TA_44370
cgtccgaaaaccctctcgagttccaggaaccttccagaagaacgtcccggaatcgtgggcctgggtcctctcctccccatggccgggtcggcgtcggcggcgggtggccagccccagaagcagttcctatccatcatccgggactttcgcccggcgagaaagtcccaac

SEQ ID NO: 44371 - DNA, 417 bp, Triticum aestivum
  Clone ID: PAT_TA_44371
cgtccgtggagtacctaaatattggaggtggtttggggatagactaccaccacactggtgcaggcttgcctacacctatggatcttatcaacactgtccgggagtcggtcctctcacgggatcttactcttattattgaacctggaagatccccgatcgccaatccttgctgcttggtcaacaagggcactggctgtaaaatctaacggcacaaagaatctcattggagttgatggcagcatggccgagctcatcaggcctagtctatatggagcatatcaccatatagaactagtttccccctctccaggtgcagaagtagcaacctttgatattgttgggccagtctgtgaatctgcagattttcttggcaaagacagggagctttcaacacctgacaagggagctggtttggtt

SEQ ID NO: 44372 - DNA, 195 bp, Triticum aestivum
  unsure (1)..(195): unsure at all n locations
  Clone ID: PAT_TA_44372
cttcgttacgtcaantttgttgagaatcaccaatagtttttcctggaggagcttagtggggggaacgtctggattcaaggtcaaaaacttttccttaaagattttgaaccggggtttggtggattcaaactctaaggatgaccttgccaagggggaattcaacttaacttcccaggtgattattcttaaccacct

SEQ ID NO: 44373 - DNA, 264 bp, Triticum aestivum
  unsure (1)..(264): unsure at all n locations
  Clone ID: PAT_TA_44373
cgtacgcccacccntncttcgttccttcggccgcctaccctatttatttaaccaacccagtccggggtaccaattggaaggatggcataaataagaataagatgatggtgaggcccaggggcgattccaagtttgagggccttctgtgccttgcgtcggacgccgttgaccttctcttcttcggcagcacccaccttcattctagcccttgcagtagcagctgggcgcttctcgattcgctcggctacattggggcccccgggg

SEQ ID NO: 44374 - DNA, 313 bp, Triticum aestivum
  Clone ID: PAT_TA_44374
cgtccggagatcagttctcgatttcgattccgggtccacagaattccccaggcgagcgagggagatggccaccgccgggaaggtgatcaaatccatagccgcggtggcgtgggaggcggcgaagccactgtccatggaggaggtggaggtggctccgtctcacgccatgggggtgctcgttcaagatcctattcacctgcctttgccacaccgacgtctacttctgggaggccaagggccagacgcgcatgtttccttggatcttctggcatgaagctggaggcataacagacagagttagagagggtgggac

SEQ ID NO: 44375 - DNA, 146 bp, Triticum aestivum
  Clone ID: PAT_TA_44375
cctcctctcttttgctaaaccccttgccctcgttcccatcgccgttgtcgtgacctgtgcggggggcctagacgacccggcggtgcttttgcgacaacccaaggatgcggtccttatggactgtattgtggggttgcgccgtctgt

SEQ ID NO: 44376 - DNA, 171 bp, Triticum aestivum
  unsure (1)..(171): unsure at all n locations
  Clone ID: PAT_TA_44376
cgtccgccctcncctttgcagacggaccacaactacagctaatcgcttcctgtctgctgacatggccgagtgctcatatccaacggtccacggtagcacgtttctggttgtgaccatatcaccgtcgtcctgaatggtattggctatgccctatggtactaagaggattaa

SEQ ID NO: 44377 - DNA, 328 bp, Triticum aestivum
  Clone ID: PAT_TA_44377
cgtccgcgcacacgtcagagcaatatctcggtccagggtataagataaatccgccaccatcttgtttgagggatctatacgatcatggagcgctcgccaaaggccccatgtgcttcaatctgctcaaggatagggaccgagttgcaggggcctattcccatcacgacgcccgggaggccacctgctgcggagatgttgaattgaacgcaagggaaggctatgcacaactgccataaaatgtctggtacaatgtgaatgagagtgacatgccatatcttcctttcattgacgagaagtactcatgcttggacaactggacatatgcaaa

SEQ ID NO: 44378 - DNA, 244 bp, Triticum aestivum
  Clone ID: PAT_TA_44378
gcgtccgcatactgtcagccttggtttcacgaccctaaggccagctagcggtggcccctacattggcaagaggtgcccattcactggaactgttgccataaaggccatactcatatctgtaacctggcacatggccaaggtggacccgaccatcattgggctgaggtactacctccattttgccgcgtagggtcctacgtctaggaagagcgactccctcatcccagcttaccccttgccctgg

SEQ ID NO: 44379 - DNA, 402 bp, Triticum aestivum
  Clone ID: PAT_TA_44379
cgtccgaaaaaaaaaaaaaaaaaaaaaaaaaaaaaaaaaaaaaaaaaaaggggcggccggtggggggctaaaactagcccggacgcgtggggtgctaacggtgttgttggggccatttacgtctagctgaaaagttgtttaacatggcgagaccgatcacccatgaactgaagcacacatgcgtgtgcagtgtgagctaatttagctgttcccggccgttgaggaagataaggactactgaccgttgccttacaacttatattttcaagaagtatcgctagcccggacacgaatatttgataatcgattactttttgtttggtgagagaggtctgctacaaccttacatttcttggtttgaaaatctgtatcggggtggcttgacagttcaaattttggaac

SEQ ID NO: 44380 - DNA, 435 bp, Triticum aestivum
  Clone ID: PAT_TA_44380
cgtccgcggacgcgtgggcttggcaatccaccacccacccgagaggaagaacaagcaaagctcgttcttccatctcgccgccgccgcagccgcagcgatctcatcgccgtcgtcgggaaggaaccccctggtgttgccggtttggagccagggtgatgagctgcctcacgttccgccgctccgccgccgacgcaagccgcctccaggacggcctcctcgtcttcatgttcttcatctcgattcccatacgtagtctgaataatagtcgtactagtagtaattctagtattactagtagtaatctcttgtaaacgcacgccgctcgtgcttgcggttgcgttcgcgcggacgggggggtcctcttcttctgctgctgctccgtctgcatcttcgtcttcttcttcttcgcggttgacggtcgcgccggcggccatg

SEQ ID NO: 44381 - DNA, 345 bp, Triticum aestivum
  Clone ID: PAT_TA_44381
aggcgcacgcgtacgcgtacgcagagccttgctcccgcttcccctctacgcgccgtcgccgccgactgcgagggcgttgacgcccacctcgaagtcatggcggagcagaccgagaagtctttcctcaagcagccaaaggttttcctcagcacgaaaaaggccgacagggccaagaggccaggcagggctggcaaccgcttctggaagagtgttggccttggtttcaagaccccaagggaagcgatcgatggtacctacatcgacacgaagcgcccatacactggaactgttgccatcaggcgcagaatcatagctggaaccgccacagtgccaagatgaacagga

SEQ ID NO: 44382 - DNA, 437 bp, Triticum aestivum
  Clone ID: PAT_TA_44382
cgtccgcagaggagcaactgggaggcggacaagatgctggacgtgtacatctatgattacttggtgaagcgcaacctccacaactccgccaaggccttcatgaacgagggcaaggtcgccaccgatcccgtcgcgatcgacgccccgggaggcttcctcttcgagtggtggtccatcttctgggacatcttcgacgccaggacaagggacaagccccacgacgcaggagggcctggggccgccgcaccgccttctatggacatgaaatcaagggaacaccagatgagactccagctattgcaacagcagaatgcccacttgcagagaagggatccaaatcaaccggcccttaatggtgctatgaactctgatgtatcggctgtcctggcctctaaattgatggaaggaatgaggaatcacaatcctatggactctga

SEQ ID NO: 44383 - DNA, 438 bp, Triticum aestivum
  Clone ID: PAT_TA_44383
cgtccgcaggagatgacccttgaagaatatgagaagatgcaagaaaagaagaagtctctggaggcctctaaacctgaggagaggagggttgctgctgtagattttgagggtctccagctcttggagaagaagaagattgaggatgatgctaaatcaaaggcagaaaatgttcgcaaggcaaaggaggctgctgcaaaggaagctaaacctcgcaaggtaaagtctaccaataataggcattttgatgctgagatgtgaaaggggcatgttttactttactgaaccatcttctgaaatctgggcaatcactacatccgtgctgtttaatttgtattgcacttgttagtgatagtgtgatccttacttctgctgtttgctgcaggtgagcatccaggagtacctgaagaatgaagatggttcagagtacgtacctccaac

SEQ ID NO: 44384 - DNA, 437 bp, Triticum aestivum
  Clone ID: PAT_TA_44384
cgtccggtgcggtcgcgctcgcggcatgggctctccctcctcctcgtgagcagcggcgccgaacagttgctgggctccttttcttggctccttctcggttctggcagcggcggaccagtagtcttgcggctcgtggcgagctctcctctcctctcctggtcaccagtgcggcgctgcgacggtcgccggcgcgccatgatggaccaggagcacctggacttcatcatgcgccgccaccaccaccagggcggcatggggtttgttcccgccgaccgcggcgacagcgaggaggcgctggggtcgtcggagtcggagccggcggggaggccgcgcggcaagagggcccgcgccgccgaggtgcacaacctctccgagaagaggcggcggtgcaagatcaacgagaagatgaaggcgctgcagagcctcgtgcccaactc

SEQ ID NO: 44385 - DNA, 435 bp, Triticum aestivum
  Clone ID: PAT_TA_44385
cgtccgcggacgcgtggggcgccgtgaacataagcgccgcctgctgctcgtcgctgaacgaggcgctcgacgccggccgccgctgcctgtgctcgctgctgctggccaacggcgtgctcgccggcctcgtcgccaccctgatccccacgctccccatggtgctgccgctgcccgggtgctacctctacgcgcctgctctcgcggcctgccaaggtgaccgttcgttcaaattatctcttgcatccgcccgggcatggacgctaacgccgagtagttgcttcccctttatctggttggtttcagtgacgttgctgcagacgagttatgatgcgccgccggcgtcggcatctgtggctgccggcgtgggggatgctgctggcggcgcggtggatccggcgcctcctcaggccgacatcgcgccgccgcctaagaatg

SEQ ID NO: 44386 - DNA, 443 bp, Triticum aestivum
  Clone ID: PAT_TA_44386
cgtccgcggacgcgtggtcgacacagcacaagctgctgcaagggcgtacgaccaggcggtgatcaagttccgcggcgtggaggcggacatcaacttcgtgctggacgactacaaggaggacatcggcaagatgagcgtgttgagcaaggaggagctggtgcaggtgctgcggcggcagggcgccgggttcgtgaggggcagctcccggttccgcggcgtcaccctgcacaagtgcggcaagtgggaggccaggatcggccagctcatgggcaagaagttcgtgtaccttggcttgtatgacacagagatggatgctgcaaaggcgtacgacaaggcggcgctcgactgcagcggcgaggaggcggtgaccaacttcgagcccaaggcggcggtgacgtgcgacggcaacctcggcctgcaagcttgggacggcgagcctgatc

SEQ ID NO: 44387 - DNA, 441 bp, Triticum aestivum
  Clone ID: PAT_TA_44387
cgtccgcccacacgccccgacgctcaagcccccagacgccgcagcgccgacactccacccgcagcgggaaccatggcggtgcggcaagaacaagcgcatgtccaaggggaggaagggtagcaagaagaaggccgtcgatccgttcaccaagaagcagtgggatgacatcaaggcgccgatgctgttcaccagccgcaacgtcggcaagaccctcgtgtccaggacacagggtaccaagattgacttagagggtctgaagcacagggagtttgaagtatctctagctgatcttcagaacgacgaggaccaggcctacaggaagatcagactccgtgctgatgatgtgcaagggatgaatgtcctcaccaacttcaggtgcatggacttcaccactgacaagctcaggtcccttgtgaggaagcggcatacactcattgaggc

SEQ ID NO: 44388 - DNA, 367 bp, Triticum aestivum
  Clone ID: PAT_TA_44388
cgtccgcgaagccaaccatcaatcagcagcacccagccacacagcgccgccgcagtcccgctcgaccgatcgccggcaatggaggagcggggcaggggcgggagcaacaagatccgggacatcgtgcggctgcagcagctgctcaagcggtggaagcggatggcggtggcgccgggcggccgaggcaagaacggcggcggcggcggcggcgccgtgcccaaggggtccttcgcggtgtacgtcggcgaggagatgcggcggttcgtgatccccaccgagtacctgggccactgggccttcgaggagctgctccgggaggcggaggaggagttcgggttccggcacgagggcgcgctccggatcccct

SEQ ID NO: 44389 - DNA, 443 bp, Triticum aestivum
  Clone ID: PAT_TA_44389
cgtccgcggacgcgtgggcgctcctctcccacatcctccaccgcccgcctctcctcgcgtacgcgcgctgtccttcttcccaccctctctcgtgcgccctgaacgcctgggctgtcggagctgacgctgatacttttttttatgtctcccgccgtttgggcttcgcgcgcaggtcgaggagtggcgtccgaggaggagcgctgccttcccgcctacgcgctctccggctcaactgcagcgcggctgaagcaaccgcctcggccgatgaggcgcctgctcccccggcgaggaagaaaagagtagtttctggtgtacagccaacaggaatggtgcaccttggaaattatcttggcgctattaagaactgggttgcacttcaggatttgtatgagacattctttttcattgtggacctgcatgcgattactttgccatatgatgca

SEQ ID NO: 44390 - DNA, 132 bp, Triticum aestivum
  unsure (1)..(132): unsure at all n locations
  Clone ID: PAT_TA_44390
gcccacgcgttcgcccacccattctcaaacccaaatcgttcggggggcgctattatgctccggactgcgtccncccccgtcgccggatgccgttactcgcgagatctcgaccatggaggtcatcagcggtct

SEQ ID NO: 44391 - DNA, 439 bp, Triticum aestivum
  unsure (1)..(439): unsure at all n locations
  Clone ID: PAT_TA_44391
cgtccgtccacgcgtccgcccacgcgtccgttcagatctccataatgctaaccttggaacacctggagaccttcagattactaaagaagaaagngttagcctggtggatgaagctgagaaatggtgtggtttagcatctcaggctgttgatgtggcatctcatgccgggactagcttggatgaatccctgcgctgtcatgaggttttggattcctttgatcatgaaaagagtcttacatttgacaggccaatctattcccaaggcagggatgggggacttgaaaataacctgtatttactcaatggattacctgatctccaaggtgtcgaccttggaacaccgatagatgatcttcagggggtgcagttctattcacaggaaagccttggcagctggctggaccgaatgtagatcgttaaaaaagtggacgatggaaga

SEQ ID NO: 44392 - DNA, 338 bp, Triticum aestivum
  unsure (1)..(338): unsure at all n locations
  Clone ID: PAT_TA_44392
ancaacaagacgctatgcttatgatattcttacagtatataattatgggcgcgaagggctatccttacactggataattataatggggaaatgctcctgggccatgtaaagcttgcttgtgatctttccatgtatcaggtaggaacctacttggatccccttcaatttcaggtaaggggccgaactagcattcattcaaatgggaggcctgggccaaaagccaagaccaatccccacttttcccttattgcccctttctaaaacgtagcccttgaattcttcagcacatagaaaactggggtggtggttacatttccatagtttatgagggccttttt

SEQ ID NO: 44393 - DNA, 432 bp, Triticum aestivum
  Clone ID: PAT_TA_44393
cgtccgaaattgaagaggcttgagggtcagccgtcattgacaaccactgaggtgcgattgactcgtgcggaagctcccagaaagatttctgaattacctgggttggtttgtgatgacatctctggaggacaggagaacattccaattcctgctactaatgtggtcgacgacccacctgttcctccatctggttttgtgtactccaaatcgctaaaaatctcaaaaggcatgaagattccatctgattgtgctggctgtgactgtgaaggtgattgtgctaataacaaaaattgttcatgtgctcaacttaacggctcggatttgccttatgtatcatttaagaatattggcaggttagtggagcccaaagcagttgtattcgagtgtggtgctaactgcagctgcaatcgaaactgtgtcaatagaacatct

SEQ ID NO: 44394 - DNA, 369 bp, Triticum aestivum
  Clone ID: PAT_TA_44394
ggggatggttaatcaaatagtgaaggagttcgatgaatattgtcattgttcataaactccttgaaaatttgacaaacttattatcagtcctgcaagctccatgtgttctagagctaataccaggttagtgtgggctcgcttccttcttcaccacttcatactccagccccttcttgtcgtcagtagcttcaatgcagattgttgagccttcactggcttgtcctttgaccaacatcttggaaagagttgtcatcacattcttttgcatccacctccttatgggtcttgcaccgtaggttgggctatatgattccgataagatagtgtccaatgcggcatcactaatagaaagagagatgcccttggtag

SEQ ID NO: 44395 - DNA, 441 bp, Triticum aestivum
  Clone ID: PAT_TA_44395
cgtccgggaaaatctgctgcggccttcttcaacccctctgcttcagatctgccggcaatggcggggtcgccggagcagttcaggggccagtcccgcctcccccgcttcgccgcgcccctccgctacgacctcgtcctccgccccgacctcgcggcctgcaccttctccggctccgcgtccgccgccgtcgccgtctccgcgcccacccgcttcctcgtcctcaacgccgccgagctcgccgtcgaccgctcctccatccgcttccaggactgggcgccgacggaggtggcgcagttcgaggaggatgagatcctggtcctcgggttcggccgcgagctgcccctcggcgagggcgtgctctccatggacttgaccgggaccctcaacgaccagatgaggggcttctacaggagcaagtatgagtacaatggggaggcaaga

SEQ ID NO: 44396 - DNA, 437 bp, Triticum aestivum
  Clone ID: PAT_TA_44396
cgtccggaacaatttttgattcgctggcagaggcttatgaattctacaatctccattcctggggggtgggctttgggattcgatacggcaagagcaggcaaaatgtcagtggcacgaaatgtatgcaagagattgtgtgtggctgcgctgggaaaccagagagggaaaacagctcgtcaatgaggagcaattgcgccgccatgcttcgtttgcaccggacagatgatggggggtggtatgtatctgaaaatcgtgcagcccacaaccatgaaatgctactgacctgtggctgagaagctgcactggccatcacaccggcacattgacacatacacaagggatcttgtgaagcaattgcgccagaacaatgttaacctggggaaggtctacagcatcatcggcagcctgtttggtcggatggagaatgtcccgttcac

SEQ ID NO: 44397 - DNA, 446 bp, Triticum aestivum
  Clone ID: PAT_TA_44397
cgtccgcccacgcgtccgcccacgcgtccgcccacgcgtccggaacaatgatgcaggcccttccatacaagctagaaatgcatggcaatatcctaaagacatgactgcacaacaagaacttggcgaacgacaagcagcttcgcttcctaatggaatttatgagcctcctatgcagataatggaaggttctcctgaatctggaggcaccactacagttgaaagacaggatcttgcagtcagagttcaagaagcaatcactgatcctttatgcgtcaaagaccgccgaagcgcattaaatggaaagagttatcctccatctaaagaagaagcggcacatcgtatggagaacgtttctctaaaggggaagcgttgcaatgacctagctgataaaaatattactacagtgaagcgctttatgggtcattatcacagagacaaatctggtc

SEQ ID NO: 44398 - DNA, 450 bp, Triticum aestivum
  Clone ID: PAT_TA_44398
cgtccgttccccttttcctcctccacctgcaaagatcaagctatacagcgaacgcaacctcctccttgggcttctcctcctccgcctcctgtgatcaagcgaagaaggagcctcctgttcttcgagatggggagccgcggggaacttcttcccctaccggcgacggggagcagcaccgcgacggagccccgtgatcagggggcggcgccggggccacaagctcggctttcgccctcgctgaaaaggaggtggacggaggaagcgtccagctccaccgctgcgggtgaggaggatcgagcgccggagagccccgcgccgtcggctgctccgagcggcacgaccaccgcgaccagtactaccagggctccgcctccgcctggggagggtcccgcgctaggaggaggagaaggagatcagccggaggtgcaaggcccggcgcagccgcagccc

SEQ ID NO: 44399 - DNA, 435 bp, Triticum aestivum
  Clone ID: PAT_TA_44399
cgtccgcccacgcgtccgcccacgcgtccgcggacgcgtgggggagaacaggggccaggggggcgacacacggtcgccatcgccgtgatcgccggcgccccctcccccacacacccgccccagccgccgtcccgacctctcgccagcgataagcaaatcccgcccgcctccacgtcgtccacaaaagccccgttctttaccacccccatcccgacctcgctcctcctctccacccgcccctccctcctgatcccagccccagccccaatggcgtccgccgcgcgcgggacacgcgccgtcgccaccatggccaagaagagcgtgggcgacctcaccgccgccgacctcgagggcaagcgcgtgctcgtgcgggccgacctcaacgtgccgctcgacgacaaccagaacatcaccgacgacacccgcattcgcgcc

SEQ ID NO: 44400 - DNA, 437 bp, Triticum aestivum
  Clone ID: PAT_TA_44400
cgtccggactgaacgcgccgccgccgtcgccgtatctccttaatccgggcctctatctagcctgcgtgaaaggtcagacatggaccagaccgaagccctgccagacgacacgctcgccagcatcctcggccgccttccgccgtgcgacctcgccgcgtcccgctgcgtccgcaagacgtggcgcgccgtggtggacgcccgccgcctgctgctcccgcacctgctcccgcattcgctgcatggcatcttcatcaactacatcgactacgagagcccgcgctgcttctcgcgcccctccacacagaagcccgcgatcgactgcaacctcgacttcctgcctggttacgccgaggatttcgattcaatcgtagatcactgcaacggcctcttgctttatgagagcgacatgaacttgtgctcctacgtggtcaaccccg

SEQ ID NO: 44401 - DNA, 257 bp, Triticum aestivum
  unsure (1)..(257): unsure at all n locations
  Clone ID: PAT_TA_44401
tcttgtgtttatgcttgcggncgctgcgttgtacatgccttttatgatgatcacggtgctcaacctgggtctctacnncaaggtggtcgccgggctgtctgttaggagcggagaccgcttcgcctactatttgtaccgccgcttcctggacatgttctgggtcgttgtcatggacattggtaatgcgctcatcgaagagaagctcgcagtcatgaatgcagtcaccgttatttacaacgacatcttctctcactgcc

SEQ ID NO: 44402 - DNA, 241 bp, Triticum aestivum
  unsure (1)..(241): unsure at all n locations
  Clone ID: PAT_TA_44402
cnccctgagaggcgcggggccagcattcggcggatactggatactgacggatacagaatattcggagctggtaactacnccggttgccgggncaacaccatttactacagttgatataatatctcaagaaatcaactcgcgatgcatgacaataattaaggctggaactattgtggctgcaactgcttgctctacattgagagggtctggttcttttgaagtgcaacctccattgaggata

SEQ ID NO: 44403 - DNA, 355 bp, Triticum aestivum
  Clone ID: PAT_TA_44403
cgtccgagccacgcgtccgcaacaacttagcccgtggtcactacaccattggcacggtagattggggacctatgccttgaccgtatcaggaagcttgcagacaactgcactggtctccaggggttccttgtcttcaacgctgttggaggtggaactggctctggccttggttctcttctccttgagcgtctctctgttgactatggaaagaagtccaagcttgggttcacagtgtacccatcccctcaggtctccacctctgttgttgagccatacaacagtgtcctgtccacccactctcttcttgagcacactgatgtggctgtccttcttgacaatgaggccatctatgaca

SEQ ID NO: 44404 - DNA, 435 bp, Triticum aestivum
  Clone ID: PAT_TA_44404
cgtccgtttttttttttttttttttttttaatcaatagccatctaaccatcaggtagatgttaccactaaccaaaatatacactggacaatagtttcgtatgagtctgttaaaagaatagaagccacactatttatattgatctgatcatactataggaggccaataatttggcaagccaataatacacatgaataacaatatgccattgcgtaacaaataagaaccttggacccatgtaaatcttatgctgcaacagccgctaatattccgacgtgttgagtttatgcgtgctcacgatggccgagacgatgccggggaaggctttggtaccccaccagtcgtcctgctccgacaacatataaatcttcagttcggatgtgtggggggacataattgaagggaatgatcttataatccacaagtctcaaggcaa

SEQ ID NO: 44405 - DNA, 215 bp, Triticum aestivum
  unsure (1)..(215): unsure at all n locations
  Clone ID: PAT_TA_44405
cgtccgcccacgcgtncggcggtatcgtcgtgtgcagcgccgcggcggcggccgaggcctgggaggcggagcccgtggagaagttccggctcgacaacctgagcccgcaaaaaggggcgcgggggaaagcctaacggaaagggcgcggtatttttgctggggcaggccccagcttgcggttcggtatgcgcggccagaagttgtgcttcgggccc

SEQ ID NO: 44406 - DNA, 451 bp, Triticum aestivum
  Clone ID: PAT_TA_44406
cgtccggggcaccagtggaggggtttctttcgctcctttgtctgtggaaccgctggcacttgatatggatcaatcaattgatattcttctcgcaaatgcttgtcaaggagatgacaacctacggtcagtagcagaaggcaaactaaagcagctccatgatcttgacctttccaacttcctcctaggtttatcatctcagctcttgagggaggagactccagaagagtctagcatacttgctggtatcatccttaagaactccttggactcaggggagcctgcactcgacgatctagggagtcgaaaatggctcagcctcgatccatctatccaatcacagattaaggagaacttgctcctgactctagaatccaattgtgattcaaggcgccgctcatcaaaaattattgcaaaagttattgcatgggttgcatgcattgagataccaagg

SEQ ID NO: 44407 - DNA, 469 bp, Triticum aestivum
  Clone ID: PAT_TA_44407
cgtccgcgcgagaccacccgcggcggctggccggccggcggtataggcgacgaggcgaagtaactggagacggcgcgggcggaccgctccgtgtggctcatgaagcgctcccccatcgtctcccaggcccaggcagggcgccttcgtcttctccagcgaagctaaccctaacccggccgtcggcaaggtcgtgctggccctcgaccccctcagctgcgctgagccctccctccagctcaagatggagatgcctcaaactagggaaactagcacttgcaacttaccaaagagtggccccttgaatatgttcttcctcctccgtgtcttcgctatcgccatcctgccttgctctgccaacaacgccacccaactggtctatgacacagaaggcaacgagctaaatagcaaggcaaattactacatcctgccagccaaacctgcaagcggtggcggtctcaaagccatccct

SEQ ID NO: 44408 - DNA, 268 bp, Triticum aestivum
  Clone ID: PAT_TA_44408
cgtccgcccacgcgtccgcccacgcgtccgcggacgcgtggggaatgtactcccttctgaggctgagaaaatgccatggcttcttgagaaaatgcctggtatgattgatgatggagatgtgcttgtatttgcaactaaaaaggctcgagttgatgaggttgagaaccagttgaatcagcatggattcaaagttgcagcactttatggtgacaaggatcaagcatttctgatggagacactggataagttcaagtttgggatttaccat

SEQ ID NO: 44409 - DNA, 155 bp, Triticum aestivum
  Clone ID: PAT_TA_44409
agagcataggcatactttgcctctctggaaacaagagatgccgctgcagctatttaaatcatcatgaagaggaagctgccgagcatgagcttgtgaactgccatggagtgcgcagatcgacacattttgctgctacagccttgctaaccaacact

SEQ ID NO: 44410 - DNA, 432 bp, Triticum aestivum
  Clone ID: PAT_TA_44410
cgtccgagaagagccacttcgcctactcatgctacttctagtgctgccgcctagatcgtttgttgtcagtaataagaatgaactgaagtgagctgcttggccatgctttgggtagatatgcaagtgtgttgttgttgctgttgttgtatcactaatttaggttttgttgtgggaagcacagtatcagaatgttgtctgggaacaagcaccacaggcacatgcatgattacagcgtgctacagagtggaccatgagagtctgtctctaggcatggcatgcgagaagagcgtgctacagagtgctacagagtggaccattagagtctgtctctaaggtaccaagttgtatgcttaatcatcctatatcagctcaccagttatggcagagatggctctaaagttttgttctcaatggaagatgtgatttctgtct

SEQ ID NO: 44411 - DNA, 441 bp, Triticum aestivum
  Clone ID: PAT_TA_44411
cgtccgcggacgcgtgggtttttttttacaaaactgaacaaatgcctttacattgccagtgtagcttgcgagtacaagccaacacatttgaccaaacttacaaatctggacggcaagcggaaaacacctgtcccagaccaaaatatctgaatcccaacacatgacttaaaaatctggtaagcaagttaacttcccctttgctgttgtcagcataaatcatgttaatcctagaaaaaatatatccaaaaacctactggttccatcagacgacaatctgataccaattcaacacaaaaaggaccgatccaatcctggcctgtgctataccggctctcaccggtaactggctgctcaacattagttgctggtccagtctaccggacttgcttttactgtctccattcctacaaataacatgaatcagatcttgttagatagatg

SEQ ID NO: 44412 - DNA, 308 bp, Triticum aestivum
  Clone ID: PAT_TA_44412
cgtccgggtacgcgttcgtccacctcctcgccgacgcgatgagcgccaccagcacgcaccatcggcggggccagtcaccgctactggggcacgctctcttcatagatatcgctattctttcggatgcccccggcgtatcgtgcgcccgcgaggaccaggattgcaccccgccgcactctccaccgatggtcagcctcaatgacctggacaggcactgccgctggctgtagtcccacacgcgtgcgcaggcagccatgtacccttcgactcctccagactggggtgagctgttctacatcatgcagaga

SEQ ID NO: 44413 - DNA, 456 bp, Triticum aestivum
  Clone ID: PAT_TA_44413
cgtccgtccacgcgtccgcccacgcgttcgcccacgcgtccgcccacgcgtccgaaagcagttggtatcattgtggagtataaaatactacaattaagaggaggcggtgacctccccatcaggtatttaaatctgcggggactagagacacatgcactcaacttctctgatattctatcacatgactttgcacgaaggaccttgtatgaactgcgaattcaaatgtgcaaaatgaaggaaataattttaagtcacgagtttgcacaaccaagctgctgttttggtacactcaatcagatccttttgtttcatttgtcagacttgagagagataatttggatggaaacatctccaacatctctattttcaaggctcacttgtttgacggtgttgttttgcggaaagctaaatgacctctcttgggcgatgtatctgccttgtctcgaacaactcata

SEQ ID NO: 44414 - DNA, 460 bp, Triticum aestivum
  Clone ID: PAT_TA_44414
cgtccggctccccgtgctccttctcgcccaaggaatgcgaagcaaaattttcagagattcaagcacgctactctgcatgcgatgcttggtttgaggagcttcgcaagcagagagttgctgaattgaaaagggagctgaggaaatcagaaagttttattgggtccttgcagtctgtgatcgagagtctcagcaatagcaaacatgataatggtaataacttaggatgtcacactgaatcatgttcacacactgaaaatgcagctgatactacttcctcgagcaaagaattgtccaaagacagatcatccgctgctagtttcacagaggaagcaagcaacagtcaaaaatctcagaaagttcaaaatacatcagcagagacattatcaaagccccatgctgaaaagaagctctgtgccaaagatggtttgctttggggctctagaaagaaaaggggattgag

SEQ ID NO: 44415 - DNA, 387 bp, Triticum aestivum
  Clone ID: PAT_TA_44415
cgtccgcccacgcgtccgcggacgcgtgggccgcctcgctcttctcccgagcctggtcctcatactatcgcctctctccccccacacagatttagcaatctaggtttagcgccttcgtccatctcgtagctgctgcgatggcgatcaagaggaccaaggccgagaagaagatcgcgtacgaccagaagctctgccagctgctcgaggagtacaccaaggtgctcatcggcgtcgccgacaatgtcggctccaagcagctccaggagatccgcaagggtctccgcggagactccatcgtgctcatgggcatgaacaccctcatccgccgctgcatcaaggtgcactcggagaagaccggcaacaaggactttcttgagctcagcaacc

SEQ ID NO: 44416 - DNA, 458 bp, Triticum aestivum
  Clone ID: PAT_TA_44416
cgtccgtccgcggtcgtcgacctctcgccgtacctcaaggaggccatgtacgtcggcttctctgcctccacggaggggagcacacagcaacacaccatcaaggaatggacctttcagaccttcggattgccgccggcgaccaacgcctcctcctttaccaacaccacgagcaatgtctcggagccggcggtgcccggcgtggccgcgagcggcggggcgaccagcaagaaaaggtttgggcgcgccatcaccatcctcggccccgtcgcgctcgccgtcgcgttcatgttcttcgcctgtgtgtccgtcaagaagctggcggagctcagctccaagaaggacgccgtcttcctgccggggctgctcaaggggccaaggaagttcaaccacaaagagctgagcatggcgaccagaggatttcacgcgagcagagtcatcggcagaggcgcgttcggcac

SEQ ID NO: 44417 - DNA, 452 bp, Triticum aestivum
  Clone ID: PAT_TA_44417
cgtccgcggacgcgtggggcagggttaaaaatgtgcgctacctttgaggaaaggacgagagaagatcaaactgcaatggaagatcagaaacgtttgaacgatgccctgcaaatggagttgacagaactaaaagcgcatacagaatcttccttgaatgttattaaaaaattctatgaagttcgttcgagggaatgtgaatgcccttcaaacattacttttgaagagaaatgctcaattcttctagatgattctgctgacagttggagtttcaacctggatggcgaaacctcaacttcgaagcatctctagaacaggagaatgagtcgcttaaagctaaaatatctaagctgcaaagcaatctaagaatgagtttcgaaattgaacagcacttgcaaagaaatgtacgaacactggaaaagaaacaggcactcaatgatgatcttatgagagat

SEQ ID NO: 44418 - DNA, 455 bp, Triticum aestivum
  unsure (1)..(455): unsure at all n locations
  Clone ID: PAT_TA_44418
attggtggatcatctgtaacacgaaccgttgatagaaactcaaaacggaaacatgatgaaacgggaaacggaaaggatgggaaatggaaaagaaaaaagaaaagaagctgttcagcaatcccactttgcaaaccttcatctgatcccaccctatccgataccttcatggctcacatgtcagaggctggcgacccgttcgaatttctcccgctatcaatcctcgccgacatcctcggccgcgtcgctcataccagagacatcgcatcgtgccgccttgcctcgcgcgagctcctcgccgtggcttaccagtgcccccgcattcgcctagacgccttcggccgcgcacccggtcttcggaagggtgggggaggggtcgagggcaccgtcttccacacactcgctggaaacctcgcgtcacgcctcgggtcgcacctncgctcccttgtgatcattgc

SEQ ID NO: 44419 - DNA, 305 bp, Triticum aestivum
  Clone ID: PAT_TA_44419
aggtaccacgggaacattctagttccggtagctcatggagatactggtgcaaaggaagtgtgcggaagtgcgaaacatgcaaaagatagtggggtgatcctggttaccgggttcccacaggttggcgacatggaaaacaaggaacgtgcaaacaattaacatacggtgcaaatgcgcagttcatttcatacatcacttattcattcgttcatggcggtcgtcctcgagcattataccttctaagcatgcattttggggtgggtcgggttattagagggaagtttacttttttgcgacagttgttg

SEQ ID NO: 44420 - DNA, 446 bp, Triticum aestivum
  Clone ID: PAT_TA_44420
cgtccggtgccagcaggctgagcgaagcatgcaacaaatacatgtcactttgccagcggcgtccagacaggaatcctcagcattcacccccaggcaccttcatcacactggaagaggcttcgaagatggggatcttcgtgactcctgcagttcagacatgttctatagatgagccacaggctgatcatggtggatccagcaatagatctacaagttgtggtagtgtcccttatatcgatagattaggcaacagccaacattcagttgatgttccatcaggatcgagcgctgaacagcaatccaagccaaccattcagcagacagtagataaacaagaaaacgaaactgatgctcctcctgctcctgctaaagagctttcgaggcgtttgagtgtgcaagatagaataagcatgtttgagaataagcaaaaggagcaaacttcaact

SEQ ID NO: 44421 - DNA, 227 bp, Triticum aestivum
  Clone ID: PAT_TA_44421
cgtccggttccgccgcctgggctcccgctcgcccgcggcgtcacaggatggccgcgtgcgccagggggctcagtggcgccgcccttcgatctggccgccagtcggccggcgaagttgagtgcggggccctggccgcgccccagcgcgtggccccaggcgcgcgatccgctgatgctgctacacccgcccggagcccacgccgtcgcggaggctgctgatctccgcca

SEQ ID NO: 44422 - DNA, 336 bp, Triticum aestivum
  Clone ID: PAT_TA_44422
cgtccgcggacgcgtgggtccgacccgtaaaccgaccgaccgaccgttcgctcgctcgccccccctcgggggccgttctctaggcggcgaggacgcctccagcggcggcctcgccggtgcggaagttttcggccgcggacctctttctctgcgtggtcactatcttattactcatgtgcatactccttgcctcctacaccccccgtcttcagcctcacggacgcagtccccaccggcggctcaagcgttaccccaagaacttcgccgccgtcagtttttactacggggccggcgctgaccacgatttcggaagaaaccggcacgcggcgcccttcg

SEQ ID NO: 44423 - DNA, 450 bp, Triticum aestivum
  Clone ID: PAT_TA_44423
cgtccgctcaaccagtcagtcgccattactcttgtttctcatcacccaccgcgagcgcgaagcaggaggagtggaggagcagcaccatgctggggcatctggtcgggctggtgaaggtgcgggtgacgcgcggggtgaacctcgccatccgcgacctccgctccagcgacccctacgtcgtcgtccgcatgggcaagcagaagctgaagacgcgagtggtaaggaagagtatcaatccggagtggaacgatgagctgaccctctccattgaagatcccaccattcctgtcaaactggacgtgttcgacaaggacacattcttcgacgacccgatgggcaacgcggagctggacatcggcccgctggtggaggccgtgaggatgagggtccagctgcagggcgtcgctgacaacaccgtggtgaagaagctggtgcccaaccggcagaact

SEQ ID NO: 44424 - DNA, 301 bp, Triticum aestivum
  Clone ID: PAT_TA_44424
agcttgcatatttattactgtgcagtcgtggccactgaatttatccagccatgtttgattgttaacacaatagcttagtttgtacaacatggctgtataccaaaactgctctgctgtgtcgatgcatttcctgccttgattagatagattgatagccactagtgcagtttgtagtcatggggtttggtgagttagcaacaaggtctatttactgggaaaattattgttgtcaagcaataagcttggcacatcatgttgctaatccatttcggctgtttgtaatatcagaagacatttgggc

SEQ ID NO: 44425 - DNA, 350 bp, Triticum aestivum
  Clone ID: PAT_TA_44425
cgtccgcggacgcgtgggacggtggtgaccgccaccgtcaacgagggggagtactagcggatcaccaaggaggagaagcaccacaagcacaaggagcaccttggcgagatgggcgccgtcgccgccggagccttcgccctctacgagaagcacgaggcgaagaaggacccggagcacgcgcacaagcacaagatcgaagaggaggggggcgcccctggagccggcagagccggcgggttcgtctttcacgagcaccacgagaagaagcaagaccacaaggaggcccaaggaggccagcggcgagaaagaaacaccaccactttgggttagatcaccggtttacctgcggt

SEQ ID NO: 44426 - DNA, 252 bp, Triticum aestivum
  Clone ID: PAT_TA_44426
tttctttttttttttttgttttttttttttttttaatgattgttccgcagcagtccgtccgattccgtccactgcggcccttctccaggacttaacgtagctcaagaagtctcaccgccacatcccatctcttaggggtcttctcacggggggcgagcgtaccaagcgcaccctgttcttttacagcccaaaccacccttgagatcgactttgtttacgagggtgtggacttttacactaccattacacagg

SEQ ID NO: 44427 - DNA, 448 bp, Triticum aestivum
  Clone ID: PAT_TA_44427
cgtccgcggacgcgtgggcggacgcgtgggaagtaactgaatgcaagtgtggtgtggttttagatgtgaacaactgtggaagtgtcctgtcccatgaatgaaatgaaatccccggcatggccaggtgatagtctgttcaaaaaaaaaaaaaaaaaaaaagcgcggcctccgtccgccccctcaatcggggtccagcaatgccccggcggcggccgagggccggggagaagcggatggacgccgcgatcgaccacttcgccgagatgggataccgcaaagccgacgtccgccgcgtcgtcaacaagctcctcaaggatgtgtatgggaaggatgggtggccgttgctggagggcagttgttactccgtagtgcaagaagcgctctttgagatggaggagcaggagaagttgcaacagcagcagcagcagcagcagaatgaggatgatga

SEQ ID NO: 44428 - DNA, 351 bp, Triticum aestivum
  Clone ID: PAT_TA_44428
ctttcgcccacgcctccgcggacgcgtggtgcattttaggactcgacgagttgtgtggcctttgaaaaaattggcctcctcgcgtgaatgtgttgcttgttctttgtatttctgcaagacgaaggtttggtaactgatctgattggtatgtctatgatgttcttgagttcgtatattcttcagcggaataattgttgtattattctgactagctcttactttcaggtggttgtcaaaatacactatggaacataaatacttgggagatgtattaattaattagtttgttcttttttcaggtttattggataactggatcttgcactccacaagttttataggattctggtg

SEQ ID NO: 44429 - DNA, 264 bp, Triticum aestivum
  Clone ID: PAT_TA_44429
cgtccggttgagcggtataccagagagtactatcatagcagacctgaacatgaaccctcgtggagggcttaatgaacaggcagtggggggtttactcctggatcactgtggaggacagaatcacacacacagactagaactccttggtacatgaggaggaaccttcaggaggtcactgtagcagcgactttgagaacaagagtggttatccgtttcggccagcttcttaggaaagaacggtcacatcatatggaactgctgatc

SEQ ID NO: 44430 - DNA, 297 bp, Triticum aestivum
  Clone ID: PAT_TA_44430
cgtccggtcttgaggcggaagtagatattgtacaactctttatcaatccctggcaaacccaccaagaagaaataggcaaatcacgatacacccacgcgtcggttaaagcaaacacaatcgacccccacagggttgcccacctagctgatgctaaactgaccgcttcatggcgccatagccggagcccttcgactaaagagagccctacactgttttgtacagtgggccaaaatcctgcgactacaaaatcagcagctcatactgtcggatcgcgcaaaggtaccaccctcactagta

SEQ ID NO: 44431 - DNA, 434 bp, Triticum aestivum
  Clone ID: PAT_TA_44431
cgtccgcggacgcgtgggctcgtggagtcgctccggcacgtccacctcgtgctcgcggacgagcacaacgcgcgcgtcgcgctcttcaggttggactgggacaagaagatgtggatgcaggaccgggtgcgcggggaccgtgtcctgcttttgggccgcgggtgctcggcctctgtgccggcggcgtcgggccggccgcctggcatgctgctattcgcgcaccagccgtcgttgagtctcgttgacgtgggcggttgtggcgctgggctcgcgtggttctgggcggaatcgtgggtggatgacggctcggatgatatgctggtgctgaagaagaagatgcaccaccggcaaggcgagttcaccgctggtgactcgttctggttcttcccggccatcgatccggatgaaagggctatggttgcatcgcaggccta

SEQ ID NO: 44432 - DNA, 374 bp, Triticum aestivum
  Clone ID: PAT_TA_44432
cgtccgcggacgcgtgggctcagacgctcacacactcactcagcaagaacgcagcgccggcgacgtaccggcctaccggaaagcggagtctccacgacggaccccgtgcgcgcgcagggcggcccgggaggcggaggcgccgacatgggccggatcccgtgctgcgagaaggacaacgtgaagcgcgggcagtggacgcccgaggaggacaacaagctgctctcctacatcacgcagcacggcacgcgcaactggcgcctcatccccaagaacgccggtgagtccccggcgccagcagacgctctggttacgtcgaaggaacgtgcgttgctgttgttcgctggcgctgaacgaggttgcacccgtgacagggc

SEQ ID NO: 44433 - DNA, 426 bp, Triticum aestivum
  Clone ID: PAT_TA_44433
cgtccgctccatctccgatcacagccagcgctcacaactccaccagccaccgcccaaacgccaccactccgttccagacgacctctacctcacgcgaaaccacctaggcacgtcggcggcggcggcctttcccctgctacatggctcacttccgttccagctccagccttcgccgccaccgcttcgcggggcgatgaagacgacggctgccgaggcagcgcagcagcagctgctggacgagctggctgcggcggcaaaggcagctgaggccggtaattccactggcgcgcgtgagatattggcgcggctcaatcaccagcttcccccccttgggaagcccttcctccggtcggcttcctacctcagggaggccctccttctcgcgctcgccgatggacaccacggggcctcccgcatcaccttacc

SEQ ID NO: 44434 - DNA, 411 bp, Triticum aestivum
  Clone ID: PAT_TA_44434
cgtccgccatcaccccaggtctacacctctgttgttgagccatacaacagtgtcctgtccacccactccctccttgagcacactgatgtgtctatccttcttgacaatgaggccatctatgacatctgccgccgctcccttgacattgagcgcccaacatacaccaacctcaacaggcttgtttctcaggtcatttcatcgctgacagcttccctgaggtttgatggtgctctgaatgttgatgtcaatgaattccagaccaacttggtgccctacccgaggatccacttcatgcttttctcctatgccccagtgatctcagctgagaaggcctaccatgagcagctgtctgttgctgagatcaccaacagcgcctttgagccttcatctatgatggccaagtgtgacccc

SEQ ID NO: 44435 - DNA, 429 bp, Triticum aestivum
  Clone ID: PAT_TA_44435
cgtccgcacagaccgcccgtgcggtgcggtgcggctgcggttgcgacgggagacgagcctccgccggcgaagcgaggccgcgcgactcgactcgcgtgctcgagggaggggaggggaggcgaggtggtctttgggttctcggcggcgtgcaggtcgacgcggtggcgaaggattcgctgcctaggtttccccgggagcctagatttttcttactatggcttctgaggaaatcaaatcaaagaagcaaagaaatgacgaatgcattataaactgtctcccagaggacctcattgagcggatatttttgaggcttccagtgagcactttgttgaggtgtgtcagtgtctgcaagcactggcacaacttcatacgtgatccacagtttgtcgtatcacacctttcagtgtgcgccccgagatgtccttctgt

SEQ ID NO: 44436 - DNA, 412 bp, Triticum aestivum
  Clone ID: PAT_TA_44436
cgtccgcggacgcgtgggtgccggagcagtgaagcaagcacctcccacgtcccacacagatcgagcagcgacgtacgctcggatccatggactccccgcaaaagaagctcggatccaccatggacggagagatgccacatctgctgcctgtgactgtgagcgagaccgtgtccaactccaaggagacgcgggccgctcctcctccggacgctgtcgtgattgtcagcgagtgggcgttctaccccggcttcatcgcctttctcttctacaccctgcattatgcaatcacttccgcactgtccttgttctttctgctgacgggcgcggaggcggaggccgccaaggtgagcgtcctacacgtcgggatgctgtgctttgccgcactccaggtggccagtggcgtatctagggg

SEQ ID NO: 44437 - DNA, 380 bp, Triticum aestivum
  unsure (1)..(380): unsure at all n locations
  Clone ID: PAT_TA_44437
cgtccncccacgcgtccgtgcgatcggtggaggtcggccggcggacatgtctctgaccgacgtcaggatcggcgaggaggtgtggctcacctgcctatcccacgcccttaccaacgagaccgaggaggtcatgggcctgctccttggcgacgtcgtgtcctccagcatgggcggtttcacagctgtgatatggggcgcgtcgccgcagatgacgtgcgagcggaagaaggaccgcgttgaggtcaaccccgagctgctcactcgtcgtgttaggcgcaggccgaggtaatgaccgccaccatatggaagacgacctgtttgatcggctggtaccactcgcacccgcatatcaccggtctgcctttccatgcagatgtgcg

SEQ ID NO: 44438 - DNA, 428 bp, Triticum aestivum
  Clone ID: PAT_TA_44438
cgtccgcccacgcgtccgcccacgcgtgcggcgacgacgaccggcacgactggtactcgctgggcaggttcgacgccgccgccaacaagtggacgccgatcgacactgagctcgagctcggcgtcgggctgcggtacgactggggcaagtactacgcgtccaagtccttctacgaccccgtgaagcagcggcgcgtcgtgtgggcgtacgtcggcgagaccgactcggagcgcgccgacatcaccaagggctgggccaacctccagtcgattccgaggacggtggagcttgacgagaagacccggacgaacctcatccaatggcccgtggaggagctcgataccctccgcatcaacaccaccgatctcagcggcataaccgttggcgccggatacgtcgttccccttcacctacaccagaccgctcag

SEQ ID NO: 44439 - DNA, 212 bp, Triticum aestivum
  unsure (1)..(212): unsure at all n locations
  Clone ID: PAT_TA_44439
cgtccgnngacacctcgntgtgtgtgcagatgacgagcgcgttgctcctgacgatgagcgagccggacagggtgacgccgcatagcgtgagctgaagctgactgatctatgataattaacagcactgaggtggtagacgaccgctcgctgcagttcctgtgccctgtcatcctccgcgacaggaaccacatgctgcccaagtacatcaaccc

SEQ ID NO: 44440 - DNA, 432 bp, Triticum aestivum
  Clone ID: PAT_TA_44440
cgtccgcggacgcgtgggggatggccgaggcggggttgttcgacaacacgtcaccaccgagctgctgccgagataatgccgatgctcaatccggatctggatgtctcatctctgaacgttagaaacgctgagaagtccatgtaagcttgcccatgctggttccgcgcaacattatatctctggactttcatacttccacagctctagacatgaacttcctgatatggtaacaaaattctggtggagagacctcccatatttattagacttgcttgctttggcatgttacttcctctaaattttaaataggatattcttgggaatgagatgtaattttaggaaataattagtattcagcactttattttatcctgaaactattgatctctctctctctctctctctctctctctacgtacatctacatatatc

SEQ ID NO: 44441 - DNA, 381 bp, Triticum aestivum
  Clone ID: PAT_TA_44441
cgtccgcatgtatttgctaatgctgtccataagaacggctcctcctatcccctgctcctctcgcattggcgcaagtccgcctcctcccccgcctcggtctcaacgcgtgcagcagcgatccggtaggagctcgagccgcagtggtggtccatgatgccttcgccgtcgtccccggctggagaagcatgggccgcagagacggccggatctgtccggccctcacgctgtcgttcgtccactctcaaggataatttgtttgttcagctgatttgtacagttccaataccgggttgttaaggaaaatccagatgatgcattctacgagttggagacccccccaacagcaaatttagtccgacgtttttgatgaaaatagtggtt

SEQ ID NO: 44442 - DNA, 362 bp, Triticum aestivum
  Clone ID: PAT_TA_44442
gaggcaaaggcgaggcgcggggggtcggatttggggaggctgatcgagcgggggatccgccgcccctccatcccctccaggtttggtgtcaggcgcgggggctccgggccgattggtctttgatcccgggcccccgaatcagctcggatcgcgcgcggatcctaggccggcctcggtcgccgctctcgccccggagttctccctgatccgttggatagatcactatataatcctcgtcctacatccacacgctgggaaggctgcatagatattcattctagcatgaagcacagtcggttaattttcggcaatattggtcatgctgggggatacatgtaccagtttccaccagaggttgcaat

SEQ ID NO: 44443 - DNA, 323 bp, Triticum aestivum
  Clone ID: PAT_TA_44443
aaaaaaaaaacaaaacaaacaagtaaaagaaaatagagaataaaaaagtaagcctagtcttgtctatatgtttaggggggatccaccgttacccgagtcgccttccttctagtgctcgttcattagctctcgcacacccaacagaaggcttggacacccaggacccgtagatgcgggcatacgtatcatattccgggtccggctaatctgccgcggcccgattgacaagaccaccgtccttgtgcagagacacaaccttaccttttccggttaaaccgacgtcagggaccattggcacccttttcatggctatgagcattttt

SEQ ID NO: 44444 - DNA, 327 bp, Triticum aestivum
  Clone ID: PAT_TA_44444
cgtccggcgaccgccgccgccacgacgaccgccgagtcgagcaccaccgacagcaacggcggcgcgcaggccgcgcgcgagccgacgcgggtgttcacctgcaactactgccagaggaagttcttcagctcgcaggcgctgggcgggcaccagaacgcgcaccggcgggagcgcacgctggcccggcgcgcggtgcaccggctggaggcctacccctacggctacgccgacgtggcctccctcccgctttacggctctcccgggctgtaccccatcggcattcaggcgcgcgcggttgctgctgggcccgatgccgttccttgtggg

SEQ ID NO: 44445 - DNA, 427 bp, Triticum aestivum
  Clone ID: PAT_TA_44445
cgtccgccctccctccctgccatgactgccaacccccaatctcccgtcgcaagcctcgaatgtgcgccgagcatgcaccatgttgccctactgtggaaagtacaaggatgagcgcatcaggaacgctgcctacattggcacccctggcacgggaatccgcactgctgataggtcaacctggtccatcgggaagcgcttcggctgcattaatgtcgataacgttgaggacaaccgtcgttccctacgtgagctcctcttatgaacccttggtgccctgcagtacctgagcggtgtgattctttttgaggagaccctgctccagagcaccaagggtggcaagcccttctttgacttcctcaaggcgggcaatgctcctccccgtgattaaggggggttaagggtactattgagcttgctggaaccaacg

SEQ ID NO: 44446 - DNA, 433 bp, Triticum aestivum
  Clone ID: PAT_TA_44446
cgtccgaaagacactgaacacaggatcactcttttatgcaacgctcaatgctctctcatatttctacatggtctgtacttggggaggctacacattcatcataaaccttattccgatgcatgtgctgttgagcattgtaaccggtcgttattcttcgcgactgtacattgcatatgctccccttgttatactgggaacacttctggcagctttggtacctgtcgttggttttaatgctgtattgacatctgagcactttgcatcatttctggtgtttataatccttcatgtggttgcttttttgtattacatcaaaggacttttgactcccaggctgttcaaaatggctatgactcttgttataactgttggcctggctgattgttttgcagatgtagctatactcgtagcgttggtggcatctagcccaaca

SEQ ID NO: 44447 - DNA, 332 bp, Triticum aestivum
  Clone ID: PAT_TA_44447
cgtccgcggattcgttcccttacagggagctggagaacggcgtgctctgggaagtcgatggccattgggtcgttcaaggagcagttgatgtggacattggagccaatccctctgctgagggtggtggtgatgatgagggtgttgttgaacagtccttgcacctcataaaatgctcatatctaggcggtgttatagcatgcatctttgcggccagattcaagccctttataaaatggatactttagtggataaaagaacgattctttcatgccaacacattaacaattaatgttgctagagagtggcatttttagggacagactctttcatag

SEQ ID NO: 44448 - DNA, 441 bp, Triticum aestivum
  unsure (1)..(441): unsure at all n locations
  Clone ID: PAT_TA_44448
cgtccgcggacgcgtggggcgatgatgaagctcagaagctgccttcccggcgctcgcacaggaagcctggcaacgccatgggcgcctatgcttccccacctgctcctcgtccaccggagctgctgttcccagcccacacaagatctcagtcgatgcttgagctgcaggacgtatcggagtcgaccgccatggtctcccccagggacaagcgccggaagaactagtgaaggcaccgggccacctgggcgtcgctctgtcagtcctcctcctccagccactggcgtccattttagactgcggaatccagtgggcgacgaatggtgccctgatgcttgcggtgcgcgggcgatgatgctttttggcgaggtcaaatggacccgaatgttgatagagatctggaagcgttctctttccttttttctatagctngtgctggacaca

SEQ ID NO: 44449 - DNA, 386 bp, Triticum aestivum
  Clone ID: PAT_TA_44449
cgtccgcggtgcttcttcctactctggtcagtcgttcatccccttccagaccgtggctgtgcggagcggcgtttcgccatggatggcctcgagttcttctttgaggaagcagaatcaggattggttcctaaaactcatgcgggtgatttattgggtggaggaatcgatgttgtggagtctgtggttgcttcgatccatgaaggtcgcgggcgctcctctggtgtgatttcttctgagccgatggatgacagcagcgccaaagagcagttccgagtggtgggcgcgaatctcggctcacaaaacaacggtgggagcgaagtggtttgcgacttgaacgacatggtttttcaggaaacttcccatgcgtcaatgggagatgagggaga

SEQ ID NO: 44450 - DNA, 424 bp, Triticum aestivum
  Clone ID: PAT_TA_44450
cgtccgcgcagccatcgccgcggtcttccttctctccgcctccctccgccgccgcgcgcagccgccccggctccccgaccaggtggtccccggccccatggcggcccgcaaccggagcttcgtgctgtggctgcacggcctgggcgactccggccccgtcaacgagcccatccgcaccttcttcgccgcgccggagttccgccacaccaagtgggccttcccctgcgcccccaactcccccgtgttctgcaacaatggcgccgtgatgccgacatggatcgatatccacgagcttcccttgagccctggttcgccgcaagacgagagcggtgttcttaaggccgtggagaatgagcacgccatgatcgacagggaggtggccgaggaaatccatcccgacaacatattcgagagtgagcctcag

SEQ ID NO: 44451 - DNA, 434 bp, Triticum aestivum
  Clone ID: PAT_TA_44451
ttccgccgggttttgcaagccatcctggatccatggtcccggtgcgagaggtcgtcgaagatgacccgagcggccgattcgcagacttactggatacagttgaaggtgctctcccagacggcagtgattcagatgagaaaaaggccagcagggagtatgtagcgatggacgacaagattggctgggttagcaggaaacggagggatgccatgccagacgagagatcaacaagtgcagacagggtcaccgcgctggaaaaagcactaaccgggtttgcggatagggattcagaaacagttgtgaccccgtcagtcgggctgacatttgattcaataatcgaagcatacaagttctacaacctgtactcttgggaaactggatttggggttcgttatgcaaagagcaggactaatgtaaaatgggacaaaatgcat

SEQ ID NO: 44452 - DNA, 435 bp, Triticum aestivum
  Clone ID: PAT_TA_44452
cgtccgcacagagagaggtaaactggtctataaacactctgtgatggaaacagaccaaatgacgtgctaaaagaggaaacgttagaaagttacttacattttcttggtttatgcccttgccttctttattctacattattataaagaaaatagtaataataacatgaagggttgtgagtaaaagctgtatggtgaaggtgcaaatgctttataaaagatgacaacccttgtttcttacatgcattataattactgtcagtcaagaatcttaggactgatgaataaatcttaacgcatcatgcatcaagaacctgcagatagtgtgccacaagcctgtatgaccctatcaagtggaacatatatatgaaagaacatttgatgatcctattctcatgttgaaattgcagccagcaagttgccatgagttcccaaaaa

SEQ ID NO: 44453 - DNA, 436 bp, Triticum aestivum
  Clone ID: PAT_TA_44453
cgtccgcggacgcgtgggcccccccccccccgccccgatgtcttcatcccaattccatggcgcgagtgcagcttacccgtgtttgttttcctcgccgtaaaatcagttgactggcccgcctgatcccatggacgcctaccggtggagccggatccggcaatgcctctggcgcatgcgccggcacgccattttgctgatactacgccctggtcgggatgcgtaagaacgcctcctctaccgacatacgtgccgcctaccgacggattggcatgaagtggtacccggatcgttgggcgagcgacccctgcgcgacacgcgaggcgaagcggctgctccagccaagccagtaggcgctacttcgttttgtcctacatggggaagaggtccatatacgacgccggtttctttgatacgctctaaacgacgactagttttt

SEQ ID NO: 44454 - DNA, 385 bp, Triticum aestivum
  Clone ID: PAT_TA_44454
cgtccgcccacgcgtccggccacgcgtgcgggcacgcgtacgtccacgcgtccgtccaagatggaaggtgttacgacgttcagcatcgacttcccggctcaagaatgtgacggaggtgggcgacgtgaccccgctcggcgtgctcgccagcgtctccaaggtcaagaacgcgcagatctgggcggcggcgccgccgacgaagaccgacatggccgtctagctcgccgacgagaccaagaagaagcctaggattccaacggctactggctcatggtcagttgggagctgtctgtgcactacgcgagcgtgagcagctacggacggacgttcgtacgcgctggggaggcacccaccggggcacgcaagcagccgttgacggagggcc

SEQ ID NO: 44455 - DNA, 441 bp, Triticum aestivum
  Clone ID: PAT_TA_44455
cgtccgcttggatctctgctgctgtcgagcggagattggactgcttctcacaaagcagtaagggttactccgttgtcccatgggcacacatctaataggggtctaaggtctccgcatcaaattcaagcttgtgcaacaatgtcttgctatgctacctgcacctcttatccaaagttctcattcccaacatgtgaagaccagtacctaagtcaatacaatggaatacgcaacctgcaaaggttggtccatcaagaaccatggaaccaagatgcacgctacttgcttgtgcttgctattttccaaaaagcacgtgaagagaagtaccccaaacatatttgtgccactttgaagaggctggttttacaaattatgtccagcagtagcaattcacaagagcataaactcatcctttatgagaagtacttgctacttcttttgtct

SEQ ID NO: 44456 - DNA, 385 bp, Triticum aestivum
  Clone ID: PAT_TA_44456
gtagcacgcgaatgaagtgagtgagagcgagacgccagtcgcttctcgcggctgcgccgtgccgacgccctcctcgccggctcgctgcgccgcctccgtctgccgccgcatcgccgacgcctcgaccgaatcatcgggcaccaccgccgttgtaccatctctccgacggtcagaagtttgctcggaagaaatgtcatagacacaaatgtagaaggatgttggcatctacagctgaagtgttccacagaattttgctcgaggctgcatatgtattttcctttccgagactatccttttacataaggtcacattgtgtgattgccagtacagttgcttcaagattgaaaccgtctcatccatcctgtttgataaaatgtcggcacca

SEQ ID NO: 44457 - DNA, 496 bp, Triticum aestivum
  Clone ID: PAT_TA_44457
cgtccgcggacgcgtgggcggacgcgtgggcggacgcgtgggtgaggccggagcaggaggcgagctgcaaggccaccgaggaccaccgctccgagttcgacgccgccaagccgccgcccttccgcatcggcgacgtccgcgccgccgtgccggcccactgctggcgcaagagccccctgcgctccctctcctacgtcgcccgcgacgtcgttgtcgtggcggcgctggccgccgccgcgtggcgggccgacagctgggccctctggccgctctactgggccgtccagggcaccatgttctgggcgctcttcgtcctcggacacgactgtggtcacgggagcttctcggacagcggcacgctcaacagcgtcgtcggccacctgctgcacacatttattctcgtcccgtacaatggctggaggatcagccacagaacgcaccatcagaaccatggccacatcgaaaaggacgagtcatggcacccgatcactgagaa

SEQ ID NO: 44458 - DNA, 221 bp, Triticum aestivum
  Clone ID: PAT_TA_44458
gcgtccgcggacgcgtgggctcgttcgccgcgcaggagacctcggccgagaagcctacgacgggttgagtccctgtttaggacgacaaccttgatattaaactgttttacctcccggcctttgccagtgaaattggtaaaagctctcaagttggacagttggaataatttttgttcatccttgggggcggttttcctactatttgtttgttgatttagggg

SEQ ID NO: 44459 - DNA, 692 bp, Triticum aestivum
  Clone ID: PAT_TA_44459
cgtccgcacaaccagacgggaggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaaaggtaacatgttcaagaacaagagggtcctcatggagagtatccacaagtccaaggctgagaaggcaagagagaagaccctctctgaccagtttgaggccaagcgcgccaagagcaaggcaagcagggagaggaagattgccaggagggaggagagattggcccagggtcccagagatcatgcaccagcaccagcggctgcagctccagctgcggcaccgaagaaggccaagaagtgaaggtctgacatgaagctttagctttct

SEQ ID NO: 44460 - DNA, 494 bp, Triticum aestivum
  unsure (1)..(494): unsure at all n locations
  Clone ID: PAT_TA_44460
cgtccgcccacgcgtccgcccacgcgtccgcggacgcgtgggctccctccctccctcccatcccgtcgccccgtcgccgacgcgtcctgccgccggcgcccgaccgattcgccgatccacgcaccgcccgaatggagccggcggaggcggaggcgggaggcggcatcgccgccgcgaggagcagcccggccgccgtgcaggccaccaacgacgacgccgcggcgagcaagctgtcctgtgttaccaaagggtacatgaaggatgattacgtgcaccattttgttaggcggacaacaaaaagggctccaataatcaatcgtggctactatgcccgctggtctgttcttaggaaacttatgctccagttcctcaatgctgngagtggcagtgatgatcagaagaggaaacagatattatctcttggcgctggctttgacacgacatttttccagttgcaggatgaaaggcttgctccggacctttatgtagagctg

SEQ ID NO: 44461 - DNA, 452 bp, Triticum aestivum
  Clone ID: PAT_TA_44461
cgtccggctgcttcaaaacccggccccctatcgcctcaatctcccctcgtcaaacccattcacacacaatgggcaaccgcacctcgcgccaccgccgcgccgccgcggaccagccggccacggcccctccgccgacggcccagcccaaaccccagccgccgccgaagccccagacggcgccggccccggccccgacgccggaagcgggacaggtggccatgggccgcgttctgggacgcccgatggaggacgtgcgcgcgacctacaccttcggccgcgagctcggccgggggcagttcggggtcacctacctcgtcacgcacaaggctacgggccagcgcttcgcctgcaagtccatcgccacgcggaagctcgtccaccgtgatgacatttagggtgtgcagcgggaggtgcagatcatgcaccacctcacggatcaccgtatcattttt

SEQ ID NO: 44462 - DNA, 638 bp, Triticum aestivum
  Clone ID: PAT_TA_44462
cgtccggcgagacaggatcaaccttttgcgtgcagtattttaagcgccttgatgctacccccaatggtgcagggcaattaggaactctgaaggtgaatctctgactaaataggatttagtccgacattactgcagggagataagagcaggacgcacaatgcctgaggatttctttactctgactgagatgaaggatggcatttcaactacggcaagaatagcagagctggtttctgagatccaaaagctgagagatgctgctgattttagtacatctgacttcataaggcagtgttcaacagctgcaaaaacacttggatctaccaacaatgaagaatgtcttcagcattttgttcagctaaatggtattggttatctcaatcagtggcttcaggatgctcaaaactgcagcaaggaagtcagcagttcagcagaaggtttgataaatgcaatattaactgcattggagcggctgccagttgatgatatacataaagctccttgtggtttaattcccactgttcatcagctactttctcatgaaaatacagagatcagtcaaaaggcaagattactttgccagaaatggagcagtgcaccaaattgtgggaaaaatgaccgacaaatagatgcaaaag

SEQ ID NO: 44463 - DNA, 525 bp, Triticum aestivum
  Clone ID: PAT_TA_44463
cgtccggcttttcatggttgtgctgaacttttccaggacatccatacagaattgattcagtatagaaggaatcagatgatcaaacgaggaactgtgaaggaacaactaactgttgattcagtgtccataaagaaaaatggttcatgtccactgatgccagaagaggttggacttctactccaagcattaggttatccatcaactacaataatatacttggctggttcggaaacttttggtgggcaaagaatactcattcctctacgagctatgtatgccaacttagttgatcgcacttccttgtgtagtcagagggagctatctgatttagctggcccagagtctcctctctcctctgatttgccgcatcctccacctcccaagagcgagaaggaactcattgaggaatggaaaaaagcagggcctcgtccgaggccgctgcctccacctcctgcaagaccattttatgcccatgagaaggaagggtggtatgggtggattggtgagaatgacacggaacctgat

SEQ ID NO: 44464 - DNA, 606 bp, Triticum aestivum
  Clone ID: PAT_TA_44464
gcgtccggcttgaagctgaggttcttgcattggcggggaaagcactctctgctagttcatcccagaggctatctgatgttgaaattgctgtttttggttcccgtgcgcatctggagaagcaggctcttgccacgaggaaatggtatcgaaactttcttatgaaaggtttccacttggtagtactgttgactgctggtcctggaatcagagatacacagtgtggcttcaagatgttcactcgatctgctgcgaggaaactctttacaaacatcagattaaagaggtggtgttttgatgttgagattgtgtacctatgcaagcacctgaggatcccgatggcagaagtatcggtcagctggacggagatacctgggtccaaagtgcgcatgacaagcatcctgcacatggtgtttgagctcctgctgatcagagtaggctatgggctgggcatatggaaaatttactcatagaccctgttctgggtaactcattagagcttaggtctcgatcgcttcagcgtatacaccaaacttagttcgtcactttgaaacacagctaccaaattagtttaaggggccattgaaaactttttgagattttcgactg

SEQ ID NO: 44465 - DNA, 639 bp, Triticum aestivum
  Clone ID: PAT_TA_44465
cgtccgggggcaaggcggcggcaagggagcgccgggaggagcggcggcgggaggtcacgctcctccgcgccgtaccctacgagccccaccagcggtggtgggacggcctcgcgccggcgcgcgccgtggcggtggtcacgggggccagccgcggcatcggctacgagatctcccgccagctcgcgcaccacggcctccacgtcgtcctagcctcgcgcgacgccgcgcggggccgggacgccgcggagagtatcctccgggagcaggaggcggcgagcgcggagtggcggcagctggacgtggcggacgccgcgtcggtggaggccttcgccgcctggacggcgcggacccacggcggcatccatgtccttattaacaatgcaggtgtaaacttcaacagaggagcagataactctgttgaatttgcagagcaagtaattgagacaaattattttggtacaaagcggatgattgaagccatgctaccattactgaaaccttctccgtatggtggccggatagtgaatgtaagctcaaggcttggtagggccaatggcaggcgcaataaaatcggcgatgcgatcctaagagagcaactattaactgatgattgcttatctgaggaattgattgatggga

SEQ ID NO: 44466 - DNA, 515 bp, Triticum aestivum
  Clone ID: PAT_TA_44466
gcgtccggcttccctgaggattgatggtgctatgaatgtggatgtacaatgaatcaccagaccaacttgttgccctaccctaggatccactatatgctttacttctatgcctccagtgatctaagctgtgaaggcttacctatcgagcgagatgaccggttgactgagatcaccaacagcgcctttgagcgcttggtcatgatggccacgagcgacctcagacacgacaagtacatggactgatgttttatgtaccgaggagatgttgtgcccaaggacgacatcgctgctgtgggcaccattaagaccatgcgcactattcagttgggaggctgacgccccactggctacaagtgtggagtaaactaccagagactaggtgagggaacgaggcggttgaccctggcaaggttcagagggctgtgcgcatgatctgcaacttcacctgagagcggatggtcttatatcgactatgacactgcggtgctatgatgatctataggcgatgctacagc

SEQ ID NO: 44467 - DNA, 582 bp, Triticum aestivum
  Clone ID: PAT_TA_44467
cgtccggccgtggaccagccatacccggtgcgggtgcggcgcgaccggagtccatgtgcgagttgcccccatcggccatcgcgacagagcaccggcagcagagcgagcgaaaggaagccacgacagcaagggaggaggagaggcagccgtcgccgacactgatcccccgagcggattagagaactcgcctccatcgaagatctgaatcccctcctcctgctttcggaactcggatcattccttccttcattcccgatcgatgcggatacagcctcctccggatccgcggatctagccttctgtgctgctgcagcagctgccgctgctcgattgattggcgggggagatgaggttctggagggacggcggcgcgagcgggagcgggcgggacctcaacggcgggatgccctacggccaggtgcgcgtcctcgtcgtcggcgattcagtacgacaagaacatgcaaacaccagggtgagtgagcaatctaaacatcataatcaagaaagggatgctgcgagggtggtgattaattaccaggtcctcatgcttgatatggaggttgacctccaggcgctcggaga

SEQ ID NO: 44468 - DNA, 670 bp, Triticum aestivum
  Clone ID: PAT_TA_44468
cgtccgccaacccctcgtgccatcctctctctctctctcgaaccctagcgctccactcctccctggccgccgccacctccggcgccctctgtccggcgagatccacgactcctcctcctcctctctgggtcgatcccctccaacccacgactccacaactcctcgtgctcctctctggatcgatccgcaaccgcttccaaccgagctgccgcagacctcccccaatcccggcctcctccacgccgattcgagcaacactccccacttccagaccaaaccctagcctgagaccccttcctcctcgatggccaacccctccatggcggccggcgccggggtgccgttggtggagggggtccatgccgttggggcccagatccgcaaccgcttccgcgtggcgcccgtcgaccgcgtggctgcggccctggcgacgcgatggtagcatctgccctggcggcgttggccaacgagaaaccgcgagatcctcgacgctgtgggcaccaccgcagcggcgctaagcaccaccgatgctgatggggtccaacgaggcggacaagccgctgcggcggatcggcgcgtcattcgagcagctcgcggccgtcgccaagcagcagcagcagcccgcgatggctgcgggggacttatcacgcgcctgctccaacgtctccgt

SEQ ID NO: 44469 - DNA, 542 bp, Triticum aestivum
  Clone ID: PAT_TA_44469
cgtccgcccacgcgtccgctactgcgacagcgcgctgcttcggcggcgacacctccgacatggtgtaccgggctctacttgcgggggcagcggatttgggaggaagccatccagcacctgctgtccatcgggatggcgtcggtcgaccgggcgcttctcacgggctgctccgccggtgggctggcggggatactgcactgcgaccagttcggcgccttcttcgccggccgaagcaccaccgtcaagtgcctcgtcgacgcaggcctcttcctcgacgccgttgatgttaccgggggccgcagctagagatcttactacggcgacattgtagccatgcagggagtggctccaaaccttacggccacctgcaccgatcacctggacgccacctcgtgcttcttacctcagagtataatcgacagcatcaagacgctcatcttattgctcaacgcaggctacgacgtgtggcagattgaggaaagcctggcccaaagcaaagccgaccccagacgctcctggcgagcctgcaagttcaaccgctc

SEQ ID NO: 44470 - DNA, 485 bp, Triticum aestivum
  unsure (1)..(485): unsure at all n locations
  Clone ID: PAT_TA_44470
cgtccggctccgacgatcccaagctccgccttaaaggcagcagctttctctctttctcctcccgcctaacctcgattccgtcttgtgtacgcctgcttggaacgtatccgcgttgaatgcgtcctttggttttggtcaggtctcaggtcacggtggttttccgttggcggtgtgagtggtggtggtgctttccggtggtggtttgtccatcggagctcctgcttccgctcttctccgacgacgatgctgtggactggctgctgattttggtcaggtcacggtggttttcctgtggttgtggtgctgtcccccggagctcctgccgcaccttgttcagctccgtcactgccgacgtcatcaagtcttcctggcgtggcttcatctctgactgggtgtgtatgcggcatggcttgccttctgggagaagcaccatntgtagatgctccgcctaagcggcgacaaccaagccgatctactcatgcttc

SEQ ID NO: 44471 - DNA, 544 bp, Triticum aestivum
  Clone ID: PAT_TA_44471
cgtccgtggcctttacgtgcagatgcagttttttagtgggtgtggccgtgtgggtgcggctttgttgccactattgggaatttgggatctggccacgggacccagcacgcatttatcgctcctggagttcggtttgctgcctgccccgagcatttatcagcgccaggccgtccttgtgccaggggaagggcgacaggtggggagatctcgcgcggtgttcaggctgtctctgatgctgctccatgcccggtcgattttgatgggattctctctgtgctgttggttcttcctactaggattgctcgggtttatgcttagagtgtgcgctggcctgacggccggccgtgatagttctgctgtgcagtttggttagggattctgtcactgccatgaatgccctgctcaagatttgttccctgacatgtctgaataccggctgtatcaacctgtcagttcagtctgtatgcaagatttgtgtactaacatagcttatcatttgccatcacaaacagctgcatgcaaacatgcattctggtttgcttgc

SEQ ID NO: 44472 - DNA, 477 bp, Triticum aestivum
  Clone ID: PAT_TA_44472
cgtccgcccacgcgtccgcccacgcgtccgcccacgcgtccgcatccattgaacccctccctctcctctcctctcctcgccgaatccaccccggcgctcgctgtccgagatccccaccaattcggcacgccgcacgtgtgcacgtataacaacacatcgggtcgaccgatcaatggctctgctcaaggccgcgcgcgtcgccgacgtccccagcctcgacgtcgtcgtgccggaccacctcgccgccgccgcgcgggtcctcgacgcggagtcggcggcggcgatgaagaggcagcagcgcggcgcgggccggcggttcgcggtgatcgggcaccgcggcaaggggatgaacgcgctggcgtcgccggaccggcggctgcaggaggtgaaggagaactcgatccggtcgttcaacgaggcggcgcgcttcgccgtcgactacgtcgagttcgacgtccagtgtgcaaagatggtgag

SEQ ID NO: 44473 - DNA, 327 bp, Triticum aestivum
  Clone ID: PAT_TA_44473
cgtccgcggacgcgtgggttcgaattatcgcttgtacatgaatggaccattgggatttgggacttgcagctacatcgtacagcacaatccgacatcaactgttgaatgtacactccctccgcccacggcatattcctccaaatctcgccaccaccccaccaacgccacctcaccggcgcatcgcatcgcatcgcatggcggctgcggcggtggcctccaacgggggcgcggcgcccgtgcccgggcgcctcgcgtgcgtctacagcgaggcgcagacgagccgcatcgcgcacgctctggccctaccttacatgcttcggtcccact

SEQ ID NO: 44474 - DNA, 408 bp, Triticum aestivum
  Clone ID: PAT_TA_44474
cgtccgccaaaacggccgcattttcggcgtcatcgtcgtcgccatggcgggcgccggcggcaggagcagggagcggctcacgtcgcgcgcggaggaggccgcggggggcaagcggcggaggcagaggtgggaggtggagttcgcgcgctacttcgcgaagccgcggcgcgccccctctgacgccggcgccccctggcctccgttacatatgccgcggcaagcaactccaccagggcacctggctcctggcagcctcccctgccgccctctgcatgtctagccccacccactccttagccgcccgcgtcctcaccgtctccataggcagcattgactacgaggagcactatgtatctatcctcaactaatcatggtcacagcttgcatgcgtaacagactgcccagttc

SEQ ID NO: 44475 - DNA, 596 bp, Triticum aestivum
  Clone ID: PAT_TA_44475
cgtccgcggacgcgtgggcgagagtaaaaatatgcacggactcgggcttgttgccgaatcagttgtagaacttggagaggtggcagcagatactgaaacaggtgtggtggagaatgtaagtcctgagcccttgggtgctaaagactatagctcagatattcctggtgatatcgacaatgaccagtcattggatgtaagtaagaagagtaaggactccagatcaatgaagctttttaaggttgctattgcagatttcgttaaagaagttcttaagccatcatggaggcagggaaacatgagcagagaggctttcaaaatgattgtgaagaaaacagttgataaggtctctagttcggttcctggcaatcatataccgaaaacaccagccaagattagacagtatgtccagtcttctcaaaggaaagtaaccaaactagtaatgggttatgttgacaagtatgtgaagttatagctgcatccttaaattgggctgggccaatcagaagagacttcctttgcagttgtagaacctgtgaagaatactgattcaggcggcaagtcgtgtattgttctcttggaacatctatctacatgag

SEQ ID NO: 44476 - DNA, 439 bp, Triticum aestivum
  unsure (1)..(439): unsure at all n locations
  Clone ID: PAT_TA_44476
cgtccgcccacgcgtgcgcggacacacggtgcggcacacggtgcgggcacccgagcggcgaccccaacgaggagttcctgtgggagctgctagggcgccctcgagcgcgtgcacctgctgctcgccgtcctgctcgcggaggtcttcttggacgcgtccttgagcgcggtcgacagcgtcttccacgcggtgttccacgccgtgttcagctacgaggacagctacgacgcccaggagaacctgcaggacccgatcgtgaacggcgccgtcaacgtgctccgctactgcctccggtcctgggcgccgnccgggctggtggtgttcaccttctcctgctcctgcttccggtactgccaccaccacgtgcacggcgacgtgcacgcggggctgaacgagtcccactgcaacgacgactgctactgccgcccgtactggctga

SEQ ID NO: 44477 - DNA, 540 bp, Triticum aestivum
  Clone ID: PAT_TA_44477
cgtccggacttcgacaaggtgaaggccactctgaaaggatcaatgaagatgagatttgagaggtccgacgatcccctcgagcacatcacgacttcggatgcgatcagaaggctgttcagctactaccagcactcgcagcactacttgacggcgcggcagaaggtcgacgagatggcacgggtgaaagggacggtcctggatgcaggggggagccaggccagctttgggatgcaggccgtcacgctcaccaagcgatcgttcgtcaacatgtcgagggactttgggtactactggctgaggcttgtcatctacattgtggtcaccgtctgcattgggtccatctacctcaacgtcggcaccaaatacaactccatcctggcacggggcgcgtgcgcgtccttcatcttcggcttcgtcacgttcatgtcgatcggagggttcccgtctttcgtggaggacatgaaggtgtttcagagggagcggctgaacgggcactatggcgtgctggcgttcgtgatcagcaacacgctgtcggcgatg

SEQ ID NO: 44478 - DNA, 582 bp, Triticum aestivum
  Clone ID: PAT_TA_44478
cgtccgcggacgcgtgggatttggccgactgcgccgcacgaagggagaaaggaagggggcaggaaaacagggggcggcgcggcggaacggagagcggaggagaaagagaggaagcagtctcagttctcgatctccgaggttggtgccggtggctagggctggaagccggcggcagaggcagatctgatccgcgggtggcggtgcagaggcgagactccccggagcttcggccggaccggccatccgattccgcggcccgcctctgcgatggttcgatctccgccccccacctccacccagcagtaattttattatcctcctagggttcaaatctgggcgagatcgtcgccggatcccccgggcggttctcgtgctgggacggccaggccgggcctcgatccgtgggcgccgccagttcgagtcaaattccccatctcctctgtgcttgagttcgtcgcgccaccacgatccctctagcccacacactggactttgataaatagtctctggctgctgctgctgactggagtgatgaattcgaggccgatcgtgctcgtcttcctcctgctcgtgctcatcata

SEQ ID NO: 44479 - DNA, 608 bp, Triticum aestivum
  Clone ID: PAT_TA_44479
cgtccgcgcctctagggtttcaccttctcaccctcctgatgtcttgtctggctctgtccgatctacgtgctggttgggacaaacagaccgtgtgcgtccgtgtgtctcgcctatggcattaccgtggtggtttagagaatggatctgtcaagcttctgcacatgatcctcatcgacgctcatggtaaccatggctatgcagttgttccgacatattttcttgtcacttatattgatatgctgcatgaaggcgtggtgtatgagttcagtcgtttcagcgtgatgtcttcatcatgaaccccgtcgatgcgtcattgatgatccaatttacacaatttacaattgtgaagaattgtttcgatctgaatgacgtatttccggagtgggcattcaacctgaccccactaaatgaattaccccttgcaaatgatactccccaagcctacatagatgttatcggggttatcatggcgatttctcctgtgaaagccagtcgggtgcccaatactcttagacaagtattcaggtgccgtctgatcctctctgacaataatggccacgaacttgaaataacctttggggtgagagtgctattcgaattaatggaga

SEQ ID NO: 44480 - DNA, 543 bp, Triticum aestivum
  Clone ID: PAT_TA_44480
cgtccgcccacgcgtccgggacgcgtggggggacggggccccatggatgtaatggagctcttctttgaagtatgacgattcacgctcgcatgcagggtctatcttacaaggggaagcagctgcagaggaatctggttgatgcttctattcatggggctcgcacacgcactggcgattagatttcttaccatgcaaacagtggaggaatggagtccggagagaacggacgaggacggcacccagaagagacaatcatgacagaggagattttcgattcatacatctgcggtagcgaggtggtggccgattcaatgtcccctgaaaatatgagtggccaaagaagatgagatgcagagggagtggtcgtctcaaaatcacagggctcctgctggacacgaaaggaagtttacttgagatctaatctattattttgtgactctgtataatggtagcacataatggagtaaacgagtcttcatgtgaaatcgacacgtgcttatgacatgcaaagcatcagatatcttgattgttctggttctggat

SEQ ID NO: 44481 - DNA, 572 bp, Triticum aestivum
  Clone ID: PAT_TA_44481
cgtccgcggacgcgtgggatcaactaccagatcctctccaacccggagttcctggccgagggcacggctatcgaggacctgttcaagcctgacagagtgcttatcggtggccgggagacccccgagggcaggaaggccgttcaggctctcaaggaggtgtacgcccactgggttcccgaggagaacatcatcaccaccaacctgtggtctgctgagctctccaagctcgctgccaacgcgttcttggcccagaggatctcatccgtgaatgccatgtccgcgctctgcgaggccaccggcgccaacgtgtccgaggtgtcttacgccatcggtaaggattccaggatcggccccaagttcctgaacgccagcgttgggtttggcgggtcctgtttccagaaggacatcttgaacctggtgtacatctgcgagtgcaatggcctccccgaggtggccaactactggaagcaggtgatcaagatcaatgactaccagaagagcaggttcgtcaaccgggtcgtgtcctccatgttcaacaccgtctccggcaagaaggtcggcatcctcgggtt

SEQ ID NO: 44482 - DNA, 472 bp, Triticum aestivum
  Clone ID: PAT_TA_44482
cgtccgcggacgcgtgggcggacgcgtgtctgactcatgaccgccagtgtaaatcagcaggcacttgcacatgatggcgagggtggtgcgatctgctgtggcttcagattctgactagttcactcgtaacgttaaggaggctgttgagatgttgaggaaggcaagggagtgcatgatggacatggactacaaataggccagggacgcgttgctgtataggtcagaacggcttctgtccaccggcgtggcattgaggccgacaagactggtaacattcgttcagttagtgaacacctaccttctgcatggggagctcaagcttaggattagccttgagctgaggacgctgctgagcaacagcgttacgtatctgaatggaacagagcgtgtgtcactcgccagcaagcttgacagaagaatccttaacagagagagcatctggtccgcgctagtgtgcgtcatcgaggagtgt

SEQ ID NO: 44483 - DNA, 119 bp, Triticum aestivum
  Clone ID: PAT_TA_44483
cgtccggtttgaaagttttcctctcaatttcggccaaacatataacacagaggatacatcacagcaacaacttagtgctggagatgtcattgttcttagtgattctgatgaagagaatg

SEQ ID NO: 44484 - DNA, 538 bp, Triticum aestivum
  Clone ID: PAT_TA_44484
cgtccgcccacgcgtccgcagccaccgccgtctccctccgtcccccgccgccccgccgaccaccgaggcccgagccagcggccatggccgggaagaagcgcaagtccgccgagaagcagcccaagggcagccgccttccgctcggcgccgacgccgacgcggtggccgacgccggcaagcgccgccgctccggcgccgccaagcgccaccaggccgaggaggaggagtccgtgccctcctccatcagcgccaagatcctccgcgaggccctcaagcagcagcaggaggagggcctcgccgactcccgcgacctcgtcgccgccgccgccacaccagccgccgcagctgtttccgccccgtccacgtccttgccgttccccgtccctgctgccgacggcgacgatgacgacgaggacgtcgacgagttcgacggcttcgacgccctgagcgagtacgacggcggcgtgccggagatcgacgaggaggacgagaaggccctcgccgaattcatgtccaaggacacctcctccaagcgatc

SEQ ID NO: 44485 - DNA, 651 bp, Triticum aestivum
  Clone ID: PAT_TA_44485
cgtccgcgcatgccgtcaccaatggcaaccttcccgccgtcaagtacctcattgatcatggcgctgatgtgcatcagcaacgtgcaaagggaaacatcactcttcttcatgcagctgcagttcatgggtactctgaaatagtaaagtttcttcttgcaaggggagctgatgtcaatgcagtatcagatcttgggacagccctcacgcatgctgctattagaggatttcctagtattgtcaagacccttttggagcacaatgcagatcccaacaaggctagttgtcagtttggacttttaagcatggcattacaaaaatcttctgtatcctgtgtgaagttattgattcagggtggagctaaagtcagtggtgatagtcctcgggataatcttttggtaaaggctgcagagaagggattaactgaagctatcaagtgcttgttggaagctggtgcaaacccaaatgttcctaacacatttggtagactgccaatagagttggctgctgagtatggtacacgggaagatgttgagattctctttccgttcacctcacccatttcaactgtggcaaattggagcgttgatggaatcattagtcatgtgaagatggaaatcaagcaactagaggatgacaattttgtgaaagaga

SEQ ID NO: 44486 - DNA, 175 bp, Triticum aestivum
  unsure (1)..(175): unsure at all n locations
  Clone ID: PAT_TA_44486
cgtccggnctcccccaaaacctagcccctcccctctccccggcgtcccatgtgccccgtgtcgccggcgccccggcgccagcagtagatcgccgcgccggggatggcgctccccggtcactccatgctctgcttcggtcgaagactgttataagatgccccaaggaaactatcat

SEQ ID NO: 44487 - DNA, 344 bp, Triticum aestivum
  Clone ID: PAT_TA_44487
cgtccggggttatggtagaagaaatcactagaattggcgctctctttgtttgataaggggtgcatggcggtcaatgtgaaggagtttggggacgctgctgactgcttcagacatgctcttgagatcagggttcgacattatggaggcctagctcatgggtgtgctagcacgttttaccgttatggaggtgcattgttatgcatagctcgggaggcagccaatcgttcaggtaatgtttcaaagcgtgcaccaaatgaagaatctatcacacctacaaccaactaagatgattctgaagaaggggcaaacttgcgtggtataggttatactgacggtaacatgac

SEQ ID NO: 44488 - DNA, 443 bp, Triticum aestivum
  Clone ID: PAT_TA_44488
cgtccgcaaaataccaaaatactgcagatgcactcatgggataaactcggaagcatcaaaagtagtcaacagacgaaattagaaaaataatacagttagacatgcaggttagactgaaatctgattatgcccaaacatgtcatatgccatgaggaggatgagtctggttgggaagagcattggcgagagcagtcaacctccttccttaacttcttggcgcagtagccagcgaggacggcaatgcatgagccgacgcggatgacgagggagatgatgagcaacatttggcctcccctgctcgtttacccaaccggcttcatccaactgtggtggtcggatctcagatccttccactggttgtgcagattcttcccttcatattgtttagccaaaccaagacaactatcttcttaccatttgtgcatgtcaattgttacctttta

SEQ ID NO: 44489 - DNA, 271 bp, Triticum aestivum
  Clone ID: PAT_TA_44489
cgttcgcggacacattgaccgcccatcctcacccctctttcgtatccccacaaccaagaacaggctccctttgcttgtgtcccgacaccttctttccaacgacgccttttccccgagcgtcgcgccgtcggcttccccttctgctccctcggacggcacgccaccgtcttccccttcgccgtccgccatcgacgtcccaaacgaaaagttgaagcggaggttggaagcttactataagggggaggaagagtctgaactatcgcctggcgct

SEQ ID NO: 44490 - DNA, 302 bp, Triticum aestivum
  unsure (1)..(302): unsure at all n locations
  Clone ID: PAT_TA_44490
tcgcnttcntccacgcttttctttaattttcgtgcgtaataaaccccatattccccaaagcccccaaccatggatttcactggcgaccttaagggcaagcgccctctcttgcattctgacgacgtgtctgccgccgccgttgtcgcggtggtgccggatgaggcggaggcgaagccctcgtcttcttttgaggaggtgaaggaggcggagccggtgacagaaaagcatggaggaaaagcccgcctttgtgctggtggccgaggacggtgtgtaggtgtgcattttggagcccggggcgcgga

SEQ ID NO: 44491 - DNA, 428 bp, Triticum aestivum
  Clone ID: PAT_TA_44491
cgtccgcggacgcgtgggcggacgcgtgggtttcgacactcttggtgaggcatacgacttttacaatttgtactcctgggagaaaggatttggcattagatatgggaagagcagactaaatgtgaacaggacaaagttggaaatactcgttcctgccgctgtgaatggccagccctcatgagattgctggggtcaaaggacaatggatgcccaatgcatatctttgtgaggaagtgtatgagtttaatttctgatagggagtcgaggaaaattatgaggagaagcggacaacaatcgggaggccccttatgcgagcaaatatggcaaccgagagacatgctgggcagatatacactagagctatatttgagcaattcggtcatatactataggagtgtggtgcatattaggtggaagagatcaaaaag

SEQ ID NO: 44492 - DNA, 354 bp, Triticum aestivum
  Clone ID: PAT_TA_44492
cgtccgcgcttctcggttgctgcgtcgaccgcgacctctacctcgtctttgtcttctccgcgggcgggtccgtttccgggaaccttcacgacggcgaggagggggcgccggcgatggggtgggaggcgcgtgacggcgtggtggtgggcacggcgagggggctggagtacctgcacaaggggtgccggcgggggatcattcaccgggacatcaaggccttcaacgtgctggtcaccgacgacttccagccccagatctccgacttcgggctggccaagtgagtgcctacggagtggacgcaccgggcgatcgcgccgatcgagggcacctttgggtgcctggcgccggagtact

SEQ ID NO: 44493 - DNA, 398 bp, Triticum aestivum
  Clone ID: PAT_TA_44493
cgtccgcccacgcgtccggcgtctcctcctcctttccccaacccagaccaggagcgcggctgtgttccccgtcccctggccccaggtgagcctccctcgccggcgcccgatccgccgccgaatcgtctcgattcctcgccgctccgcccgattccggcccgtgccgtcgctgatttcgtgtttttcggcgcaggaaaccagccatgaagggggccaaatccaagggcgccgccaaggccgactccaagttggcggtgaagagcaagggggcggagaagccggccgcctaggggaagaagggcatggccggcaaggtccccaacaagcccaagagggcgccatccgcctttttcgtcttcatgggcgagttccgcgaggagttctagcagtataacccc

SEQ ID NO: 44494 - DNA, 136 bp, Triticum aestivum
  Clone ID: PAT_TA_44494
ctttcgctagcgtttgagagaacaaaaacagtccaccgtcgtacgatggcgccgagcacctttccttgcgcgctcctgggcgtgttccttgttcttctgatgttcggcgggcttgtgccggcgttggaggcacagc

SEQ ID NO: 44495 - DNA, 376 bp, Triticum aestivum
  Clone ID: PAT_TA_44495
cgttcggttattatgaccccacttatgccttctctttacgcattaagatgtgtcgctcctttaaaaaaataagatattgattcttgtgttttgaagtcttggatgtgactaattgtatgacatgccgatatctggcgagcctggtgtgttctgttttctcacacccaccgctgtcgcacaaggtgattgttggacgtgagcgagcttcaagagcacttcctacaggctgtgggccgttcacaagtacttcctttcaagccgaatgggctctttagtaagatgcatcatcttttttgaatggaacaagattgaccatattgtttgaagtgaaaaagattcattatgatctacccattacttgatttgaaggtttcaa

SEQ ID NO: 44496 - DNA, 238 bp, Triticum aestivum
  Clone ID: PAT_TA_44496
cgttcgggaaagtgttaaatcatacgtaaattggacccatgcaatggctgacagattgggggggtcttattaagcgggagtgtgctctcctgcgatgggcgtttcctgtgctggattgactacttcagcggtgtactgttatgtgacttcgtcatgtacactcttaaactacttggcgcgtagttttgtgcttttccattgagaaaatatctttttttatgtaggacttgttgaaagg

SEQ ID NO: 44497 - DNA, 410 bp, Triticum aestivum
  Clone ID: PAT_TA_44497
cgtccgagataatatgcagtgctcagtgcagttcttttccttgtgccaatatgcagtgctcagggcaggtcttttacttatgctgacacatttttcccacatgatgatttttacaggtgctcgatgggaagaacatacggatgcattttgcaaacagtggatgacctgctactgctgctacagatgagcaaggtacttatccggtctttgtttgttgtgttcaaaatctgtaatgttagatggcgccctggacatgtacctttgtatgatcaccagtacatattttaagcttaatcttacgaccatcttcaagtagaccagtcttctgatttttcaacttgacattgcctgtattattctgatttttgatgactgaaaaccataggaacacctgcctggttagctaattc

SEQ ID NO: 44498 - DNA, 361 bp, Triticum aestivum
  Clone ID: PAT_TA_44498
cgtccgcccacgcgttcgcccacgcgtccgcccacgcgtccgccggctccccctttcgccggccctcccccgcatgtcatccgccccaggtgcagaggcgagcttcccggcgacggtggcgctggctcgaggcaggggaacggccgatgcggggtccgttggatcgaggcgtggggagcggtggatgcggcgtctgcggcacgagaagaacatcggttgcagccaattcgatgacctgatcaaaacgaaaatacatcttggattagtcgccattagtcctggtctcctacgcaagtgaaaagagaaaacaagggacatgttctattcgagagtgctaccaaaggaaaccattgaaatatca

SEQ ID NO: 44499 - DNA, 211 bp, Triticum aestivum
  Clone ID: PAT_TA_44499
cttccttccactctttctaatttattacactactgttggtcttgtcggctgtcgtctggtgtgtgtttttcctgtgggttatactgtttcccctaccttatctggcgggctgacttttgactcggtcagtagctaaacttcgtttgcaagttgtttgccgtacgtccattctgcgccgtgcgacggctcgcctttttctccccgttttttt

SEQ ID NO: 44500 - DNA, 252 bp, Triticum aestivum
  unsure (1)..(252): unsure at all n locations
  Clone ID: PAT_TA_44500
cntcctcccacgcgttctcaggtctagggtcaagaatcgatgatatctgcgtccgggattggggagctgttggcggcgagcatgtgcaatccatatcttgagcaggcgatatccgacctgcaaagggaaaccggggttttgttcccgttgaacgggttcggtcacattctcaatgagcgttattctacgggggagggctcaagatgatgatctctttcatagcgaacaattataccattttatgaacggagc

SEQ ID NO: 44501 - DNA, 431 bp, Triticum aestivum
  Clone ID: PAT_TA_44501
cgtccgcccacgcgtccgcgatacccgagtttcttgcagctatcggtcgcggcggctggttctctgcctctcagtgggcggctaatccagtaacgtcgcccttcctgtggtgcgttggttgcaattttcccgcgaagcttttatgggacaatctgcccatgtgccggccttgctacggccaggctctcgacaaaacggctagctacgagtgcgccaaggctcatattcagggtgagcaggatgtggatcaggctctggctcagattcgggctgagaaggctctggctcagcagcaagtggatgcggctctggctcaaggtcggaggattgtcattggtccgcaacgccagctcgaccacggccagtctttttccgcggcgccggcccacgctcatgctcaacgatgccatcgcttcggagcgccggagccc

SEQ ID NO: 44502 - DNA, 385 bp, Triticum aestivum
  Clone ID: PAT_TA_44502
cttccgttctccttctcctaaaccactctccctatccccgagtccagaatctaccccccgtctgcaatggcatgcatagaaccgatgcgcgttctctttaccggcaccgtaagacaaatcggatttgctcttggtcccatgattgccaggggagttatgcttggtgcagaccagcctgttattctgcatatgctggatattgaatttggtggtgaagctcttaaaggcgccaagatggagttgatcgatgccgcatttccacttctcaagggagttgttgcaacaactgatggtgtcgaggcctgcactggggagaatggcgcgggtatgggtgggggattccccagcgaggaaggaatgggaagggagggtggtatgacgaaaa

SEQ ID NO: 44503 - DNA, 190 bp, Triticum aestivum
  unsure (1)..(190): unsure at all n locations
  Clone ID: PAT_TA_44503
nccttcgattaggcattctcccttcgagaaggtgcatcacataattgcgcgaactgctttattgggtagggagcatgggggacacgtcagcatatagattcaaagggtttaagcacggattgcaattcaacacttgggattctttgatgcccggaccattcatctctcactagttacgttacggtacatt

SEQ ID NO: 44504 - DNA, 296 bp, Triticum aestivum
  Clone ID: PAT_TA_44504
cgttcgtccactcgtccgcccacgcgtccgcttgtcttccagaaggtgcgtgcaatcttgggaggacggattcgctttatactctcaggcggagcacctctgtctggtgaaactcatagatttatcaatatatgccttggcgcttcaatagggcatggatatggtctgaccgaaacatgtgctggcgggacattttctgagtataatgactcgattgttggtcgtgttggtgctccactgtcttgttcattcattaagtcgatagactggggcgaatgtggatacttgacatctgg

SEQ ID NO: 44505 - DNA, 229 bp, Triticum aestivum
  Clone ID: PAT_TA_44505
cgttcgcacacactcaagccaacggcactcacactactctcatccactcacaagctaatctagcggggtgggtcacttcagtgcgagtctgcatggcggctccgaggggcgcggcactggcgctgacgaaggtgctcgcggcgatgctggtggcgccgccggcgacggtgcacgccatatcctgctccacggtgtacagcacgctgatgccgtgcctgcagtacgtgca

SEQ ID NO: 44506 - DNA, 249 bp, Triticum aestivum
  Clone ID: PAT_TA_44506
ctctctctattatgtctagatctcaatgctatcacaagaggactttgaggaggatgagtgcaatgatgggtcttctgttggctcaagaaagagctcttcaaaagacctactggtgctgagttagaggaaaacgagtgcactgtacatgcagacattgtaaatcattgtcttgattaggaggctcaaaaaatgtaaatggagtcgcaacgaaccgcgcgagaaggggtggccccaggatatccatgacct

SEQ ID NO: 44507 - DNA, 268 bp, Triticum aestivum
  Clone ID: PAT_TA_44507
cgtccgcctcacccgcgccccccgccgcagcgcccgtcggaaggttctagagatggcggtggagaaggagtcgacgtcggtcccgctcagccaggcggcggaggccgtcgacccctaggacccgttcaagttgtcgtcgcgccccagctcgttcaccaccttcacccgcatggcatgctgtgctgttcttctgagttgggtgtcaagaaaatctatgtctggattgttggttcttttttctgtgtcttgtttgtcctgttttctcatt

SEQ ID NO: 44508 - DNA, 416 bp, Triticum aestivum
  Clone ID: PAT_TA_44508
cgttcggtcagcatatggatctgaaaatgatgatctcttgttatttaaccaatttgacgtgggtcaagatttctctgaccaccactatgcattgacctcagcagggaagatgagcaaagatttgactcaaaacaattcataatgtttggaaacttttacagatagatctacctggatctatatatgatagaggacatgaggacaggattgatctgtaataggctgttattgtggggccttctggaactccatattatgaacggctctacttattagatgttcggtttactcctgagtacccgggatgttcaactaaagtaatctatcattaaagttggctttgtctaaatcctaacctgtcttgacgtgggaatgggtgccttatcctggttaacactttttggggatcttgatgt

SEQ ID NO: 44509 - DNA, 421 bp, Triticum aestivum
  Clone ID: PAT_TA_44509
tgcgtccggctacttctttattctacacattagatttttttttctttatagacttagcttctttctagtcggcaaaaattcttgggtgcaaattccctcttctgcttcgcgacgtggtcatgcgcatttgacgataggcgactactgcattgtccacgcgtgtgcggtcatggacgaggtctacgcctgtctccccaccagacaccttcttggcttcgaacccgctgtggttgttgctcccgatgagaggaagcccggtgccccggccgaagttgtaaatgccgttgccacctctcgcctgcattattttactgctgctactggtgccaacggaggtggttaccaaccttcagggagtcctttaggttgtgatgtataaacacagactaactgggaagggtactttaatgttggcttttat

SEQ ID NO: 44510 - DNA, 213 bp, Triticum aestivum
  Clone ID: PAT_TA_44510
cgttcgcgcaccttcacgacccggcctgctccccccctccccccaaccagatctcgccgcgatggcgcccgccgatgccgcgcgccgcctgctcctcctcctcgcggtggccggggccgtgctccgcccggccgcggcggagatcaagcaggagtccttcaaggatgaactcccgcgggaccatcctctttcagaagttcggcttttcgcacc

SEQ ID NO: 44511 - DNA, 303 bp, Triticum aestivum
  Clone ID: PAT_TA_44511
tcatccgattcaattgatatcctttgttggatgaatggcatagcatgggctttaggttcacttcgtgtactacttcatgccgaatgggcttcttgttgcaccacctgggcgcctaccttaaggcgctcagtgttgctatggagtggggaatgcctgaaggggctgattacctggggactttgtctatcgtccattagaatgagtggtgtgacaccttgggcgctggctggcttcttgtggtaccagtatatgtcttttccaggggagcacaaaggctattttcactggcgttgcaaaacaagg

SEQ ID NO: 44512 - DNA, 361 bp, Triticum aestivum
  Clone ID: PAT_TA_44512
cgtccggtcaaaactagattctgatgaaatgtctggcgctgctataaattttgaggaacattatgacgaggaaagcattaacattgatgcttccagtgattcatccctggagccgtatgatctgtcagatgatgatactgatttgcagaagaatttcacacatctaagtgatcttgcagctgcactgcgaaaacctgacgatctagatggtgttgaaagcgctcttagttctgccgaaaagcttgtgagagcatcacctgatgagctgcgccactgctcgggtgatcttgttcaagcactggtacatgttctgtggtctgatgttgccatggaaggcgaggaaaattcttcttgataaaag

SEQ ID NO: 44513 - DNA, 408 bp, Triticum aestivum
  Clone ID: PAT_TA_44513
ccggaactctgcagttattgacctatcctctcgtctgctctgttccacctatagtggtatgggtaagttacaggtacggtattcgtaatcaggtacttttccgtgtttttggtctgattgtatcacacgctagcgctcggtctcggtcggcggggtgcatcgtccttctctgggagcgagttaacgagcgcggggatcgaccgctcccttcttgcccgtcgggtcccactggatctactccttggaccgtcgggggagagcagggggaggcgagcgccgggttcgacgtaccgcgcagcgtaggcagtactaagacgattacactgtatgcacaggactgaacttttgtgaccctgtagttagtaacaagaaaactcttaattgaagctgcacacagagaacctttat

SEQ ID NO: 44514 - DNA, 303 bp, Triticum aestivum
  Clone ID: PAT_TA_44514
cgtccggaacaagtgcggcaacggcaacggcgccggcgggcgaggcaacaacaggcgggccgtggcggcgctgagatgaaccgatccgacccgacccgacccgacccgaccgatgattagttgtagagcggttaaccttgcgttaattgcttatgatcttccgagccgatccgatccgatagcttagctcgttccttttctgcgtgttctttctctctgtacatacatacagctagcggtttaatccgtgatggtctgatgggcaataataacatgtcttcgttcgttggtttattaacaaaa

SEQ ID NO: 44515 - DNA, 222 bp, Triticum aestivum
  Clone ID: PAT_TA_44515
cgtccgcggacgcgtgggctgacgcgtggggccatggccaaggaggtgagtgaggagccggagcacgccgcgccggcgcacaaggactacttcgacccgccgccggcgccgctgttcgacatgggggagctccggatgtggtccttttaccggtccctcatcgtcgagttcgtcgccactgctgctctttctttatataatcgttgccaccgtcattggttt

SEQ ID NO: 44516 - DNA, 407 bp, Triticum aestivum
  unsure (1)..(407): unsure at all n locations
  Clone ID: PAT_TA_44516
cgtccgcgaatttcaagtagcacatggttgagcatttggactgatgagggttctctggatatgcatggccctggttactacaacttaatctatggcattctttcttttgggcaggttctagtcagtgtatagcacaagaagaggacggacaccgcccaaatacctcccattgcatttttgtagcgtgaaaggaccttcgtactgacaactccagtttcacgttcctcttgcttaataagaacagattttccctgctttgttttactcgaactatcctggctcttttgcggaccaccatcagctattactacgtccccattttcagtgtgctttatgtcatcctgtgacttgttntcgtcttggttctcttctgtttgttcctccatctttccagcattttccataag

SEQ ID NO: 44517 - DNA, 405 bp, Triticum aestivum
  Clone ID: PAT_TA_44517
cgtccgcagccttcatgcatgcatgactgactgtctagctagcccgagcagtagagctagtgcatgacgtgatggctccaacctccctgcagaggccgaggaagccgaggtgcccctcccacgccatgctctcgctctcccctgccctcctctccctccttctcctcgtccccttcctctacctcctcatccaccgttccgcgtgctccccgcccttcagcaacctcacgaccgccaggcgctcatcctcgagcgtcagcggcttcgccggagaccttcgcgacatcgagtttctcgtggaaccacctgcccttcatgttgtcgaagccgccctccgccaagctcaagatcgccgtgttctcgcggaagtggcccgtggccacaggccccggcggcatggagcgg

SEQ ID NO: 44518 - DNA, 352 bp, Triticum aestivum
  Clone ID: PAT_TA_44518
cgtccgcggacgcgtgggcggtttcgttccggagttgtgaggattcgttcgactatgtgcgggggtcttcttcatggactcgttcttcttccttgcgggatttcaggcaagatgaccatcaccctcgatatcacttctatcttttcttgttagttgcttcgctctatcactatgttgtgctacctatcacttgtttaccatgcctcccaaatggccatgacagcctctaaccttttctcccttccagcaaaccgttgtttggctatgttaccgctttggctcagcccctcttatagcactgttagttgcaggtgaagttgaagattgctttatgatggacaggattttgttg

SEQ ID NO: 44519 - DNA, 393 bp, Triticum aestivum
  Clone ID: PAT_TA_44519
cgtccggcagaacaagcttcagatacgaagccttctgtagttcctcatgagaatggtaatgacaagctgtcaaatattgatatgcacaagcttaatgatgcctcttcccccatcttgcttagcgggaccagggcagatgatctgggtgatgattcgaggcaaggttccctgtcagatgagatgaatgctaggtcaccttctgttgaatggcatgaaaagactgcaattgtcatgactacaagttctgtctactgtgatgatgttgccatggatagggctgaaaatgcagaaactaaacatattaagcccgtgcagcgagaatttgatcatagtgagatggagaccttggagcatcagggggccttacttcagaaggcaaagttgttactatca

SEQ ID NO: 44520 - DNA, 363 bp, Triticum aestivum
  Clone ID: PAT_TA_44520
cgtccgcggacgcgtgggcggacgcgtggtcttttaacccacccacgcaagccccaagcacacgcagcgcccgcctcctccccagctacccctcgcttcgctccgatcccaaggtaccctgcggttccacgccagttcgtcagagatcctagatcggttggctccccgtgatctcgggctctgcgggctttgatcgtttgcgtcggcggtggttgctgcaggttggcggccggcggcaggatgaaggccaaggcgggctcccgcgccggcgactccaggctcgcggtgaagaagagctagggcgagaaggaccccaacaagcccaagcgccccccgagcgccttctttgtcttcatggacacc

SEQ ID NO: 44521 - DNA, 176 bp, Triticum aestivum
  Clone ID: PAT_TA_44521
cgtccgcggacgcgtgggcgcggtccgccgccgtacatcacatgtcctcctgccgcggcagctgagtagctagctcagctcagctgagagtggggggagggccggcgatagtgcaagggggcagcggccatgagctggaggagagggggaggggactgtgccgtaaccaatgctgt

SEQ ID NO: 44522 - DNA, 243 bp, Triticum aestivum
  Clone ID: PAT_TA_44522
gcacgcgtccgcggacgcgtgggcggacgcgtgggaggggccttgctatgagtgggaagacaatctggagaagggctggggggtacctaccgggacgaatggcacctttgatgagattttatgttttcatgtcgctggcatatctgttagtcatggttgtctggtttagcaattacatacggtttttgaggtatttactgtcaatacagaattggatcacacttttaattgcttttggactgt

SEQ ID NO: 44523 - DNA, 385 bp, Triticum aestivum
  Clone ID: PAT_TA_44523
cgtccgcccacgcgtccgtgctcttcagcaagttttaactgatgatgtcgacttcaatgtgatgcttacctttttggaattctacgagactcttctaggatttgtgaacttcaagctttaccattcaataaatgtgaactatccgcctattctggatcctcgtctagaagctttggctgctgagctctatgcgctgtcccggtatatgtcttctggaagactgccgggaaatccagagtctaatgggcttattgaagacaaagagactgaaaataataaagagagctcaaaaactgacgagtctgagctcagattggcacagcttcaacatcagctacctgctaatgaaccttgtgcgttaatgcatcttgtagaagaatcaact

SEQ ID NO: 44524 - DNA, 403 bp, Triticum aestivum
  unsure (1)..(403): unsure at all n locations
  Clone ID: PAT_TA_44524
cctactnaaaaaacataactctttctctttacttccttagcgtgcccacccacaacacacaggcgagaaaattccctgtcctccaacgcatccacattcgcatccctatcatcggccactactcatctgtaagcgagcttcttcaaagaattagcgctgaccaaacccgcgatccctccgcctgcatccaagggtcatccacagctccatacaccgtctcatctatcatgaacacctccaccactctcatgacttttctccggaaccgtattcgccctgctcgaccatatcccctccaccccctccatctaccaaggccataaacctaaaggtcttcctcgacatatacgtcgacttccccgatctatcccattcccccccttgggaccggctgagcataacg

SEQ ID NO: 44525 - DNA, 427 bp, Triticum aestivum
  Clone ID: PAT_TA_44525
cggaatcgcaatttccaccgacgcgtacgccctggccctataaatctccacgcgtcctacatggcctccttaccatcctcctaatatccacgcgccatcctcaccatactggagcttcgcgctctcgacaaggcctcctgacttctgaccccgctagatctccgtccacgccgctccgtcaactcgcacggggaatctcgccatggccgccgcgtcctccgccacctccgtacacgacttcaccgtcaaggatgcaagcggcaaggacgacacacctgagcacatacaaggaaaaggatcttctcattgctaacgtcgcttctcagtgtggcttgaccaactccaactacaccgagctgagccagctgtacccgaagtacaaggaccaaggctttgagaactttgctttcccatccaacagtttggt

SEQ ID NO: 44526 - DNA, 439 bp, Triticum aestivum
  Clone ID: PAT_TA_44526
aattcccgttccgggccaggcgtccgcgttggcggaggcctcaggttcaccgctcccaaggtccactcacagaacacgcccgcccctgggtacctctaattgcagcgggtcgctgaggtggataccccaagccttgacagaacaaactgcggaatgacgaggatcttcgtgcagcgcgggaacgcgaccatggcgaggcagtcgggcttgtaatgctcacagtcgctagactacttactgtacgagtacgccaacagcccaagaggttctgaccaggaggcaccgctgacgaggcatctgtacgcactcaagctcttggtttgctgggatacaactgagcatctactcaagggtcggcaaaagtagtagcaatgatccttcaaggctgattgaaacttgtgaatgacagctcaagtcatgtgcaaaagggatctgagag

SEQ ID NO: 44527 - DNA, 397 bp, Triticum aestivum
  Clone ID: PAT_TA_44527
cgtccgggagtttcgagtgcttctggcgcaatgatggcgcagccgcagctggagaagaaggcgcccgcgcgggcgaggccgccgctgacggggaaggtcgtggccgcgctctgcgtggccagcttcgccgtcggcctgctgctcagcggctggatgccgctcctgtcggcgccgatcagctcccgggtgaacaagacttctgctcccggctgcgacgacaaccgcgtaagcaaggggttagccggggagaggcatgaccccaagggcatcataagcgaggtgtccaggacgcaccacgctatccagtcgctggacaaggcggtgtcttctctcgagatggagctagccgtggagcgagctcggagcggcgacgccggcgccggcgcggggggctcgt

SEQ ID NO: 44528 - DNA, 294 bp, Triticum aestivum
  Clone ID: PAT_TA_44528
cgtccgctccggcgcaccccctcgtgcctcggggaccccgatccgccgcccacaccacgatcggttcatccatcacacccctctcccggacgcccctgctcgtgactcgcgcctgagcgaaagggaacaccagctagcttggcagctcgcttgatggaggaggagctgagtcagatggagcccggcgcgaaggtgacgctgcagcggcaggcgtcgtcggggtccctgacgcagggcccgtcgggggagctccggcggcagacgtcgctggagtcgtccccccgctcggggcgc

SEQ ID NO: 44529 - DNA, 391 bp, Triticum aestivum
  Clone ID: PAT_TA_44529
cgtacgctttcgatgtacttccccgtccccattccctccgttccccagaccgcatcagttccgcaccggcgcccttctcaccctgcccaaagccctaaccgctcgcccgctccgccgccatgaggtccaaggccaacggagacaccgcgttcaaggccttcggcaagaacaagacggccaccggcggcgtcgccaagccgaagcgcgcccccacccctttcttcgctttcctggctgagttcaggccacagtacatggagaagcaccccgaggcaaagggcgttgcggccgttaccaaggcggtcggggagaagtggcgcatcatgtcggatgaggagaaggcaaagtatggcggcatgaaggcagatgccccagcaagcaagggggtgaa

SEQ ID NO: 44530 - DNA, 537 bp, Triticum aestivum
  unsure (1)..(537): unsure at all n locations
  Clone ID: PAT_TA_44530
cgtccgcaatcccactcccacaatttccggaatagcaagcgcgccgccgccgttcgggttcgagatgttccagccgttcgaggagctcaagggggagctgtccctcgtgccgcagggcaaggaccagtcgctcgccaggcacaagttcgtcgacgagtgcgaggccgccctcaacgagcagatcaatgtggagtacaatgcctcgtacgcgtatcactccctcttcgcctacttcgaccgcgacaacgttgctctcaagggatttgccaagttcttcaaggaatcaagcgatgaggagagggggcacgccgagaagctcatggagtaccagaacaaacgtggaggcagggtgaggctccagtcaattgtcacacccttaacggagttcgaccatcctgagaaaggcgatgccctgtatgcaatggagttggctctagctcttgaaaagctggtgaatgagaaactgcacaacctgcacagngtagctacgaggtgcaatgatcctcagctgaccgactttgttgagagcgaattcct

SEQ ID NO: 44531 - DNA, 474 bp, Triticum aestivum
  Clone ID: PAT_TA_44531
cgtccgcggacgcgtgggaaaaggtggaacgctctcaagatggtcagataacagagatagtctacaagagttctcacaatcaccctttgccgcctccaaaccgccgctcaggtatccctttgtcgcaaatcaatgatcaacaagtccatgttctagagaaacctggttcgcacgcagggctcaacactgcatctttgtgggaaaatggtaaaagtgagtgcattcaagatatgcaaggtgtcgagggaagaccagctgctggccctcctgtatctgcatatggtgatacatctatcatggagtcccaagatgcagctgatgtctcgtcaacgctgtccaatgagattgatagagcaacacaaggcaccatttctttagactgtgatgtaggtgaagatgagactgaatccaaaagaaggaaactggatgctttagctgctgttaccattcctactgcgaccaccacaagttcaa

SEQ ID NO: 44532 - DNA, 583 bp, Triticum aestivum
  Clone ID: PAT_TA_44532
cgtccgtccacaagcagaggagccgactcccaagcaccaacgcacgccgggcataagaccagcgaccaagccaacatgcgtccatctcgggacctccggctggccgtgctcctcctcttctcggcctccgtcctcctcccggcagccagagcccagcaggagaccgaggaggaggaagagttcagctactcgctggacgcggagaacgggccggcgaactggggcgagatcaaggaggagtggtcagcgtgcggcaaaggcaacatgcagtcccccatcgatctcgccagcccacgcgtctcgctggtgcgcggcctcggctacctcaaccacacctacgcccccgccaacgccaccatcgtcaaccgcggccacgacatcatgctcaagttcgagggcgacgccgggagcgtctccatcggcggcacgccctacttcctccggcagctgcactggcactcgcccaccgagcacagcgtcaacggccgtcggtacgacatggagctccacatgttccacgagagcgcccagggcaaggccgccgtcatcggcgtcttctacgagatcggcgcccacgacgcct

SEQ ID NO: 44533 - DNA, 482 bp, Triticum aestivum
  Clone ID: PAT_TA_44533
cgtccgcccaagggcaaacaaagcacccacgccggggctgctatcccacacccgcagcctccctcccgcagatcgagcggcgcggcgcggcggccggcggccggagggagatgaggaagcgcgagagggagaacccgtgcggggtctgcgggcactaccacaagtgcgaggaaggggagatgtggggggtctgcggccacaggcccgccgcggcggacgcggtggccccggcgagggtcgactccgccttcccctccgaggtgctcaagggcttcctcttcctcggcagctacgacaacgcctcccgctccgaggtcctcaagacgctcaacatcacccacatcctgaacactgtgccggattgccataatctttaccggaattcattcacttaccactgcctccaagatgataaaacattggattttgatggtgctactcagtttttagagcaatgtgaatgaggggcttcacgtgttctt

SEQ ID NO: 44534 - DNA, 558 bp, Triticum aestivum
  Clone ID: PAT_TA_44534
cgtccgcaagcaggtctgggccatcgccgactccaagcggctggggtacctcggcttcggcgaattcatcaccgcgatgcagctcgtctctctggcgcaagcggggaacgagatatcccaggacagccttcagcgcgaagatctaatcagcttcaatcccccagtgatggagggtttggatgctcaacttgccaaatccaagcatctggcaaagagggtcgatcaggatatggatggatttcctcaggcacagggaccttctactaaccattggttcaactcgaagtcatccaagaagatacccctgactgctgttacttctgtcattgatggtttaaaaagactatacatcgaaaaattgaagcctttggaagttacatacaaattcaatgattttgtgtcccctttactggtaagtacttgtattctctgtatctgctttctatacgagttgaaaatgattacttcactcgctttgcgtgtttatattccttcctaatgttatctccttgtggcattacctttaaataagctacttaaggacaaaaaaatatcctt

SEQ ID NO: 44535 - DNA, 529 bp, Triticum aestivum
  Clone ID: PAT_TA_44535
cgtccgcccacgcgtccgtgttgctctccctcccctctccccccctctctctcttgcgcgcttgcttgctccccttctccgtgtgagcgaggccgagacggagcaccagcggaggagggctgtgctgaagaaggctgcgccagcgagagcttggtgactgggagtttcatacattccacaagaccactgaaatactggaagactcgcaacctcaagagattgcattccacgaaacagcgctggggtcaacgctagtagatcatcaaaatgtccactctactgccgcagtatcagcgggagacattggaatggctgaagtcagcttgttgcttggtgaatctgacacatcagctaccggtttactgccagtgtcattcttgtcatgcagtcctagatctatggttccaatatcagttccttcatcatctagccttgaagccatcctaacacctaatccaatgtacagtgatgttcagttgaaagaagtgatgaactacaatgctacagaaatggatgaaagcactgagtt

SEQ ID NO: 44536 - DNA, 541 bp, Triticum aestivum
  Clone ID: PAT_TA_44536
cgtccgcggacgcgtgggttgcattcaggttgtcattaggtacgagatggtacatcagtgtctccactatagagatgaatataatacgccaaaagtaagtgtatgagcccagcttgttttattgtggattgctgctacggtgagcactatatatagtcacaagtacgtcttgcagcacactaaattatatccggcgcaaagtcgaatcgaacacggctgtgacatcacaagcatgctgctcgagcgctacctaactgctgagctactccagtcactcgcttgcatctagcctagaagcccagatggcactgactggtgcactcgaatataggcgttgatattatgatagcttggatgcactgcatatgtgacgaattcacaaattgatgattctgaggcactggtgactgtagatgcaagtgagtgatgcaaattcagaattgcatacgtagggcctacgactgactaagggtacgtgatttggaagaaagtgcaagcacaatgaactcatccatatgaccaggctgctacagagcctatc

SEQ ID NO: 44537 - DNA, 593 bp, Triticum aestivum
  unsure (1)..(593): unsure at all n locations
  Clone ID: PAT_TA_44537
cctgcaggctccgggccggactcccgggttccgcgcctgcaccgcgcctcgatggatgccgcccaaaaccctaggctgaactgaaccctcctccccgagacgcggccatggcggagccggccctcctcgacccctcctcccacttcgacctccgccactacccgcccggcctcttcgacccggacctgcacctcgcggacgacgacgacgacctgccgctcgggaatttcggcctcggcctcggcggcgccggcggcgactgcgacgacctcgacttcgacctgcccgcggatttctccgtcgaggacttcctcctccgctcccctgagcggagcgactccgccgagggctctgccgccggatccggccccaccgcatcctcgtcctcccccgccgcctccggcaccggctccgccgtcgccgacgccagctgcgaggtcaagcacgaggagtcggacgaggggaggagcgccgccgcccctagctggggcctgaagcggaagccggcgagccccgcccccagctcggaggcggccaagtgccgccgatccggggacggtgaggnctcccctttcgcgtcggcctcgcggccc

SEQ ID NO: 44538 - DNA, 623 bp, Triticum aestivum
  unsure (1)..(623): unsure at all n locations
  Clone ID: PAT_TA_44538
cgtccgccccaatccccaatctcccaaccaatccaccaagcaaaccctagcccagccccgatggcccgcacgaagcagacggcgaggaagtccaccggcggcaaggccccgcggaagcagctggccaccaaggcggcgcgcaagtcggcgccggccaccggcggcgtcaagaagccgcaccgcttccgcccgggcaccgtggcgctccgggagatccgcaagtaccagaagagcacggagctgctcatccgcaagctgcccttccagcgcctcgtcagggagatcgcgcaggacttcaagaccgacctgaggttccagtcctccgccgtgtcggcgctgcaggaggccgccgaggcctacctcgtgggcctcttcgaggacaccaacctctgcgccatccacgccaagcgcgtcaccatcatgcccaaggacatccagctcgcaaggcgcatcaggggcgagagggcctaagatgtgtccgtctcgtcttatctgcaggtgtagggagtagcatatgttgcgtggtggagtaatcttgtattgtggtagtaagattctaactgaatgtagtgtttgatgttaccatcttgctgncatcagcaatatgaatgaaagttggctat

SEQ ID NO: 44539 - DNA, 184 bp, Triticum aestivum
  unsure (1)..(184): unsure at all n locations
  Clone ID: PAT_TA_44539
cgtccgccgttcgatggtcgctacgttttgacttgtgcgttttcaccggacggtagatcttggccaacggatgacctgtgggctcgggctgaatttcattggctgggtgccagcttattgggtgcgcggngcagcctgtcctgccgcgccgcgtgcatacgaggaagcccgggtcgctggcgct

SEQ ID NO: 44540 - DNA, 280 bp, Triticum aestivum
  Clone ID: PAT_TA_44540
cgtccgcggacgcgtgtgcatcggcgcacgagacttgcggcgccaactatactcaacgcgacggaacgctagccagacgctcatggatattgacgtatgggcgggccaggagcggaaaacgaaacgagaaactggaggagagcgcaagctgaacccgaacgcgcagagtatattaagtgggaaggaggagctagatgtctgatcctatcaatgaatgggtccacaggttaatggaggggcttatataggatctgaacgtgtgcatacaggaacactgatg

SEQ ID NO: 44541 - DNA, 578 bp, Triticum aestivum
  Clone ID: PAT_TA_44541
cgtccggtaacatctgctcttattggatattcatttctgactggattttttcgtattggaacaattattcttgcgttgcatgacacgagtgatgtgttccttgaaactgccaaattgtgcaagtacatctgaaaaagaactaggggctagcttattttttgggctttttgctctctcgtggctcctattgcgtctgatttacttcccattttggataatcaaaacctcaagctaccagtccatcatatccttgaggaagctggataggttcccaacgaccttgtactatattttcaacacaatgcttctcacattacttgtgtttcatgtgtattgggggaaactcatattttcaatgataatgaaacaattgaataataaaggaaaagttggagaggatgttcgatctgattcggacgatgatgactgatgggggtggttctttgacaattgtgatgggccatttctttgctggtaccttgccctgtacttacaacagtagattgtgttggtccgcaagcttgtgctaagacagtttcatttctggatattacctcatgatatcaaagatggctaga

SEQ ID NO: 44542 - DNA, 646 bp, Triticum aestivum
  Clone ID: PAT_TA_44542
cagagaggggcagagccatggcgattttggctggttagctttgtcgttgatctctggagagcgagccggtggttaggcgtccggtcctcctcccccctccccctgttgcttctccttcaagcgcgttgaggcagaggagaagttgacgcatggtgattcagcggcggcgtcttatctgcttcccttgatttggtgatgctcctccttttgttgtggtgttctccgagccttgtgcgtcccttcttcccacaacgaggttgcaagtctcttgctcttgactctacaaagaaagcatcaaatgattcgtcagttggtaaatctgctggcatgattgtggttttctccaatgtagacattcgaaatcttaggatcaaatatgtgaatgacatgtttttcagccccttgaacagctgcgacaaatcttttgtcactgctttctttggaggcaatgccaagtgaggttcagcatgtgcacagtcctagctcagttggtggatgagttctctttttgagtagcatgtaacatagaaccactagtgcaaatcatttggatcattggtggatttacaaggtctttttagtggatttaaagtggcatctttaatgcatcttgcactggaatttttagtgggtaatctagcagcct

SEQ ID NO: 44543 - DNA, 583 bp, Triticum aestivum
  Clone ID: PAT_TA_44543
cgtccgcttgacgcagcttgggattgacaaagaccgtgtacggttccggcagcatctgccaaatgaaatggctcactatgctgctgattgttgggatgcagagatcgaatgctcttatggatggatcgagtgtgttggaattgctgataggtcagcgtatgacttgcgtgcccactcggataaaagtggtgttccactcgaagctcatgaaaaattcgcagagcccagagaagtggagaagttagttataaccccatcaaagaaggagcttggtcttgcgttcaaaggggaccaaaagatggttctcgaagcattggaagccatgggtgaaactgaagctctgggcatgaaagcagctttagagtctaaaggggatgttgactttaaggtttgtacccttgggaaggatgttaccataaagagaaatatggtttcaattaacatggagaagaaaaaggaacatcaaaggaagttcactccttctgtcatagagccatcatttggcatagggagaattatttactgcttgttcgaacattgcttctatcaaaggactggcaagacagatgatgagcaggtgaat

SEQ ID NO: 44544 - DNA, 575 bp, Triticum aestivum
  Clone ID: PAT_TA_44544
cgtccgcggacgcgtgggcggcgacccaggtacaagcacgtggcggcgtggcggcaactgggatgcacatgaggctactgttcttctaccggttcacagcgtccatgtgacaccgccgagcccttcatttgcgtcctcctgggagaccaccatgcagcaccaaggcgcctacatgctcatgttagagttaatggaggatgaagtgtgaccgtactatctccttgtgtctacaacgacgtgtgtcagtactgtctccttgaccggctccttaggctctccctgtgcggtagcggctcaatctccgcggtgccgtcgaggaggggctggggcggccgtgtctggtgcgctctcgctactcatcgaccttgctgttactacctcatccttgaagccatgggtggcctctaattttccctttggagtgttgaatgcaaactgcaaaagtagagctggttggctagctgttgatttgatcgggggatatcatatgaagtgagtaaacagaaagaaagtgagtaaacagaaagaaagtgagcattcaagcaggaactgcaaatgctctattttagtcaaag

SEQ ID NO: 44545 - DNA, 633 bp, Triticum aestivum
  Clone ID: PAT_TA_44545
cgtccgcggacgcgtggggtagacgccaaaggttgcgggtgtgacggaggagcaccatggcgggcgtgcaggccatctttccctaccaagttatcactgctaccccactgtagtccctggcaagtacatgttgctaccaaggaaaatatgctttctcatcaattttgcagcatgcattagaaagttcaaagtttatatccttgaataaatttcttcatgaaggtgcatcaggatgaccatccaccattgtttcttcgaaagcacgcggcagaggcacccacacccgcggttcagcaagatctacatctccaacgactacaccaaggactggggcatatacgccatatgtgcctctgttgaagctcagttaactcatataggtgtactgtttcatatgctggcaacccacacgctttgaaacaatcaatttctaatgaatcaatacctgcatttgcaaattgtatcccagtgtaacatataggaaggaggacagaagacgactattttcaattacatgccggagaaggctgccgacagagaagagacgacagcaggagcagagcctctcttcctgcaggccttaggcatcttcttacaatgcccatacatattgcatattcatattactatttt

SEQ ID NO: 44546 - DNA, 648 bp, Triticum aestivum
  unsure (1)..(648): unsure at all n locations
  Clone ID: PAT_TA_44546
cgtccgatggaaaaaagactgtctctctctgagccgcccacaccaaagagagagacagaggtccccttcatctcagctaagacgagcggcgtcaggttggaaaaatcaagaacggcggtgcagcgcagcgtgaggatttcgtcgactacccaaagttctcggcggtagatgtggcaataggtgaagcacctacggatcccatcttctccagaaccaatagccagataccttcacatcacccgtcaatcgacgtggatcttgttgaagacgagaacaacagcaggccagcgacgccgccatgctgccgaccatgccgggaaacgatggatggataagacggcagagaaacagaactagcaattctttccaggcaccagtagaaggatatcgaagtgctatagagcgtgcaattgaagaagcatcaaaacttgggaaacaattgttttcgaacaacctgttggcttaataaatgaaatggcaagtcttttgccttgtttcaaaaaaaaaaaaccgagcaggaggcatatgagttctacaacgcatattcatggtggcttggattcaacatcaggcggngaaacaaatatgtcaatgactcanaatacaaatcaaagcagcaagtttcaaagtgggtttttcggaaaagtt

SEQ ID NO: 44547 - DNA, 545 bp, Triticum aestivum
  Clone ID: PAT_TA_44547
cgtccgcccacgcgtccgcccacgcgtccgcccacgcgtccgcccacgcgtccgcccacgcgtccgcaacgagccacgctagcgtttgagagaacaaaaacagtccaccgacgtacgatggcgccgagcaccttcccgcgcgcgctcctggccgtgtccctcgttctcctggtggtcggcggcctcgggccggcggcggaggcacagccgccggggaggtgcgtgccgcagctgaaccggctgctggcgtgccgcgcgtacctggtgcccggcgcggccgaccccagcgccgactgctgcagcgcgctgagctccatctcgcgcgactgcgcgtgcagcaccatgggcatcatcaacagcctcccctcccgctgcaacatcggacaagtcaactgctcggcttgaggcggaacgaagaaacgatgcgagtcacagagtgactaataatgaaggtggtcatttctgccgttgttgcggcatgtctgcctcttcgccgccgtcttagttttcgtttgtccagtctgtcgtgtcctgctgctgctgtc

SEQ ID NO: 44548 - DNA, 283 bp, Triticum aestivum
  unsure (1)..(283): unsure at all n locations
  Clone ID: PAT_TA_44548
acgcgtccgcccacgcgtgcgggccactccacgcctgctgntgcaccacatcgcccgatccccaacctccggatctccccagtcccagtgacgcccacctccccctgaccccgcctccacccgacgtcgccggccccgccccctcccactcccgccccgccggcaaggcgggcgccgccatgcccgggggtgcctttgaccgatctcctccttcctctccgtggacgccgtgggagcacccatcccgatgcccagaccctaaccggggacgcgcgctccggga

SEQ ID NO: 44549 - DNA, 521 bp, Triticum aestivum
  Clone ID: PAT_TA_44549
cgtccgaaagtttagtacgcgagagctgtatttgtctgaggagtttcgtgttctcatcaggagcaccgagcggcccactgagcagacaagaatagagtacttgtcattgttcagccattcacatttctttattcctgaaatattcaaggatctaaaaaaggtggttgtattggatgatgatgtggttgttcaacgtgatctgtctttcttgtggaaacttgatatgggggacaaggtaaatggtgctgttgaattttgtggtgtaagactgggtcaagtgagaaatctcctgggtaagacaaagtatgatcctaaatcatgtgcatggatgtctggggtgaatgtgatcaatttggataaatggaggaagcataaaataacagagaattacctgctgctccttaaacaggtcaagaaaaaagacgaggtatctctgagagaagctgccttttctttaagcctggtgtcttttcaaaatctcatctacccccttgatgggaggtcgactctgtctggacttg

SEQ ID NO: 44550 - DNA, 602 bp, Triticum aestivum
  Clone ID: PAT_TA_44550
cgtccgttcccgtctccccgctcctttcccaaatctgaccgcagccgcacgacgcacctacccaacccccagagcaccagcagccccgacctagcccagcccggcccctcgcgcgcccgcacagccggcctccaccgcgccgccgcgccgccgcgccgtggccgccgggcacctcccggtaggggagcggcgcctcgtttctttgatgcgccgtgaaggaattgggagcaagaagccgtgatgtttactccgcaggggaaaggatggaacggctggtccacgccgtctccagggaaccagcgggccggtggtggcgctccgcccgcatctgcgccccttggcaaggccaaagggacttcacagagagctgccgagctcgagcaggagttacatgaatatcaatacaatatggggctgctcttgattgagaaaaaagagtgggcagccaaatttgacgaagtcacccacgtgctgacacaaaaggaggagatcttaaagcgggacaagctgcacatttgaatgctatatcagaatatgaaaggcgagaagaaacatgcggaaatcactgggtgttgagaaacattgtggagctgatcttgaaa

SEQ ID NO: 44551 - DNA, 527 bp, Triticum aestivum
  Clone ID: PAT_TA_44551
cgtccgcccacgcgtccgcccacccaccgcctcctccctaccacagctcgctgccgacggcctcccctctcccatccgcttccctcccaccccagacggattgcccctctcctctcctgcaacccccctctctctctctccccacacttcacagtgacagcaggcactcccagatccatccggatgccggacatggaggagtccgcgcagcccaagcccgccaacccctcggaaccggagctctcctcggacccgcccaagggcgcggggacgaacgcggatggctggcggcgaggccgccgccaggagatccgacttcgccgacgggaatggggccggatccgccacgcccgagcgctccatcctcgtcgacagggacgactacatcctagtaggtcagagcgctccatctggtgggtccgagcgctccatcctcaacagggacgacggggacgactacatcctcgacagggcggcctacatccggcaggtcgcccgccagggtggcggcagacttcgccatgggc

SEQ ID NO: 44552 - DNA, 538 bp, Triticum aestivum
  unsure (1)..(538): unsure at all n locations
  Clone ID: PAT_TA_44552
acgcgtccgcggacgccgtggggcggcggcgagccgggcgcgaccggtgcgtgttatgggtgcgcaccggacgcgtcgggcccgtcgggaccgcgggcgcgcgaacgagcgtgcggttgtcattgggaggaggtgtatgtcgccgttgtgatcgagttcatgctcgagttcggctacatccttctggcgtttgtcgttggcggctgccatggcggatgcggaggcggcgtgcggtgagtccatagcgtgtggtgtggtcgggctcgtcggatgcgcgagggacgtgcgggacgcactggtgcggttgggctcgtcgggcgcgtcgaatgggcgcgggacgtgcggngcgcggagggatgcctggcgtcagtggcggtgccaggggttagctgtgtagtcaactgactacacaacattttcgcatgcattagtagacatcaagcaaaaaccagtacaaatttcatacaagcacaagtatttgacatcacacctttgtactcctagcttcgccactgcctggcgtgtgtcaccggcggag

SEQ ID NO: 44553 - DNA, 475 bp, Triticum aestivum
  Clone ID: PAT_TA_44553
cgtccgagacagtgtaaagaggaaaaagatttggacgttcgtgcgcccgtggcggcgttcgtcgctggccaaaaaatcttgtgtctactgttctttttcttccacctccgttcgagtgagaggagagatagctagagggctgcggttccaacaattggttccagagccacaaggttcgaggggcggccgtggcgcgcggtggcgtccgcggccgacatggaggcatcggctgcggcgcgtggcgagcgcgtggcgacggtgacgcgcggcgagtccgcggctgtgcgttgtgatgtcgtgcgcgcgaagagcacggtggtcgcggagacgaggaggccgcggaggacctgcgtggtgggcgcataggtcgcggcggctcggcgcgacaccgtggaggcccgtggcacggagccgcggcggacctgcgtgggggcgccaaggctgcggtggcgccgcgtggcagcatggaggtgat

SEQ ID NO: 44554 - DNA, 459 bp, Triticum aestivum
  Clone ID: PAT_TA_44554
cgtccgcccacgcgtccggctcatttcaccgtacatgaagtatagattgtgtttttacttatcagatctgtccaatttattagtaggactgtgcattcttttagtacctatatagcaagggtccagcccatagtgtactgtattatatatatgcgccagtgatcgaatttactatggtccatcctatacagcctcgtacagctgcatattgtacattcttttagcatctatgtgataaataccagtactatggttttgattgcagagcagttggtgtatattatttacagttgtcacgcagagtacatattcagtagaggttccttagcatttggctgtcttacttatcctcccctccgtatcaaaatataagacgtcttttgacactacattagtgtcaaaaaaacattgtatattttggtacctagggagtaatagttactatggattggtattgga

SEQ ID NO: 44555 - DNA, 322 bp, Triticum aestivum
  Clone ID: PAT_TA_44555
cgtccgcccacgcgtccggggagaccacagcccacgctcactgtccatggagaggacgcagggcttcttcgcggcgctgaagcaggaggtggcgcgcgggctgtcgccggcgagggcgcgccggaggtccgagtcggccgacctcgacgccgccgcgctccggttctccggcccgggggagatgctcgcgccgctcatggagggccccgatccggagtccggcgacggctacggccgcgccgccggcggcgccaggagggagggctggggccgctgggtgcgcggccagctcgcgcgcacgccctcctcggtcgccgccgcg

SEQ ID NO: 44556 - DNA, 501 bp, Triticum aestivum
  unsure (1)..(501): unsure at all n locations
  Clone ID: PAT_TA_44556
cgtccgctgagacttgagcagttcgttcttaacaggatgttgtatggccatgtcggaagggagtcgtttatgaagtctattatgcagtgttagaacagatgaatggaagtccatgatcttggacccagcagaatttttgtgcaacaagtagtgatgagttactagtaccattatctaccctagacttataaatactcagtaaagaagggctacctccaggctgcagcttcgtcagttcatgtttttctctaggagtgtaacttgttagtttttccttcgagaggttctctgtgtataatcaatcacattgctacttctgaatgtccagtcacactgnatgtgtccntcaaaaaaaaaaaanaanaaaaaaaaaaaaaaaanaaaaaaaaaaaaaaaaaaaaaaaaaaaaaaaaaaaaaaaaaaaaaaaaaaaaaaaaagggggggccgttttagagggtccaaggtttcgtccgcgtgcttgcaacggaatagtttttttt

SEQ ID NO: 44557 - DNA, 456 bp, Triticum aestivum
  Clone ID: PAT_TA_44557
cgtccgcccacgcgtccgcccacgcgtccggaacgaggaaccctagccgcgcgaggaacgcctagatccccaaggccggcgacgatggcggcggttcggtgcgcggcgaggaggctcggcggctctctgctccagcggacgcaggcggcggtcgcggaggagggacgcctgctctcgccaagcaggctcatgcgctcccgccagctctccaccaaggtctccggcgagcgatcgcaggtggcggagcgacacctcctcgagccaggcagcctcatgcgctcccgccagctctccggcgagcatgctcgcaacatccagaagaaagaggatgactgctgggcggggttcattgagacgctaaagaggttggacgagcttgaaaaaaagaagaaacccaatgtcttcaagcagcgcatgatatccatcgaccgtgcgttgaagagtttggtctatgga

SEQ ID NO: 44558 - DNA, 499 bp, Triticum aestivum
  Clone ID: PAT_TA_44558
cgtccgcccacgcgtccttggacgcgtgggggggggggagccgcgggctccgtgcgtgcctacgccggccgctgactccctctcctctagctatccgtccccgccgccgatcttcgctcgtcctccggcgacctatgtctgcggctgtgatgcaggccacagcgcccgtagggcgcagcgggggagcggagattgcgtacgttagctacggcggtgagcagcacctctcactggtgatgtcgctggtggacgcggagctcagcgaaccctactccatcttcacctaccgctacttcgtctacctttggccacagctcaccttgctcgcgtttgatgccaaggatggtaagtgcgtggggacagtggtttgcaagatgggggagcacagaggcgccttcagggggtacatcgccatgctcgtcgtcctcaagccctaccgaggacgaggaatcgcaactgagctgggtactagagccattcgggtaaagatggaatctgg

SEQ ID NO: 44559 - DNA, 466 bp, Triticum aestivum
  Clone ID: PAT_TA_44559
cgtccgcccacgcgtccgcccacgcgtccgctaccataatgctatgctttctcatctgtactcgtaattgttcaggcatagatgcattatggtcatggagaacaataccagtatgaattgattgccctcctggaaggcatggattcagtggcaaacacttcgattaggatgcggccctctaggtacgaaggcatggattcaacggcaaaaaaattgatcgggatgcagctctttaggcaagaatccacagcaagaacatcaatctggatggattcaaccagtgtgctagatcgttggatgacataatacagttatgatgtgggtcgatggtggtactctagctccaaccaaactctggctcatccgatctccagttaggttcattattcatcaatttaagtgctacgtattcctatttggattatacttggtgcataaaattattgaatcaggaaattattaaaaa

SEQ ID NO: 44560 - DNA, 639 bp, Triticum aestivum
  Clone ID: PAT_TA_44560
cgtccgcggacgcgtgggtccggcacgcagtcccgacgttgtctcctccgccgtccgtcgcccgccgcctttgcgaagcgcagcctacacgccgcggtggatgccacttctctcatggctgcggactggacatcggcgcgccgggcgtgggagaagtggaccgggaagcatgtcggatcttccgggatgccgatcaaggcggcgctgctgctcaactacgatccgacaggaccatctcgcctcttccccatggtagcagagcaagagggagcaaaatttactgctgttgatctgcagccgtccatggacttctttagaaggaataatctgcagacggaattcttttctattggatcaaaccaatatgtggtcacctcaatccacgagcactggttttctgctcgttgcgttaacacgacacagccaggaggtgaaggagttataattatgcagattggagcatacttgttagtctctatgtatgatggttcagtcggttcggcttcacgggcaatggtggctgttgatcagtttgatggcactttaaccggaaacacataacttattatgatgtagacccatggccttagagtctagtgtataacctgacatactgcctaatcttgctgctattactgg

SEQ ID NO: 44561 - DNA, 513 bp, Triticum aestivum
  Clone ID: PAT_TA_44561
acgcgtccgaaaatgcctgcacaaatacctcgagtacgatccttgagcttaagccttaagcaggttcagaaggctactcggagattttcacctgcacttaagctaagtgaaagtggatcctgggaagtctacaagggtatcttaccaaataaccaaattgttgccgtgaggagagctaaaaagggctgtgatcgtgctgcggaagttcacaagaaagtgcagctccttacagcaattaatcactggagtttggtgaggtctctatgttttattgataaaggaaatcagtttattatgatcagtgagtatgttccaaatggcagtctaaggcagcacctggatggccaacatcagaaaatcctggatttggatcaacgcatatcgatcgctattgatgttgctattgccttgacttatcttcatttatgtgctggggaaacaatgatctgttatgatttaaagactacgaaaatccttctgacagagagttatagagcaaagttgggtactttt

SEQ ID NO: 44562 - DNA, 568 bp, Triticum aestivum
  unsure (1)..(568): unsure at all n locations
  Clone ID: PAT_TA_44562
ccggaatccgggtcgcccacgcgtccgacacaagactctctctctctccgcgtgtgcgtncctctagtcgtcgcccagtcgctgccgcactgctcaggctcaagctcaagctcgagccccggctccttcgccaaccctcgtgccgcgatcccccgcagcagattttctgtgtgccggttgctagctgataagatctgactgacggcgccggcaaggttgtggcgccacggggatgcagaggcaggggcggcacatggagcggtccggctccaagcgggcgctagaccctggcggcagtggcggcggcggcggcggcgacgacgacgaacgtgatcctaaacggccgcacgtcccggccctcgccagtgtcattgtagaagctctcaagttggacagtttgcagaagctttgttcatccctggagccgattctccgaagagttgtcagcgaagaagtagagcgtgctctagccaaactgggacctgcagcagcacctgctagaattgaaggagggacctctcccaaagaattgaaggccctaatgggagtaatctccagcttcaatttc

SEQ ID NO: 44563 - DNA, 385 bp, Triticum aestivum
  unsure (1)..(385): unsure at all n locations
  Clone ID: PAT_TA_44563
cgtccgcccacgcgtccccctacgcgtacctgcaacgtgtcagacggtggcaaactacaacattcagatggagttcacccttcacctggtgctcgcttctgcggggtggctagtaattgcatctggcgtttgacctgctggtttatcctggtcgtacggtggctggtgctctgtcgttcatttgatctggtgctggttcgaggcactactactgtgttgggttaatgaactatcgagtccccgtgttattcgttggttgaaacggatgctgtcacagcatgatcgttataagtagtgcataactgaacttcagatattgcgctgatgctgctgtggttctgtatattgtgctttaaaaaaaaaaaaaaaaaaaaaaaaanaaaaa

SEQ ID NO: 44564 - DNA, 509 bp, Triticum aestivum
  Clone ID: PAT_TA_44564
gcgtccggctttctccaaaatggttaggcatcatgggctgttgttgcattgcaggtgtacttgacaattttacagaagtctgatgtcatgctgcgtgaaaatttgtttggagaccctctgacttcacattttttatttagttagctagaaaaccaattagttgttaagtttgagtattcaaactgatgcggagaggtgaagagttctaaaagcttgtttggcaacttcgttctggatagaggagtcttctacaaccacaaacttatacctatgctgcatccttgtttcgactcattgtccagttctaattatggtctgactttccttgaagaaacttctaagtatgccgattatatttgggctgttcattgatcggcactttggaggttttattggaagattgtagaattggaaagtctagcaaaacgtcagttggtgtgaggactcggtgaagcccgggagggtttgactaatgattaatcctgatcctgaagcatattactccctcc

SEQ ID NO: 44565 - DNA, 534 bp, Triticum aestivum
  Clone ID: PAT_TA_44565
cgtccgcggagccgcgcaacgatccagcgcacgcggcagaggaagcggcgacctccttcgatcgaagatgagccaggacaaggccgccggcgagaaggcggcggcggagcccaagaggcagacgccgcggctcaacgagcggatcctctcctccctctcccggaggtccgtcgccgcccacccggggcacgacctcgagatcggccccggcgctccggcggtgttcaacgtggtggtggagatcaccaaggggagcaaggtcaagtacgagctcgacaagaagaccgggatgatcaaggatgaccggatcctgtactcgtccgtggtgtaccctcacaactacggcttcgtcccacgcaccctctgcgaggacaacgaccccatcgatgtcctcgtcctcatgcaggaacccgtcctccccggcaccttcctccgggccagggccatcggcctcatgcctatgatcgatcagggtgagaaggatgacaagatcatagccggctgcgccgacgaccccgagtacccacacctcaa

SEQ ID NO: 44566 - DNA, 285 bp, Triticum aestivum
  unsure (1)..(285): unsure at all n locations
  Clone ID: PAT_TA_44566
cgtccgaaatatccagccttggaaggaaagcatataattatcctcatgttacaagggttggcatcccccaaatatcacaacaacccagacatatcaggaaccaaaagaccctatcatcccaacagactggtgcagtgatacaaggttaagctttctcctcgttgttgttcacctacttggatcgctgcctcatctttcggcgcttcctccgccgccgccgcagcaagcagataccgagacccagtccgcctgctgcgcccccgccgccacctccgngatgagggc

SEQ ID NO: 44567 - DNA, 436 bp, Triticum aestivum
  unsure (1)..(436): unsure at all n locations
  Clone ID: PAT_TA_44567
cgtccgctgctctcctctgtcctgctctgccatctctgcgactctgccgcatgccagctcctccccactccattaccgcaccaaacaccctcacaacgcgccgccattaccgcggccatgctatcgcggttcaataattcgctctggatgcaggaagacgacggccatgagcaacagggcctcggccacgagcagccgccggcgatggggatgatgccgatgatggggcaggaggctgggcaccaccacgaccagcacctcctggctatgcccacggggggaggcggcgggttccgcgccccgtcgatgcttgatgaggactggtacttcggcgcgggcgcggttggcgacggcgccgcgaacgggtccatggccctggtgcccgccggtntggaagcatnggngtccagctccngcttnggagcccgtccacaga

SEQ ID NO: 44568 - DNA, 496 bp, Triticum aestivum
  Clone ID: PAT_TA_44568
acgcgtccggctttatttgtttttccataagtaccactataatgaatacaacatgtagaggggagaacaaatattttctgttgtttaggacaaacaggtctataatgcagaatcaatctgacagaatgacatcaaccttagttaagttgctgctaacacaaccaaatgtgtttcttcagtggatcacgtacttagggaacatcaacgagcctacaagtttttccttgacatccattaatttccccactccggcaaccggagcaaagggtccaatttttgaagacgggcccaactttgacacggcatttcgagttttccacggcagagacggggttgttccactttcagaaggagcatttgctcatattgagaagcctctgccaaagcccgctccagaatttaaccccttggcagccaaagcagctaccatcagtctctcaggattcggaggctttttcagcttccgtgatttctcaaacaagcgcataagcagaac

SEQ ID NO: 44569 - DNA, 593 bp, Triticum aestivum
  Clone ID: PAT_TA_44569
cgtccggcagcctttctgcagtgtgtgaaagagtgctcgggggatgcctggctccatcaacaatgggcggagacggatgcgacaacatgaccatgatcttggtgcagttcaaaaaaccagtcagtgacaagaaaaaggctgacgtgggggagcaatctgcaaaaggcaaggaagagtcttgaggttgagtgagtatacgtgttatgcgaaggctccactggtgctgaggtctacggctcttgacacgggctaggatgctaagttgtcaatgtgaaattgtgtgcactctgtggctggggtatcgactgtatatcagtcgattgctgtggttggcgtgcattctgcctgcgaacccaggataaatcacattgcttggcgcaacatcgaaatcctggcactcaacttctcttagccgctctgttcgtcattgtacaatccatggtttggatcatccacgcctcccaaattcataatttggtgttttgttatagtttgtgtgtatgctgtaaacgtggctggggtgttcctttgttttttggggggatattccatgccttaagggctggggctggtgttctgatcttgaatggatc

SEQ ID NO: 44570 - DNA, 535 bp, Triticum aestivum
  unsure (1)..(535): unsure at all n locations
  Clone ID: PAT_TA_44570
cgtccgcccacgcgtccgtccacgcgtccgcccacgcntcggcccacgcgtacggctcaatccccaaatcctcgcgaacgaggagggtggcgccgtgataggcctccgtcgcagcccgcggctccacccccaactccacaggagcgaggagggcgccggagtgaccaaccgccgcagcacgcggcgtgggcccccaagtccactcgagcgaggcgggctccggaattccacgccgtcgccgccgcggcggtgcctctccggctgcgcctgcctccctgccggacgacgacgatatgctccgggagatcctcatgcgcctgccgcctcagccgtcctctctcccgcgcgcctccgccgtctgcaagcgctggctgcgcgtcgccaccgacccccggttcctcagcagcttctctgcccaccatcgcaagccacccctcctcggcgtctttgagagagacatgtacaacatcgtgttcactcccgtcctggaccctcccaaccgcatccctcctgaaaagttccccactcggcgtca

SEQ ID NO: 44571 - DNA, 451 bp, Triticum aestivum
  Clone ID: PAT_TA_44571
cgtccgaagaacgtcaccttcgtggcaatgaacgcaccacaccggaacgcccagtccacgtggtcacacgtcgcgcgcagcgggaaagcgcaccctcctagcggatgccgcccccgcccacacgcgtccacgcggcgtccctatccacccctcccctctcccgccgcgcgccgtgaactcgaggcaaaacccagcagaagctcacgagcgaagcagcaggccgagcaaatcaatggcgatggcaccgtcagcatccgtcgtctccttctccgcccgcccgtccgctgcgctccggccgcgcgccgcctccgtcaccgcgggagctggcgggcgggtccgcgccggggcgcccaagggaggcaagtggtgggcgccgctggtcgggtggtccgggcgggcggactacatggaggcccggacgccgacccgggtggtcgagcaagaggaggag

SEQ ID NO: 44572 - DNA, 418 bp, Triticum aestivum
  Clone ID: PAT_TA_44572
cgtccgcccacgcgtccgcggagcgacccaagaagcgtcgcaaggagcgcgcgccgacgccgatgccggcaacagataagcgacgaacgaggagctcctcaatgccaaggtttctggcttagaatccgggtttcctttggcgattacttgtctgtaataggtgacttgtctagggttcctagaaacctccctccctccctccctcttggtctgtatgatagttagctgcctgactgaacctgctaccttttggcgtatgcctgaatttagctgtcaacaaaaaaaaaaaaaaaaaaaaaaaaaaaaaaaaaaaaaaaaaaaaaaaaaaaaaaaaaaaaaaaaaagggaggaaggaaataaaggagcaaaggtaaaagacgaaaaaagggaaaaaaaaaaaaaatggatggggggacgt

SEQ ID NO: 44573 - DNA, 424 bp, Triticum aestivum
  unsure (1)..(424): unsure at all n locations
  Clone ID: PAT_TA_44573
cgtccgcggacgcgtgggcgagctttcatgcagccccgttgcctccctcttcccactccaccggcaatccaactatccaagcctcttcccacctacctcctctgctcgtggaaccccgtctgagcacgaaattcccgcaaggaaagaaaaaaggagaggaaaatctctcccccaggagccgggcgggggagcctttcctccctcagaaaccctaatcctcccctcccctcccctctcctcccttcccctctaaagccgccgctcgcagcgatgacgccgcccttccgcccgtcgccctcctccaccgcccccgccccgcgcggttgcggcggcaagcgctgcgcgtccggccgcgacccctggcccgtttaccncgtccgccacaccgacttcttttgccgcctctgctcctcctgcggcctcc

SEQ ID NO: 44574 - DNA, 518 bp, Triticum aestivum
  unsure (1)..(518): unsure at all n locations
  Clone ID: PAT_TA_44574
cgtccggcacgaacagagtaaggaagtagccggagtgtntgtttccgcagctggtgtgtcaacctcggtggtagccatggccgcgctgaggagaggttcggccgtggccttggcggcgctggtggcggcggcgatgtgggccgggatggcgtcggcggccgtgtacgaggtgggcgacaaggtggggtggaccatcatgggcagccccgactacggcgcctgggccgcctccaagaagttcagcctcggcgacacccttgtgttcacgtacaacaagcagttccacaacgtgatcgcggtgagcaaggcggactacaagaactgcaacgtgaccaagccgacggccacctgggccacgggcaaggactccgtcgtcctcaacaccaccggccaccactacttcctctgcggcttcccgggccactgcgccataggtcagaaggtggacgnncgcgtgctctnctccggtggccctttcaccggccccgccaaggcgccccgcccgggagccccgggcg

SEQ ID NO: 44575 - DNA, 492 bp, Triticum aestivum
  unsure (1)..(492): unsure at all n locations
  Clone ID: PAT_TA_44575
tacgcgtccgccacgcgtccggtcaccaaagccatgaggggtttcccgctggccggcgtgctggtggcgctgctgctcgccgccggggagctgcattgcgcagcaacagcggcaccagcaccaccagcaaaggcatcggcgccaccgccgcaacacccaggagcgccaccacagcacgcaccaccggggggggcgcggcgacaccgaccatcacatggacgagccccgccggttcccaggaagcaggaccctccatcatcaccaccgccaccgccgccgaagcaggaccctccgcctccatcgccgcctcagcagcagcaggaccctccatcgccaccgccacaggagagcataccaccaaaacaggtcgtgccaccaattcaggaccccgacgcggnggcaccagcacagccacccaggggcgggaaccgctccgcggtcaacaccacccntctngggttcggggactccacggtggacccaggcaacaac

SEQ ID NO: 44576 - DNA, 489 bp, Triticum aestivum
  Clone ID: PAT_TA_44576
cgtccgcccacgcgtccgcccacgcgtccgcctcacccaaggccaccagagcaattccatcaccccaatcaaaacaatcttatggttgggccagttgcttttcacctactgcagcctaagcaacagattttgcctgtcattgaggaagctccagcacaggatgatgaagatgaaggctggggtcactgggctatgccacagcaacaacatcctgtagatgtggaaattcatgctggagagtttctgaaattaaatgacttaatgggacctcttgaagtacatgttgtgcagccagaagatgatcacagtggtctcactttatctttgggactgccaagtgcaaatgttagttctgctgagtctgctattggagcaccaggcataccatatctggatgagcttctggcacccctagttctaccagaagttcaaccagttgtacctgttgcacatgctgcttttgatcttaatcaacccatcgaacagctg

SEQ ID NO: 44577 - DNA, 491 bp, Triticum aestivum
  Clone ID: PAT_TA_44577
cgtccggccatggccgcacggagagccgcgcttcaggtgacggtgtgcgcggcggtggtggcgctggcgctgtgcgcggcgggcattggcgcgacgcctgcggcgaggggcgcggggtgccggaagcacgtgcggagggtcacggagtacggggcggtgggggacgggaggacgctcaacaccaaggcgttcgtccgggccgtggcggacctgggcaggcgcgcgggcgacggcggcgcggcgctggtgggccgcggggcggtggctgacggggcccttcaacctcaccagccacttcaccctcttcctccaccgcggcgccgagatcctcgcctcccaggacctggacgactggccgctgatagcgccgctgccgtcctacgggagggggagaggacgagcccggcccgaggtacagcaacttcatcggcggatccaacctcaccgacgtcatcatctccggttacaatggcacccatcacgggcagggg

SEQ ID NO: 44578 - DNA, 438 bp, Triticum aestivum
  Clone ID: PAT_TA_44578
cgtccgcgaaatactcctcctcctcccctagggttttgctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaatgttcctacgtggcacagggacctgtgcagggtttgtgag

SEQ ID NO: 44579 - DNA, 551 bp, Triticum aestivum
  Clone ID: PAT_TA_44579
cgtccggcacgcgcacctcccgcctctcctctcctcgccccccgagatcggaatcggcgcccccccgtccgccgccgccgccgccgccatgtcgccgtctctgctcggggggctcaccaagtcgctggccatgaccgtgctctccgaggtcggcgacaagaccttcttcgccgccgcgattctggccatgcgccatccccggaagctcgtccttgctggctgtctatcggcgttaacagtgatgacggctttatctgcttctctaggctgggttgcaccaaatctgatatcacgtaaatggactcatcatatcaccactctgctgttcttcgtgtttggcatctggtcattgtgggaaggcttcaaagaagaaggagagtcagaagatttggctgaattggaagcaaagctggatgcagactttaagagtaacaaaggggaatcaaagaataaatcaaaggcaactgaagatacaaagaaaaagcaaaggccatttctcatgcagttcttctcgccaatttttataaaggcattttccatcactttctttg

SEQ ID NO: 44580 - DNA, 533 bp, Triticum aestivum
  Clone ID: PAT_TA_44580
cgtccggtcctccgcgccgcctcgccgcctcgccggacctccgccgcctcctcctccggagctacatagaggtttgattgagcgagatggggttgagggacaagaagaggaaccagaggcgcgtgctctcgcgccgctcggccggccccaagaccggcgagggcaaggatttcctgccgctggaggggaaagagcagagggtccgggagaagaagcagcccgaggagccggagagcacggccaccgtcctgtacatcggccacatcccccacggtttctacgaggaccagatgcaaggtttctttcagcagtttggggctgttaagagggtcagggttgcccggaaccgcaagacagggaagtccaagcattatggattcattgagtttgagaaccctgaggtggcgaagattgtggctgatgagatgaataactacctgttgtttgagcacactctgcaaattgcgcctgtcccaccggagaaaggtcatgccaaattatggaaaggtgtgccgaagggatttataccagtc

SEQ ID NO: 44581 - DNA, 549 bp, Triticum aestivum
  Clone ID: PAT_TA_44581
cgtccgcggacgcgtgggcggcaggtcccccgccgccggtgttggcgcggcggaagcgggcgccctcgatgagcacgcgctgggcggagctgaggagcgcgccgttgaggtggtcgaggacgctggcggtggtggggtagaggaagggcgaccccggggcgttgtagtaggcgttgagcagcgccgccgtggcctcccggagcagcgtccggtacgggtcgccgcggccgtcgagcgcctcccgcagcgtcatgtccggcccgtaccgctgcgccgccagcgggccgaacgccatggccaccgtcgtgttgggcgtcaccaccttccagtggcaccggtgctccggcaacgtccactggtcgtacgcgcacgcggagccggagcttgagccggagcccgagccatcggccggcgtttcgcttgaggaaggcgcggtcggcgaggggatagcctccggctctggctgctgcggcaccgtcggcgggcggcgccagacgggaggcaggagcccggggctgcggcgccagaagatcggcaccggggaataca

SEQ ID NO: 44582 - DNA, 584 bp, Triticum aestivum
  Clone ID: PAT_TA_44582
cgtccgcccacgcgtccgcggacgcgtgggttttcatctgtacgtatcagcggtgagctattcccacttgagggtgactatacatcagttgcaaaattagatccaaacatgccagtgtttttaggccattaaatagacattgatgcatatagtgtttgttaattccatatcgactcacatggaaaattgcgatgttttagcaagcccactatttttctaattaactgaacataatctaaaaaccaatattggggaagggatgttctcctggttaggatacagggctgctaattatcgttgttgcccgacctcaaacaaatggacaacgatcacaccttggaacctgcaacctgagcatccaacccaattcgattcagtcggcatgtaaccaccagagaaccatcagatctgataaagaacatgtctatggggcggaatgcatgatacaaggcaaggtgcctttatgtgtcagatctgaaatgcaatgcacacaaaaaacaacaagtaaattttcatcaaagtagtaatacatcctcgcacaaaagttgtgccaacagttgcatccaagagttatgatatataag

SEQ ID NO: 44583 - DNA, 540 bp, Triticum aestivum
  Clone ID: PAT_TA_44583
cgtccgcccacgcgtccggatcccccaagagctccctctcccccacccacgaagcgcctcccatcccgatggcccgcacgaagcagacggcgaggaagtccaccggcggcaaggcgccgcggaagcagctggcgaccaaggcggcgcgcaagtccgccccggccaccggcggcgtgaagaagccccaccgcttccgccccggcaccgtcgcgctccgcgagatccgcaagtaccagaagagcaccgagctgctcatccgcaagctgcccttccagcgcctggtgcgggagatcgcgcaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctagagcgcctcgagcttcgtcggaggtgtagagggtgttaggttctgaacctgtgttgcgtggt

SEQ ID NO: 44584 - DNA, 592 bp, Triticum aestivum
  Clone ID: PAT_TA_44584
cgtccgggatgccagagctccgccggttcgcgcccaatgtggcgcattgttctggttggcaccaagctagatctgcgtgaccacagagcctacctcgccgaccatcccggtgcctcggcaatcacaaccgcacagggtgaagaacttaggaagcagatcggcgccgcagcttacatcgaatgcagctcgaagacgcagcagaacgtcaaggccgtcttcgacaccgccatcaaggtggtcctccagccgccgaggaggagggaggtgatggccgccaggaagaaaaccaggcgcagctctggatgctccatcatgcacttgatgtgtggcagcacgtgtgctgcttgaattagcacaccggactgactctggagacgaagcatggtgtagtaggcaagtcgatttgctgacatagcgtcgacgtctttctaatgcttctgttctgtttagctactactatatgttgcgtgttttggtttctacttccaatccaatcctacagcgtcaggcgctaggatcgactattcggattgttggtgtaatgttatgtaagcaaggttgtggaacagctagattcagtctagggtcaact

SEQ ID NO: 44585 - DNA, 627 bp, Triticum aestivum
  Clone ID: PAT_TA_44585
gcgtccgaatacatcctgctcaatgttcgccgcgacatcaggtggcgtcatacatgagcttgctatgtggcaatcatttctcctcgatgtggcggacacggaggaacctggacagcatgacaagagttgtgctgacttagtgcgggagctctcatatgatattgaggacaagattgacaactccatgtcacttatgctccatcacgcctgtcccaagagtggcatcaagaagcacatgagcaaattcaagaacttgttacctgtcaagatcccgtatcagatagccaaagatataaaagacatcaagagccaaatcttggaggtcagtaatagatgtgaaagatacaggtttgaggatgtctgcctcgcaagaacagaattcgttgaccctagattgtgcactgtcgatacatgtgcagccgaccttgtaggcattgatggtccgaaacatgagcttgttaagtggctaagaaacggggaggatgaatcggtgcatcaacagaaggttgtctctattgttgggtgtgcgggattagggaagacgactcttgccaaacaggtctacgacgagcttagaataaactttgaatatcgggctttttgatcaatttcacgaagccctaatat

SEQ ID NO: 44586 - DNA, 476 bp, Triticum aestivum
  unsure (1)..(476): unsure at all n locations
  Clone ID: PAT_TA_44586
cgtccgcggacgcgtgggcaacacgccaagagcatgaaggagttttcctaccaggagatcgaggcggcgaccggcggcttcgcggccaagaacgtcgtcggcaagggcagccacggctgcgtctaccagggccaggctcaggggcggcgccggccacggcaggaggctcgtcaccgtcgccgtcaagaaggcctcgcacccgcagggggaggccaagctcgccaacgagatcgccgtgctcacggccgcgcgccaccacccgggcgtcgtgaccctcgtcggcgcggttgcggcggcggggcggtcgccgcttctcgtcatggagttcatgcccaacggctcgctgcacgacctgctgcaccggtccccgaggccgccgccgtggccgcgccgcgtggagatcgcgctcgacgtggcgcgggccatgcgcgcgctgcacggngccgcgccccgcgtcatacaccgggacgncaaga

SEQ ID NO: 44587 - DNA, 519 bp, Triticum aestivum
  unsure (1)..(519): unsure at all n locations
  Clone ID: PAT_TA_44587
cgtccgcggacgcgtgggttggcatcatgggcgacggcgacggcgccggcatcaaatccgctgattcatcgggccctctccgcggcatgggcggcgccgaggtgcgcaacaacggcgcttcgatagaaatcgaggagccggccggtgtcgcggtggcggacggcgttggcgtaggacgaggaggaggaggagggtttcccttggcagctgtgaccgtggtcgtcctcgtaggcttggtcgccgggcggctcccggccgtggcgctcaccgtgctggtgtgcgcggcgctccagagactgcggcgggacgggacggtggtgccggcttgggagggngaggggaggcggttagagctttccatggcgggcgtaggaggagcctcccgatcccaaggttgatgtatgtaaattagtgagtgagtgccattaaacagcaggagtgagtgaacggtggtactataatccttccttactacatacttggtcttaagttattcaaaagcttgagcgccttccctgg

SEQ ID NO: 44588 - DNA, 377 bp, Triticum aestivum
  Clone ID: PAT_TA_44588
cgtccggtggaggtggtgccgtgctgccgttccgttccgctccgcggtggccgccagtccagttcgctgccgctgctctcgcgagtcgcgaaaccacctcgctcctctcgtggcctccgattctgcctcgcaacacaggcgaactccccagcgcagccactgccaccacgccagcccatgggggccgccgaggcggaggccggaccctgctccgtgccggcggacgccgcaggcccttcggcggcgagcgcctgcctgtagtcctgatggtgtagggcaggggagagggggagcagggacagagagtgagtggtgagatgggggcgattgggggcgacgagatggcgccaggggataatgtggacggaggcgaggtg

SEQ ID NO: 44589 - DNA, 481 bp, Triticum aestivum
  Clone ID: PAT_TA_44589
cgtccgtcttccccgatctcccagatccaccaccaccaccagagcacaccacacgagctccgccactcccccaaactaaacccccgccccgccccgcgcgcggatgaaaccctagcccagatccccccgccccgcccgcccatggccgccgccgcgtcgacgatgctggagtccctcccggcgccgctgctgcgggcgctgcggctcaagacgaagcagcaggagctgctcctccgggtctccgcgctggcgctcatctacgtgctcgccttcgccgtgcgcctcttctccgtgctccgctacgagtccatgatccacgagttcgacccctacttcaactaccgcaccacgctctacctcacggagcacggctactccgagttctggaactggttcgaccacgagagctggtacccgctcggccgcgtcgtcgggggcacgcttttcccgggcctcatggtcaccgccgcgctgctccacc

SEQ ID NO: 44590 - DNA, 568 bp, Triticum aestivum
  unsure (1)..(568): unsure at all n locations
  Clone ID: PAT_TA_44590
cgtccgcccacgcgtccggctggtagccctatggaagaatcgtctgaagaggatggggatgaatgttcagactctgatgactcgaatttcatcacctcttctgataatttagaagatgtgaaggagggagagaaagttgatgaccatggattaccttctgatgactcggaggatgatgactatgatccagcagggccagattctgatgaatatattgaagagaagcaagataacgcagacttcacatcggactctgatgatttctgtgctgacattacgaagtcttgtcatagggatgaagtttcgtctggtcataaggttggaggtcatactaatggcttggaaggggcctctgttcggcctagcagatcaatgtcacatctcactaccaaagatcttgagataggccaggatgcgacttgaccatcaaggagacggcaggttaaaccgttggactacaaaaacctttatgatgcttatgggaaagcaccatctggttcgagttacggtgaagatttgtctaagaaatgcacacctgaaactgaattcactccancaagccctcagc

SEQ ID NO: 44591 - DNA, 535 bp, Triticum aestivum
  unsure (1)..(535): unsure at all n locations
  Clone ID: PAT_TA_44591
cgtccgatcgctactcttcccacttctgatcaagcaaagaagtttgtggatcaattcattcttctgatgaaacgcgatggctacacactatgcaattctacggtctgtaatggattctctgaactcacacagcaatccacagatgtatctcagcccggctatctgactggagaacatccacagtaccaggggttctcgccttctgttgtgaaaagcgttgtgattaatgaatgtaaggatgcaggttttgcatcggagaagaggctcccagatgtacatgccaatgctcggcagcaagggagccagcagtggggactgccagatgtacatgccaatgttctgtatcaagggagtcggcagtggggcctgacagacgggcatgcaaatgcccagcacgaagggagtcagcagtgggggatgccagatgcacacagatatgccatgcagcaagggagtactcggcagcggnggcagtcatatgcgcacacaaatgttccacagcaagggggtaaccagcaatgggggcaaccatatg

SEQ ID NO: 44592 - DNA, 446 bp, Triticum aestivum
  unsure (1)..(446): unsure at all n locations
  Clone ID: PAT_TA_44592
cgtccggctagtagagtctgagatcacctttaatttcgtgaaaaaaaaggtgatctcagactctactagctaacaaaaagtagtacaaattaacatcaacttgtggttgaagtatcatccggtattaacaactcaaaatcattagggctaaaaaacgaagccacctcgctgcttgttcatggatgcggagaccctcaacatcttcccctcccagccgatgcatgtggagccatcaccaaagggggagcttggtctagtcctgtcgccagcgcccgtggggtcgaagatgccgtcgccggaccaccatcaccaccaccaccagnagcaggcagccgccgcggccatggaggagttggcggcggngagcaggaggcagcaacangagcaccacctccaactggagnaccagcagcaacaaccccgctttgncaccgccgagnnccgaa

SEQ ID NO: 44593 - DNA, 506 bp, Triticum aestivum
  Clone ID: PAT_TA_44593
cgtccgcccacgcgtccgcccacgcgtccgcggacgcgtgggcctgtccagtgcaagtctctgtggaggcaatttaaagctgaaactgagtataccgtcactcaagccatagctgctcaggaagcaaacaagaggaacaacaactggctgcctcctccatgggcgctcgctgcgatggctgtccttggtttcaatgagttcatgacattactgaggaacccattttacctggccgtcatgtttgtagttttcctagtcgggaaagccatgtgggtacaactagacattgccaatgaattccgaaatggatttcttccagctctcctttcgctgtcgacaaaatttgttccgacaattatgaacattctgaagagactagctgatgagggggcagcgcccgcagccccagagaggcagagagagacggagctccaaccaagggataatagttcaaacagcaaccgtgacatcagcaggttcctcccgcttaacctcttcagagaatg

SEQ ID NO: 44594 - DNA, 500 bp, Triticum aestivum
  Clone ID: PAT_TA_44594
cgtccgcccacgcgtccgctctattcgcaaaagggccctgggacttgtttacctactcgtcaatgacacgaatgtaaagcctttgaccaaggagcttgttgattacctacaagtaagtgatgatgacttcaaggaagacctcacagcaaaaatatgctcaatagttgaaaagttttctcaagataagctatggtacttggaccagatgttcaaggttttaacactgactggaaactttgtgaaggatgatgtatggcattctcttatagttctgataagcaatgcgtctgaacttcaaggatactcggtcagatcattatacaaagcattgcaagcatgtggtacacaggaaagcttagttagggtagctgtttggtgcattggtgaatatggtgagatgctggtcaaccatattagtatgctggatgtggaggaaccaatcacggtaacagaatctgatgctgtggatgctttagagctagctcttaagcgctacttct

SEQ ID NO: 44595 - DNA, 624 bp, Triticum aestivum
  Clone ID: PAT_TA_44595
cgtccgaatcaatgcggggttgtatgcgagagagttaatggatagttccaaaaaaattgttacggagaatcaaggggcaccagggatgagaaccgaggaagttcttgctatggcgacagttgaagcacggtcccctggctcttcaactatcttggttgctcactttgatgggcaggtatgatcttttgtcaatttttttgtgtgaattctttcatcaagaggcatgcataccacttgctgtaacatttcttggtggttaattgtacatgttttttttttctcatcaactgactgatatggcaggtccttcatgtatctaatattggcgattccgggttactggtgataagaaatggacaagtatatacacaaacaaagccgatgacatacggtttcaatttcccgttgcaaattgaaaatggcgtcgatccttcaagacttgtacagaattacgctatcgatctacaagaaggtgataccatcataacagcgtcagatggtctgttcgacaacgtctacgaccatgaggtggcagacattgtctcaaaatctctagaagccgaccgcaagcctacggtccgaacctaatcacttttctttggttgaaaaaagaaaaacctaata

SEQ ID NO: 44596 - DNA, 244 bp, Triticum aestivum
  Clone ID: PAT_TA_44596
cgtccgctaatctcgtcgcctcgccgtcccccaggcgcccaaaaccctagacgcaacccggctccgccgtcgcccgccgcggcccgcggccatggatctcctccgcgcgaacctccacaaggtccgcatcccggagcccaccaaccgcatccacaaggacgagtgctggcgctgcttcgacacccgggagggcggagggcgggctgtacgtggacatgaactcggtcgtggggttcgggaggga

SEQ ID NO: 44597 - DNA, 535 bp, Triticum aestivum
  Clone ID: PAT_TA_44597
cgtccgcctctctctcctcttctctctctctcgccgcggcagccacagcgaggtggcccggcagagtgtgcgtagattcttagatttatacgcggggagcgctgagccgagcaagatgtcgcggttcgtcgacaagctgccgttcttcgaccggagggcgtcgccgatggaggaagccgacgatatcccgcgcagcggcctcctccacctgcacggcggccaccaccactaccagcaccaccaccaaccgcagaccgccttgatggcgccggagccgtccccgcccacgaccaagcagtcctcctccactctggcgcagctcctcaagcgcgtcaacgacgcgcgcagcgacgcctcgtcgcccaactcgtccccgtcccactacaccatcgagctcggagcctccatgccgggctccaccggcagtgagagcgagcacaccagcctcaccggtgtcggtgtcggtgtcggcgacggcacgctgctgcccgtcgtgctcaagttcaccgacctcacgtacagcgtcaagcagagg

SEQ ID NO: 44598 - DNA, 529 bp, Triticum aestivum
  Clone ID: PAT_TA_44598
cgtccgcggacgcgtgggcggacgcgtgggcagcagtgttccattccattctccgtcctcagatcagcgcagcggaggatcaaaccaatccatctaggtttggcgagcgccgagccgaggggaggggacggaggaggatggtgaaggccatggcggggtgcccggccaagatgggcttccggatgcccgccgagtgggagccgcacgagcagtgctggatgggctggccggagcgtccagacaactggcgggagcatgctgagccagctcgaaaaacatttgagagaactgcaattgccatttcaaagtttgagcctgtcacaatttgtgcaagtgccaaacagtatcctcgtgtccacgagctgatggaacaccaaccgaacatcagggtggtcgagatgagcatgaacgattcctggttccgtgatactggtcccacttttattacccgtgaagggcggatcagatataggactagcagagcaaacaatagccaggattgactgggaaattacgcatgggaggactc

SEQ ID NO: 44599 - DNA, 474 bp, Triticum aestivum
  Clone ID: PAT_TA_44599
cgtccgcagacgtgtccgcgcacgagtacgaagcagtggcgcgcgcgagcaccaaccagagaaggagagggcgccgccgcaggcaaaggagagggagcaaccaaaaccatggataagatctgcacccaggacatgaagaagacctactgtcaggtgatcctgaagttctactctaacatgaccgtgctattggacacctacatgatggagctagaggaggtctccatcatggaggccgagtgcatcacccatatggtgggcggcttcaacacccatctgatgcgccgcatctagctcgagctcgagcgcggggtgtgtctaaagctgcaggacgaggagcctgagaaccccatgctcttcttgcccgagaagtcggtgctcgaggtcaacaaggacctgctggacaaggtgaccatggatatgctggccttcctcgggatggcttgcctaaccagctttgagcgcgccccctaa

SEQ ID NO: 44600 - DNA, 520 bp, Triticum aestivum
  Clone ID: PAT_TA_44600
gtacgtaccagctgtgccgatcgaacaatgcaccgccagatggccgtcgcggcgtgggcgctgctgctgctgctgtcggaggcggcgtcgcggtgcgcggggcaggcgctggtgccgggcgtgatgatcttcggggactcggtggtggacgccggcaacaacaaccggctggccacgctggtgcgcgccgacttcccgccctacggccgcgacttcccggccacccacgcgcccaccggccgcttctgcaacggcaagctcgccaccgactacaccgtggagagcctggggctgagctcgtacccgccggcgtacctcagcgaggaggcgcagagcgacaacaggaccctcctccacggcgccaacttcgcctccggcgccgccggctacctcgacgccaccgccgcgctctacggcgccatctcgctggggcggcagctggattacttcaaggagtaccagtccaaggtggcggcggtggccggcgagaagcgcgcggcggcgctcacgtccgggtcca

SEQ ID NO: 44601 - DNA, 321 bp, Triticum aestivum
  unsure (1)..(321): unsure at all n locations
  Clone ID: PAT_TA_44601
gggaatatgcttatttgtgtcaaagagtggtctatgaaaaagagcgaggaagcaatgcagtactttgggggagaaagagaatgccgagtatgaccacgaagatctcttgtggagtttctacaagggatgggaaatttttctgggaggcgcggcgtgttgaccgcgatgtatttaagtttttcgtgatccacttccttgatcccaggttggcgaacaaaaaaactaatctttggcgcctgcgctgcttttgggaggatattgggcaaggggcaaaattggctaaccagccaggcgcgcccttcatnggatattaattagggg

SEQ ID NO: 44602 - DNA, 597 bp, Triticum aestivum
  unsure (1)..(597): unsure at all n locations
  Clone ID: PAT_TA_44602
gcgtccgctcaaatcccatttatccaaaaccccagggcgagtcgaancttacaagccatggatgcgcgcgaccgcaaggggaagggggtagccccaatccagccgcgccgcgccgcaccctaccccagcggtggccgcggggaggcctcgtcgtcgtcgacgccgccgccgccaccgcagcagcagggggggcgcccgattccgcccgtgctgctggggcggatgccgccgaccccgccggtgggtcttttggacgaagcgcttcgcgtcgcgccccaaatgcggacgatggacgcgcagacgctgtacttgccaggcgtgccacgcgtccccgcctccgttcctctggcggcgccaccgccgcggatcccgccgccgcaccagcatacggccgcaccagcagcgaaccgccaagctctactctccgggccccgcccgccgatggcgccatcgccgcatacggcgaactccagcaccagcgaaccactgaacgccatgggatccgngcaacccccccgcgccccccgggctccatccccagcaccaacttcaacatgatggcgcgcagggacccgtcggcgtcgtcgaggcagcagc

SEQ ID NO: 44603 - DNA, 402 bp, Triticum aestivum
  Clone ID: PAT_TA_44603
cgtccgcgaacacacccccgcctcccacgcctcgccgacccgctcctcctccccgccgggacatcggccgcgcctccgccgccttcgccacctccgcccgcagcattcggccgtcggtcccgagaggttttgctgtttcagaacttttgaactagaaagatggtactctcctcaacaattgcccctcagagtaaggtcacagaactgacggatgataccaagtatgattccttgaatctggagcagaagaaaaaagcgtggcctatggaaaggcacagatctgctgaagtgagccaagcaattcttatctaagatagggcatggtggttttcaactttggcatcagccccaaatccctgtgatcttaaaggtggttgtgcaccaatttctttatgtttcctt

SEQ ID NO: 44604 - DNA, 233 bp, Triticum aestivum
  Clone ID: PAT_TA_44604
cgtcactcccacgcgttcgtgatacttgtgccaaagggagtttgcgttgaaatatttaccagaggacggcatgttttcaactggtctgcacggtgtttgaagttgtgcctacgatcctcactgattttggcatggtgaaaaaccctttgtccaatgtcgatgctcactagtggagtgctgctcaaccacttcggattaactgaagcacggtattacactgtcttgttcggtgt

SEQ ID NO: 44605 - DNA, 361 bp, Triticum aestivum
  Clone ID: PAT_TA_44605
cgtccggtcggtcgcgcgcatctccgtctacaaggcgtgctggatttgggtgcgccagctccgacccccttgccgcgttcgacgaggccatcgcagacggcgtcgacgtcatctctgcttcgctcggcaccatgaaggcacgcaagttctacaaggataccacggccgtgggcgcgttccacgctgttagcaagggcatcgtcgtctccgcctccggtgggaactccggccccggcgaatccaccgtcgttaacgtcgcgccgtggttcttgaccgttggcgcgtccaccatcaaccgctaattttcggccgacgtttgttttggtaacggtgagacctttacgtgcaccttagttgtacg

SEQ ID NO: 44606 - DNA, 409 bp, Triticum aestivum
  Clone ID: PAT_TA_44606
cttccgtccacgcgtccgcatccctgggttggttgcacacttctctcccacccccaccaggggacggccatctttccctcccctgtttctcgccttatctccattgccgtctgctgcgcgcttcagcctagccaaggaacgaggaggagcgggttgttgtcatggcggcgccttcggcggctgtgatggaggagcttcggggcagtttcagggaggggcggacgcggcctgccgagtggcggacagggcaactcatggcgctcgtcaggatgatcgtggtgaaggaggtcctcatttatcaacgcgctccacgccgacctcgccaaggccgttcatggaggccctaccttcaccagattattggttgcgagtggggcctgtgtggttccccctcaaggggttctataat

SEQ ID NO: 44607 - DNA, 279 bp, Triticum aestivum
  Clone ID: PAT_TA_44607
cgtccgcgcctccgttgaccatgctcgtccctgcctcgatccagtgggatcggcaggggcacgaccgatccagtacccgagtgggccggcctgccagcgccctcccggcctcccctctccaccagctgggccaaggcccgatgtaagaagcctctctagatcccctcttcctgttgggccaacaggattcggcccatgtagtgttttttttcctcggggcgaattttctatttatccagtgtttggcagttatatagaaaagtccctccagatcaaaaa

SEQ ID NO: 44608 - DNA, 186 bp, Triticum aestivum
  Clone ID: PAT_TA_44608
gacccacgcgtcctcttcgcgttgggccaaatgtttgacttagctgtgacatacaaacaaacgagtgctgaggggggtggatgtttgtggcacgaaaaaccttttaatgtaacatacttgtagggtcactttttcgtggcgaagtgtgtggaatgcccccacattcaattgggcgtgcatttttaa

SEQ ID NO: 44609 - DNA, 259 bp, Triticum aestivum
  Clone ID: PAT_TA_44609
cgtcctcccacgcgtccgcccacgcgtccggccaatttatccagccagcgagcgcaatccctagcgtcgacgcccattcccccgcccgcccgtccttccccgcccattcctgccacgatccctcggccgcggtcgggtcgccatgggaatggggccgctcgagaacgccgtggccgtcgatggcgcgccggtggtgaccgcggcggccgcggcagcggaaggggggtcgtatgctctgctgcattgcgtggagggcttt

SEQ ID NO: 44610 - DNA, 445 bp, Triticum aestivum
  Clone ID: PAT_TA_44610
tcgacccacgcgtccggcgccaccggctccagaggtggccgcgacgatcgaagctgataccgacggccgcggcaatggcacccgcggcgccggcagcgggaacgccgcgaggaaggtgctgagcaccatcgactgccagatctgcgagtcgacgtgccgggtcaagtgcctcatcaacaacctcttccagtggggcacttgctaccagcgctgcaaggccgacaactgcaacgactggtgtaggtagccctccgtcgaactaacgagccggccgatgcatgtcacaagcatggagccgtgaatggatcccaagtacagccgggggctacattactatagatgtccttgagtctctcttgataaaagaaaaaaagatgttcttgtgtcctgccactgctaaaattttggcttcaccgcctatatataaagattgacgctgctactt

SEQ ID NO: 44611 - DNA, 352 bp, Triticum aestivum
  Clone ID: PAT_TA_44611
gccactcgtcctttaagcaagcaaggaaggaaggtacgctcggatggcttttggagcggctgtgcgggagggggcgggggacggcgtcgtgaccttcctctgagtgctctgtgtctccacgctcggcgcctccacggccgccggcaccacctaccttagcctgcacgaggggatccactacgccctcctcgtcaccgctccatcctcgcccttcttctgttcgccttcaaccttctgtgcgacgccctctgcggcgccagctttaaccccaccggcgtctcctgcttctactgcggcggccttaccagccccttcgctcttgttcatcgcgctccgcctaccagcgcaagcc

SEQ ID NO: 44612 - DNA, 248 bp, Triticum aestivum
  Clone ID: PAT_TA_44612
ctcgtctttctcccactcgttctaatttatcaatcccttctcttaaattattaacatcgattttcacaaaggcagggtcaattacataatttatgccatcaatggctaaatgaaccttcaacaatattggttgcttcaacctccttcctcttcccaggtatagctaactcaaatatctttcactgcatttcacctacgcacgagtcgctatacactagtgcaataattatctatgctcatgatacatt

SEQ ID NO: 44613 - DNA, 320 bp, Triticum aestivum
  Clone ID: PAT_TA_44613
cacgcgtccggaacttcaatagtgcatggtcaggcttgacccagaattgttaaatctgggggcataactcctgggagcaaagcatgaaaatggatgtctatcttagtcagaatcccttcacaagagcatataatccccgaagaatcagttgttgtctttgtatactcaaattgcgggtcggttcggtgaattgcatgacacttccattagaatggctgctaacggtgtgattaataatggtggttactgggaagattctaggactttcttctacaagagattacggaggaggatttccctatgatatttttgcttaggaa

SEQ ID NO: 44614 - DNA, 229 bp, Triticum aestivum
  Clone ID: PAT_TA_44614
cgtcctgttataatgtcttttagtgataatgcagcttttatacttgtattctgcagggaaagttggcaagggtgacagcgaaagcatttggtacagctgtatctattatgattggattccagaaagatcttgaatggtttgatctggtggagatcctgctaccattggacataaccattctaatcataaaactttgcaaggacatattttaacatcataatgttgttct

SEQ ID NO: 44615 - DNA, 423 bp, Triticum aestivum
  Clone ID: PAT_TA_44615
cgtccgctgcaaactgcctcgttctctccgcgctccggtctccccagtccacgccgcacaggctgggagagctcgaattccctcccgcctcccctcgcctcgtcccggagaaggctagctgcccggcgatccgagcgcggcgcccatggcgttcgacaagatccaggtcgccaaccccatcgtcgagatggatggtgatgagatgacacgaattatatgggaatggatcaaagataagcttatatttcctttcctggacttggatataaaatactttgacttaggtctacctaaccgtgatgctactggggataaagtaacgatagaaagtgcagaagctaccctaaagtataacgtggccatcaaatgcgcaactgtcaccccagatgaaggacgcgtaaaagagtttaatttaaaagctat

SEQ ID NO: 44616 - DNA, 218 bp, Triticum aestivum
  Clone ID: PAT_TA_44616
ttttataaaacacatatggcaaatttattagggggattaccagttggtgctgtttgttcttgagttaacccttttactgcgtaaagaaaattcctgttaccataaagggtaacggcagacaaaacaaatatcagatgttgttcaacattgaaccaatatatgataaatttatcgtcggtaaactttcactgccatttttatgatctctatttctgttt

SEQ ID NO: 44617 - DNA, 383 bp, Triticum aestivum
  Clone ID: PAT_TA_44617
cgtccgcgggactactaggctgtcacatcccttccatctaccacaaccaacggcgtctgcgataatggccggcttgccgcagctgcttctgatcctcttccccgcggaggttgccgtcctgaccctgctgctggcctcggcggcgggagcgcgggctcacgcctcctcgtcctcgtcatcggcgacgtaccgctgcggctggtgcccgcgcaggtccaccgcgtccatcctccctcccggcgccggcgcactgaccggtgccgcctgcgggtatggtggccaggcggcggatatggccgtcgacggggggttccacattgcggccgtcagcgccagtttctttcgcgggggccggccctgtctcgccctgctaccagctgatg

SEQ ID NO: 44618 - DNA, 205 bp, Triticum aestivum
  Clone ID: PAT_TA_44618
cgtccgcgaagacgccagagcagaaaaagaaaaatcgcctggttcttgagcgggtccatggtttcggggagggggtcttgatccgaggagcgggaggcggtgtttctttcttggataggagaggaggcggttcttggacaggaggggatagggttgtgggatggccggtcatgtttgttttggcctcttctatgtgcggggggga

SEQ ID NO: 44619 - DNA, 408 bp, Triticum aestivum
  Clone ID: PAT_TA_44619
cgtccgcaatcctcgatctgtactcaacctcccctccgtccgtctcagttccagatttccttcccgatgggtccgatcaagatcggcatcaatggtttctaccggatcggcaggcttgtggccagggttgcgctccagagccccgatgtcgagctcgtcgccgtcaactacccctttatcaccaccgactacatgacctacatgttcaagtatgacactgtccatggacagtggaagcaccatgaagctaaggtgaaggactccaagacccttctcttctgtcagaaagaggtagctgtgtttggctgcaggaaccctgaggagatcccatgggctgctgctggtgctgaatacgttgttgagtccaccggtgttttcactgacaaggacaaggctgcagcttacatt

SEQ ID NO: 44620 - DNA, 166 bp, Triticum aestivum
  Clone ID: PAT_TA_44620
gaatcccagtcccgacctacacgcacgcctacgctcactcgtacgtgtaccgaaagggagttttttgcctgctcgtacgctagtataggggccgtgtcttgctacttggtggactaccatcaacaacgtgatattgcgggtccgtcattctataaagagtacactc

SEQ ID NO: 44621 - DNA, 411 bp, Triticum aestivum
  Clone ID: PAT_TA_44621
cgtccgaatattcccttccccttccgtatgttttccactcatccgatccaaatccagccccctccgggcgaagctaagtcaagggctttttcctcctcctcctaaagatgcacttctctgtgaagaccctcaccgccaggaccatcaccctcgtggttgagtgctccgacaccatcaacaacgtgtaggctattatccaggacatggagggcatccctccggatcagcaccggctcatcttcgctggcaagcagctcgaggatggccgcaccctggctgactacaacatccagaaggaatccacacttcacctggtgctcagactccgtggtggcatgcatatcttcgttaagaccctgaccggcaagaccatcaccctggaggttgagtcctctgacaccatcgacaacg

SEQ ID NO: 44622 - DNA, 430 bp, Triticum aestivum
  Clone ID: PAT_TA_44622
cgtccgttcgactctctgtctctctctccgcctccgccgagggcttccgagaatccaccagcggagcagcgagacagggacccctccgccgcctccaccgcctccaccgccgtctcatccgtcctccggtccccgtaccggagatccggcggttctcgtgctcaggaggtatttggctttgcacgaacaagatctcacatggaaccatcctcgcagcctgagcctgtggtgggtgtggccactgctgggtcacaagcatatcctcctcctgctgcctatccaggtccagccatgcctgccgccattcctcctggctcgcagcctgcagtgccattccctgctaatccagctcaactcagtgctcagcaccaactggtttaccaacaggcccagcaatttcaccaacaactgcagcatcagcagcagcagc

SEQ ID NO: 44623 - DNA, 367 bp, Triticum aestivum
  Clone ID: PAT_TA_44623
cgtccgtgttgctcaataaactacaagagttgtccatggccaagctgcgtcctgacttctgcagtagtcacctaccaagccatgcactgagctctgtcagattggctctgggatcaaatcttgcccgtgccattcttgaagaagcttgaactctggttgtatctggtggagtgtcagctccagtttggtggcgttgctccgcagttacattgtcaggctccatattttgttgctgagaaagttcagcggctctgctatagatgtatcacatattgtttttagctttggtgatctcatctgtctgttttttttatacgaatcggtgcttgtaactgtattcttgggtaaaaaaaccagcatgttgttg

SEQ ID NO: 44624 - DNA, 293 bp, Triticum aestivum
  Clone ID: PAT_TA_44624
ggcgatcgttcctatttgtcagttttggggttccttcactgcatgttcttccgcgtggggtggagctgttgcgagggggaggagccctgcgacgacctcttactcctgctgtcgtgaccaccaccactgtgtctacaagaaaggttctaccatcccctttgtagctttataaagaaacaatggcgtttggattggtcaacccatgccttcatgaactaccatactcttcactgtattggttgtacatgtgatattttgtaggtgcttgtcatttgattatgatgtgtcattgt

SEQ ID NO: 44625 - DNA, 189 bp, Triticum aestivum
  Clone ID: PAT_TA_44625
tcttccgttttcccaaactaatggcacccacatccgtcgtctccgccccgcgcccgctccgcgcgacgccgcgccggcatccttgcacgccctgtcgccgtcaccacgccgagctgtcccacgccctccgcaggccgtgcctctccgtcttggcctccgccgcctacgaagccatcagcgcctcgtcgc

SEQ ID NO: 44626 - DNA, 394 bp, Triticum aestivum
  Clone ID: PAT_TA_44626
ctgttcgcccactcgtgtcggctcggataggtctcctggtgtgtgcaatgacggcgagtgccgaataaggtggcggtggatcaattggctggcaggcggacgaagccccatgatgtgcgtcggcggtgatacgcgtccaagtacatagatgccttgtcgggctgcgcgggtacatgtaccacgtggccagggaccagcacgggtggcggtttttccagcagcggctcgacgacggcaagcgcgaggtctattttatcttcaccggcgttgcccgtcacgccgtggacctcatggtgaacccggtcgggaactacctcatgcataagctggtaggcgccttgagggagggagcatatggaagggcatcgtgctcacccttaacaaaggacccctt

SEQ ID NO: 44627 - DNA, 204 bp, Triticum aestivum
  Clone ID: PAT_TA_44627
attcgagccacgcgtacgcgtccgcgagccctcttatgtatagttcaattttatctatataatagatgctgcctccatggggggggcttcatatgaaggggggttgctacaataaaactgtgaacaattgctattaggatgtgaattgatgttaatcctatgcttaactgtaaaaagattcttaccagatactttcccctgaga

SEQ ID NO: 44628 - DNA, 179 bp, Triticum aestivum
  unsure (1)..(179): unsure at all n locations
  Clone ID: PAT_TA_44628
ggctcctttcctnaattcccnactcgacgccatcgtcctcgtactcgtgtgcatgacgcgttgggcctctcacaaccgtcatcgcgatatgggttacgcgggcatgggcgtcatggaggaggagggggagcatgagcacatctttcggagcaggttcccgtctgtggccgtgccagatg

SEQ ID NO: 44629 - DNA, 344 bp, Triticum aestivum
  Clone ID: PAT_TA_44629
cgtccgcccacgcgtccgtgtagccctactccggactgtgatcctaataatgctatcatagtcgaggcatacagaaggagcaggataaagttaccaactccgtgcatgacaccactgttgaaccaacaacaaagaggcccaaggaactgggagaacatgtgttccgaccagtatatgcgtcgctgcatgaggaggcacaaagactcatgctgtggggccaaggatcgcatgttttctacggagtcgatgatgtcctatggtttcttcaaaataacggaagccacatccgtcagctattacaacgaagcttactggacattgcaacaatggtgttagcatgtgtc

SEQ ID NO: 44630 - DNA, 319 bp, Triticum aestivum
  Clone ID: PAT_TA_44630
tgtgtttggtatccatgttgaagctggaaagttagatctccgttattacatcaagggcaacaaatgtgagagttctacccaaaggcagctggagaagacgatcccaatcccaatatgtccaggctgcccggcctgatatcaaagctgcaaccgggaggtacttgctcctaggaaagattggacccatgcggttcgtagactcatctccacaccaagatttggaatatatgtaacttgatgacaagacatttggagttgcgagggttttgaccaaatattccgagattgccttttccaagacgtggatatataccaactt

SEQ ID NO: 44631 - DNA, 191 bp, Triticum aestivum
  Clone ID: PAT_TA_44631
ggtaccggtctcgagatcccgcggcacgcgtcacgctatttgtagaggtcccgtcgttccattacagcacttcattcttccgccccaaaatctcttgggcgggcgcgtgatttctggcccgcgttgttctatgccatcggatctagggtttcctcgctgatgctctctctgggtagcgacgcgcgccacct

SEQ ID NO: 44632 - DNA, 262 bp, Triticum aestivum
  unsure (1)..(262): unsure at all n locations
  Clone ID: PAT_TA_44632
cttttcggactcngtagcgccttctctattttaatttatcaagccgctgttgctgtgccactcgcggaccatccgccaccatgcataacgaggtgttagacatggtggacctctacatccccaggaagtgctcggccaccaacaggatcatcacggtcatggaccactcctttgtccagatcaacattggtcactgttgatgagaatggcctctatgatggccgtttcaccacctttgctctttttgggtttgttcgagctt

SEQ ID NO: 44633 - DNA, 116 bp, Triticum aestivum
  Clone ID: PAT_TA_44633
cttccgccctatcgtcgttggcgcctcaacccacgccgtcctcgcttcctacccacgcgcaacgcgcgatggatgcgatgaatgaggtgcggaacctggacctggagcggtacatg

SEQ ID NO: 44634 - DNA, 190 bp, Triticum aestivum
  Clone ID: PAT_TA_44634
cgtccgcgcacgttggccgcattcccaagcccgggatttgtagggagaggagggatttgtcgagagagggaggggcgcagatcgttgatctttctacatcctactactgctcgcctccagtgtgggggtgcgctgcggtttccggaggggaggccaggggatcgagtggctaaccgaggaaggaattggc

SEQ ID NO: 44635 - DNA, 263 bp, Triticum aestivum
  Clone ID: PAT_TA_44635
gcggtgccgttccatattcccgttctgcccagcttcctctccaccctccccctgtctttgtggttccagcttggttttctcgccccctccctcccgacccaccgtcggccccgtccgacattgtttagcaaggaggaaaggccaagcctgttcatgcaggccaaggtcgccgagaaggactacgacgagaattgacctgcctaccttcataagaagaagggtgatcaaaaggccctactggagctgtaggccatgtcaggcca

SEQ ID NO: 44636 - DNA, 269 bp, Triticum aestivum
  Clone ID: PAT_TA_44636
cgtccggtgtatttgccctctgttgattgctttgcgacttcttgctgaattttccgtgtcgtagggaggaggaacaaacctagtctgggagacaggtagggagagaggtcactcttagttcatctgcctgttagctcagactcctgatggctgccatggaggttggtgttaagtgagctcgcactttatcattttccgttgtatcgctatgttagtcattctctttgctttgtctgttctcagctttataataaggtcactttgctaaa

SEQ ID NO: 44637 - DNA, 235 bp, Triticum aestivum
  Clone ID: PAT_TA_44637
tcttccgtccgtcgtcttcgccgccgccgactgtatccatgtcgctcatcgcgggtgaggagttccagcacatcctgcgtgtgctcaacaccaacgttgatggttagcagaagatcatgttcgcgctgacctccatcaagggtgtggtccgtcgcttcttcaacatcgtctgtaagatggtccgctttcgacttgaacatgagggccggtgagcttttcgcggttgagatggtcc

SEQ ID NO: 44638 - DNA, 299 bp, Triticum aestivum
  Clone ID: PAT_TA_44638
cgttcgcggacgcgtgggcggacgcgtgggcggacgcgtgggtttttttttttttttttgtatcaaaaaaggctttcgctccgttttatatataaagttccaaccaaccacattctgtttcaaacacacgccatcttattttacgcacacacctaaggttagtatacatagtctcttgactcagaaataccatacccagctacttctagagctgtcgtgatccatcaaccgtgaacatgccaccttcgaagagttgtttctgctgacgttgaacctttagctttcaagggtgttccttt

SEQ ID NO: 44639 - DNA, 415 bp, Triticum aestivum
  Clone ID: PAT_TA_44639
cgtccgcggacgcgtggggcgtctccaccctctcgtcttcctccctccctccctcccgcctgttctccccttcccctcctactccacagcccgtgccccaccctcgagctcgcctcgcctccctcccccttccctcctacggtctggagatgctcgcgagtcccaccaagctccaccatctcctcctcccggcgccgccgcatctcgccttcgctctcccgcacgccgcgccgccgctccacgcgtggcttcccctctcccgcgtggcgccgccgcgcgtcgcggcactcacgcatggctactcgtgccgaatgcgacggaggggtacgagggctaaagttgtggctgccggaggagacgaggcgaacagctccggcccgaccatattcttcgtgaaaattcccgtccgcgaccg

SEQ ID NO: 44640 - DNA, 420 bp, Triticum aestivum
  Clone ID: PAT_TA_44640
cgtccgaccaaccccatccctaatcaactcacccaaccacgaccagaactcaaatccaatacggagaaggaaatcgaatcgaagctctcttttccctcctcctactcgttcgccgccgcaggagacctcggccgagaagcctccgacggatctcgcgcgtcttttagacgggaatttgaatattttggttcgagatgttgacgtacggtcgctgatttcgcggctctccgtggttgattagcagcttgagtccctgtcttggaggggagcatcgggatgtcttcgattgcgccgtcgtcttcgtccatcgccgtgcttcgccgccaaccagtgcagttcttgggaggcagtgatgtttccaagcaggcaaagggatcaagttcttattcttttcccacaaattcgagaaatgccaacatg

SEQ ID NO: 44641 - DNA, 156 bp, Triticum aestivum
  Clone ID: PAT_TA_44641
tcgttctgtgcattctacaccatgtaaaccgcttttaatacgtatcctatgtattgcgctgcatgaagctgatcatggtcgacggttactgcgccatcaaatctatggtcatctgacgactgcgttaaggccacctacagttttgttggttttgat

SEQ ID NO: 44642 - DNA, 302 bp, Triticum aestivum
  Clone ID: PAT_TA_44642
cgtccgtcggtcgcgtggatccgtttagtcactagtggtctagcaaatccacagcgccagtgccacgcggacactgagagacggagcgtttggctcgtcactttcctacagatacagaagctgagggagagagacgccatttatgctgtaacacatgggcgggcccaagaaagaaggggggaagtctgagcatggaggtgctggccggaggaggccgcggttgacttatgcatgcgctacttcttgttggtgccgcccttgttgcatttgacgggcgacgcggatgcgtggtctcaccacgg

SEQ ID NO: 44643 - DNA, 148 bp, Triticum aestivum
  Clone ID: PAT_TA_44643
tcgttctatgacgcgtggtgtttaataactttattagttttgttcaaaacaccaactggggccggtgttgaattgggctggtcatgattctggagatatttgaggtggtatcaatgtagtttgaattatgaaagcgtatgtttgaatt

SEQ ID NO: 44644 - DNA, 230 bp, Triticum aestivum
  Clone ID: PAT_TA_44644
tctatcatggacgcctggtttccgaccccactgccggttttttctgcagactagggttaactcccggcgacgcggcgccccacccggcgccatggccagccgcagcggaggaggaaggtcttcccgccctgctccacgtgctgctccagagagaaacccagcagtgccagaccgggcagcttatccaccggctaccacccagagcagaggtggggggatcatgagcggga

SEQ ID NO: 44645 - DNA, 397 bp, Triticum aestivum
  Clone ID: PAT_TA_44645
cgtccgcggacgcgtgggcggacgcgtgggcggacgcgtggggcagaagtttgcttctgatgtacgcgagggtaaagtaccagagaacagattgtcttttggcgcgccttggagacatccacctcgggctgacaatcctgacatgtgctacaagtgggcaaagattcaactgatggattttgtccagtcttatgtaaacacagaatttgggttgaattacctagcagatgatagcctggaaatattggatgatcctgcagcagtcgccatgatggaggttggcttactttatcaacagagagatccatcctttgtgcgaccaatcacacgtgggattcagcgttgtcttgctagatggcttgttcagcagagactagagttgaccccttaagaataa

SEQ ID NO: 44646 - DNA, 379 bp, Triticum aestivum
  Clone ID: PAT_TA_44646
cgtccgcccacgcgttcgcgtgaatcctccgtttcaatagctcatcttccctcgccccgggcctggtgtagcgcaccgatccaggagcttccgctgccggctgcgccatggattccgagaccgagaccttcgccttccaagccgtgatcatccagctgctcttgctcatcatcaacaacttgtacttcaacaaggggatctttctttgcgagctcatctctcacgcctccgatgcgttgtattaaaacaggtttgagagcctgactgacaaagagcaagccggatgcttagactgagctggtcatctctttgatccctgacatggtcacgaacacactcactcttattgactgtggtattggtatgaccatgtcagacc

SEQ ID NO: 44647 - DNA, 415 bp, Triticum aestivum
  Clone ID: PAT_TA_44647
cgtccgcccacgcgtccggcggcggcggcggtggccacagatccacccatccttaaaaaacaatcggcaccccggtcagtccactcccccgcgccgagcgagcgagatcgagaggaggcgccatggcgaagcagaagcagcagcagcccaagcccggccctgccgcgggcgacgccgcgccgacgccccgggagttcaagacggctcactcgccgtggttcacctacgcctccatggccacgctcttgtccctctgcccgccattcgtcatcctcctgtggtacacgggggcgcacgcggacggatcggtggcgcgcacctacgagcacctacgcgaccgcgggatcctggaagggctcaaggccgtctggcccaagcccaccctcgtcggcgggaagatcatactcggcttcgc

SEQ ID NO: 44648 - DNA, 352 bp, Triticum aestivum
  Clone ID: PAT_TA_44648
cgtccgcagaaactggggcatagactgatataccgtgttactgcatgaccacaatagttgtaacaggatgatgtggcgctgtcgtggtgcgcgccatcatggccctggccttgctgattgcgacactggccgcctgcgctgtaaccagcccagggaaaaagtcctgtgtcagcggcagggtctgcgccatcgtgagcatatgcatcacgtcgatgccggaggcagtgccggatgaacacgagactgtaaggatccctctgtcaccgagaagctgaccatgctatgcaagacgacgaccgtgatgacgaggtacgtggtgatgttggacgagatcttctacagctaccctgga

SEQ ID NO: 44649 - DNA, 319 bp, Triticum aestivum
  Clone ID: PAT_TA_44649
tcagagaggggagagccatggcgattttggctggttagctttgtcgttgatctctgaagagcgagccgggggttaggcgttcggtcctccttccccctaccactgttgattctactaaaagcgcgttgaggcataggagaagttgactcatgatgattcatcggaggcgtcatatcatgcttgccttgatttggtgatgctcctccttttgttgaggtgttctacaagccttgtgcatcccttcattgcacaacgaggttgcaagtgtcttgctattgactgtacaaagaaagcatgtaatgatgcctctgtttggtaa

SEQ ID NO: 44650 - DNA, 292 bp, Triticum aestivum
  Clone ID: PAT_TA_44650
tctacctctctcgtcctttctttgtttgctctctctgttgccgcgcccatccttttccgtgcgggagcctcgaccgtgctcgccgcctccctcccgatccacctggtcaccactgctccggtggcatggcggatcagctcacctgactaccagatcgccgtgttcatggaggccttcagcctctatgacaaggacggcaatggttgtatcacctccaatgatctgtgaacagcttttcatttgcttgggcttgaacccaacggaggctgatctttaggactattatcaatga

SEQ ID NO: 44651 - DNA, 326 bp, Triticum aestivum
  Clone ID: PAT_TA_44651
cgttcgtttacgcgtgggcggacgcgtgggtccgcacccttttccgtcgccgtcgtttcgaacctcccccaaatcagcagcagtcgaccggaggcgccgccatggcccgtaccaagcagaccgcccgcaagtccaccggcggcatggcgccccgtaagcagctcgtcaccaaggcggcgaggaagtcggcgccgaccaccggcggagtgaataagccccaccgttacaggccgtggaccgttgctctccgggagatccgcaagtaccagaagagcacggagctgctgatccagatgctgcctttccagctcctggtccgtgagatc

SEQ ID NO: 44652 - DNA, 310 bp, Triticum aestivum
  Clone ID: PAT_TA_44652
cgtccgggctgccgaagctacccaaggtacctggggagaagaccaagaagagaaggggaagggagcatggcggccttcccgtgctcgtgatcgagcgcgacgccggcatcagggagctgcagctgacgcggtgggagagcagcggcgtctgcgtcatcaagggagaggggtacatggacttcatcaacaactgcggcttcagtgtgggtgacgtggaggagatctgggctttcaagcagaaagccttgccttttggtcggcgtggatatctaccaggaggggtaccaggagaggccctctctacattctt

SEQ ID NO: 44653 - DNA, 216 bp, Triticum aestivum
  Clone ID: PAT_TA_44653
tcgttcgtggtcgcgtgggcggacgcgtggttccgcactctcttccgtcgtcgttgattcgaacctcccgcaaatcagcagcagtcgaccggaggcgccgtcatggcccgtaccaagcagaccgcccgcatgttcaccggcggcatggcgccccgtaagcagcttgccacctaggcggtgtggaagtcggcgccgaccaccggcggttgtgaagaa

SEQ ID NO: 44654 - DNA, 241 bp, Triticum aestivum
  Clone ID: PAT_TA_44654
cgttcgcgcgagctttcaccagaacggatctataggcactctgttctaactggccatggattgggcgcacggcgcattgctgctgcagctgctggccgccggcctgaatgtcgtcgaactcgttgtgaccgttacagtcacacatacagacaacccgtggtgccgtccgaaccttccgtggcggggcgccgtcgcggcgtacctgagcgataatgaacatatggagttactgctaaacccc

SEQ ID NO: 44655 - DNA, 317 bp, Triticum aestivum
  Clone ID: PAT_TA_44655
cgtccgcttggtttgttttggacagagactgattggtctcaaatggtttcgatccatggatggaaaccaaatcgtctgaccactcctgcatcttgtcgttacataagatcacgttcactagattgtcaatgaacccatccacaaaggagttgcattgtgtgccagcatttggcttattgtgccatgtgctgtaaacccatggcctctccccggagctgcttctgcaggctgacgctggctctgttcgagtaataccatagcatggagagacacgttggtggttggtgttatagcaataccttgtcacgccttggcta

SEQ ID NO: 44656 - DNA, 298 bp, Triticum aestivum
  Clone ID: PAT_TA_44656
tcgtccttccacgcgttcggttcgttgtccgccttttacttcatcccactgctccgccccggaagtggaggccttccgttggcccttctcacccccgtcccgccccatccagccaacggagtgctacgagcgcccggcccgcggcggcactccctcgaccgcccggtcgtcgtccgtgcacgggatccgttacgatccgtgcgctcaacagaactaggattttttgtgggcctttatgaattttgtggactgtctattctaggggggcagttgggttcttctactggtagggatctgg

SEQ ID NO: 44657 - DNA, 212 bp, Triticum aestivum
  Clone ID: PAT_TA_44657
cgtccgttgtatatattgtgaataatgaggtatgtctctgaggatgaggcatccctcgtgattggacagggcgcgaggaaccccaggagagtgcgcgtgctattcctgaggcgcggtgagtcgatttcggagccgttacagtattgtctttagatgttagtccgtttgtagatctttatcgacgagaatttggtggtatccgtccaagaaat

SEQ ID NO: 44658 - DNA, 378 bp, Triticum aestivum
  Clone ID: PAT_TA_44658
cgtccgcggacgcgtgggggagaatcagggtcaccatgatcatgactcatactatggggaacgtgatactgaaagtttagtcgcggcaatggaaacatatgttgcaaatattccaaaagaggcccatgttcttgctttggaagacaagtccaacaggactgttgatcctgcaaagcgacctgctccaatgaccggcggctggagaatagaaggttttgcgcgggctaaaaaggttcctggcagtgttgtaatatcggctcgatctggctcacactcatttgatccatctgagataaatgtttcccactacgtcacaacgtttttcatttggcaaaaggctctcatcaaagatgtttaatgaaccggaaaaaacttttt

SEQ ID NO: 44659 - DNA, 302 bp, Triticum aestivum
  Clone ID: PAT_TA_44659
cttcctgagtcatattcacagcgcgacccctcgaggaaacccttccggcgccgcagcaggagcagccatgggtatcgacctcgtctacgtggggaggaacaagaggaccaagcgcgtctcgccctagtccgacgatgtctacctcaagctcctggtcaagctctaccgtttcctggtgaggaggaccaagagcaagttcaacgccgtcatcctcaagatgctattgatgagcaagactaaccgtccgccgctctacatgcgccgtctttacaacttcatgaagggaaaggaggagaagaaca

SEQ ID NO: 44660 - DNA, 330 bp, Triticum aestivum
  Clone ID: PAT_TA_44660
tttctacctcactctttcggaaagttctctatgataagatgccttcaaagaaattgaatttatctcaagatcgtactacgaagaatatgccttcaaagaatttgaatctatctcaagatcattcaacgcaaagtattgtcccaggtcctgacttgaaagttcgctctgtgcactttacacaacttccaacaaggcttgctgactgaagcttacggtaaaaatcacttccctggcatgaaaaactagcacaagctgaatactgaggggaggctggagtatattcagaattcttcacataacggattggaccttaggaaatagtgcaatctt

SEQ ID NO: 44661 - DNA, 307 bp, Triticum aestivum
  unsure (1)..(307): unsure at all n locations
  Clone ID: PAT_TA_44661
nctagccctcatactctctatttccgtcactccacccgtatcgtttaccatggcggtcggctaagaacaagcgcatcttcaaggggaggaatggtagcttatagaatgtcgtagatcctgtcaccaagaagcagtggtatgacatcaaggcgccggtgctgttcaccatccgcaacgtcagcaagacccttgtgtccaggacacagggtaccaatatcgcctgatagggtctgatacacatggttgtcgaagtatctctagctgatctttaaaacgatgaaggaccagtcctataggatgatcagac

SEQ ID NO: 44662 - DNA, 262 bp, Triticum aestivum
  unsure (1)..(262): unsure at all n locations
  Clone ID: PAT_TA_44662
tcnttcttgtacgcgtgggcgacgccgtttggggccagaccacaaggttatgatcggagggagcacgaggacagggtagggtgtgcacctgtgcacagtatcatagaccccccaggggagagctgctgttgttccggtagtcggttggcctccaatccgatcctttaggagaaacctcacatatggaacttcatttaagcaatcccctgagcgacaaaacgttgaagccaccaacagagcgaagccggtctttaagaagaaa

SEQ ID NO: 44663 - DNA, 368 bp, Triticum aestivum
  Clone ID: PAT_TA_44663
tcctccgtctgaatctcgtcctcctccttccagctaccaaatctgccgacgtgccgcccggcggaaggaacataatcgagccccgcggttgcgcgatgaacatcgacatcaccgtgttagtgaagccggagtacccggtggaggatctgaaccccgcctttaccaaggtcgtcggcaacattttcgcgcttgtctacatgcgcctctttaccattctacggcgttttcgacaccgtgagcttcctgtactggtcaagccggtgatccgtgtgccgtagatggtgacgtggggccttatctgctacctagatggtatcatgtacgcacttccagaacttcggtcggaacgccatgattggtgttctttt

SEQ ID NO: 44664 - DNA, 206 bp, Triticum aestivum
  Clone ID: PAT_TA_44664
cccttctcccactcttacgtccacacgttcgtccactcgtccgaaaatatttggagatgtcactgctataggagaaagggttgtcaacataggttgatctgttgggcactggtataagcatcctaatgtccaagaggaactccatcattggtgggctcacttacaggtctcggcttggggatatctgctcatttgatatcaggagg

SEQ ID NO: 44665 - DNA, 247 bp, Triticum aestivum
  unsure (1)..(247): unsure at all n locations
  Clone ID: PAT_TA_44665
taatttccnttttgcccactcnttctcccactcgtccgcccacgcgtccgcccacgcgttcgcgaacgcttgggcaatggcggaggagaccgataccgacaagcagctcttctttccgtcggatgtctagctccacgcatccacgaaggacttgttgtgtcgtcatccatgggaaggttgtctaatgtgaccaaattcctcgaggaccacccccggttgagaaggcatgttcctcccccatgcatct

SEQ ID NO: 44666 - DNA, 250 bp, Triticum aestivum
  Clone ID: PAT_TA_44666
cgtccgcggacgcgtgggtcgccgtagccagcctagcagactctctcgagctggagaggatacgatcctacggagcggagagtgaaccgtcgatccctcgagctttctgcagttgagcttccatggggaactgcttcggctccgaggaagccgaagtggaggccgtcaagcagtcaccatgccacgagcacggacatggacgcccccaagcgattgcaagccgcggttctactctcatggcagcgcccac

SEQ ID NO: 44667 - DNA, 241 bp, Triticum aestivum
  Clone ID: PAT_TA_44667
tgcatatggcttcttcgtacccaagcttcggcaccaattcttcgcactcttcccctgccgccgggatggacgtccagatgggcgagccgcaggcggtccctcctcccgccgccgcagcggcggcgccggccccatccaccattcaacatttgaaggagatcgccgcggtgatcgaggcggtgtcggtcaccaaggaggttcgtcggatctcccgtgccgttcggctcaccgttgtcctgcg

SEQ ID NO: 44668 - DNA, 318 bp, Triticum aestivum
  Clone ID: PAT_TA_44668
tcgtccgcccactcgtccggtccactccggggccgcggcggcatgtgcgatgctcaaaggtctcccagggccagatcgatgcccgtgtgcggcaccaccatactctacttcgtgatctcgccctgtgctccgccgccagcagctcccactaccttctccgtgcctttacaccaaggatccaatcagtccaagatccagcccaaatccaactgcctcgctaccaattgcgaggacccaagctcggattttggtgataggtggcggcggctcacaggtgccggtgcggcaggcccggggactctattttttaggcgggag

SEQ ID NO: 44669 - DNA, 230 bp, Triticum aestivum
  Clone ID: PAT_TA_44669
tcttcctctccgtagctctcgccccttagcctatttcgtcgtcgtcgccgtacgacttgttggagtttttcccacccctttcggcaacatgggtaagacacgtggtatgtgagctgggcgcaagctcaagacctaccgtaggaaccagaggtgtgctgacaaggcatacaagaagagccactcgagtatcgtgtggaagaaacccttctccgagtcatcttacgccattg

SEQ ID NO: 44670 - DNA, 198 bp, Triticum aestivum
  Clone ID: PAT_TA_44670
gttctcccacggccacaggaaataaatcattcttccatcagtttatacaaacacgattgggatttcgattaacataaacagaccctaccttttgtaatgggttcctaaaacagcagcttgaaagaaatgtcctttgcatttgcaggggagcgggtgaaggacacgtaccatttttttaacggcctcggggggttttga

SEQ ID NO: 44671 - DNA, 323 bp, Triticum aestivum
  unsure (1)..(323): unsure at all n locations
  Clone ID: PAT_TA_44671
cgtncgtggactcgtgggcggacgcgtgggttgatctccaaggtgctcatgatgacgatttgtgtgaggacaaggagaactgatttctgacgcatcagatgtgctcttggtatgtactacgtatttgcctattatgttttccatcttctttctccatgtctatagctcagcttgtcgtacactgatcaactatgctgtactagtggcaaggtatttacagatatttcttaagcataagtatctgattagaaaagtgaactccacacagttgttgtgtgaaacttggccaatttcttttttggcaaggggtagattaaatgcta

SEQ ID NO: 44672 - DNA, 286 bp, Triticum aestivum
  Clone ID: PAT_TA_44672
cgtccgcccacgcgtccgcggacgcgtgggttcacagtctagattcgtcagccgcctcccaggccgctcgccggcggccaggaccaccggagttcctgagtctcctttctctccgacggaggcacgcctcctcttcatcgccactgttgagggcatcggttgcaaccccgcggcggcggcgagcggttcccccgagtgcttggttagtgccgagcatcgcgggtgacgccactagagcgcggtgcggcggctcccgcacggtcagccttcccggagggccaagacc

SEQ ID NO: 44673 - DNA, 239 bp, Triticum aestivum
  Clone ID: PAT_TA_44673
tcttcctcggactccttttctcacgcgtggcgcgacgcaccaccacctacacctccacgaactgctcctgcggtgggggcaacggctaccggggtcatcatcctccctcttcccggatctcgtctctgcccatagatcgaaggaccttctttgttgtctgaaatttgtaccaagtgagcagctgtacttaataacatctaaacgtttgcagtgcatcaatctaactctgacctcacaat

SEQ ID NO: 44674 - DNA, 226 bp, Triticum aestivum
  Clone ID: PAT_TA_44674
cgtccgcccacgcgtccgcgactcttcgggagaaatctctagcttcaaatgttcgaagcgggcgatgacggcggctacgtcggtttcttctttgaggcatcgccttggagagtcaacattttgcggtttgcacggatctctttctcggcgggtacagtggacgccggtgcagtggctccgggtggcttctgtatgtgcgccgagatggcgatctcggaaacattgc

SEQ ID NO: 44675 - DNA, 232 bp, Triticum aestivum
  Clone ID: PAT_TA_44675
cttccgtccacgcgttcgcccacgcgtccgtggtggtcctagccctagcgccgccaccttgttttcgcctcccttccccctcgccgccggctgaggccaagcccggtgcgccgcctaggaaggtggcggcggtgccctggctgtcctgccttttctgcggggggccgaggtttctcggagcgggggtcctgtcggagagacggtaccggccctgcgacaggcggtggcaggg

SEQ ID NO: 44676 - DNA, 194 bp, Triticum aestivum
  Clone ID: PAT_TA_44676
tcgtccgttgcattgaggctgggcggggcggttcggtgctggaggatgcggtgggatggaggtcgagatgggatcggggagcaagggtcgtgcgggctgagctattattctttctcttttatcctccatgtaccggttcggggctgacttatgttgaggactgcgggttgaattctccaaaacggaggggcttt

SEQ ID NO: 44677 - DNA, 227 bp, Triticum aestivum
  Clone ID: PAT_TA_44677
cgttctctcacgcgttccgcccacgcgtctcgctccatagatccaaccaatcccgcaattgcgtgcgagggtgattctccgctcgacttgtaggacaagatcatggccgaaaatggagacgtgccgacgatcgtcatagacctcggcacgacctacttctgcgtcatgatctggcagcatgaccgggtggagatcatcccaatcgaccagggcaaccgcaccacgcc

SEQ ID NO: 44678 - DNA, 105 bp, Triticum aestivum
  Clone ID: PAT_TA_44678
tcgtccttggactcgtggtatgagtatcacgtctggacgctccggcttcgatgattgtttgggctttggacctacagaactggtttaaggatagatctggatcat

SEQ ID NO: 44679 - DNA, 134 bp, Triticum aestivum
  Clone ID: PAT_TA_44679
cgtccgcccactcgccctgtaagcagtaggtgtaggatgttagtagcgccagagggatgtgattccagatctttcctgaaggtggttggccagtatctttgccctactgccgggccacttattttgcttgttta

SEQ ID NO: 44680 - DNA, 198 bp, Triticum aestivum
  Clone ID: PAT_TA_44680
cgtcctctgacacgtggtctgaggtagatcgatacatctttaataagtttacatacacagtgcggtgggcgatcgagatgccggagttctgcgtgaccgtccgaacgcgtgttcatcgcgttgtacctgatccggtcgctgctggccgcctgacacacggagcgggccacggtgagggaccccagcgacgacgcctag

SEQ ID NO: 44681 - DNA, 113 bp, Triticum aestivum
  unsure (1)..(113): unsure at all n locations
  Clone ID: PAT_TA_44681
acnttactcctatctttctcccacgcgtttcttataaagtttatactcacctctacaccatcataaaggtcgctcgagattaatatttaaaggtacacattgtgaataatata

SEQ ID NO: 44682 - DNA, 243 bp, Triticum aestivum
  Clone ID: PAT_TA_44682
cgtccgcccactcgtccgtggacgcgtgattccgcgctccgcacattgtttgggaggagctgctctagttcggttggcgagggcgggtgcatcccactgccgcgccatggacggcgactgcggtcgccctgaagttcgactggcacgctgacgatgacgtgtgccaaatctgccccgacgggctgcacaccacggctaacggcaagttcttcaccgactgggactactgcacgtttccggtct

SEQ ID NO: 44683 - DNA, 402 bp, Triticum aestivum
  Clone ID: PAT_TA_44683
cgtccgttgacttctcataaacttttttcgtaccccttttcagccagatagttatattgtgaagcacttgacaatgaagctctctgtcaactattaaagcattgacaatttctatcctaaagctgaatgtttttgtgggcaattcgttcgtaaaagcaatggcaagtgagaactactaaatcattgagagtctccttgcctccctcacgggctacacacgctacaacctgcttggatgcaacatgctggtcttccaaggcctacgtcaagcacaccagtgtttccaggttgtacgaggccctgttaacacttataatttgagtgatgttgccacagcctggccttgctgatgcgacatgagtagttttttctagcaatcacgcacatctgaagacttactgg

SEQ ID NO: 44684 - DNA, 170 bp, Triticum aestivum
  Clone ID: PAT_TA_44684
tctttcaatgtccctttgtcggacccttcttcagcgtttctctttctgtttgcctagcccgcatggctgggcgaacccgccgacgctcagccccgccgtcggctagggcaaggttgagttcagctctgtcgggatcaaggcgaacgtcgccgtcttccaagatgtcaagg

SEQ ID NO: 44685 - DNA, 300 bp, Triticum aestivum
  Clone ID: PAT_TA_44685
cgtccgcccactcttgcgtgctggttttagtcagctcatgagggccctccggaggccacgaccgacgcgacggcagaagaagaagacgcccaaccactcgcctatccattcttgtcccttttcctatccgttggtcgacctgctggtactcgccctcgtcctcgccgtcgccgtcgtcctcctccacgccctcgtctgccccctcggatgtatgcaccaatgtatgcaccagtggaacaagtgctggtacaagctcacgtacaggctcagggacaagttttccgtaatgcttcacatatt

SEQ ID NO: 44686 - DNA, 336 bp, Triticum aestivum
  Clone ID: PAT_TA_44686
tctttcgattatcgcaagcgttatcagttacagtgtgaccaaagtttcagattcttccgctacatgcactaagtctaataacaggaggaacgggcgcgctaacagtccttgaagcatgcttctaaaacgatgcattctcctcatgaagaccaactgaatagatcgagagtacataattctatatttcaatggagaacaaaatgggagatatcttaaacatagagaattgacatagatagactttgccatgttcattgacgcaacaaagaactgatgataacgttaatgaatggtgataaaatattgtgagataaagatcattcaatatccagtgat

SEQ ID NO: 44687 - DNA, 298 bp, Triticum aestivum
  Clone ID: PAT_TA_44687
cgttctcacccacttggtggtgttggtgctcgacctgtagctcctcttctgacgcgcgcacctgaacctcgcccacaccctcctcgcgctcctcttccccaccgtgccgctcagtatcgccctcgaggcgctcatcctgctacagtcctttttcgagcccctgcttcccttcatcccctccgtctccgccgccgtcgccaccttatgaggtgcgagcggtgacccccagctcgtgtttggggcgtggctgtggcagcgcttctaggagtttgttgccgcgctctgttagcttaccgtg

SEQ ID NO: 44688 - DNA, 385 bp, Triticum aestivum
  Clone ID: PAT_TA_44688
cgtccgagaaggtgtcatacaagtgcagggcgacatcaccaatgctcgaacagcggaagtggttatcaggcactttgatggatgcaaagcggacttggttgtctgtgatggtgcccctgatgttactggacttcatgatatggacgagtttgttcagtcccagcttatattggcggcactgacaattgtgactcatgtacttaaagttggtggaaaatttgttgcgaagattttccggggtaaagatacaagtctcctgtattgccagttaaagctgttcttctcacaagatacatctgcatatgcctagccctccagtagcaaaatcgtcggaacatgaagcggaaatcatgtgcgaggatcctgtgtctcggatggaggaagt

SEQ ID NO: 44689 - DNA, 406 bp, Triticum aestivum
  Clone ID: PAT_TA_44689
cctctctcatcatctcctctcctctcctccaccgcatcctctcgatcgcatcttccggcgttccactggtcccatggagattgcccgccgggagcccttcagcatcatgtccggctccggccggaagcgcccgcgcccgctggagatccttcgcaagcggttccagtctgagctcgtcgcggttcgtcgcctcctcgccgaggcggacaccgtgctttctggcttgtgcccgtcggctccccgcgtgcgcgttcgtccagcctaggagccgctagccaagaagagggaggcgtccccttccgttcccatgaagaagatgacccccaaggagcggtaccagttctactcggaccctaccaagctagccaagctgtctgaattccatgtactccctggttatatcctg

SEQ ID NO: 44690 - DNA, 363 bp, Triticum aestivum
  Clone ID: PAT_TA_44690
cgtccgcttcccctcccattacttggtttactttcccccgcaccaccgccgcgactgggaccccccaggcgaacgccgaagcgaactcctccgccccgaccgcgtccgtgtagggctagggtttccgcctcctgtccgccctcggccatccccacgcggagcgcccgtgcacgccgcgggcccgcggatttctcccccacttttcagctcaaaatcgtcgattttccggtcggttcttgggcacgaatcgggcattgagttactccgggtatacgagggtttcgcctgatttctagggacacgaatggggctttccgaggcgattggtgccttagccgccacgggttcgggtgttgccgctga

SEQ ID NO: 44691 - DNA, 349 bp, Triticum aestivum
  Clone ID: PAT_TA_44691
cgtacggtgcggcgttcttcgttgcgcacaggccacatttcttctccctccttcacatgtccggggaaggcgctcgcttctatggtcgtcctccaaatattctcgcctgcacctcattcacttgatgtcctatgtttctccaagactgcagcatggtgctcggcggatgtggcaacggagctgttggtactcaagccgaccatttcatcggaggcagtatcacgggtcatatggcgtaacatggtagtgcgtcgcttgactgggaaggtaatggtactgcatactggattggctgcttcattcatgatgcaggggcagggggttttataagctttgggaatagattatg

SEQ ID NO: 44692 - DNA, 384 bp, Triticum aestivum
  Clone ID: PAT_TA_44692
cgtccgggctcatggagaccacgccgttcaggcctgggagctccggctatggcgctccgctgacgctgtccaaggcggtgccggcgcgcatgtccgttgggctgcccaagtcaatcctgaagaagagcaacgactagggagggctggctgcggccagcgcgctccgggactcccctcgggtgaagttagtgctggacggtggggacagcatgctggagccacctccattgccagcgagcttcgacgggaacaatggcccggacactgctgcaccagtgagcaaggtcgcgaggtcgctcggattctcgcagacatctttgcagtcgccgggccgccctgtgcataccaacctggaggcacttatgcgcccacaggaccagtaac

SEQ ID NO: 44693 - DNA, 229 bp, Triticum aestivum
  Clone ID: PAT_TA_44693
cgttctcccacgcttccgtttttgtttgtgtgtgatgatggccgtggtgttcgtcgtacatatcagctggtcgtcgaggtggtgatcgctcgccctgccgcaggtttcgcacgcatggcgacggcggaggccgatgttggcgccgccgttagcgtttcggcgcctatgatgctgcacggtcgcgtggctatcgtcacggtcggtgcttgagggatcggtttgcccgtgt

SEQ ID NO: 44694 - DNA, 303 bp, Triticum aestivum
  Clone ID: PAT_TA_44694
cgttctctgacgcttgttgcacattgcatgatcagtgtgtctgtgaaggtagatggcccgcgctggggtgttcttcgtgccctactggctccttatgctagccagcctagcctgcctcgcaacagcagctgttgatccagaggaaggggtcctcacggtcagcgtgcactacgcaaccgaggaggagtctcggtggctcagaccgctgggcggagtaatacaaggctcacggtttcgtgtaaggcttcaaggtccaggcggccacccaccaggagttcggtgcatatgaacaacatgttcacc

SEQ ID NO: 44695 - DNA, 327 bp, Triticum aestivum
  Clone ID: PAT_TA_44695
tgtggtgggaggacaaccgtaacaagatttgctgatgaatcaccaacatggagtttgagtcacatattgttcttcggtgggaaaaacatggtgaagtatggatgtgactacctttagcgtaagaccgcataagcgattgaacccctacactcgcagcgttggaccgatcaatgagtagctggggaggggcgcacatcgtcagtggtcgcatggacaactccggcgattggcgcggtgataccatgcagagaggcgttatgatgatcgtagactgtatgaaggaggcgtacatgactcactgactcctttttcctgtgtctgggacat

SEQ ID NO: 44696 - DNA, 189 bp, Triticum aestivum
  Clone ID: PAT_TA_44696
tctatacccacgcgtccaatgaacttacaacaatggtacatcatgtttgttcgaggtgcttatcactaataacgtgctggtcaaaatggggttcacaggatatcaccatgggtgtattgagacgcccatcaagatgaaaggtcaaatatgctaccagcattcacttgtacatctttactgtttaccaag

SEQ ID NO: 44697 - DNA, 372 bp, Triticum aestivum
  Clone ID: PAT_TA_44697
cgttctattaagcgttcgaacacaactactggatattgattaggataaggatgacacggggaagatcttaatcaacatcaaggatgatcatcacgagtggtacggtgacaacaaacaaaagcaaatatgtcataggatgccagattggacctccactgatgaatatgctaccatgtacaagaatgtgacaatcgactggaaggagcaccttgcctggaagtactgtttattgaaatgacagattgagtttaagggcgttcttttagctaccaagtgggtcctctttgacctttttgacaccagtatgaagcttaacaacaataattctaatgtgcggcaaggttttatgatggaaaactgaaaaggtgcttt

SEQ ID NO: 44698 - DNA, 397 bp, Triticum aestivum
  Clone ID: PAT_TA_44698
cgtccgtccgtctcccgccgtcgtcgcagccgcctcctgtcttgagccgtcgtcgccatggggagaagacctgcgaggtgctatcgtcagatcaagaacaagccataccccaagtcaaggtactgccgtggtgtgcctgaccctaagatcaggatctatgatgtcggcatgaagaagaagggtgtcgatgagttctctcactgtgtttaccttgtctcatgggagaaggatattgtgtccagcgaggctcttgaggctgcccgtattgtttgcaacaagtacatgactaagcatgcatgaaaggttgcctttcaccttatggtcagggttcacccgttccatgtgctccgtatcaacaagatgctttcgtgcgccgttgctgatagtctccatactg

SEQ ID NO: 44699 - DNA, 264 bp, Triticum aestivum
  Clone ID: PAT_TA_44699
cgttcgcggacgcgtgcgcagcactatagccagacaggtgagtgtagatgttcctgatgaacgtggaaggaccgagattctcaaggcgcacggcaacaacaagaggtttgatgctgacgtttcccttgtggtgattgcaatgaaaacacctgacctcaggggagcagacctgacgaaacttcttaatgaggcaagcgtattatcacgccgacgatgacagaccgtaatttgctggatggagactcgttgattcaattggcgcag

SEQ ID NO: 44700 - DNA, 130 bp, Triticum aestivum
  Clone ID: PAT_TA_44700
cgttcgctgacgcgtgttctctcccatcgagtattatagtcttggtctattcgagtcctaccagtagcatctagtcgagagagcgagcgagcgagctaagcggagtggggtggtggtagtggggaggaag

SEQ ID NO: 44701 - DNA, 308 bp, Triticum aestivum
  Clone ID: PAT_TA_44701
cgttcgtttactccttggcaagtgcacagataaatgctttactttctggcactgtcagtccagcaccgggaccgaaaaggcacctatgagacaatataagctcgtccccagtaacatggcccaccatctggcgctgatagagcatcatctgaacaaaaacagaacccatgcgtagaacgaggctagcgcccagagaaatggataaccgggagagactcttgccagccgatacgcagacagattcataaacatggtagatgaagcagcatgcactacttttgcatctacatgtctatgggtgctacact

SEQ ID NO: 44702 - DNA, 323 bp, Triticum aestivum
  Clone ID: PAT_TA_44702
cgtccgacctaacttaaactccacgtctttgcttcctttcgaacaatcaacacgaccaacgcgtgcgtgagcctcctatatctaacaaacagattgtctgtttcattcaaatattgagtgaaggtaccagaggccaaaatgatatgcatgagggagggtattttgatggtttcagagatgctctcctcatggctcgaacttctgattcactttttccctggactctatgtgagacagttcatatattgagcaaggaatctgccatggtccctttcttttttatagaaaacatatcgcatttcaacctatctttacctttgtag

SEQ ID NO: 44703 - DNA, 409 bp, Triticum aestivum
  Clone ID: PAT_TA_44703
cgtccgatcccctcctctcttgctcgactgccgcccggcgctgctccccagtccccacccaccccactcaaaccctccgccgccgcggccctgctcgccacccaaaccctagagagagagagagagctccctctccgccttcgccccccccccctccctctccgccgcccgagatgggcacggttttccacgtcaacagacggtgaactgcggttcacccgtgtttgcctccggcggcgcgggggcactgctggttctcgtgatctacgtgatctccctgttcgtccaggcccgccgccccaaggtgacgccggccgcgtcctctgccccaccagacggttcgccctcaacatcctactcctcctcgccttcttcttcttcggcatcgacacctcgacctccccgccgc

SEQ ID NO: 44704 - DNA, 332 bp, Triticum aestivum
  Clone ID: PAT_TA_44704
aaggcgcaacttttttgtccaggcataccacatggagctgctatagcaaatgatcgcgtccggcaggaacacgcctgccatcgcggtcgaaccattgcggataatcagaccaggtagcagcaggagagctcccccgttgatgaagcctgtcgtgagacggaaaatggagaataaatcgagctcgcggaggcgggtcgcgaagccggttacctgtgcgatggatgctgtgtgacggaggttcaccgggatggacggacggactcctgacactcgatagtggggggggaccgtttgcatcgcattctggtgccactaggtgtggagagggtcgt

SEQ ID NO: 44705 - DNA, 314 bp, Triticum aestivum
  Clone ID: PAT_TA_44705
cgtacgtccacgcgtgcgtctacgcgttcgtttgttaaccgtgaccatgaccggttaggcgtggggccgtgacctgaccgtgacggacgccagcggcgcgacggtgatgcgggtggaggggcccttcttcagtcttttgggccgttccgtcctcctcgacgccgagtggtgcccggtgctcaccgtggagcgctcgccgtccctgttcgagatcacccggaggtgggaggcgttcaggggggatagcacgagctccaaggacctgctcttctccgtcgccgtgcattctttgctgaccaacacgggtgacattc

SEQ ID NO: 44706 - DNA, 401 bp, Triticum aestivum
  Clone ID: PAT_TA_44706
cgtccgcggacgcgtgggctcgcgcacgcgcaccgtggtcaccacaccatccagatccgccgctcctcctaccacgacgtcatccgggtgtcggacatccagcgcttcatggacatcgccggcgtgcagacctacgtcatcaacagcgcgcgcgtcgtcttcctcaacgagcgcccccagcagaagcagcccggcaaggccggcggcggcgccggcggcgccaacctctgcgaggtctgcagccgcagcctcctcgacaacttccgcttctgctccctcggctgcaaggtcgccggctgctcctccgacgggggcggcaacgacaaggcgaggatgatgcggtccagcaggcccggccgcgccaagggctcgttggactccgaggcggtctcctcctcctc

SEQ ID NO: 44707 - DNA, 327 bp, Triticum aestivum
  Clone ID: PAT_TA_44707
tcgttctctgacgcgtggtctgacgcttgggccggatttctcactctggcctgcacctcacgccggaattgcgtgccgtcgctgccgactgttcctcacgccggcatcccgggctgtcgttgccgaccttcattcgtcgtccagtaaccggtcgtgcgcgccctatctatgttcttgtcgcttctcccattacttttttttctctctctatctcaaatcttttatccctctgtttcagaaacaacggcagcatgtatcctgatgtgtagcctcactactgacggttctgaccttggagcgaccagatccgtgcgtttacggtctcgt

SEQ ID NO: 44708 - DNA, 314 bp, Triticum aestivum
  Clone ID: PAT_TA_44708
ccagcccccacccaccggactcaaaccctccgtcgccgcggccctgttcgccacccatacccttgagagagagagagagctccctcttcgccttagcccccgccccctccctattcgccgcccgagatggtcacggattttcacgtcaacagacggtgaacagttgttcacccgtgtttgtcatcgagagagcgggggcactgctacttttgcgagaggaaaagatatcccggttagttcaggaccaccttcacctggggacgacgcccaatttggtgtcccacgcgtaccgataggctctactaaaggaacaa

SEQ ID NO: 44709 - DNA, 336 bp, Triticum aestivum
  Clone ID: PAT_TA_44709
cgtccggacatacgtgccccttcgtccacggggtaaacaggttcaaacgcaccgcttcttcctatgcgcggtaggcacgaaggaggggacacaccggccgtggttcttggagcgatggcccataaggaccccgccaatggaaaaaggcccaccaccggcacgacatccactccctcgtctatccgcttaacaaagatcttctaagacaatatggcgatcctggtcaaaagtgggggtggttttatagcctcgggcgtcgtccacaagcttttggttaacgagaagaacgaggtcattgttggtgacaacatcttatatgggtcaaaagacaacctt

SEQ ID NO: 44710 - DNA, 197 bp, Triticum aestivum
  unsure (1)..(197): unsure at all n locations
  Clone ID: PAT_TA_44710
gcgaccacgcaacnggaaataataactaaaacacacacacacatttttcaaactgacagaaaaatatctgcgttattcttttatttcccatccatcaaaataaattaccaccttttttacctattatccaccttgacatcaacattgatatacctacaatcttctataaattaccttatctaacatttccaccctct

SEQ ID NO: 44711 - DNA, 440 bp, Triticum aestivum
  Clone ID: PAT_TA_44711
ggaattcgacccacgcgtccgactttccccaattttttaggaacaaacaaaacttcccattctgacgtacatgagcgcagacgcggggcccatggcagcgatgacgccgccggcaaagacgcccgaccacgcgcgacccgagacggagaaggccgacacggccctgggcgtgaagaaccccacggtcgttatgcggctgccggcgggcaagaccgtctacaaggagggcggcggagagaagaggcgccggaagaagggcaagaagagcgtggagacctacaagatctacatcttaaaggtgctcaagcaggtgcaccccgacatcggcatcttctccaaggccatgtccatcatgaactccttcatcaacgacattttcgagaagctcgccggtgaggccgacaagctcgcccgcttcaacaagaagcccaccattacct

SEQ ID NO: 44712 - DNA, 185 bp, Triticum aestivum
  Clone ID: PAT_TA_44712
ttccggcgccacgacgcacgcgtacgcggacgcgtgcggccgccgcgaaatccttcgagtctacaaccttatcctcatcctagcactgactgtggcgggggcgtaacctgggccggaggctgctgatctatccgcaggaaataaggctggaaggaaggagatcatgacggaccggtgcaaaactg

SEQ ID NO: 44713 - DNA, 214 bp, Triticum aestivum
  Clone ID: PAT_TA_44713
aggttcggaattaccgccgcgacccacgcgtccggaagttactgaggagaacacggcacacgtcactactaccctgggcttagaagactttggtattactctacggcagtacctaacaagtgaatacaaactatgtcctgatatcgatctggcaaaatattgtcgtgatctccccctgttgcactaagaagatccgaatgaaaaaattgaactt

SEQ ID NO: 44714 - DNA, 297 bp, Triticum aestivum
  unsure (1)..(297): unsure at all n locations
  Clone ID: PAT_TA_44714
gaaaganccgggaagacccacgcgtccgatgaactctagttaaacgtcgaccgcatcgggcgctacctgaaaaaaggccgattacgcccaacggggcggatcccgaccgcagttgtacctagccgacatactctagtacctcggcgccgaggccctctatattgccggaaacacacccaatgacaacaagaagaccggcatcatgccatgccatctgatggtcgtcgtgcgaaaagaccaaaagcttgccaagctgctactcacagtcaccatcgcccacgggggagtgataccaaa

SEQ ID NO: 44715 - DNA, 381 bp, Triticum aestivum
  Clone ID: PAT_TA_44715
cgttcgggggctatggcctccatgactacccctcggctccccttcctcccggcccgggcatgctgggccgccgccgacttctcttcgttgacctactacccgatacaatgctgccctgcgaaacgcacgagcggtactaacgccaactaagccgccctactttatacctcgcgggcaggggcgcccgcggtggacggcgcaagagccgccgacctcaaccgcctgcggtcctttgctatgcctgacgcggacagccctctacccggctactgcactccacatgaaggaccggccggggccttcttcatggcgtgcgcggaactggaccgggaaataagggcctgctgactagagcggctgaaaatggagcctcagcggggt

SEQ ID NO: 44716 - DNA, 420 bp, Triticum aestivum
  Clone ID: PAT_TA_44716
cgtccgcggacgcgtgggcccggataacaaaaagtggaaggtgaagcagccatggcgaccatcacggcgcctccctgctccccctctccatcgtgtatgttcctcacccgcacctattgctgctcgaggtcggcgccaagagcggccatccgctcatctgctgtggcggcggcccggcagacgctctcctccggatgggacctgtccgggctgtcgggagcgcgaccggcagctggaaaagcccgtctcgaggagttggacaccaacaacatgcttctccgccagcgaatcatctttctcggctccccggtggatgatttgactgcggatcttatcaccaggcaactcttactgttggatgcaaaggaccacacaaaggatatcaagttgtttattaattcacctggaggctccattact

SEQ ID NO: 44717 - DNA, 179 bp, Triticum aestivum
  Clone ID: PAT_TA_44717
cgtccggtgtggagggcatgccggagagcccgaggaatgcgccggtggtcctgtctagggagcgcgagccggccgtgaagaatccgttctctacgcttgaatcacgtggtggtggtggcatgcggtagggccataggatggtgccggctctggcgaggctgctcttggttctgtcttct

SEQ ID NO: 44718 - DNA, 356 bp, Triticum aestivum
  Clone ID: PAT_TA_44718
cgtgcgcccgcccccacctccgcccccgtacgtggcacccaccgccggggcgccatggcctccgggaacttgtgctcttccaccgccttcacctcctcctactcctccatactcctaccgaacaaggacgcctctttcatcttttcggccgccgccgcgtctcgccggccttccgagccgactggtgctgaggggcctagctaaacgcgacccggtcgagccgcggatgcttaaagctcctgtggtttctgacgagagataggcactgtagccgccaggtcgtgacagtggtgggctcgcaccgtccgattccgcgtgggggctcgagttcgcggcggcggcggaggttctcaatg

SEQ ID NO: 44719 - DNA, 350 bp, Triticum aestivum
  unsure (1)..(350): unsure at all n locations
  Clone ID: PAT_TA_44719
cgtccgatggcgcgttaaacgtagagacttctgttacagtgacacaaaactttgataatcaatggagatgtgagcaggnctgactagacatgagacttgtggactgagacaaatgaggacatggcgctgggttacttgatgggactggaaactgggcctgagatattgaaaatcatgcatctggaacagatgcgagcatggaacgacagatgacatgctctcggcagaaaattgacatgaaaggggagggtgcggatgagcttgctacagggcaaaacagggtgcttagcgagagggctgatataagaatgaaagtgtggagaaccaagttttgtcgtgtgatataagtt

SEQ ID NO: 44720 - DNA, 417 bp, Triticum aestivum
  Clone ID: PAT_TA_44720
gctgcaacgaccgcaccgaccgtcccgggacgacccacgcgtccgctcacatcaaggatcgcgggctccacagtgccctccatccctgcactacctccgttcgcgggcggggatcctttacccggcaccgatcccttcgccgccgtcgatctcgtcgctacgacccccttcacgagccgccgccgattcccttgaggagccgcagccgatcccttcacctgcccggctagggctcccatccgtgtcctcgcccttgcgccattaccatcgccttgttgtgggggcccccgtcaatcaccaccatcagcaaatccccagtacatgccgaagccgttcagcaacaaccagcgcttccttcctaaatccatgacggataccacggtttggtgggatccacgaccgcgacaattaaaacgg

SEQ ID NO: 44721 - DNA, 271 bp, Triticum aestivum
  Clone ID: PAT_TA_44721
cgtccgcggaaacgggtacgctctcctactacaaagaccatccaccgacacaagcgcgcgaatgggggcaccggcaagccccgatgacttgactactccgccggcccgccgcctggatcaccctattggctccgcgcaccacaggccgggctatgatgtctttgaaggaagctcgagagagcgaggctcgtttagcggaagcatatccgaaccaacatggaacgggctcttcaacacaagacaatgcagttacacatcaactgaccgactc

SEQ ID NO: 44722 - DNA, 417 bp, Triticum aestivum
  Clone ID: PAT_TA_44722
cgtccgtgcagaaacagcagtcagtacagatgcagattccacagcttcatgctggaaacgacgtgaacgagggaaaggttagacaaggaactgcaatgaaacctggtatgtatcaacagcacttgggccaacgcagtaactattatcatcagcaggtgaaacagagtggtgctttcccaatttcgtcaccacaaaacaaccttcaagcatcatccccacaaatttctcaccatcctcctgaggttgatcagcacaatccattgccatctcaagtcaagactgggacacccttgcattcagctaactcaccatttgtttcatcaccatccccgtttatcgccccttcttctataccagtggatgcagcctaaccccactccaatatattaatacttactaatactgggcaggcctgga

SEQ ID NO: 44723 - DNA, 256 bp, Triticum aestivum
  Clone ID: PAT_TA_44723
cgtccgcccacgcgttcgaccacgcgttcggcagcgagctggctagggtcggctatacaatacgggtagctaggtagaggagccgcccatagaaatggaacatggcatcatctttgtgatgctcctggccaatggcggccaccgcaggagcgcggtcaggagccactgtgcaaacatcctgcgtgcccactgcatatggcgcccctcgcatgcacggccgaacagtgcccccgtctctcgccgccaactcgtcccc

SEQ ID NO: 44724 - DNA, 203 bp, Triticum aestivum
  Clone ID: PAT_TA_44724
tcatccgcaccctccctccttcaccaccccattcccacccacccagcatgtcggcaggaactctggggccctcccacgcggcgcgcccgctcgccgtgcgcgctaatcttgatctgccactggtgtactggtgatggataacaattaatattctattagtcatggtgggaactgactcctcggcgtcatcaatacaatatgat

SEQ ID NO: 44725 - DNA, 172 bp, Triticum aestivum
  Clone ID: PAT_TA_44725
cgtacgctgacgcctgttcatccagacactctcgcgtttgagagaacaaaaacagtggatccaggtacaactgctataaacaatttttcactagcgctcaatgcctagtacttagctcatttggagcgctgcttacattgtccccccggggatgccaatgcatcctggtgat

SEQ ID NO: 44726 - DNA, 274 bp, Triticum aestivum
  Clone ID: PAT_TA_44726
cgtccggagccgccttccccttcctactcctcggtccagcgcgcggaggaggaggcggcatgggggggggcggcgacctgaccgacgactagcgcaaagcgctgtgggggagcaaggtcgcgccctttccggcgccaacagcggtctatcggccaaacccggggatgggccatcctggaggaccactgactacaaataagggtgctgggttagggaaatgtctcgagagaaatctacaggagtctggtggggttgggactgttttaaatcctga

SEQ ID NO: 44727 - DNA, 177 bp, Triticum aestivum
  Clone ID: PAT_TA_44727
cgtccgcagtcatatgacatctgctaccgtactatcctcctcttcccccgaagcagcatgcgcggggttccggtgcggcctcatagcaatggtcactctccgtcgtcacccccgactgcaaaatcgacggactcctgtacgcctgtgttaagctaggctagatcagggcgatcgaga

SEQ ID NO: 44728 - DNA, 173 bp, Triticum aestivum
  Clone ID: PAT_TA_44728
catacgccgacgcgcacgctgacgcgcacgttcaggaggagctcgcacaataccttgcgcgaggggctaagtgagaaactgaggagctcgaagattccgtcgctctaatcgttacctgaaagaccgacatatattactgtataggagctccaattgagtacctgcactaaata

SEQ ID NO: 44729 - DNA, 423 bp, Triticum aestivum
  Clone ID: PAT_TA_44729
cgtccgcgcccaggctgccaccggatccgccccacggccaccggcctggagccgcgatggcctggatccagcctcacctcctccacacgagcctccaccttcctccactaccttccacctagccccctcgccttcctcctcgtctcgtgcccccccggctgccaccggatccgcgtcatggccaccgccccggagccgcgacagcctggatccggcgtcacctcctccacatgagccgccacctccctcccccaccttcctcctagcctagttcccgacagttggctaggccggtaaactagagccaccgcccccctgtgagatccgtggcggccaatctggaagaggtaactccccatggtgctccacgacgagggatccgaggcccaccatgccgccgacgatggattcgacccggcaacc

SEQ ID NO: 44730 - DNA, 277 bp, Triticum aestivum
  Clone ID: PAT_TA_44730
cgtccgcccacacgttcgggcatgaccatcaccctggatgttgagttgtagcacaccatgtacggggtcagggctatgatccaggacaaggacggcatctttctggaccagctgcgattgatctttgctggcttgctgctcgaggatggccgcaccctgtgagactacatcattgagatggagtccacccttgacctggtgctgacggtacgcggtggcatgcacatatctgggaagaccatcaccggcaagaccataactcttagggttgagtcct

SEQ ID NO: 44731 - DNA, 338 bp, Triticum aestivum
  Clone ID: PAT_TA_44731
cgtccgggagtccagtattaggatgcggcggcttccacgacataaccacactgtctcctatgtactttaccccttgtgtccctggtatcatcccatcctccgcctttgccacccaggccttgcagatctactcattcgaaatctttgagctaaatgacagcttgaagtggccactctgtgtctacggcgtggacgctgctcgagatgctgtggatggtaaccgcaaccttctcttctctcgctccagtactaactgccaagtactcactaaagaggatcctttttttgacttgactggcccttcttgtgctattttggatggagaccctgttgacttt

SEQ ID NO: 44732 - DNA, 254 bp, Triticum aestivum
  Clone ID: PAT_TA_44732
cgttcgctgacgcgtgggcaaaaaggttgattcttcatacagttctgagtcggagagtgaatgtgaggatgaggagaagtcaaagaaagtcggacaggctaccaagatagcttctggagctgctaaaagaaaggaggtggttagttgatttttcagatagtgatgagagtgatgaatagccttcctataaaatgctgaatgatgctgcgaaggttacttctaattcttgcaataaggacatgcaccagtgatga

SEQ ID NO: 44733 - DNA, 129 bp, Triticum aestivum
  Clone ID: PAT_TA_44733
cgtacgcggtacgcgtgggtgacaattatgcagaccgtattttgtttgcatagcgggaaactgcgggaacagggtgctaggcgggctttatatcctcctaattacaaggtatggagagggttaaccgaa

SEQ ID NO: 44734 - DNA, 132 bp, Triticum aestivum
  Clone ID: PAT_TA_44734
cgtccgacttctcgtacacagactcggtcacctttcttttttatcacatcctatcttcacgccgcgggggacctgacattccagtatcggccactagcaaatacaaatattcctcgtttgggaagcaaattc

SEQ ID NO: 44735 - DNA, 417 bp, Triticum aestivum
  Clone ID: PAT_TA_44735
cgtccgatggcattcagcctgatggacagatgcctggtgacaagactgttgggggaggtgatggggctttcaacaccttcttcaatgagactggtgctggtaagcatgtcccccgtgctctctttggtgaccttgagcccactgtgattgatgaggtgaggactggcacttatcgccagttcttccactctgagcagcttatcattggcaaggaggatgcatccaacaactttgcccgtggtcactacaccattggcaaggagattgttgacctatgcctggaccgtattacgaagcttgcacacaactgtacttgtcttgatggattcctcgtctttaacgctgttggaggtgtaattggcttctggccttagttctcttctactggagcgggttttttttgattattgaatgaag

SEQ ID NO: 44736 - DNA, 233 bp, Triticum aestivum
  Clone ID: PAT_TA_44736
cgttcgcgtacgcgtgggcatgcctcaggtttattacatagagcttcaccagaagcgccatggacggcgcatggactacgaggagcgcaagctcaagaaggaggcgcgcgccgttaagaagaacttcatggatgcccgcatgctactctcgtccaatgtcaagtggttcttcaagaagcttgttgccaagttagtctcaaatttagaatatcctgaaaatgctcgatgagtct

SEQ ID NO: 44737 - DNA, 353 bp, Triticum aestivum
  Clone ID: PAT_TA_44737
cgtccgcggacgcgtgggcaaacgcgtgttcgctctcccatatttccacgcattgtaggctttggcctccttcttccccatttcgctggtgtcgcatcccaccaaccacccctactcgccgtcatgagggagtgcatttggatccacatcgggcaggccggcttccaggtcgggaacgcgtgctgggagctctactggctcgagcatggcattcaacctgatggccagatgcccggggacaagaccgttgggggaggtgatgatgctttcaacacctttttcacagagactggtgctgggaagcatggtccccgtgcttgttttttagatctcgagcccactgtgattgatga

SEQ ID NO: 44738 - DNA, 403 bp, Triticum aestivum
  Clone ID: PAT_TA_44738
cgtccgaattttcccaattttttcggcacaaacaagccttcacattctgccctacatgggcgcagccatgcgcgcccatggcggcgatgaagccggcggcgaagaagcccgaggaggaggagcccgcgacggagaaggccgacacggccctcgccgtgaagaagcccaaggtcgtgaagcggctgccggccggcaagaccgtctccaaggagggcggcggcgagaagaggggccggaagaagggcaagaagagcgtggagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgcta

SEQ ID NO: 44739 - DNA, 359 bp, Triticum aestivum
  Clone ID: PAT_TA_44739
cgtccgggaggcacttcgacggcgagccgacgttgacgcgcctcctacctctgcggtgactctggcgtctacaagcgaatcgtgcgcgcctgctatcctgtactaaaatggggttctccaccccggcccgcagagcaaactgccaccagcccaccactaatccaattctagaaggactatgtttgtttgcgagcacagcaccgtaggcaggagggacttcggatcgtgcacggattctctatcgatgcgatcgactgcatcggacggtgtactaaaattgactccaaatagaaggaggggagattcttgaccgccatgatcgtcgcttcttaccgggctcgacttcgcaatgggaagct

SEQ ID NO: 44740 - DNA, 118 bp, Triticum aestivum
  Clone ID: PAT_TA_44740
cgtccgctgaactctaattaaacctcgacctcatccgtcgataagtgaaaaaatgctcaatgtgcgcaaggatgcggagcgcgctcacaggcgtacctatccctgtttaatctaggac

SEQ ID NO: 44741 - DNA, 387 bp, Triticum aestivum
  Clone ID: PAT_TA_44741
cgtccggtggctatggcctccatgactacccctcggctccccttcctcccggcccggacatgctctgccgccgccgccttctcttcgttgtcctcctccccgttacaatgctgccctgttaaacgcacgagcgttactaacgccaactcagcccccctcctttctacctcgcggccaggggcgcccgcggcggacggcgtaggggccgccgacctcaaccgcctccgggcctctgctatgcctgtcgcggacagccctctacccgcctactgcaatccacatgagttacctcttggtgctttcttcatggcgtgcgtggtactgtaccgggaattagggcctctcactagtgcggctctaatggagtcgagcggggaggggctcaag

SEQ ID NO: 44742 - DNA, 196 bp, Triticum aestivum
  Clone ID: PAT_TA_44742
cgtccgtataactgccattagcttgtgacctatggatccattttttattttcatcattttatgctcatgcatctggtgttgcagtgtattgtaaaaaacttaacgtgatgatgctatggcttacaccggtacctacaagttggccaaattttgggtatcctttgtagattgtgggctgtttcttaaacgactttgc

SEQ ID NO: 44743 - DNA, 388 bp, Triticum aestivum
  Clone ID: PAT_TA_44743
cgtccggccacgcgtccgcatcaatggggttgagcattattaggtcatcttttatgtccttggttgtgcggcagggaacactccacttgaccaagtccctgtttgggaattcatcatcctttgaagtgcttaaattccctggaggaataacaataattcctccgcagcacgcctttcctgctgaaacactggatgcaacgtttaattttactctgaatttgccaacttacaaagtgcaagacagaactgttgaattataggatcaaatgaaaaaaggcctactactcaactttaatgagaatcttgatttgaaattgggaaatttgacggatcaacaattcttccgcaactattggggaaacctacatttgttcgtggtgttggaatc

SEQ ID NO: 44744 - DNA, 205 bp, Triticum aestivum
  Clone ID: PAT_TA_44744
cgtacgcccacgcgtacgcgcgctttgtctagaggggacgaaaaacctggttctgttcccagggagatgagggtggaggatggatatggggttattgagagaagagagggtggctttaaatttatttactggaatctgataataatgcacctttctgacctcgtttgacaggtttttttatggacgattcactatattattttta

SEQ ID NO: 44745 - DNA, 128 bp, Triticum aestivum
  Clone ID: PAT_TA_44745
cgtccggccacgcgtccggccaccccgtcggccacacctcaagccaagcgtgcgaccactcattcggcatgtgtaaggcagacgatctcgatcacatccttctatgtcggccaacgcgatgccaacgt

SEQ ID NO: 44746 - DNA, 341 bp, Triticum aestivum
  Clone ID: PAT_TA_44746
cgtccgcggacgcgtgtgcggactcgtactacaaagaacatccaccaatacaaggacccaatgggggctgcgggaatcgtcgagtacttgaataatcaggttggccctgcttgcaaggagatcatggctcctgacgatgccacttaccttgtaaacggcaagatccacattggagatgtcgagactgaattaagcggaacttaacctacaccaccaagttgcgggctctgaaacacaagacactgcttatgcatatgaccacaccgagtttgcgaaccatttaccacgccgtgatgcggctttataaagggcttcgaataggctacctaagccatgggata

SEQ ID NO: 44747 - DNA, 365 bp, Triticum aestivum
  unsure (1)..(365): unsure at all n locations
  Clone ID: PAT_TA_44747
gcagtaccggtccaaaattaccgnaaccacccactcgtccgggaacgaacactaggcaggaccacggtcctagtcctgccgactgcgacgctgaagtgctgcatcagcttcacattcatcggcctggaccctgtatatgaccgcgccattgaacccttcgtgaggcacctcaccgatcacccccggggcatcaccatgctccagcgcatcggcgcagggatggcaacgacgagcatcaccatggccgacgcggcgctagaggaaaccaagcgcctttcgtgttgacaaggacgcggacctgctcaaccggacgaacgtggcagagccgatgagcctatgctggctggtactcgattacgttctta

SEQ ID NO: 44748 - DNA, 196 bp, Triticum aestivum
  Clone ID: PAT_TA_44748
cgtccggcggaggctacaggaaggcggaggcgactggaaggcgtaggaaccctagccgcggaggaacgcccagaggcccaaggtcggcgacgatggcgatggcggtggttcgctgcgccgtgaggaggctcggtgtctctctgctccagccaacacaggcggtgtttgcggaggatgggatgcctgcttgtgccaa

SEQ ID NO: 44749 - DNA, 212 bp, Triticum aestivum
  Clone ID: PAT_TA_44749
cgtgcgccctcgctttcgatcccacatgccgagagggtcggccgctgtcggaggcgaaggggggggggtagggaccgtcgtccatggcgtcccactaggaccgggagtcggtctaggcgctcggcaacgggacggtggtggttccgcataggaaagacggtagggtggagcattatgaggagtgtaagcgcaactactccgccgatatcggg

SEQ ID NO: 44750 - DNA, 368 bp, Triticum aestivum
  Clone ID: PAT_TA_44750
cgtccgcacacgcttatgtttctccgacactggactgccagagagagggcgagcgttttggtatcggcgttaacgctgacttcggtgtcgagcctggatggagctagccgctgtggccaaccaacaggctgaccctggcggccgccgcgtctcccgcgagaatcgcactcgctcgcctatggttttctccgaggtcttagaggagggcatccagatcgtggagatggcaggaggtgtcttcatccaattgctcctcatggacaaggtcatggagaacgagaagaacgaggtcattgttggtgacaactttttcactgcataaaaagacaacttggagaagtgggttggacatgctatttttaaactta

SEQ ID NO: 44751 - DNA, 397 bp, Triticum aestivum
  Clone ID: PAT_TA_44751
cgtccgcaacctggtagtactactagtactggtaaacaaatttcgagtggccaacagcaaggaggatcgatctccagagagattactcgctccctcccccgcggcgtttcttggatttgtctccggaggaggaatccggagcgccccatccgcgtctcgatcgaatcgccggccccgtcgcttccgcggagctcccccgatcccgtcgcccggtgcggttcgaattccgcccgaattggcgttcttggcgatcggtttggaggcgggactggattcttgattggctggccgagttgtctctgcggggaagctccgtcggccgggaatcgcgccttcctcgtccggccaaggaaagacagggggagatctcgtagcgtgtttcggcggatggcgatgc

SEQ ID NO: 44752 - DNA, 148 bp, Triticum aestivum
  Clone ID: PAT_TA_44752
cgttcgcggctcgctgcgggcgtcggcggatttcccgacggaccggaacctgggcgagctgtgggcggtctcgtcggcgtcgagctaccactacgagaacgtgacgctgcgcgacctgatgctggactgtaactaaccggtgcggcgg

SEQ ID NO: 44753 - DNA, 130 bp, Triticum aestivum
  Clone ID: PAT_TA_44753
tcttccgcccactcgttcggtaaaactctagctcccgccgtcgactagcaacgagatgatggattcgcggtggcgctcgatagtgaacgagcttgtagttcattgtgcaagcccttcagtcggacctgcg

SEQ ID NO: 44754 - DNA, 178 bp, Triticum aestivum
  Clone ID: PAT_TA_44754
cgtccgcggacgcgtggggcctgccctcctcgcgaacctaccgacgtgctagcgccgacgtactattatttactgcgactactctgagccctacgccctgaccgacgacgatgagtttctcgatactccgcgtgcgcctcgtatccaacgccagggaggatcgaattactccgtccgt

SEQ ID NO: 44755 - DNA, 312 bp, Triticum aestivum
  Clone ID: PAT_TA_44755
cgttcgggcgaatgccaagataagatcgacgcgtggtctgccgcgtgcgcggggcaagatccaccttcggatgccgaggcctgcgccggcgctcggaaggcactgatgaagtgcataatggatgctgaggcagccttccgttgacacggaggagcagcaggagggaaagttgacctgattgtggtcgacgccggcctcattcatagctaattagcgctatatatacctagttttatcatggatacctttgatagattaataatttggagttattatgatttatagtagtatcttattttagatcgtggatat

SEQ ID NO: 44756 - DNA, 268 bp, Triticum aestivum
  Clone ID: PAT_TA_44756
acgcgtccgggacgcgtggggccccgacccctctactccaaggaaagcccgcgggggcggtgagggagcggcgacgatgacaacccgtttcaagaagaaccggatgaagcgcggtcatttgttcgtcgtacacggtcgagttggcaagcaccgtaagcatcccggaggccgcggtaacgccggatgcatgcaccaccatcgcataattttttgagaagtacctatttcggtttctttggtcttggtttggtttagctcatattaaaca

SEQ ID NO: 44757 - DNA, 192 bp, Triticum aestivum
  Clone ID: PAT_TA_44757
cgtccgcgcaagcttttaccagtacggtacgacaggcgctctgtcctcactggccatggctagggcgcacggagcattcctgttgcagttgttggccgtcgtcctgcaggtcgtctcgctagctgcgaccgtcacagtcacgcagatggacgacccgtggtgtcggccgagccttccgtggtggtgcgccgt

SEQ ID NO: 44758 - DNA, 193 bp, Triticum aestivum
  Clone ID: PAT_TA_44758
cgtccgacggcctgtaaaattagcaagagtcttcccatcttttgcacagcatattttgtatcagaggatggatggggttcagttgatgttgctgaattataaagtggcttgatctgtggctttccaggaccaacatgtaactttggtgagctgcagcactaaagaagctatagatgtaacgcgctttagatca

SEQ ID NO: 44759 - DNA, 203 bp, Triticum aestivum
  Clone ID: PAT_TA_44759
cgtccgaaggacacttctcagcctgaagtattggatggaggcaattgtaaagcgatttctaagggaccttcataagaggaagttgttgcaaatcgggctatgctgagccaaggacactgttaacactcctttgtagtttgactgagagagcgacgttgtctatggtgtgagtgtagtggctggcgtatttgctaaggatggtt

SEQ ID NO: 44760 - DNA, 105 bp, Triticum aestivum
  Clone ID: PAT_TA_44760
aattcccggggtcgaacccatcgctgtccgtaaggcacactttctcagtcctgtaagctatatgacatgtgaggctgatttgtgcaagcggacgttctaagggta

SEQ ID NO: 44761 - DNA, 142 bp, Triticum aestivum
  Clone ID: PAT_TA_44761
catccgccccttttcctttacccatcaccaactccctccggccgcagctagggttccgcggatccaagcctagctagctagggtttgctcgccatggccgcggcggcggatgatgatgtggttccgcccgtcatcgccatca

SEQ ID NO: 44762 - DNA, 302 bp, Triticum aestivum
  Clone ID: PAT_TA_44762
cgtacgtaaacgcgtgctaacacgcaaacacatatctgaagtcggaatgagcacgcgcaccggacacacacgaagatatactaaaacagcgaacaatgaagacaaaagcgatggcgctctccacctcgtacttcggcgacaaggaattgaatgacctgacgtcgtatgcgatataagaggaggcgcgcgtcaccatgcgcaagaccgtgggcaaagccaagccgatgtcgttagacaaaacaagaaacggataagaccgcgtgctctacctatagccgatctccaacgacccttcgagctac

SEQ ID NO: 44763 - DNA, 363 bp, Triticum aestivum
  Clone ID: PAT_TA_44763
acatacgatctaaatccttgctcccgcttaccctcgacgcgccgccgccgtcgcctccgagcccctggacgcccacgtcgcagccatggcggagcagaccgagaagtctttcttcaagcagccaaaggttttcctcagcacgaaaaagggcgacaaggccaagaggccaggcaaggctggcaaccgcttctggaagagggttggccttggtttcatgaccccaagggaagcgatcgatggtcacctatattggcaagaagtgcccattgactggatcggttgccattcaggtgcagaatcatagttggaacttgccacagtgccaatatgaacaggaccattcattgtttgcagtgatctacc

SEQ ID NO: 44764 - DNA, 256 bp, Triticum aestivum
  Clone ID: PAT_TA_44764
taccgcctgcagtaccgggcccgacccacccgtgcgcgagatcccggcggccgggtcaccgacggcggcatccaggagcgtgccaagcgcgccccgagatctcgctgatcgtcgtcctcgtccgcgccgggggatttccaagcccgtcgatgccgctggtcggggtcgctgaccccttccacgggcggcggagccccaaattgattacggcgcgcggggcggaggacgactgattcctgcgggagagaggaggagg

SEQ ID NO: 44765 - DNA, 298 bp, Triticum aestivum
  Clone ID: PAT_TA_44765
cgtacgttcactaactccatacaacaccatccaaccttttatgaatagatgatgatacgtgtgcactatgcgaatacaacccttgcgtctgtaggatccgtaaaaagggaaacaagatgtacaccggcaggaagaagatccagaaggacaagggcgttgagccttatgagtttaaggacaccgtcgagcatgctatatttgacctggagaacggcaaccaggagctcaagagcgacctaaaggacctgtacatcaacactgcaatccatatggatgttgatgggaacaggaaggccgt

SEQ ID NO: 44766 - DNA, 397 bp, Triticum aestivum
  Clone ID: PAT_TA_44766
cgtccggagaggctacctatgcgactcggaatccaggttctctaaccccttagagatgaaaggcgggagactacagagatactatgtatgaacattataacatgagaagcaacttttgcgcttacagcaaattcagggcctgactgatgaaatagttcacatattgtcgcgtacagttgtttattcgcatgctttaggcggtctttgggaattggagtgactgcaacggtcctgaatgcggagtgagattgatagcggggacctggacttcctaacagggccgccattcgacttgggcgtttgaatgaactgatcaatttatgtgggactaaactcccactgcaagcacttcgtatgctgcctctttatcttcctgctgagttcgttccaacattcg

SEQ ID NO: 44767 - DNA, 253 bp, Triticum aestivum
  Clone ID: PAT_TA_44767
cgtccgcttacgcatctctccctcagctccggtaagcaacaccagctctcctctcccctcgcttccgtgctgcaatgtcgaccgacgtggccgccgatgtcccggcccctgaggtggaggtgaccgccgaccccgttgtggagaccacggccgaggccgccgtcggctacgcgaagccgtccaaggagaccaaggcctaggcggttaaggccaagaagccctccgccccgaggatgctccgctctaccctcgt

SEQ ID NO: 44768 - DNA, 211 bp, Triticum aestivum
  Clone ID: PAT_TA_44768
cgtccgcggacgcgtgggcggtacggttcggtactcggttgactcttacctgcagctgaagcggatcaacgtggactacaacgaggcgagcggtgtacttttcttgcctcgcgccgttctcatggaccttgagccctgcaccatgtacttttttcgctcttatcccttcgttcagttctttcttcctcacttctttatttttctttcaatt

SEQ ID NO: 44769 - DNA, 182 bp, Triticum aestivum
  Clone ID: PAT_TA_44769
cgtccgcccacgcgtccgttcacgcatcatcgaacccaacctcgccgtcggataatccgtggggggggagttttagtaggcgcgctacgtaaccagatcgtcattctgttcctgatcaccgtgaagccgggcgccagctgcattggctcggtcatttacggcgaagcagtttatggaggaca

SEQ ID NO: 44770 - DNA, 276 bp, Triticum aestivum
  Clone ID: PAT_TA_44770
cgtccgcccacgcgtccgattacacgccaacgtcctcccaatctgcttcaaaaaagattaggaaggaagtcccgagtgagagacggcgactccaacggcgccaagccttccgctgagctacgtgctcagacacatggccagaccgatgattcagcagtacattgaccacaacgtagtgggcaggtaactgaccgggtacttgacggcggacgtggtggacgaggtcttcgacgtcctgaatgagctccagtataagcgcatacacagtcgaaagaa

SEQ ID NO: 44771 - DNA, 177 bp, Triticum aestivum
  Clone ID: PAT_TA_44771
cgtccgcccacgcgtccgcccacgcgttcgcccacgcgtacgttggaggactccgaggccaggcttggggtcggcaacgagggcgcttacgacaaggtgatggacgttggcgtaccggtcatcaggtattggcgaacaggggctcatggtcgacgctgatatgatgggacgagcttc

SEQ ID NO: 44772 - DNA, 426 bp, Triticum aestivum
  Clone ID: PAT_TA_44772
cgttcgcggacgcgtgggtagctcgccatcttctatgtcacgtacgaccttcatctctacctgcttcccagtgtatcgaacagaggcaccgtggcaggactcaaggtgcagtaactactccagttgtacatgagccatgggttcaagagaggttcttggagttctcatggtccctgcttgggcggacgccgaaagggtgagagtcgatttgttaaggcttccctggtatttgtcttcaataccaatgcattattttctcatcactaagcttttgactcgctcactacttgtttcttgcactatatggccagatctagctatttcattatccatgatttttctttaaaggccaccgactaaacatacataagcttggtaatttctttttggctgcagctaaaaatttattattataagtgatctttt

SEQ ID NO: 44773 - DNA, 296 bp, Triticum aestivum
  Clone ID: PAT_TA_44773
cgttcgccacatcgtaacaaacactacaatctactcgcaagagctgtatcaactgcacgggcgcctggacccgcctctggttgggtcctctttcgaatctgctcccgcgcatttgctgctggatttgctggtgcgtgcggggggacgggggtcggactcgaagagcaacgtggacggcgcgcttaacggagtgctgccgatggtgttcaagctggagctcaagttttaaattgccaccagagttgtcatcgctgtactctttcacctttgtgcatacatttggatccaccttgagc

SEQ ID NO: 44774 - DNA, 227 bp, Triticum aestivum
  Clone ID: PAT_TA_44774
cgtccgtctactcagctgccttcgtcagagcttgttagtgttatatcctttatcggggaagaaatctgaagaggatcctccttgctcgtgtactagtacaagcatttccgccaacacacttttgaaggattcttacccgtaccgggagctggacaacgcgcaactctgataacagggtttacattggatcatacttggtacaatagtggcagcaatcgcggccactc

SEQ ID NO: 44775 - DNA, 226 bp, Triticum aestivum
  Clone ID: PAT_TA_44775
cgtccggaaacccccatccgtccgtccgtcccggggagaagaccgcctgcggaggagaggagacgcggtcgaggcaagaggagagttaaatccctattttgctcccccccccgcgccgccgaccctacctcgggcattctcttcggcgtccttccttctttcagggtgaaaagcagtaacaggatggtgctgcgcgtcttagggtatgcttctctgatctggatcc

SEQ ID NO: 44776 - DNA, 419 bp, Triticum aestivum
  Clone ID: PAT_TA_44776
cgtccggcagaatccaagattaaattctaccagccatctcggggaagctgtaaagcagcttgcaccaaccaccctggggggccagggatcaacggataggccagtgaatggtttaagtacaacatctgttcctctgaagcgcaatcctggatcccatcctgtaagaaccttggaatcgtggggcctgactggggatgttataggaaaaatcgcttacactgcagtcctggggcttgccctatttggtacattaaaactgctcaggtttcagtttgggaacacaaaacctgccccctcaacgagagaatctgcagctacatcttctctgaatgaagcatttccgtcagaaggttcttttatcagtagcagagtaagggaacagtttgagaagctgtcaaaaatgctttggttgaacaata

SEQ ID NO: 44777 - DNA, 235 bp, Triticum aestivum
  Clone ID: PAT_TA_44777
cgtccggccacccgtgctgctggactagcactacttctactgctatctcgttgcgtcccgacagccatgaaaggataggagtgaggttcaatgagaggataagtacatgccacacctagttcttacacagggcggagcgagctgtgaatcgagggctctgtctggcaaggttggtcatgaggagaaacacccaatcacctactgcttttctgttttcatgctcatgcttaaatcg

SEQ ID NO: 44778 - DNA, 126 bp, Triticum aestivum
  Clone ID: PAT_TA_44778
cgtccgcgtacgcttggtctctcctcatcccatatcttttatcgacaaggaccatcgagctttgagggccagcgtcatggacatgatcacgcaagctttggtgccttcccaccagcctaatcactc

SEQ ID NO: 44779 - DNA, 427 bp, Triticum aestivum
  Clone ID: PAT_TA_44779
cgtcctccttgccactgcagaaacctaggctgtaggaaagaatgggaagacagatcaggtcaaacatgaagcgcaaagtaaacatgtagacagacaaagcaagccgaggaaaccgcagaatcgtcgggaaatgcagagcgaaacgccgagtcggaagttggaaaacaagaagaaggcactgatgccagaagcagggcatatgaaaaagaagcctgagtatactgtggtgacacaacaggagattgaagaacttgcaaaagaacatgtcagttttagcaaaccagcatatagcacacatggcgaaggcggtttgtcagaaccattgttaatagtagtgagaggtcgtaacatatactggagcagccttcttggaccaatcattacagaaaaataacttgaggatcttaggagaaagcatcttgaatca

SEQ ID NO: 44780 - DNA, 233 bp, Triticum aestivum
  Clone ID: PAT_TA_44780
cgtccgcccacgcgtccgcttcctcctaggaatccacgccgatccaccccgcctttgacacttgggggtgggggagctgccaggaacgcctcattcaccttcctcctccaacctggtgctggcacgtggcctacttgtctgaaccttatgcgtggaccttgcaaggccatcggttcccgaccgcggtggtgaccgtatgatgcctctctcccgagtttccagatcgggagagg

SEQ ID NO: 44781 - DNA, 166 bp, Triticum aestivum
  Clone ID: PAT_TA_44781
gcgcactcttccgcctacctctccaatctgtgatccccactactagcgctatcctaatcctaaaccctgagtggggcaagggcggcggccattgccatcatttacgacatccatgaggaggaggctgcgtcgtatctgtctaatgcgttccctgccccggcggcgg

SEQ ID NO: 44782 - DNA, 317 bp, Triticum aestivum
  Clone ID: PAT_TA_44782
cctttcgcccacgcgtacgcggactcgtttgctttggtttgctgacatctacaccatacagggcctgggggaattggacactggggtctttatagacttgtacggcctaccatgtgcaattctgaaacgctaccctcaactgctttagcatgaagctccctccaacctaaggcagcgtaattggcaaaccaaccggagtggtcctttgaatcccgaaactcggcggcggcgggctctccaccgtgcctactggcatcaacacggtattggcctttccctttctgcctccgcgtttttactttacgctgtcgatcttt

SEQ ID NO: 44783 - DNA, 107 bp, Triticum aestivum
  Clone ID: PAT_TA_44783
tcgtctcacactttatacacttacattggtttatttagctagctaggcggagattgctatgagaggggaggtgatctatactctgtcttgcctttaatcttcttttc

SEQ ID NO: 44784 - DNA, 197 bp, Triticum aestivum
  Clone ID: PAT_TA_44784
cttccgtagtgtctttttctccttgcttgtcatcctcgcgcaccttctggagttattctggggacggggtaccttcctacggggtctcttcctctccttaaccacccggagctccatggccaccggaccgtagcctgggccgttaacatggatatatgagcctgacaggaatctggggtcagaacttgcccaaacgg

SEQ ID NO: 44785 - DNA, 241 bp, Triticum aestivum
  Clone ID: PAT_TA_44785
cgtatctaaacgccagtcttccctatccaaaccatcggtccttttctgcagtcgactcctgatatggggtttctttctggcagacgagccagctgtagtaagtcatggatcggtacctgagggtggagaagccgctgtgaggaggtgcctatcaaggttaacgatgattctaatcacctctcagggtatgtatctcagctacattcacctactcctcatatccttttctaggttaagggtt

SEQ ID NO: 44786 - DNA, 406 bp, Triticum aestivum
  Clone ID: PAT_TA_44786
cgtccgcacaaaccaacctacgcccctggatctaatctatatattataccttcctgcacccgatagtgtaccggcggctacggacgggcgggcccacattatcaggttctctccctgcttcgctctctacgccgtgagctcccggaggagacccaacggagaggggaaggaagaagcaaagtctcggacatggcacgtggacttcctctggacatcgagcccggggaggcgcccagagctggtgagacggtttgcttttcacgccaagctcttcagctgtggtgttatgcaatataattgggcattctgagcataacataaaggacgacgaatactctattctgatgacgccagcataacatgcatcgggtgacaacaccacagaaatattacctcagtaatccca

SEQ ID NO: 44787 - DNA, 359 bp, Triticum aestivum
  Clone ID: PAT_TA_44787
cgtccgcccacgcgtccgtttttctcctcctcctgccaccgatcccgaaccagggaggaacccggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctgtgaagaccaccattctctacaagctcaagctcggagagatcgtcaccaccatccccacaatcggttttaatgttgaaactggatagtacaagaacatttattttaccgtttgggatgtc

SEQ ID NO: 44788 - DNA, 342 bp, Triticum aestivum
  Clone ID: PAT_TA_44788
cgttcgtcaaatcatgatttaaagactcatgccaataaatctaaagcgcgccttgatcagttcaagggcatgggcaacccaattcattttcataatgagagagttaaaccccccaccagtagctcgcggaagtgctcgattgtactcttactacgctacacaagattggtctgacctgtgatacgagaacacgatggctaacaaatacaacagctcctgtggtggtaagagtaacagattatgctgagaacttgtttggtggagaaggaagccctacagaagagcacccctgtacacaggtcgcctgttttcacttctgaagaggcctaccagaaagtttta

SEQ ID NO: 44789 - DNA, 287 bp, Triticum aestivum
  Clone ID: PAT_TA_44789
cgtccgaggacacctagagcgagacttttatacacaaagtgatgctttggtatgttggctctagcgccacacgccggctgtttaacgatgaacacatcacgctcataacctaggaaaactgagttggcttcggatgaatattcttctctttcatagccacccttgagatgcgcattgatcactccggctcaacctaacagtttgccggactcacgtcagctaatgttcagcttacggaaagaggtgtgacctatgtgagaccactacaatgcaggaacaagagactg

SEQ ID NO: 44790 - DNA, 201 bp, Triticum aestivum
  Clone ID: PAT_TA_44790
tcttccgtaataaatgaacacattcattattttcaccaggcattgcttacaggcatatatgtggatggagtcataatagtctggtgaaaataattaatgaataaatgtacacattctaaaatcaaaataaaaagggctgtctatctataggattcaagcttacgtactcgtacatgcgacgtcttagttctaatatagggt

SEQ ID NO: 44791 - DNA, 292 bp, Triticum aestivum
  Clone ID: PAT_TA_44791
attccccgattcgacccacgcgtttcgcagactcttgtggattttctctctttacactgttatcagcgacttttgccctaactctgtagcgagggattgggccacccacatcaagcgcgtcaccgactacgttcttgattgcccgagaggcatcaaggtttctccgacacgaccggatgcccagcgtgctttgatgcatttagttggccctgggggcagcccacgcccttcggctcgtggtgcgagcacgctttatcctgcatagtgggacggtggctcatgtcttcagacg

SEQ ID NO: 44792 - DNA, 130 bp, Triticum aestivum
  Clone ID: PAT_TA_44792
cgtccgaacatactctcacccaatctcgtcttcgatcgactccactctcgtcgaatactccttccggggcggcttatgatgcagagttttgtgaagaccctcactggcatgaccattaccctagagggtg

SEQ ID NO: 44793 - DNA, 209 bp, Triticum aestivum
  Clone ID: PAT_TA_44793
tcgccactcgttcgcgttcgcttgggcccacgcccattatgtgcgctttccacaatcctatagcgaggggtttggggctcgtctccggtcaccattgtgctcttcatgattttccagggcaccatgttcttcttggctggttgttccacgttttatgcggagttttcagatgactggtattacattgaggtcccttttcatgctcaagg

SEQ ID NO: 44794 - DNA, 166 bp, Triticum aestivum
  unsure (1)..(166): unsure at all n locations
  Clone ID: PAT_TA_44794
tcntccggtgaggaagaagaataagggcgctgcggtgaggaggcagtgccaacacttggtatcagaggggggttgttttgggcgtggttcgcccaacctcatgcgtggtggcggtgactaagttctccggcggctgtgggatgcttcggtccgagtgtcggtttat

SEQ ID NO: 44795 - DNA, 118 bp, Triticum aestivum
  Clone ID: PAT_TA_44795
tcttatcgtccacgttttactttaacgctttgctctatccccaagctccataggcttcttaatctgcttgggtctttgcatcgacggcatgtccccctaccaatcattcgggtaggat

SEQ ID NO: 44796 - DNA, 329 bp, Triticum aestivum
  Clone ID: PAT_TA_44796
cgttcgtccacacgaccgagtttaccgattcacctcaccccaccctgccactatcagatctgctccggcctacgctcttaccgttgccggcgatggtgggatactcgtaccagccgatgcttatggatgggcacaagcattttgtggtccttgtcgaggccgtgcttaaatacatcggtgcccgacgtgagctctgtgccattacccggacctccgttggtcccaacggattgaataagatgggcattaattatctagacaagctctttatcatgaggtgatgctgcgactattgttaacgaggttgttgtccagcaccctgctgttaa

SEQ ID NO: 44797 - DNA, 281 bp, Triticum aestivum
  Clone ID: PAT_TA_44797
gcgacgcgtacgcccacgcgtcctcccacgctttcgatcacgcttttttccactattagtgccccaacccggagggcgcgcaagtagaagtctagtttgaattcctgggggtggaggagagaccgatggcgcgttcgaagcagacggcccggatgtcgaccggcgggtaggcgccctgaaagcggctgtccaccatggctggttggaatgtcggtgctctccactgggcggcgtgaagaagcctaaccgttacaggctctggattgtggtgctgggtgtga

SEQ ID NO: 44798 - DNA, 203 bp, Triticum aestivum
  Clone ID: PAT_TA_44798
gctacaaatggctccgtcttcttcgttcccgatcatccacatggggctgctggccggtgaggagcgtgctgatgcgatggacctgcttgatgacgcatgcgagaactgggggtttttccaggttctggaccacagcatcttcacggtgtctgaggacgatgttgagaatattactcttgagcactacaagagggtgcgcgagc

SEQ ID NO: 44799 - DNA, 241 bp, Triticum aestivum
  Clone ID: PAT_TA_44799
cgtccgttaggtcattgctatgctaacatttggattgaccgttttaatttctcttgaaaaggcaggtgaaaggacatttgggcaagttgttatagttacagcagctgctggtggaacaggacagttctgggtacatcttgcaaaactagcgggcaacatggtttttgtcatatgtggtggctaaagtaaggctgcatttttagctttcttaggtggtgatcgagttattaattactatcat

SEQ ID NO: 44800 - DNA, 313 bp, Triticum aestivum
  Clone ID: PAT_TA_44800
tattgagccatacttatctatgacgcgtgggttcaaaggcgccatcatgttcttaacgaatcatatcgtccgtgaggtcgggctgttacaaggcgccccgcaagcatctctccaccaaagctgtgaggaagtttgttcctactaccggtggagtaaataagctttatctgttcagggccgggaccggggcgctccggttgtgtcgcaagtaccatatgagcacggagctgcttatccgcaagctgtctttccaggtcctggttcgtgagatcgtgctttacttcaagacggaccttaggtttctgagctcatt

SEQ ID NO: 44801 - DNA, 261 bp, Triticum aestivum
  Clone ID: PAT_TA_44801
cgtccggcaaccctcggcagaaactgagagaaggctctttttaccataaccataccccaaagctcgcttatcgtcgtagctgctcatctagctagagccattgcgccgaccacggccatggagacacccatgggaagacaccttggaaccacctactggtgcgggagtgttacaccataaaggcgtgcggcgatcattattcgacgtcgagagtatgcgcacaaggccgtgtcacgtatattatagcgtctgggtgcggcc

SEQ ID NO: 44802 - DNA, 174 bp, Triticum aestivum
  Clone ID: PAT_TA_44802
cgtccgtggacgcgtgggccaaagtagcccatgagcacatgtgactcttactccaatcctgacaggcgaatgcctgccgtctcagctgtgtcaggtaatctgaatggctatgacgatccaagccgtgttacaaacttatatgatccagtcagcagtaaatcgttgatgacggat

SEQ ID NO: 44803 - DNA, 235 bp, Triticum aestivum
  Clone ID: PAT_TA_44803
tcgtcctttgactcttgctcagtctattgctgcacacacttaccgttttgtcacgtgagaggagaagcctgtagcgctctttcttgagcggttcggtgaaggatggccgtctgctctgacgccgacgggtagcgctggttcggggtgttcatggacttcttgtacagcattttgcgcgcgcttgtagttatttattctccattttttttttcttgtcaatatcgtcgttttcctt

SEQ ID NO: 44804 - DNA, 242 bp, Triticum aestivum
  Clone ID: PAT_TA_44804
cttccgtaatattcatacaatctataccgtcaattttatggttggcctcgctttcttccagttcaggcactatgctctgcagggggtgcctcatggtacggttgaccttgttttttcccattcagacatggatttgggatgaacatgcataggagagggagagagcacaaagtggggaggtgaaacatatgcatttgtgtgcgtagaagcaagcaattcgcatttcggtcctttcttttttt

SEQ ID NO: 44805 - DNA, 292 bp, Triticum aestivum
  Clone ID: PAT_TA_44805
cgtccgcttacgtttggagtttgcatgcatgcatgcacgcatgcacaagcacgtctcgatctcgaaggggggggctttgcatgagcccgaaggagtcaagaacgcaccatgcttgtcccgttcctctcgccgcggccacgtactatcatcatcttcttctttctttttctgtattttcttcttctcctcccttttgatcgtcctcccatcgccgcagcaaaggatgaatggttcgggtattgacttctgtccatcaatgtaaaagcctccaatcaataaatgaacattcaga

SEQ ID NO: 44806 - DNA, 126 bp, Triticum aestivum
  Clone ID: PAT_TA_44806
cgtccgttttttttttgacaatgtcacagcactagaagcagcatagctgagctaagctaagccagtggcggcaagagtggcaattctgttcatggtggcactcgttgccttgacaaatttttgcaa

SEQ ID NO: 44807 - DNA, 241 bp, Triticum aestivum
  Clone ID: PAT_TA_44807
cgttcgtccacgcgtacgcccacgcgttcgatttattccccacaactacgaagagagtagtcttccagtcttcgtttttgtctacactctagtgaataccggaaaggaaagggcaaaagtcagcctagtaatgacctgggcgaattctataggtggactttcacatcagtctggtggtcatgtaaatgaaccattcattggagaaaatggaatttttggtgttttcctacattcacaatga

SEQ ID NO: 44808 - DNA, 265 bp, Triticum aestivum
  Clone ID: PAT_TA_44808
cgtccggatggattggagaacaactccaggggggagggaggaagcactgaaggtcaccatggacctcgcccaactcccacccagcttcctgtctggagctgtaagccaaataaaggatgttgttctcggcggagtcgcgcttgagcatgagtcgacagagaaatctaatcaaagccaatagcttgactcgggtctggcaactgctattgtcgtggaggcagggcgctcacccgatggcgggataccccgcccagggcgtggtcca

SEQ ID NO: 44809 - DNA, 291 bp, Triticum aestivum
  Clone ID: PAT_TA_44809
cgtccgcggacgcgtgcgtctatctctgtctccctttctctctcgcaccggaccgcatcctctccctgtactgtcgggtgcgctcggccatcaaaaggttgcacgcagaggccaacagaagaaacacctttctgtggggggccagtcaaacctcaacaggcaaatttcatgcctgatctacccgttactctgccatttgccttcgatcctattggtgacgcacaagctgaggatgcttgtgcacgcttcggcgcaaaagattatgctcatgtgcgcatccagcagcgcaac

SEQ ID NO: 44810 - DNA, 272 bp, Triticum aestivum
  Clone ID: PAT_TA_44810
cgttcggacgaacattgatacctgtcgctgatcaccgctgtcgtcgtcgccgacgccggaggagccacgccgatcgtttacatgaaaggccgaagctatcacaccgagggaccgctcacacctacggcgccgccttgactttcagcaagcgcgacctcgaagacgagctcgtctaagactctgaggaatagggcgacgaggaggattgtctactcgtcgtcggcgtcggagtcggagtctgagaacgatcagttagcggagtgggagatgaa

SEQ ID NO: 44811 - DNA, 232 bp, Triticum aestivum
  Clone ID: PAT_TA_44811
cgtccgcccacgcgtccacaacaacaaggcatatgtcaattaggctttatcccagctgatgctggttgggaaactccatactgacagagcagcatatcattttaggtaactgtgggggtttcagtccatctgcttctaagaagagcccctttgatatgatcgccgtaaagtcgtcgaattactttgatcttttaagcccacaaagcaaccagaatggcactacaaagaacct

SEQ ID NO: 44812 - DNA, 277 bp, Triticum aestivum
  Clone ID: PAT_TA_44812
cgttcgcccacgcgtgcggcctatacaaggtcagtacaacttctaaggaagatatgatctggtgaagttcatcagagaaatccatgctcaaggcctctatgtgagcctacgggttggcccctttcgcgaggcagaatggaaatacggaggcttgccattctggttgtgtggtgtcctaaacattaccttgagatgcaacaatgaaccctacatggtacataatgctaaaatttgtcgctaaatattgtaacatgtgtgaatgatgaaaatttatatc

SEQ ID NO: 44813 - DNA, 346 bp, Triticum aestivum
  Clone ID: PAT_TA_44813
cgtcctctctctccctctttctccccaccctctccgccgcattcccgtttcccccgacccttaccccgggcctgttgctcccgttcaaaccctaaccctaaaccccacccgcgcctccatccaatccctgcctggcgcccacccgttcccggcggcccggattaggatttgccgcgccggaccgattcgatcgaggtaggcagtgagcatcgctggccactcagtacacaagacacgcgcccccgcctcgagatggctgctgaggggtgacaaggaggaggggagagtagtagagggagcgccccagcgttaatggcatttgggagatctcatggcgtccaggctt

SEQ ID NO: 44814 - DNA, 269 bp, Triticum aestivum
  Clone ID: PAT_TA_44814
cgttcggtcgacatcgattaagtaccatggggtgagattcataatatataagaagactcgccttgataaactttaagggatgcatgagtacagttagtttaaattaatacctttaagcattgtgatttatcagtgcacagttctggtgtatatttttttaagtatattgatcatatggattttgatccttgttttggattttatgtaatataacgttatttttatgtgacttttttgtgtttatgatatattgtatttactttttcctt

SEQ ID NO: 44815 - DNA, 282 bp, Triticum aestivum
  Clone ID: PAT_TA_44815
cgtccggtggacatacaggcttgcaacacaccggagctgtctcgtgcacgtcaaccctcagcagcagcctgatccatcatgttgtcgccgacacggcgcgcccaaattccctgtgagagcatccccaccgagcttgcgggcgtggagctccgctgcctcccttgccatgccgaccggttccgcttggccgccgactgcaaacagaggcgcgcctctgcgcggcagacctatccgaccccgcactacccgtggctcgccttgcctgaccgcacattatacagg

SEQ ID NO: 44816 - DNA, 292 bp, Triticum aestivum
  Clone ID: PAT_TA_44816
cgtccgacgctcctcccctcccccgcgtcgcccttcctggcggcgacgggggaccctagcccacaccgtggcagcccctcccacccccaccccgcaccttgtcgccgtcggaggagcggtcggcgaaacccgtgcctgctcgcaggaaggtggtggcggggcgtctccgttgacccctgcttccagcgcttggcgtctgggaggtcctgcttctgcgccagatctgacgcttctgctgcccctcccctcaaccgcgtcggggggcgccggacctgtcttgggctttctctgg

SEQ ID NO: 44817 - DNA, 212 bp, Triticum aestivum
  Clone ID: PAT_TA_44817
cgtactcggttgtagctcattgcgaggaagaggaagcgaagatggtgaagttcctgaagccgggctaggcggtgattctgttgcagtgcatgtacgccgagaagaaggcggtgatcgtgcgcgtgttcgaggagggcacccgctaccgcccctacggtcactgccttgtcgtcggcctggccatgtacccgaataaggtgatccgcatggtc

SEQ ID NO: 44818 - DNA, 258 bp, Triticum aestivum
  Clone ID: PAT_TA_44818
cgtccgcccacgcgtccgttcctccatcagctcaactccatagctttcccgaacccttcgcctgcgttccacatcctccatcctcctcgctctcacccatgtcgtccgtccagtgctccgcctgcggctcccgcacccaccgcaggaaccactgcgccgcctcgccttgctcacgctgcgggggaaacggccacttcgaggccctctgcaccacccccgccggcttcgactcggccagcgccacccgctgcggcgtct

SEQ ID NO: 44819 - DNA, 295 bp, Triticum aestivum
  Clone ID: PAT_TA_44819
cgtccgcggacgcgtgggtttgtggttccagggtttagctagggttctacccacgatcaccggcgccgtccgccccgccgccggcggatccatggccggcgcccgcgccagagaggaggacgcggtgtggctagcgcgccatcagcgcgggcgtgcaagagcgcgccgctgttcctcttgtgcggccagaaaaccctaaccctcgacggggccgtgaagttctccaccggacggctccccttgtcgatactttttgaccggttgccctcgctcgaggagctcttcgtcgcgggcg

SEQ ID NO: 44820 - DNA, 305 bp, Triticum aestivum
  Clone ID: PAT_TA_44820
acccacgcgtccgcggacgcgtgggggctcagggctacccgccggccggctacccccagcagggctacccgtcgcagtatgcgcaggagccgccgccccaccagcagcagcagcagagcagcggtccttccttcatggagggatggtaagctcctcgtcccatctcctcgattttccctacctgcggggtcccgagcgctagattagatcaaagctcgcccggggcttgtgcttagggctgtaaatcatgatcggccgtgtcagatctgcccgtgcacaccggcggcgtcccctttctccgtcgg

SEQ ID NO: 44821 - DNA, 320 bp, Triticum aestivum
  Clone ID: PAT_TA_44821
cgtctcggcgcgcgacgcctatcaccaggcgcctttctctctctcgcgcgacgccgttctctccgcgttgatgctccctctctctccctctcgccggcgtcttgctccgcatcgccgctcaccgctccccaccacacaaagctgccatttttatttgtcggcgacggctgctgggcgaggaggagctggatccacatgcgctggtccttgatctgcttgtggataggcgtgaggagtcgctgaagcggagcccgcggcaccggcgcgggcgtgaagacgacgacgggaggatctggagcccgagcgggaggatctggagc

SEQ ID NO: 44822 - DNA, 223 bp, Triticum aestivum
  Clone ID: PAT_TA_44822
cgtccgcggacgcgtgggggaacgtcggtcccctcccctcctgcgcagcagccggggcgcgctggttctagccgggctcctccggcgtacaaccctactcctctcgggtctcgggtccagcccttcggctccaccctgcccttcttattctgacctagggtttgtgcgcccctgtgagcttcgtccccgctccacccagtagcgggcgttcctatctgtcccc

SEQ ID NO: 44823 - DNA, 297 bp, Triticum aestivum
  Clone ID: PAT_TA_44823
atggatgtttaaatcattgtattccaataactctaaaatgccagaaggccttgaatggaccagtatcaggaaggggagactctcctgagaagtttcattaataatgttttaattactctctttcttatataccgttttcctgtcatgtatatggttgtccttttaagtatagcagtatggaccattattaccgtatatttatttacttattaaggaaaacaatttatgtttcttatggaaggattctaactgtaattcaattttaagggtaaatatttatagacatgttgtggaata

SEQ ID NO: 44824 - DNA, 329 bp, Triticum aestivum
  Clone ID: PAT_TA_44824
ttctccgttctacccacgcgttcatctaaagaatgatgagcttaaccaaggtcatagtgcttgtaaccggggcctcaggctttctggccttttggctcatcaaaagactttttgagagtggatattttgtgatagggacagtcagagacccatggaattggataaaaagtcggacacctattgaaattacctgttgcatatgagaggctccaacttgggagagctgatttattggaggaaggttgctttttatgacgctgagtaggtttgttagggtgtcttccacattgtattaccttgtcctagggaaattctgactccaaattgta

SEQ ID NO: 44825 - DNA, 386 bp, Triticum aestivum
  Clone ID: PAT_TA_44825
cgtccgcggacgcgtgggcggacgcgtggggtctcctctcctctcctcgtgccagcagtagcacccaccacccaagcaacggagagaggccgtcccctccctccctcatcctccctacgcctgccgcctctcccacttgcagcggcattgcctccgctctcactccagtcctcccccctcccctcggccccgccgctcgagggagatagcgtcgcgtgcagctctgccgctcctacccgcttaattgctcgccgaggcagccggaggaggtagctaaagaaagagccgctgtggcaggcgacgaaaaggggaacgaccaccgaccatggcaagggggtgaatgctgccgcgcccgcgcgagtgagccaactcgcagatctacgccc

SEQ ID NO: 44826 - DNA, 208 bp, Triticum aestivum
  Clone ID: PAT_TA_44826
cgtccgcggtacgcgtggtgaaaatttctgcagacacctctcatttttcgttcgttccggatcgcgagtttccaaacccaaaccctataggaggcaggaggatccagcgcggcgatgttggtggcgtacgcgagcaccgtcggcggtgatccgcagatgctgaagcggatcgtggtgggagcgtacgactactagaacgacgcgcggt

SEQ ID NO: 44827 - DNA, 212 bp, Triticum aestivum
  Clone ID: PAT_TA_44827
cgttctcccacgcttacgcgcgtcgtcctccctcagggtgactcgggcggcgccgctcctcccggcggagcaggccctctctctccagcttcccctcccctcgccgccgccagacggactccttcggtcgaagcccctacggtttcggcggtggtggttacctgttgaccctggtctgttttacacgcgtcgggatctcgtgttctggtgga

SEQ ID NO: 44828 - DNA, 344 bp, Triticum aestivum
  Clone ID: PAT_TA_44828
cgtccggtacgcgatctatgggagctgcagcaaggcaacaccagcggaagtccccccctcagtgctatacgtgagaaataccggcagtaaaagtttgaatgtgtagccaacatgctgtcgccggcgatgcctgggtcgctcttccatagacaagctaacggcaccagccccctgctgatcaacaactcgtagcagcgcagcgtcagccccctgctgatcaacaatttgattttttccgaagatcttgtagcatcctttttttttttttgaataaaagatgcgtgattccatttatcaaaccagagatttgaacaatcgatggctcccacaggacatacaaggag

SEQ ID NO: 44829 - DNA, 210 bp, Triticum aestivum
  Clone ID: PAT_TA_44829
ctttcgcccactcgtacgaatctatttgacatgttcatagatctatcgtttttaaatgtgaaggcaggctctcctgaaccttttaaatgatgaccctgaaatgctgtggtgtctagagcaaattggcgatggtgcttttgagggtaatggttcttatcttaccaatggaaattcatgcattcaagtaagacctactgccaccttcattac

SEQ ID NO: 44830 - DNA, 217 bp, Triticum aestivum
  Clone ID: PAT_TA_44830
tcgttcaacccatgcttcctctttatcttggcagtctggaacccggggttccacagtcatattctcttcccggtcttggcgagggggcatgaaacaggcgaccgaccggtcaaaacaagctcgctcggcgcttcttccgaattagaccccgccggatctttctcatccagggaacagaggggaggaagaagggggacacctatctatgaatgcactt

SEQ ID NO: 44831 - DNA, 121 bp, Triticum aestivum
  Clone ID: PAT_TA_44831
cgcctgcagtaccgttcactaattcccgtttcttcccacgcgtccgctcacgcgtcttgtcggcggcagcggcatgatcaagatgaactggagtatggtgcgcgaaggccaaggttcgagt

SEQ ID NO: 44832 - DNA, 168 bp, Triticum aestivum
  Clone ID: PAT_TA_44832
ctgcaattccgttccttaattccattatcaacccactcttacgactaaatcatccgtcgcttttacttcttcggatgtaaaacaaagagcttcatgtttgccggagcgagagatatggctaccaatggcgatgggcctgtaatcggcatatgacctttgcacgacgta

SEQ ID NO: 44833 - DNA, 165 bp, Triticum aestivum
  Clone ID: PAT_TA_44833
cgttcttggtctcgtgggcggacgcgtggggttagagatcatttcttgatttcgaatccgggcgcagagaatatcccaggcgagcgagatggttacagtctggttggtgatcaagtgctatgcctcggtggcattggatgtgggaaagcctgttgttcatggagg

SEQ ID NO: 44834 - DNA, 359 bp, Triticum aestivum
  Clone ID: PAT_TA_44834
cgtacgcgactttcaagctcagcagcatttgtctgttcggcaacaattgctatcatgggaattctgggtaaaaacttcccaaagaaagaagttgcccaatttacttgtaaatctgagcgccatattgggacacagtcagggggcatggatcaggctatatctatcatggccaaacctggatttgctgagttgatagatttcaatccaatataagcaacagatgtgcaactaccttctggtggtacatttgtgattgcccactgtttggcagagaccaagaaagcagagacagttgctacatactacaacatccgcgttgtatagtgtcgtttggcagcgattgttttcgtcatcaaact

SEQ ID NO: 44835 - DNA, 134 bp, Triticum aestivum
  Clone ID: PAT_TA_44835
gcgtccgtgacctttcacgtaattgtctctccgtcaccgcatattctcccgattatttcctcccatcgtgaatactcctttgtcttatagaaaacgacgcacgggcaggtgccattattcaaccaaagcaagcc

SEQ ID NO: 44836 - DNA, 151 bp, Triticum aestivum
  Clone ID: PAT_TA_44836
gcgcgcgcgcctcatttcatgcctaggtcggcaaaaccttagtgtctactgttcgttgttgttccaggttattaccatgaggacaaatgtgtttggatgcatgattatctaataatggggctgatcacttttcatttggttaatgcttgat

SEQ ID NO: 44837 - DNA, 323 bp, Triticum aestivum
  Clone ID: PAT_TA_44837
cgtccgcggacgcgtgggtaaacctccaaaatctgcgatccggatctttccccaattccaaacccggcctgccccgcccgggcgatcccccccctgcgcccccctccgctcctccgctccgcggacggccagccatggcgatctccaccgattctcgcagcgaggaggagccttcacagcattctcaggtggagaagcggtgggtgttggctgactttgacgttgggaaggcacttgggaggggcaagtttggccatgtctacttggccagagaaaagaggagctttcatattgtggctttgaaagttcttttcatgagccaa

SEQ ID NO: 44838 - DNA, 278 bp, Triticum aestivum
  Clone ID: PAT_TA_44838
ctagctcattcactgtgcgcggtcgacctctacttggtatctccatcctcctccatacgccagacctttttggaaggggaaggctccgagccgtgtgagagacgatgaataaggggggtctgctgcggtgcgtgtcgacgggggcgtgcagggtggctgccgggggccgtggcagatatgtccatctcgtcaacggcgtgtgataaggtgccggcggggcacgtcacggttgaggagggtccagaagggggaggaagacagatcgtttttttattgcc

SEQ ID NO: 44839 - DNA, 195 bp, Triticum aestivum
  Clone ID: PAT_TA_44839
cgtatctctttctttgatttttgctgtcttctactccaatccattgaccctcgtcgacttcgaccaggactggggactcttcctggggcgtgttcgactctgatgacggtcgcatattcatgcaggcacactcttctcctacccattccttttccagcttcgaccgaaaggaggttgatgaccaggaggaagagg

SEQ ID NO: 44840 - DNA, 145 bp, Triticum aestivum
  Clone ID: PAT_TA_44840
atgaccaattctatacgtagggtagcactttgtttgtggacggagggagttccttttaattagaggctatatttcattccatggtgcttactaatctttatttttacttaatatgtatgccttctttcgtgtgtatattcataaa

SEQ ID NO: 44841 - DNA, 332 bp, Triticum aestivum
  Clone ID: PAT_TA_44841
cgtccgcggacgcgtgggttttctttttttttttctgtgctcactcatttcagatggagtgacatggtctgctcaaatcaaggttaacatatttgctgtaaatcaccacgaattgttttacaaaacccctttcactcgggtcacacattactactactgcttccagtacatccgagcttgcagttggtattaacaactcattcccttcttttgtttcctctcaactacacttttgcttcttgggcttcctgtgaccaccaacaacgcaggcgtggtcgcgctcaaagggctccagggtcacctgatccgagggcttgtactggtccgccttc

SEQ ID NO: 44842 - DNA, 360 bp, Triticum aestivum
  Clone ID: PAT_TA_44842
ccacgcgtccgcccacgcgtccgcccacgcgtccgcggacgcgtgggatctttgtagactagttcaaacaaagtgccagacagatttttacatcaaattagtcctttttttctttctgacttactgatctgagcttattagtgtgttttcttttcttaataggattccttttggatttttttggtttaactcatgtgcaacactgccttccatattaccatcaaagtaaattgtctcatatcatcagactttgccgcctttattgggtgttttaccatcatttttcaacaatcttgttctcactaggtttattatcaagtcctgttctcatggaaggatatcaaagtatggcttggaaga

SEQ ID NO: 44843 - DNA, 184 bp, Triticum aestivum
  Clone ID: PAT_TA_44843
cgttcgtccttccttatccaattaatgtacggggggagaggaacattgataaacttcatgtataggagggggctctattggggggcggtggcctcccaccaagaaaagcgcatgaagcttcagatgacacattgtgagggcctcttgaccaacggcaaccaggagtatgggtgcatgcacttca

SEQ ID NO: 44844 - DNA, 345 bp, Triticum aestivum
  Clone ID: PAT_TA_44844
cgtccgcccaaccctatcatccatggcgtgtgtgctccgagctcgcgaaaacaaccgtctgatcatcatgcctcgccgaagaaggcggcgtctgcaggacctctatctgccggcttggggtataatccaccatgattgattggcctggctcaagaggtgacccttccatccatcttgctgtcggtatcttatctgaattcagacacacgacgaatcgtcggagatcggatcgtgaatgggcttctccggtccgtttggggtgccggcccaacggccccagtggaggcgctagatgccggatccaactgtacctgcccaaggcgtcgactttcattagctcaaaca

SEQ ID NO: 44845 - DNA, 238 bp, Triticum aestivum
  Clone ID: PAT_TA_44845
tcgaccgaccaattcttttacattctatagtgctattatgggttacgctgtcatcgtcatcatgtagggggagggggtgcaggagcacatctatcggatcatttttcctccagtggccgtgccggatggcgttaccgtgcctgacttagtgctggcgggcgcagaggcctactccgtcaaggttgcccttgtggaggccgatcccggatgtctgtcctacatctacggataggggttc

SEQ ID NO: 44846 - DNA, 359 bp, Triticum aestivum
  Clone ID: PAT_TA_44846
cgtccgtctcttagtaacggtaccatcatatttctaccttttttgtatttaatctgtcctgaggctgggtgaatcctccttccccaccgtctcatgatgcattaattttgtgaagacactgtcggtcaagaccatcacccttgaggtggagtcgtctgacaccatcgacattgtcaaggccatgatccatgacatggagggcattcctccagaccagcagcgtttcatctttgctgggaagcagctggaggatggccgtaccctcgttgtctacaacatccagaaggagtccaccctccaccttgtcctgcgtctgtgtggtggcatgcagatctttgtgaagaccctcactggaaaga

SEQ ID NO: 44847 - DNA, 332 bp, Triticum aestivum
  Clone ID: PAT_TA_44847
cggcgatcacgccgtcggaggagcagccgcaggacggcaaagcggcgggccaccttacggcgggagcggcaatcgagccatcggaggagcagccgcagcacggcaagcgggcggaccacgtcgcggcgagagcggcgatcatgccatcggaggagcagccgcaggacggcaagcaggcgggccacctcacggcgagggcggcgatccagccatcggaggagcagccgcagggcggcatgcgggcggtccacctcacggctgccaagggcctgctggaggaggagcccgccgcgcggctggcgtacgtccggacggaggagaagaaggacagc

SEQ ID NO: 44848 - DNA, 283 bp, Triticum aestivum
  Clone ID: PAT_TA_44848
cgttcgccgaagcccctcccgtccactgccattgccgtcatgcgccgccccgccgcgccgtttcccgcgctccgccgtccttagccacacagcctctcctcggatccactccccttcattaaccactccgcccgtctctgctcgagctagccggtccttcgaaccggcccgtcgccttgtgctccgcgtcgcgcgctcgtttttgcctgccgcggttggcggggactgacctcaacaccgaggaggaggacgaggaggagtcctcccgaggagctgccgcttc

SEQ ID NO: 44849 - DNA, 308 bp, Triticum aestivum
  Clone ID: PAT_TA_44849
cttcctttccgcttattcctctctaagctacagccccggccatggtggtgacaatccattccgtgaaggccggccagatcttcgacagccgcggcaaccccaccgtcgaggttgatgtgtgctgctcagatggaaccttcgccagggccgctgttcccagcggtgcatcaactggtgtttatgaagctttggatctgagagacggtggttctgactacttgggatagggtgttactcaaggctgttgccattgtgaacttgattatcggaccagttttgattggctaggaccctacagttcaaacttg

SEQ ID NO: 44850 - DNA, 344 bp, Triticum aestivum
  Clone ID: PAT_TA_44850
cttcctcatacgcgtgtctgctcctcccagaggccagagacattcacgatggcggcgcccaccttctccggggcatccaccttcgtccccttcgcccaccccaaaaccctagccgccgtcgccgccttctccatcttctccgtcgccttctccccggtcggatcccaccccgcatgcgcgctcttagcctccactcgtcgacgcgcggtcgccgacatggtctgtggcccggccaaggtcggcgcggccatgccgttgctcgacttcgacaccgccgtctttaacaaggagaatgttctccctcgctcgtcacgaggagtacatcgtgaggtgcggtcggaacc

SEQ ID NO: 44851 - DNA, 258 bp, Triticum aestivum
  Clone ID: PAT_TA_44851
cgttctcacaattttctattctgtattttcttccttccgatcggcgccgtctgcgccgttgatgacgattgtggcgactttgaattaagatcgtgcatctatatcatctggctataggagttcgtgggctccttccccgtcggtgaaggctactccgaagtctgtttcgccttccctccctcggcggtcggtatggggagggccaaggggaatgcgttcgtccactcctcccccggcgagggatttgtttgccctccc

SEQ ID NO: 44852 - DNA, 404 bp, Triticum aestivum
  Clone ID: PAT_TA_44852
cgtccgccacggtcgtcgcgctcaacgccgttatcctttttgccaaggccaagctcctcgaggagggcctgcccaagctgcagcgcctcgcgctcaagaaggtcaaaggtgctcacaaaggaggaacttgcgacccgtagtgatctgtctgccgtcttacttgattgaaattaatcaataccggttggtagttattagtgcgacaaagaaaaatggaggttggtgagcctcatgatcccgtactgttgtaggcgttaagttcgtctctacttctgatggaaacttcgatgatgagcactttaaggggactgaagaatcatatatatttcgtctggaattatgagattgcgtagaatgaatcatgatgaaggtttggatgttattagtgtagggcctgcaactcc

SEQ ID NO: 44853 - DNA, 368 bp, Triticum aestivum
  Clone ID: PAT_TA_44853
cgttcgataaacgccaccaaatccaatctcgacctgtttttctgtcttacagttcaagttcatcagggagtctttgtctcccccctgcttcgtctccatgggccttaagttctacgtaggcggcatctggaaatgcaatggaactgcggaacagctagagagcatcgtcaacactctgaacgctggacagatcgcctttactgatggtgttgaggttaacttcagcccgtcctattgtctaacttcccaccgtcaagggtcagctgcgcccagagatacaagttccttgctaaaactgctggatgtagaagggcggtgcttaaacagttgaaggaatgtcttagatgcttgtcaacctcagcgttccc

SEQ ID NO: 44854 - DNA, 355 bp, Triticum aestivum
  Clone ID: PAT_TA_44854
cgtccgcggacgcgtgggaaagaaaaaaaaagtggtgtttgttcctcgtaaactgcagtgcttgcttaaagtgcaggaggaggccgcagaagagacatcattcacagtgatcttgattgcgaaatccggagataagcataccgtttttgtcttctcttccagtacggtacaatggcgagctggtccatggacaccatggactgctgagttatctttggctttcttctcctacctccggtacgcatatggctgcttctacggggtgacagagtgcaccgaaaagttgcttttgcttgacacccggacaatggagttctcatttgcttgacctcccacccgaagctagaggagaatc

SEQ ID NO: 44855 - DNA, 380 bp, Triticum aestivum
  Clone ID: PAT_TA_44855
cgtccggtcgtccgcccacgttctaatccgattcaaactcaccgtttcctcgtgtccgaactagggcccaatcccgttaccaccggcgctgttgctcggcgcgatggcgcaaaaggacaccgtcaatggcaacggtgccaccactcgcctcgcgaccactcccttccccatccgcttatacaagttctttcaggccaacatgcggatcctggtcaccggcggagctggctttatcggctcgcacctaggcgactagctcatggagaacgagtaagaacgaggtctttgttgctgacaacttttttactgggtcaaaagacaacctgaagatgtggttctgtcacctaagatttgaactcatcctgtacgatgttaccgaa

SEQ ID NO: 44856 - DNA, 254 bp, Triticum aestivum
  Clone ID: PAT_TA_44856
cgtccgtccactcgtccgacaaggagcaatttcagattttgtgaatccgtcccccgaatggaggggttttatatggaccacctgggacggttaagtcgtagatggctcgtgcaagtgctgcacaaaccaatgcaacctttttgaaacttgctggtccgaagctagaccagatgttcatctgggatggggcaaaggttgtacgagatccctttaagttggcaaaggaaaaggccccctgcattatttttattgat

SEQ ID NO: 44857 - DNA, 151 bp, Triticum aestivum
  Clone ID: PAT_TA_44857
ctttcgatttcttgcaagtcagtgttgccgtcatccttttccttcactaccaccatgctagagggtccctcttcaaacgtgtgggtgtatatgttgcttcggcacttgacatactctttcggtcctcgtttccacgccattcaattatcaa

SEQ ID NO: 44858 - DNA, 409 bp, Triticum aestivum
  Clone ID: PAT_TA_44858
tctttctgtatggctgacacccttcgacatgtccgctcgttttcatatatcacttaagatcattgcaccgaggacctgtcgttggccggcacaacgccatcgttacgccgcataggatgagatctcgttcacccacgccgcctgcttccgaagtacgtgccgtcacccgcgccgtacgcgtgccctaccaccaactcagccttccgcaacaggtgccgccggctttcggatatgttgtccagccgacggccaaggtgacggcgccgtgtgccttgaactcgtccacccattgctttacatttccaaccttgactaccatcgcctttcaacgaggatatcaaggtactgttttctgagatgggtggaatccagcgtctcttcattaactatgaccagagtggatgatcat

SEQ ID NO: 44859 - DNA, 131 bp, Triticum aestivum
  Clone ID: PAT_TA_44859
cgttcggtcggtagtgtgccactgaaaggctggccttttcagtcccagggatcgatcaactcggggcaagtttatgcgcacatggtgcagttaatgacatctacatacctacttcatatcttatcaccaca

SEQ ID NO: 44860 - DNA, 210 bp, Triticum aestivum
  Clone ID: PAT_TA_44860
cgttcgctcgccgccgtcgccactccgccgttgccgttcttcgagatgggtcgcgtgatccgcgctgagcgtatggatgcggtctccgccttcaagtcccacacccaccaccgtaagggccccgcccgcttcaggtcgctcgacttcggctagcgcaacgggtaccttaaggtgcgtgttaccgatgtcatccacgacccgtggctgtgg

SEQ ID NO: 44861 - DNA, 214 bp, Triticum aestivum
  Clone ID: PAT_TA_44861
cgtccgatcatttttatttagaatatcacaccgactttttgccccctggagctaaaaataagggttgtggatccggagacaccgaccgccaatatagagacatttgggcgggacacccactaacattgagtctctgttttctacccttcgggcataagctttgtgatctagacatatcccttgtggaaaaaacccaggtttaaacgccaaaagg

SEQ ID NO: 44862 - DNA, 423 bp, Triticum aestivum
  Clone ID: PAT_TA_44862
cgtccgatcatctttgtggtgatgctaacaaagaaactatgccgcctggagctttaaataatacttctgggatcctagaaatggatagcccatctagagagtcattggaagggcaattacttcgatttagtctctgttttctgcatttgtgggatgttgattgtgagctggacaaattacttgtggatgagatgcaagtttgcaagccagaaggttgtcatatagctacaggggtggtaggggacagaggctcgtttacggtgatgttcccagggaaagaagccactcttgagctttggaagtcctctgctgaattttgtgctatgaggtcgctgtcaatagtttcccttgcccaacgcatgatcacattatctcggtcttgtacaaatgctagcagtgccttggcagctttttatacaagac

SEQ ID NO: 44863 - DNA, 293 bp, Triticum aestivum
  Clone ID: PAT_TA_44863
gtcggagccacgcgttcccggcgttaacgtccaagttcaaacgcctcccattttcactctacccctagctagctcccagctgaccctgccgtcgtcgcgcgcccgctgatcggccgcctctccctttagattctcccttcggcttgatgacagcagtgacattcgatgtggaacaattattcttgctaacaggggcgcgacaccctctctagatgaaggtgatgtccgccccgtcgaggggccacttcgcgagttgcgcgggcgacgagggctcctagaactcgcccgtgttt

SEQ ID NO: 44864 - DNA, 229 bp, Triticum aestivum
  Clone ID: PAT_TA_44864
aacatgggacaatccgttcttgctggccagcaacccggagaaccgcagcagctcccaagagaatcacagctaccaacggacacagaagagatacgcgccatactatctccagccgaagaacaatccgtcaatgaccagcctaaagaacagacggatgaggatgaggcggctagcatggaagcaacccacagccagttttctccatatgcggcatggcacaaacaatatg

SEQ ID NO: 44865 - DNA, 147 bp, Triticum aestivum
  Clone ID: PAT_TA_44865
cttcctacctttacgatcccccgacgtctatctctatttagtattttacatcttggcttctggggtatgtttagagtctgttagagccctcgatcttacttttacgcttcctccatcgaacatcctagcacgatcagatttttttat

SEQ ID NO: 44866 - DNA, 147 bp, Triticum aestivum
  Clone ID: PAT_TA_44866
tcgttcggtgcacgctcgctttgcccactcgtgcgctttttctttgtcacctcgcttcgtcccgggcgatcgccctgtcctacaggtctgcaccatggccattcgaaccttcattggtgctgtatggatgagtcttccttagaattt

SEQ ID NO: 44867 - DNA, 112 bp, Triticum aestivum
  Clone ID: PAT_TA_44867
cgttcgatcctcccacccttcctcgtttaggaacattttttccaccgccgattccatgagtaaggtgcagattgacgccctgagggaggcaatcacacacattatcaatgac

SEQ ID NO: 44868 - DNA, 319 bp, Triticum aestivum
  unsure (1)..(319): unsure at all n locations
  Clone ID: PAT_TA_44868
ncgtccgtagagcatgagttccttgctgacttgaatccattgggatggatgcatacccagccgagtgaagcttctcagttatcacctcatgatttgacattacatgctaaaaatttggagaacatcaagcagtgggatggtgtgaagtgcatcatttttacctgcagcttttccctaggatcgtgcttgtagacttgcatacaaattgacaccaagtggttttgggagggctcgtggcaactatggacatcggtagcaacccacaagggtttttcccaacttactacgagaaggttcagaatgctttttagtgaccgct

SEQ ID NO: 44869 - DNA, 335 bp, Triticum aestivum
  unsure (1)..(335): unsure at all n locations
  Clone ID: PAT_TA_44869
aattccctacccnacccactcttncgttattagttctttctggaggcgcttcctggtgacaatgtcggcttcaacgtgaagaacgttgctgtcaaggatctgaagcgtggctttgtagcatccaactccaaggatgaccctgctcaggtggcagccaattttacctttcaggtcatcatcatgataccaccctggtatgactgttacggctacgccccagtgctggtctgcctcaccttctacatttctgttaagttgctgagtctgtgaccaagattgactggttatctggtaaggagattgaggctgctcccaagtttcctgaataacggtga

SEQ ID NO: 44870 - DNA, 112 bp, Triticum aestivum
  unsure (1)..(112): unsure at all n locations
  Clone ID: PAT_TA_44870
cctncgtcgcgactcatccttctcatcccaaaacctttttatagcaaaggcggcggtgcgacatggcagaggtcgaagctgtgctctcggtggcggcgacagagaccccgga

SEQ ID NO: 44871 - DNA, 413 bp, Triticum aestivum
  Clone ID: PAT_TA_44871
cgtccgcccacgcgttcgggcggtcgtccccgacacctcttcctttgccaccaaggcccaagaggtcatcgcgcccccctatggcgcgttcctggactccatcgatctgatgcccatgacctgttcgatggctggctcgacccaagtcgcctgtgctgcgaacgccaacgaggtccacaacgtcaccacatccgtccgtctcgagcctttggtcgcccacatccaccaggaggtcgacgccgagatcgtcaccccggtggcaaccaccaccgatgttttctccgccactacccaagcccaagagccccccacgttcgccaatgattcatccccagtttccattgagatgatggccgtcacctgctcgacggagtgcttgacccaagaagttgagcaacttcatgccggagtct

SEQ ID NO: 44872 - DNA, 154 bp, Triticum aestivum
  Clone ID: PAT_TA_44872
tactctttcgtaaggtcgctgcttctggctctatgtcttcctcttatctggtccaatgtgacaatacttggctgctgtacatcacgagtctcttccattcctcgcaagtagcactctggacaggtgctatcaatggatggcgttttcacgacat

SEQ ID NO: 44873 - DNA, 194 bp, Triticum aestivum
  Clone ID: PAT_TA_44873
cgtccgcggacgcgtgggttgagaattaagaagttggtgtatacatttctctatatttataatagtgtgtgagatattggggtggaccaaaaagttgaaggttggaggttccggttgtctccagtgatagtagtgtcgttttaccacccgactgatctttgtctctctagtggacactggaagtaaaggcatgc

SEQ ID NO: 44874 - DNA, 371 bp, Triticum aestivum
  Clone ID: PAT_TA_44874
cgtccggtacaatgggaggatgttggtggtcaagccaggatcaagaagcagttaattgaagccgtccagttgccacagaaatgcccagacgcatttgaacgcttagggatccgccctcctagaggattgttaatgattggaccaccaggttgcagtaagacattgatggctcgcgcaactgcttctgaagcaaaaatgaatttccttgcagctaagggtcctgagcttttcagcaaatgggtcggtgactctgagaaggcagtgagatcattattttgcgaaggcgaaggataatgcgcctgcaatattattttttgatgaaatagatgggcttggcagtaacctcgtggccatggaaataatggcatatt

SEQ ID NO: 44875 - DNA, 233 bp, Triticum aestivum
  unsure (1)..(233): unsure at all n locations
  Clone ID: PAT_TA_44875
cccacccnntcgtgtgacgcgtgggtactgtccactacatccgttctataatccctccccactcccacattcaccagtgtggcttccttcgccaatacgaagctcgctcgttcgccgctcgcatcatcaaccagtcaggcgagtcgagatggtgtgttgtgtaagaaccagatagaccatgggcgctactttcaaagcgcttttctaagtgatagttcaacgagtaaggatga

SEQ ID NO: 44876 - DNA, 412 bp, Triticum aestivum
  Clone ID: PAT_TA_44876
cgtccggaataattgaaaggatcaggaatccaaaagctgagcgtgatgcctacaatgagtggaactacagcaagttcaggttatggcagctgaccgactacgacaagatcatattcatagatgctgacctcctcatcctgaggaatgtggacttcctgttcgcaatgccagagatcaccgcgaccggcaacaacgcaaccctcttcaactccggcgtcatggtgatcgagccctcaaactgcacgttccagctgctgatggagcacatcaacgagatcacgtcgtacaacggcggtgaccaggggtacctgaacgagatattcacatggtggcaccgcattcccaagcacatgaacttcctgaagcacttctgggagggcgacagcgaggaggccaaggcgaagaagaccca

SEQ ID NO: 44877 - DNA, 337 bp, Triticum aestivum
  Clone ID: PAT_TA_44877
cgtccgtccattcgtttcgatctatttcggcttctttctctccaagctacagccccggccatggcggcgactattcagtccgtgaaggcccgccagatcttcgacagccgtggcatccccatcgtcgaggttgatgtgagctgtttatatggaaccttcgtcaggggcgctgttcccagtggtgtttaaactggtgtttatgaagctttggaactgatagacggtggatctcactacttgggaaagggtgtttgcaatgctgcggacaatgtgtacttgattattgtaccagcttgtattggtttggaccctatagcttaaattgagtttgtccact

SEQ ID NO: 44878 - DNA, 375 bp, Triticum aestivum
  Clone ID: PAT_TA_44878
cgtccgcggacgcgtgggttctgaactgtaggatggtagtaacagtgatcatgagagtaacggttgaccaaaaacctctaggaagccacagaagcgtggccgtgcaaagctttagtctgtgtcgaacgcatctgattcacgttaccctgatctattgcaatcttagcctgctttatcgagctatggatgcctttctttgttgaagaagaaacgctctggagacttgtttgttggtaacaagccccgtgctgttggaaaaaggactccaccagtgcctgttgtaagcatgtaccgagatgacaagataggtccatcaaatagacacgcacaacccgatgcttataatggtgttgaagaaggtgctctagctgcttt

SEQ ID NO: 44879 - DNA, 247 bp, Triticum aestivum
  Clone ID: PAT_TA_44879
ccgggacccacgcgttcgcccacgcgttcgcagtgaatgcatgctcatttcgtagttcagggtttaagcatgggcggtcttttgaaagtaagaggggtaacttaacggtcaattgatcaactccaactccaaatcatatacccggttcagggcgaagaaattaggcacttacaagcaatggttatcctagaaggggctttatcattgttgctaagctatttgtgcatttagggcttttgaagggggc

SEQ ID NO: 44880 - DNA, 201 bp, Triticum aestivum
  Clone ID: PAT_TA_44880
cgttcgcggtacgcgtgggcggacgcgtggtcgttttttttacagggatctcaagccccagagcctgctgatagatcgtcgtaccaattcattgaagcttgctgactttggattggtgagggcgtttggcattttctgttcgtacatttactcacgaggtggtgacattatggcattgagcactagaaattcttctgggtg

SEQ ID NO: 44881 - DNA, 415 bp, Triticum aestivum
  Clone ID: PAT_TA_44881
cgtccggagccttgttcaagagcgtctgagctgcagctgcaggaaagcttagggtgagccataccatacgttggcaaactttgcatgttgtataagtaggttcgaaagtccttttgagtcatttagtgtgaataaactttatttggtgaagtgaaatctctctttcctcgcacgaaaagggaagtgagctgaacctattcgtgctttttctctttcgtgttctgtttggaaccccatgtagcctcagtcagctataatcgaatgatatgacaagtgatactctttcttgtttcgtttagcaggccaaattcacaaagtagtccttggcaaatcatgcgctgttttctttgttggcctacattgccctgcactcgtcttcaatgcagtgcaaaatgaacactccaaatgaacgctc

SEQ ID NO: 44882 - DNA, 405 bp, Triticum aestivum
  unsure (1)..(405): unsure at all n locations
  Clone ID: PAT_TA_44882
ccctnctcntgtactccctccgtttttatttactctgtctattagctttgtaaactttgaccaagggtatagaaaacttttagcttagacaataatatatcaatactattagattcatcattgaatatattttcacaatatacatgtgattgtaaatgttcatattgttttctataaactcggtcaaacattataaagttggacttaggacaaagctaatatgcagagtaaataaaaacagagggagtattaaatagttggcctatacgattcaacgcattgagatggtgagtaaattgacatggcaagcttatatacagcttataagagaccatcactgggactggatgtagcactcattagatacggatgggtatgcacgtttttgttagtttttaaaaacct

SEQ ID NO: 44883 - DNA, 407 bp, Triticum aestivum
  Clone ID: PAT_TA_44883
cgtccggcaaaggattcgtctgcctgcaaggaccctttgactattcccctcaagctcctcagagatggcgaccggaagtaatagtagtagccaagagagcaagcagccgggccccgagctgcccaagcagctgccgttcgattttctcaagaaaatcaccaacgatttcggccaagaccggaagataagcgacagccccttcggcacactctacaaggggattgtgccggacgatggcagagtgatagccgtgaagaaacttcatgagaacgcaccaatgccagctgatatgcagtttaacaaggaggttcagaatgttatgtttcttaagcatgagaacatagtggaggtcgttgggttctgcagcgaaacgcagaagaaactggtgcagtttgataagagattac

SEQ ID NO: 44884 - DNA, 299 bp, Triticum aestivum
  Clone ID: PAT_TA_44884
cgtccgttaatatcttgttgtctttgctgtgcagtgtccttagcgctggaccacgaggttggatagggcaagcatgtgtattctttaattattggaggctttcatattcatatatcaatacaaggcgggatatgatgcagttttttgtgatttgaacgcaactggtgacttaatatcaattagttcacagagggaactcttttcgaccgtgtcggcgacaggaacagggaaacgcctgtccacggtgtcaccaatgaacaaggccgagacaagcatctgtaggatccagttagaatgat

SEQ ID NO: 44885 - DNA, 261 bp, Triticum aestivum
  Clone ID: PAT_TA_44885
cgtccgtccacgcgtccgcgactccacagccactcaccccccgctccccaatcgagccctagctcgccgtcgtccccccctccccccgcacgagccgagcgacgcggcctgcgcccaccccctacggcgatgtcccggcggcggccgaggggcgggacgcagcggatggacgccgagatcgaccacttcgccattatgggctacccgaaggccgtcgttcgtcgcgtcgtcaaccggccggtgagggatgtgaacgggagg

SEQ ID NO: 44886 - DNA, 364 bp, Triticum aestivum
  Clone ID: PAT_TA_44886
tcttccgttctttctcgttatttttatccccctgtcactttcatagcagcagcatctccagttcgagcgagaatgaactagtattgatctgttaaaatgattgtcttcttccagaaacaatgatgcgtacgcgccgttataactcaacttcccgcgcggcagtatccttcatgtctaacaacctcgtccagatcctacgcgacttccacagctgcctactcttccgacaccttctccacctactttctcggtgtgtcccaccttacctgtttatttgttcagactcataacctcgctgttggtgggtaccacaggatgtttttgcgggctggacgacatatactgtgttgtttataggggacgt

SEQ ID NO: 44887 - DNA, 350 bp, Triticum aestivum
  unsure (1)..(350): unsure at all n locations
  Clone ID: PAT_TA_44887
ccttncggtcaacaggctgttgccatttctcggactgctaaatcattagctgcctatcccaaggctcctttccaactgagaacttcggagattgtgaatgctccgaatggggaggtaaaatcaccaccagtaagtggaaagaacattaccaaatagttatatatatatatatatgtttgaattttatgctccaggaaagccaagacctgctaatcaactgtgtatcacaagaattgggatttccagtggtaggggtattggcagcttgcgttatatacaggtgtctttttgcactggagatcattttagggttgtaagaaactgggggttttcgcccgcattatttaaaa

SEQ ID NO: 44888 - DNA, 225 bp, Triticum aestivum
  Clone ID: PAT_TA_44888
cgttcgttcccagttcgagtttcaccgttcgtatcaatcaaagccaaggttcgaagtcgttggcggtctggatcaggagaaggctagaagccatggtccgtaccaatcataccgttcgtaagtccaccgttggctaggggccccgtatgcagcttgccacctctggagataggatgtctatgtcttctatcggcggcgtgtataatccctattgttgcaggccaa

SEQ ID NO: 44889 - DNA, 399 bp, Triticum aestivum
  unsure (1)..(399): unsure at all n locations
  Clone ID: PAT_TA_44889
ggtacgcctgcaccaccgcgcaataattgccncgacccacccctcctcggacgcgtgggcggacgcttggttgccaacttacgcgctctgtctcttcgcctctcaggtgttatacacgtccactcgtttcaaaaaaaagtccatccgttttaaacttgtccggcgggttccgggcccagattcagggaggggagggtgcttttccggcgacgctcgcggcggcattggagccgtcggcggtggcgcgaggggggcggttgcggcggtgcaaggcccgggccaggggcggtcctaacgagggcgggtcgaccactttttttcaaggcccaggcgcttgcgcctcttacaccccttttcgaggtgaccgcttggctcggttcccccttccacggggaaaac

SEQ ID NO: 44890 - DNA, 328 bp, Triticum aestivum
  Clone ID: PAT_TA_44890
cgtccggcatcctctgccgttcttctcgtggatcctttcagatacattcttgccgtctctacgcttgatctcttcacaagggagctagagttccggagagaaatggtggcggcgttcataagctttgtgaaggaacggtgggagtcgatacacgctgcccctgtgatcgtgctgccatacgagggcgacgataacagcaacaaggcgctccctgcaaaagcttccaggcagactgaatcgaaagacgtgcaagaccaacggagtgacatctatgtgaatggaatccgcccttcatgatacctgtaagtgtggggagttgtgttgtaat

SEQ ID NO: 44891 - DNA, 365 bp, Triticum aestivum
  Clone ID: PAT_TA_44891
cgtccgcccacgcgtgcgcgaacgcatgggtgatttcatgtgttgttacttgatctataacttcgaggacgaccccgtcaaggaggctgccaacttcaccgtccaggtcatcatcatgaaccaccccgaccagatcagcaacgggtacgccccgtagctgtactgcaacacttcccacatcgctgtcaagcttgctgagatccacaccaagatcgaccggcggtttgattaggatgattgagttgtttcccaactttcttatgaactgtgatgccgtgtttgtcaagatgatcctcatcaagcccatggttgtggagaccttttcccagtacccttctgttggtcgctttgttgagcttgacatg

SEQ ID NO: 44892 - DNA, 228 bp, Triticum aestivum
  Clone ID: PAT_TA_44892
cgtccggtgctagacgagagagagcgagagagggagggaggtcgtccgagaaggttcaggaaggatgcctcgcgcggggttgtcggcggtgtctaacaagttggacatcgccatcgaccttgggaacccgttccttaaccgcaccgtcgacggctttctcaagatcggcgccgtctgcgcctgcatggtggtcgtcgtggacgccttttgattgcctttaaagtggga

SEQ ID NO: 44893 - DNA, 372 bp, Triticum aestivum
  Clone ID: PAT_TA_44893
ggatctgcctacttggcaggggggtttccatggctgttaacaatgtcaactccattattgttcccgctttggtcggcaaggaccctaccgttcaaactgagcttgacaactttatggttcaatagcttgatggaaccaagaatgagtggggttggtgcatgcaaaagcttggtgctaatgcaatcctggctggattactagctgtttgcaaagctggagccagtgtcaagaagattccactgtaccagcacattgtcaaccttgttggcaacaagcaattggttttgcccgttcctgcgttcaatgttattaatggtggatcccatgctggaaacaagcttgctatgcaggagttcatgatcctttctactg

SEQ ID NO: 44894 - DNA, 303 bp, Triticum aestivum
  Clone ID: PAT_TA_44894
cgttcgcccacgcgtccgcccacgcgttcgtgagcgttagagaggtattaccattgatattgctctgcggaagttcgagaccaccatatactcgtgcactgtcattgtatctcctggtcaccgtgatttcattaagaacatgatcattggtacttctcaggttgaatgtgctgtgcttattattgtctccatcactggttgtttttgaggtggtttattatatagatggtcagaccccgtgagctcgctttttcttgcttttacttttgacggaagaagatgatctgttgttgcataagatgg

SEQ ID NO: 44895 - DNA, 420 bp, Triticum aestivum
  Clone ID: PAT_TA_44895
cgtccgacgaaactttccccaaatacccatgcctccttaaatctttgtggccgtaaaccatggctagtgtcctctaaattgacagtgtagcatagaggttttacttttgtatcttttttttgacagttagactttattcctcaaataattgaccagtcgtttactcgaatgatgagaaataatattaaagatccgagtaatgctaaatgatctttttgctttgggccttcttttttgttctctcaaccttaatttaaaattaaggggcgggccgttttataggtatcaatctttccttttgcgtgcctgcctacgtttatatgttttttttatatggcgtatccttaaattgtaatttgaccttgggccggccgtttgtttaaaccgttctgtgactgtggaaaaaaccctttgtcgttt

SEQ ID NO: 44896 - DNA, 364 bp, Triticum aestivum
  Clone ID: PAT_TA_44896
ctttcgtccacgctttcgactagttctcgaccgctcttctccgccccctcctctcaccgtgtgtggcctcgttgcgccaccggacctccatcgtcgttgtcccgccccccccccctcccccttcccggtagaaaatggctgtcgccgaggtcatccagcccctcgtctgcgacaatggttccggtatggtcacggctgggtttgctggagatgatgcttccagggccgtctttcccagtatcgtgggttgcccacgccacaccggtgtcatggtccgtatggggcacgaaggacgcctactttggcgacgaggcccaattccagaggggtttcttgactcttaagtaccccatcgcgcacggta

SEQ ID NO: 44897 - DNA, 409 bp, Triticum aestivum
  Clone ID: PAT_TA_44897
cgttcgcccacgcgtccggcattttggaatggaggcattatttatgccatatgaccacaagaatactacaccagatggagctccttctcacttgatgaggtcagttttagagaatgtgaaccatcgcaatttccaagacagctgcctagttggatcaggtggtggagctgtagggtaccttgcacatgggactacaactgattatctgtatgacattgcgaaggtgccaatgcctttcacatttgagatatatggagatgagaaggcattcaccgaggattgctttaaaatgttcaaccctgtcgacaagataacatttgatagagtcattaacaagtggtgcatggcatttcctcatacttttcgaggaagggctgcgaaccctacctgatggccagggagtattcca

SEQ ID NO: 44898 - DNA, 420 bp, Triticum aestivum
  Clone ID: PAT_TA_44898
cgtccgggctcgctgctccaagctctccgcctgctggtggccgccgcacttcaaatccccccgcctcgagaacggcgccgccggggaggacggcagcggcgtgccggtgttcgccgagtacagcctcgacgagctccgcgccgccaccgacggcttcgccgcggaccgcatcgtctccgagcacggcgagaaggcgcccaacgtcgtctaccgcggcaccctcttcagctccggcgccaccgtcgccatcaagcgcttcggccgctccgcctggcccgacgcgcgccagttcgtggaggaggctagggccgttgggctgctgcggagcggtcgcctgtccaacctcatcggctgctgctgcgagggcggcgagcggctgctcgttgctgagttcatgccgcatgataccttggcaaagca

SEQ ID NO: 44899 - DNA, 385 bp, Triticum aestivum
  Clone ID: PAT_TA_44899
tgatcgaccagttcgaccgcgttggtggtaaggctctcattcattgttgtcgacggactagacatcagcgccgcgttcagaacttgcgctactcgatgctgacaaagggctctctcacttgctaaagcctgtaccttactaaagagcgtacacccgcctgcgaaaccttacgacggctctcgccaaggccctgatcactctgagcaagaaactaaacgggaaggcgtcgatggactgtcagcagaagcggccgcagatgaatgtgtgcccgatatgcggtaagatcgtggggctgagcaccagctcgctgaagctgcacctgcagaaggcacacaggcggctgtcgcactgcagaatgtacagcgccatgaccatggagatccag

SEQ ID NO: 44900 - DNA, 350 bp, Triticum aestivum
  Clone ID: PAT_TA_44900
cgttcaatggagcgtgggatctgttgatgcaacaagatggacgccaccactctcaaggggtgaaaggcccgttacgaggaaattgtcaaggaagtctcattgtacctgaaaaaggttggctacaaccctgagaaggtttcctttgttccgatatttggggttgagggtgacaacatgattgagaggtccaacaaccttgattgggacaagggccctacccttcaagaggttctggaccagaacaatgagcccaagatgccctaatacaagccgttagcgtattctccttcaggatgtatacatgatgggtgggattggaactgtgcctgttggactcgttgagactgggg

SEQ ID NO: 44901 - DNA, 423 bp, Triticum aestivum
  Clone ID: PAT_TA_44901
cgtccgtctcgcctccctccctccctccctctccccacagattcttctccctcgcgcacgcgctcctagcttccaccgccagcacgcgcacacttccatccgcttccagcagcatggccgaggagaccaagcaggaggccgctgcggcggctgcggtggccgaggtggccgtgacggagccggagccggagaccaaggcggcggccgaggaacctgccaagaccgacgagccggccaagagcgatgtggcggccgagggcgaggcgcctaaggccgagagcagcgagcccaaggccgaggagcctgccaaggaggagcccaaggcggaggcgccggcccaggacgatcccaaggccgaggagcctgccaaggaggagcccaagacggaggcaccggcggcggtggctgtcgcggaggagccca

SEQ ID NO: 44902 - DNA, 379 bp, Triticum aestivum
  Clone ID: PAT_TA_44902
cgtccgctgacttttctccagccggccacactcttacctttctatgcagccggcctcatgtttttctttgcttctctgtacgagcagcatgcagtagcggggcgcggcggaaaccggcggccgggtcaaggcagaggccggcggccgggttgcggggaagccggcccgcacagaagccggccgaccgggttggcgggaagctggccagcacgggagccggccgaccgggttgccgggaagccggccagcgcgggagccggccggccggctgccgggaagccggccgaagcggaggagaagcgagggtgaagccggcaggccgggttgcgggggagccgtcgtgagcgaagccggcatgctcggacggtgagcgcgcggt

SEQ ID NO: 44903 - DNA, 295 bp, Triticum aestivum
  Clone ID: PAT_TA_44903
cgtcctgtcactcttgtgggcgctctgatcagacagctcagaccggttgcttgcttgcttgccgaaggctatcgaggaaggagcaacgttggtccggtcggcggccaccaagctgcacatcccccccgaccactccgccggccggcgctcgttcttcctgccgatcgccgccgttgacctactgtgttgcgcctgctaccttctgggcgcctggcaccagagtggaggctttttccctttttcccccttccgctttcgttaccattgccaccgacatctcctgtaccatcactac

SEQ ID NO: 44904 - DNA, 396 bp, Triticum aestivum
  Clone ID: PAT_TA_44904
cgtccgtccatccacattacattatggcactgtcccttgggggcgcaagcgcccctaacgtgtgtgggggcatgccgtggtcgcaggcttcacatgcatcagcttgattgtgacttagaggcgattaggcataacccggcactgggtaactgcaggccattggcttattagccaagcgcgatgaccaaatgttgttaataaacgtggcactttgtgctaaggggaatgactattgtgacaatgatattgagtggggatgactaacgtacgctatgcacgaaggagaccagcctaagtcttttgtagtgggggacccgattcaacactaactgatggacgctcgatcttgataaggaacggcgacgtgatctgaccaaataggcaagtggtatctta

SEQ ID NO: 44905 - DNA, 315 bp, Triticum aestivum
  Clone ID: PAT_TA_44905
cgtccgcacttatatgttaaataagccagagtgcaaggttggtcttaccgcatctatgctaatcatttatgccattatgtgaattcttttacccaatactctattgtaggttgaatttgatatggaggggaaagtgtgtggtgttacatcagaaggtgaaactgccaagtgcaagaaggttgtctgtgatccttcttacttggccaacaaggtaaggaagattggaaaagttgcacgagcaattgcttttatgagccacccaatttcatatgcatattgattcccactcgatcttatattattttaccacaaaag

SEQ ID NO: 44906 - DNA, 421 bp, Triticum aestivum
  Clone ID: PAT_TA_44906
cgtccgctgacgcgtgggaagagaggctctgtcgaacctggtactcaaaacacaaaaaatctgcaaattacttttgtcgatcctacgtctactacaatacctacattggtatgctctactaatcttatgattttgtatcctgggtaatgaccagacaaatgatccatacatgatgacgcatcaagatgtaacttttgaatcgcaccaacttggatgcaatactcccatagcaaatactgatgaatacatgaattgtgttcttaaagaatgcatgcatctctaagataaggaattttagctctatacacgatgacgcaccatgatgggttttaaagagggctacaacttatttggaacatgatatgtgtatccaggttgctcgtcttcgctaggcccatgaatggccctcatagaccttacc

SEQ ID NO: 44907 - DNA, 425 bp, Triticum aestivum
  Clone ID: PAT_TA_44907
cgtccgcccacgcgttcgctaaatcctgctctaggtgctcctcgcatcagcataaatccggattttcccaaagatgggaagatacaggacctttctctcggactttttgtgaattcgccaagtccacctaaagagtccttgaataaaagcgcttcgaagaagccgaaggcacattttgatggtagtctaagtctaactaaccagaaaaagaaggagactcctcactggctgctgaatcgcaataaatctggttttgtggcacataatagaacaaaagatgagaatagcagtgccaaagaagttatgcctgcaatccaggctccgctaccttgtacctcaactgggtcttcgaaaaagccctcttcaagtacattgggtgcatgcacaatatctggcaaagaaattactactgccttggcaattgc

SEQ ID NO: 44908 - DNA, 403 bp, Triticum aestivum
  Clone ID: PAT_TA_44908
cgtccgcccacgcgtccgggcacctgtcacttttgtttccacgctgcagccactgccttgggaggtttatataccttcaggttcgccaccactccacctcaaaccagatgaaagccaagagagttacaactcagagggggaatcacagcgtgtggaccctgctaagaaaagtccatcccatcgctgttcagcgcctggaattactctgcatcccatagcgctatctgggctgctcatatggatatctcatcttgtctgattggagacactgccatctcggcgatgtgtacactggcactaaggtgaagccgccaaaattccaattctgagtgtaacactttgatctaccttggcatccttacgggtccactaaattcgaccaaatcacgtgccatcctttcct

SEQ ID NO: 44909 - DNA, 427 bp, Triticum aestivum
  Clone ID: PAT_TA_44909
cgtccgcaacgatctcacgcgcagaaaacacaagagagagcgagtagaaccgatatccgtagctggtttgctagactagagcggcgccatggccaagaagggctcaggcactgccgcctctctgctgctctgcctcgcgctggcggcgcacgccgtcggggctgccaggaccatgcccgctgcagctggcggcgtggcggaggcctcacttccggccgccgccgccacggagaagggcgccggtgcaggaggagccggcgcggcggacgcgaagaacctgttcgtgggcgtgggagccatgggggaccttccgggcttccccgccgtcggcggcggctacggcggtggcttcggcaacaacggagccggcgtcttcaccggcgtcacgggcccgctcggcggcgtctggggcggcgtggggagcgtc

SEQ ID NO: 44910 - DNA, 429 bp, Triticum aestivum
  Clone ID: PAT_TA_44910
cgtccgcgacgccgtcggctccaagccccatcccactttttcccgccgttacccggtctcgcggatgctgttgcggtccgcctccattcgccgctcgttcgcttcgcagacgcgttcttccgtccgcctcgcgggctcgctggggagagcggcagcagccatggccatcgggtctctcatcgcagccgcgtccaggtccagccgccacgccctcgcctgcgccgccatctcccaggcggcttacagggcgcgccagcacgccggagtgcctcctctgctctcgcggcttgcaccactcgcccgcgccttcagctcaagccctgcagcagccgatgtcgattcagatctccctgtcatggaagtgcagaaacggcgggtgggcaaaaaggccaagggcgcgaaaagcggaaaagccatgatgttcccact

SEQ ID NO: 44911 - DNA, 215 bp, Triticum aestivum
  Clone ID: PAT_TA_44911
cgtccgcccaaatgggcgaatatatgctccccgctccccaccgctcctagctccctcgccgccgatccagccgccgagaggagagatcgatcccttcacggcaggcgctccaccgcaatcttctccattagggccggcgacggaggtacggggaggagggttttggtgtcgtccctcggttgggagggtccttggggttagggtgcatggaccca

SEQ ID NO: 44912 - DNA, 260 bp, Triticum aestivum
  unsure (1)..(260): unsure at all n locations
  Clone ID: PAT_TA_44912
cccacgcggccgcagaaaccaccccccaggagncgangtggctccaggagancgagggccccaaagangggctctaaaggaggggggaacccccccacgcccggncngagcncgacgccccccgccgcgccgagcagcgccncagcgcctcccgggcgagccccggcgaaacgcacctcgcggcaggagcaaaaaaacgcctccggggccgcgcccggcgggggcgagccggccgcagaggagcagggcggggcggcgaa

SEQ ID NO: 44913 - DNA, 397 bp, Triticum aestivum
  Clone ID: PAT_TA_44913
cgcgtccggcgcctcccacctcctctcccactccgcccgccgcctcgcccgcaaccctagccccctccccgccctccgcctcctctccctcttccccgcctcctccccgctccgcgccttctgcccccgcgcccgcccctccccaatcgcctgctccgcctactccaccgcctcctccgccatggcggacgacaccagcagcaacccgctcctcgccgacttcgacttcccgcccttcgaccgcgtcgagcccgcgcacgtccgccccgggatccgcgcgctcctcgcccgcctcgagggcgagctggaggagctggagaagggcgtggagccggcgtgggagaagctggtccacccgctcgagcgcatcgtcgacaggctcgacgtcgtctggaac

SEQ ID NO: 44914 - DNA, 409 bp, Triticum aestivum
  Clone ID: PAT_TA_44914
cgtccgctccaatcgcatccgcaaaaccaacactcgtcttccttcctccctcgaccagcgcaggcggatctcatcccatccaaggcaggcaggcaggtcaggcaactcgtcccctcccctcccgaatctcgtcccctcgtttgtttcttttgcttgtgccccgaccgatctccgtcgcgagcccccagcccgtgcccgagcgagggttccgtcggtgaggcaggcagtagctagatattttatctgggcgggccgccggcggggcgtgttctttcctactcttaggggcgggcgggcgactgaagctgagccacgcggtggctggctcatatccatgcgctacctgacgaagggagcacaagttgactcactgacggcatggaatctcgcgcccaaccaccgacccact

SEQ ID NO: 44915 - DNA, 330 bp, Triticum aestivum
  Clone ID: PAT_TA_44915
tcttgcccgaaccctagcccgggggggcctccaatctgtacctttccccgtcttcttccgtccgggcctactgcccccgggccccccctcccaatcgactggtcgctacacaccgcctacttggcattgtgtcgacaccagagaacccgctcctgccgacttgactttccgccctttgacgagttagcccgatacgtccgaccgggatccgacgctcctcgaccgtctcgagggcgagcttatgagctggaaaagggcgtggtacccgcattggagaagctggaccacccgttcgagcgcatcgtcaacaggctctactgattttggaac

SEQ ID NO: 44916 - DNA, 286 bp, Triticum aestivum
  Clone ID: PAT_TA_44916
cgtccggtcgcttctacactgcctacaccagagctgggtgggggtacccctttgttcggaggggagacctattgaagcaggaccactctctgctccctgctcaagcttctggggaacgagctgctgtcggattcattgccttacagggcgctgtagaaccgaaccctctgagaagtgcttgggcattgaatcgttcaaggtgcagttcatgtgtacattggagccaccccctctgatgcgggtgtgggtgattatgaggcgggaagttgccaaaacatgctggttg

SEQ ID NO: 44917 - DNA, 417 bp, Triticum aestivum
  Clone ID: PAT_TA_44917
cgtccgttggatgttgctgtgtctgcagtcttgccctatggatggactagatatgcacagttgaggctctcagtggttaatcaaattcacaacacgtttacaatacgaaaagagactcagcatctgttgtatgctttagattgcgattggggtttcacttcattcacgccttggagtgaactgcacaatcccagttaagggtaccttgtaaatgatccttgtgtactacaagcatatgttgctgtgtgtaaagtttgagattattggagttatgactctaaataggagactggctatgttggcctcaaaaaccaaggtgccactagctatttgaatgcttttcttcagactctctatcacattccatatttcagaatggcgggttatcatatgcccactactgtttatgatatgccc

SEQ ID NO: 44918 - DNA, 289 bp, Triticum aestivum
  unsure (1)..(289): unsure at all n locations
  Clone ID: PAT_TA_44918
cgacccacgcttccgnaccgtgctgctcattcgcaagctctccttgcagcgcctggcgctggagatcgggcaggacttcaagaccgaccttcgcttccagtagctccaccgtcttcgagctggatgaggccgccgaggcctacctcgttgggctcttggtggacaccaacctctgctccatccactgccaagcgcgttaccatcatgcccaatgacattcatctcgcccgtcgcattcgtggcgagagggcctaagctgtttcctagaatcctatgttctgatctggtc

SEQ ID NO: 44919 - DNA, 195 bp, Triticum aestivum
  Clone ID: PAT_TA_44919
cgtccgctgacgcgttagtcgagtcgtaccaactctcgtcctgccatgtccggcttccgagtggtatttctcctgctaggcttggccgtcagctgcaacagtactgctgttgctagcgcgatgtacaaggcgaaggccagtgtgatttgtaggcatgattgctcgatccatcaaggtctaattcctcctccttgt

SEQ ID NO: 44920 - DNA, 115 bp, Triticum aestivum
  Clone ID: PAT_TA_44920
cgtccggcgtgagaaggagtttaacgaggagcttatgagggcgctgctggagatccacaggttggtggagccattgatggacaagatccccaacttctactaccacttattaatc

SEQ ID NO: 44921 - DNA, 220 bp, Triticum aestivum
  Clone ID: PAT_TA_44921
accctgacgcttcaaccgctaccgacgccatggaccctgttaagcggtctgaacttagggcgcggtttgaggagctcaaggaggagataaaggaaaaatctatccccggcaccagggtcaccaatgtgttaccatacgacattcgcgcttttttcgtggaggtggtgaataagcaaaaggcggggcttcgagaggcgaacagcaaccgcgaaccacgtat

SEQ ID NO: 44922 - DNA, 351 bp, Triticum aestivum
  Clone ID: PAT_TA_44922
cgtccgcccacgcgtgcggccagacgctcgcgggcacccatggtcgatgacgtcgattattgtgctatgctccacgggaacccagggcctatctagaaatagagattgctatagcagtcgttccggccttactcggatagagataatacctggcgacccatgctgtcatggctaactcattgctgcaacgtaacatattcggctactcatctatgtggcgatgttcggctcatggggatattgagctactcactgactaccactaggacatatcgttggctttagataccgtgccataggtatgtgactcgtagctgagtgcttaggcacaagaccgactaatgcgccgct

SEQ ID NO: 44923 - DNA, 248 bp, Triticum aestivum
  Clone ID: PAT_TA_44923
cttccgctcacgcgtccgtagaggccatggcgcgttgcatcatctggctgctgggcctggtgagcgcggcggtgctggagctcgccctcatagtacatacactgtggtatctggctgagccatcgggcctgcaccaccttctgctagcggagcctggagcgggcggtcatcagcgcttggcgcccttctccttgagctctatatgacgggcctcgacgggttccttttgtgcgcctttcttgctcctt

SEQ ID NO: 44924 - DNA, 379 bp, Triticum aestivum
  Clone ID: PAT_TA_44924
cgtccgcgcgacgtctacgacttcatccagtacgacctcgggatgcccccgcccagccgggagtccgagccgccggagccaggccacgacgagccgctgcggctgtggtcgtgggacgactcctccttccccgagagcgcgccgacgccaccgccaccgccgcccaagtgagccgcctacgtctctgtgctggccgtagaacgggtggtgtgacgagttcacccagttttggagcattcgcatggtagggctcttgtcgctgtcgctatctagctggggtccagccgtaccgacaatggctttaccgggcgggacctcgccgtgtatgcagtccccgatcgtttttcccgggcaacccactgcatggggaaacccaatg

SEQ ID NO: 44925 - DNA, 417 bp, Triticum aestivum
  Clone ID: PAT_TA_44925
cacgcacgccggtcggggacctccttcttcaacgccgccgccggcctaattcctccctccctcactccaagcctctactccatcaccagtctcccgccgtcgccacgccgcggtcgagggtctagtccgcctcctggcgccgccggagggtgacgaccgccggcgaccggagcggacttcgctcgagccgtacgcctacgccgactccggtggccactccacacagcatagcgtctacagcactaccagcatcaagccaagccaaactttgagtaatttgtatgcacccggctaatttgtctgcctccatataatagaggtgccgacagcgctcgtgcagcagccctgctgaacctaaaatggcggccctgccactggccaccgcggaggcctgcgacgcgaactcgcacatgatca

SEQ ID NO: 44926 - DNA, 421 bp, Triticum aestivum
  Clone ID: PAT_TA_44926
cgtccgcccacgcgtccgcggacgcgtgggcgaccagacctaaccacgcgacgtgagttccagacctccagggagccgaggcagccgccggcgcccgccggtgactcccctgcactcccctgctcgtctgctcccctcccctgactccggcgctcccgtccagtcccctgcaggctgcagccctgctcgcctgctcggctgcgctgctcgcctggctcgcctgctctgcttctccagccgggcgcggggcgccgccgcgccggctctggtccggccctgctccatcctccagtcctgccggcctctcctgcctcccggtctcccccgcgcaactgctgccccgactgtaggcgggaaataaaagatgaacatattttattcatcgggggccgcaatggaagtgtctacacccgcaagtgat

SEQ ID NO: 44927 - DNA, 251 bp, Triticum aestivum
  Clone ID: PAT_TA_44927
cgtccgcccactcgtccgttgactcttaggcaggcagacctaacccctcgtcatgagaatgaggcatgaaaaaaggcaatgtagccgcaatacccccacacctgctactgtataatcaaacgtttgggtgatacggttgctcgagtccatggatccaaccgagtcacctcataactaggtgccttggttgcagccaagtttggctggtcagccaattttgataggttaatgagggcgcagaccataggtga

SEQ ID NO: 44928 - DNA, 171 bp, Triticum aestivum
  Clone ID: PAT_TA_44928
ctttcgtttttttaagcatgccttggctcgccatttcttatggcgacatgatgtttcaggagcgtttgtagttactttgagcttagtgatcttcctacactgaagctcatttgtccctactggaagacacctaacatgtttattgcctgcattattaatgagctcggtttt

SEQ ID NO: 44929 - DNA, 394 bp, Triticum aestivum
  Clone ID: PAT_TA_44929
cgtccgatgttgtgccgttcataaaaaaagttaactatgtttataagacaatcatgaagttctgttcagtttcttatttcaattcaaattcttatagtgcaaaaattaaaaattgtgtcatagccataaaaaggaatgttttgctagtaccaaataaaggaaaaacaaaagtaggtaagttaaaaaatgtgcagtcctatatgttcagagagaaaagttggtctgaaggtaatgcgttgcaggcatgtgcaattttgaaatttcgaaaaggcattaagatgcatgattgcaacctattaattatttttcagtttttgagctatgagaagattacttcttatttttgagctatagcagttttatgtgtccaactttttaatttcttatactgaat

SEQ ID NO: 44930 - DNA, 195 bp, Triticum aestivum
  unsure (1)..(195): unsure at all n locations
  Clone ID: PAT_TA_44930
cgtccgctgaacctctcacctagcggcacatccatggcgcgcttcctcgtcgccctcctcgcgcccagcctggtcgcggttcangcttnangtcatctgtgccacgcggcgccggcgacngcggatgggttctggcgcgccgtgctgagccactcgtcattgtccgacgccgttctacgtcttctcaaacaacct

SEQ ID NO: 44931 - DNA, 271 bp, Triticum aestivum
  unsure (1)..(271): unsure at all n locations
  Clone ID: PAT_TA_44931
gaataaggccgtctatccgtttactagtatcggtggtatgacatcaaggggccggtgttgtttaccagcctggacnncngcaagaccctcgtgttcaggacgcagggttccaagattgcctcagagggtctgaagcacagggtgttcgaagtattttctagctgatcttcagaacgatgaggaccaggcctacaggaagatcagactccgtgctgaggttgtgcaagggatgaatgttcttacaaacttctggggcatgggctccaccact

SEQ ID NO: 44932 - DNA, 226 bp, Triticum aestivum
  unsure (1)..(226): unsure at all n locations
  Clone ID: PAT_TA_44932
actagccggcctcgccgttagtatgttgtcgcacccctatccccataacgggggggtctattagaaagtcagcctcctccccatctccccatagctcaccagcctctccctcttgcagccgcacttttccaccacccggccttcactcacattccggagggaaaaaaagtccaatcttttgccggcggccagcctttactccacggaggcgtgcanatggatgtgc

SEQ ID NO: 44933 - DNA, 349 bp, Triticum aestivum
  Clone ID: PAT_TA_44933
cgtccgcccacgcgtccggcggagctggagcgatgcactcctgggggacccggctgctggccgcggggacgacggcggtgctcctcctcatcgccacctgcgccgccgcctccgcgctcgacgccttccacgtcccctccgtcgaagcccaagcccacgttacgaagataaatcgattccacaaacagatcaatgggaatgacaaggtgaccttgaccttcagtctatctgcaaatttggaatcacttttcacgtggaacacaaagcaggtggtatttacattccagtagtatgtgcattgcgaaacggtagtctgaatgtgtagatgctcagtatattggcactatat

SEQ ID NO: 44934 - DNA, 249 bp, Triticum aestivum
  unsure (1)..(249): unsure at all n locations
  Clone ID: PAT_TA_44934
cgtccggtcccggctccgatctcccctcccctcccccactcaaacacggcgcgcgcgtgcacaggaggcagagccgcggccgatccggaggcctcancggccgaggcccaaagccagcagccgcccgagccgctcgccgcccgccggcgaccacgcagccaggcaccacaccggcagatccagatccagcgtgccccgcccgcatggcgggggcggtgtaagcacctgtcctggtcgacattaagggcc

SEQ ID NO: 44935 - DNA, 253 bp, Triticum aestivum
  Clone ID: PAT_TA_44935
cgtccgaaaaaaccgagcgcgcaaaaccctaaaccctagcccccctccctccccaaatcctcccctggcggctgcaggggacggagaccaccgagccgccatggcgaccctcctgaggcgcgcgtcgctgcggcgggccatcgcctcggccggcaccgcctcctgccccgagagctataggcaggtgatctgtggctctaccttgcattggcgagagtgcgcatctaaagccaaaaagaagtgttaggcaagg

SEQ ID NO: 44936 - DNA, 344 bp, Triticum aestivum
  unsure (1)..(344): unsure at all n locations
  Clone ID: PAT_TA_44936
cgtccggcgtcggtattttaaagaaatgaaaatgggctatcagattgaacccaaagcagaacactatgcgtgcatgatcgatcttttggggaaaagtggacttcttgaagaggcacttgaagttgcaaatggtatgccaatggaagctggtgaggccggttggggtgctcttttgaatgcatgcagagtgcagggcaatgtatagattggtgaatgcgctgcagataagctagtaaaactcgatccattggacagnggaatctatgtacttatgtgccaaatatatgcaaataaaagtaaatgggatcaggggaagatgctgaggatgttgatgagagatatag

SEQ ID NO: 44937 - DNA, 151 bp, Triticum aestivum
  unsure (1)..(151): unsure at all n locations
  Clone ID: PAT_TA_44937
tcactggggggggcataccaacctggatccccnntagaactctccgtgcggagcacggtagcgaccgaccgagcgatccccaatctctttttcatgcgtcgatccatcctttatatatactacccctcattcacgaccttacactgcgact

SEQ ID NO: 44938 - DNA, 189 bp, Triticum aestivum
  Clone ID: PAT_TA_44938
cgtccggcgcgcattccgatcccgcaccgccggccacgcatctcgagtagtttccagctcgccggggaagcagcaagcaagatggccggaaggaagggcggagacaggaagaaggcggtgacccgttccgtcaaggccgggcttcagttccctgtcggtcgcattgggcgctacctcaagatgggccgt

SEQ ID NO: 44939 - DNA, 199 bp, Triticum aestivum
  unsure (1)..(199): unsure at all n locations
  Clone ID: PAT_TA_44939
cgtccggttgccgncnctaaccgacgcccatccttactcgcgcgctgccggagccggaccctggggggggactacccgcgcactgccgncnccggaccctcgcccctcactacccgcacgctttcggcgccgtgccctcaccctttactacccgcgcgctaccgccaccggtcccttcttacccgttcactaccgtcgt

SEQ ID NO: 44940 - DNA, 434 bp, Triticum aestivum
  unsure (1)..(434): unsure at all n locations
  Clone ID: PAT_TA_44940
cgtccggtttttacgcgtccgacgaagtggtgctgctgcagctagtgcccagatcattgatcttgggtgaggatacaaggatccatcctgaatcatatgcgttggcgaagaatttggccaaggatgtctgtgctgaggatggacctgaagcgaatgagatggatgatgatgagcaagagatggcaattgagcatgtgagagagaagcaggaacagcttgaacgtcttgacatagatgaatacagcagaagcatcggagatgataagagagaaacattgcttgacataaagttggagctaaagtgtggtttctctgatcggaggaccccttatgccgagccaagtccagatgaggagttctgnntgctttctggtgaaactgaggacaacatatcagatggaangattgttcaagtaactgttcggcatatacaa

SEQ ID NO: 44941 - DNA, 392 bp, Triticum aestivum
  unsure (1)..(392): unsure at all n locations
  Clone ID: PAT_TA_44941
cgtccgcggacgcgtgggcggacgcgtggggggggtttggcctatgcgcagaatcggtggacaatggctggccaattcatataccgtacagaaacagaaaagatcgtgatgaatggctgcaattcctccttgaaatgggattgtgagcaaatccactagctcgagaaattcagctaaatcggatgtgcctggcttgctaatgccaaatcgatagcaaactggtgggtactctctcctattctccgagatccggatccgaaacgagatcccacggcctctancgtagcccatgggatctacaggaagggggggaagaggaactcaccattgctagggacgtgcgccgcccgcgtagatcnnccggggcctaataagaagagcgaggtggggta

SEQ ID NO: 44942 - DNA, 219 bp, Triticum aestivum
  Clone ID: PAT_TA_44942
cgtccgcccacgcgtccgcccacgcgttcggccgaataaggcggcgagaacaacacttgttagcctgaacagggagatcgcggcacaagagttggacgtacgtgaggagatggaggaggcagcaatcaacctgaacgttccacagacacaagatggcctcagtacacagccacaacgaaaaagaacagttatgccaggcaaggctgcacggtccccttt

SEQ ID NO: 44943 - DNA, 190 bp, Triticum aestivum
  unsure (1)..(190): unsure at all n locations
  Clone ID: PAT_TA_44943
cgtccggcagatagtaatagaaaatagcacagatgtcatgctatatcgtattgctctcacagggggggaggttatgcgnggggttcaaccacctgataggctaagccttgaggagccaccttctggtgtcggtatgtgttctttgtatgcattcacggatatcaaccttcatttcttacttaactttatt

SEQ ID NO: 44944 - DNA, 238 bp, Triticum aestivum
  unsure (1)..(238): unsure at all n locations
  Clone ID: PAT_TA_44944
ttgcgtcctctaaacgacaaggaggtttctttaaaggataagaatattgtgatgcagtcctgatgaatttacaattgcacatccgtggaaagatgacaagtcaaagcaacatatatatgatcgtgtttttgatgcatatactactcaagaagatgttttcgaggacactaagtatctagtacaatcagctgttgatggatataatgnttgtatatttgcttaaggtcaaactaggttc

SEQ ID NO: 44945 - DNA, 204 bp, Triticum aestivum
  unsure (1)..(204): unsure at all n locations
  Clone ID: PAT_TA_44945
cgtccgtttttcttcacttccccctcgccttctcctgcgcctcccctcctgagcggagtctggggcggggcatccatggcgaagacctaccccnttgtcagcgccgagtaccatgaggccggcgagaagggcaggcaaaagctcctgtccgtgatcggcgagaggaactggtccccggtcatgctccggctctcggtggactcc

SEQ ID NO: 44946 - DNA, 401 bp, Triticum aestivum
  unsure (1)..(401): unsure at all n locations
  Clone ID: PAT_TA_44946
tgtccggcagaaacgcccccggctgcacagccgcccgcccacctctatccagtccagaaacgcacactcccacgcgcagccagcggagcagagcagagcactgacttcaccgccgcagcggctcacccgaggaggaggcgccgccggcggctggaggagcgagcgagcgagccacccgatccgaccatgaccaagtccaagaacggctgcctcaagatcctctgcggcggcgccggatccgacgccaccgtcggctccgaccccgagaccgacgcccacnccgacnagagcaaggccatatcagataaaagcagatggagctttcggaggaggtctacaaggcaccgagttctcaagaactcngatatattcgagcctgaaactctaagttcgagcaaagc

SEQ ID NO: 44947 - DNA, 215 bp, Triticum aestivum
  unsure (1)..(215): unsure at all n locations
  Clone ID: PAT_TA_44947
cgtccggtagccgtgctccggtgtgttgccgagcgacggggtgtgccgagtcaagtgtgaggggcgcgtaggagatgtagtctctatcgggaccatgatgtgtgtccggtcgacgtgagagttcttccgggttacctcatgtgtgtgttcgagtggnagagagaaataaagccaagatactggcgttggtgcgtcacggtgntcgttgttagaaa

SEQ ID NO: 44948 - DNA, 270 bp, Triticum aestivum
  Clone ID: PAT_TA_44948
cgtccgcctcaagtcactcgggcggcccaagcaacccaaagcctctgcctcactcttccaagcaagccatgcagttaggctagctaagtagccaagctctagcagctgcccattcctccgtccatgccctctccctctcctcctcctcccgccaccaccgatgtcttgcgcggcggcggaggccggcctggtggccatggactgcgtggtggtgtgctgctgctgcccgtgcctggtgctgcagatcaccgtgttcctcttcgtccggct

SEQ ID NO: 44949 - DNA, 184 bp, Triticum aestivum
  unsure (1)..(184): unsure at all n locations
  Clone ID: PAT_TA_44949
tggctagccacgcgtccgcccacgcgtccgcgctcatcctcatcataatcctgtgcggtgtgccacggattcaagtgcgtcaagaagtgagggcaactcttactcnttatacacattcaactggccctatattactctggtgatttgagcaaaaaccatatatatggggcttatttcttttttt

SEQ ID NO: 44950 - DNA, 218 bp, Triticum aestivum
  unsure (1)..(218): unsure at all n locations
  Clone ID: PAT_TA_44950
cgtccgcccactcgtccgaaacacagtttctcaacatccaacactagaagcgtgaanttgagggttgagatcaggctggtgctaagcatggtttnccagatgacacagacgaacttttttggggttccactggcagaggggaaaggtcttctagagcaggtggacctccggtgggctttgaatcatatgtgaatttgcctgcgaaagggctttctggg

SEQ ID NO: 44951 - DNA, 292 bp, Triticum aestivum
  unsure (1)..(292): unsure at all n locations
  Clone ID: PAT_TA_44951
cgtccgaaaaaatgaagccctgactatcaaaagcaaaaaacatctccgaaaaggagatgaagaagggcatatagatgtacttgggagacgtggagtantgatgacgtttaanagtgggaccactatctcgtcgacgccgctacaaaggaggtgggccgccacaacattgtcttattgggctcgctttccttcctcccaaaaccaactcctcatgacgacatgatttaatcccgggtcaaatggaaaggttttgacagggatgcactagtacgctggttgacagaggatctta

SEQ ID NO: 44952 - DNA, 195 bp, Triticum aestivum
  unsure (1)..(195): unsure at all n locations
  Clone ID: PAT_TA_44952
tttatattttnagaaaaatnnnnttttgggggagtaaaataactgagaaccatccctctaaaatctatatcaagatccgtttggttcacataaaacgaagtatcatcacttagttcactttttttgctcggtagtcattaaccaatcaaatccatctaacataatttntattttaaaatttatatccaaatattt

SEQ ID NO: 44953 - DNA, 199 bp, Triticum aestivum
  Clone ID: PAT_TA_44953
cgtccgcacgccagatagggatgccacgacggcctgcccactaggcgtgttgcagggtccggacgcaggtgtttgccggaccaccattttcttcctgactcttcacttcttcagtttgtgtgtactttttattctttacggcttcttccttagacctcgctggttttttttattcggagtagcttttaaaaacaccatt

SEQ ID NO: 44954 - DNA, 141 bp, Triticum aestivum
  unsure (1)..(141): unsure at all n locations
  Clone ID: PAT_TA_44954
cgtccgcccacggtccgcccactcgtacgcggacgcgtgggctttcccccaaccctccccggcgggtgttcgatccgccggcggccaggctccnccatgtcgatccggatgctgaaccatatcgcggaggtgatggactag

SEQ ID NO: 44955 - DNA, 444 bp, Triticum aestivum
  unsure (1)..(444): unsure at all n locations
  Clone ID: PAT_TA_44955
cgtccgaacccctcccacctcaccttcggcgaccggatcggaggcgcgcgagcgcgatggggaacgagtcgacatggcggcggtgctggcggacctggagcgggacgcggcggcggacgcgcggacgccgcggaccaagctggtgtgcacgctcgggccggcctcccgctccgtgcccatgctcgagaagctgctccgcgccggcatgaacgtcgcgcgcttcaacttctcccacggcacccacgagtaccacaaggagaccctcgacgccctccgccaggccatgcacaacaccggcatcctctgcgccgtcatgctcgacaccaagggacctgagattcgtactggatttttgaaggatggtaaaccaatcnaactgacaaagggtcaagaaatcactgtttccaccgacttatatatcaagggcgacacgaacacgatctt

SEQ ID NO: 44956 - DNA, 353 bp, Triticum aestivum
  Clone ID: PAT_TA_44956
cgtccgactgaagccagcgttacacgaattcaagcaaaaaactgccgggttgccattgatacttaccgaagtgattttcctcaagcatatacttacgggagatctccttttccagctctggacggttttattgaatctatagcttcctttggaagtgtctcagggaaaattcgatgctggtactggttttcccaagatggtttaatgatttatagcatgtcaaggagtagatactgtgagcatattggaagagagcataaaagcaatcatggtaacattttactgttctctgtatatgactttcttgcacaggagtgcattactttgttgatgctgcttgcaaatgtaccata

SEQ ID NO: 44957 - DNA, 160 bp, Triticum aestivum
  unsure (1)..(160): unsure at all n locations
  Clone ID: PAT_TA_44957
cgtccgcggacgcgtgggatttcctccctccccgcgccggcggctccgtcctctgtatgagaagtgtgttgcgcctccngcttcgncntcctancagaagcagctatccccatcccctgctgcccaagaatggatgggtactcatgggaagctcgcgggg

SEQ ID NO: 44958 - DNA, 409 bp, Triticum aestivum
  unsure (1)..(409): unsure at all n locations
  Clone ID: PAT_TA_44958
cgtccgatttgtgggaaagtgtggaggcgcaagttgctccgcgactgatgaaggtgcacccgggggcttgccatgggtgaggacgggctccaaccgcggggcccaaagcagccagcctttgttcacatgcgtgtctccttcctgcttcacctagagctacttctccatgacgacaaggatgacgtcgccatgcgtgcacgctccaaactgtcccctgtcgcatgcccaccactcgttgctgatgcactccaacccgaggacctccactatggagggggtctcttagcctatcnacgaggtaactcatgttccttgtgcggtcttcgcccactgtgcgccctgctgccctcgaccttcttcctcacaatgnnnagcaggtttttttatttattgacattttaggcttgct

SEQ ID NO: 44959 - DNA, 353 bp, Triticum aestivum
  unsure (1)..(353): unsure at all n locations
  Clone ID: PAT_TA_44959
cgtccgattcttcagccaccgaatgaacccaatgatactgtagttcctgtacagtccatggggactgtactacatgctgagggagcaggtaaagatgcttctggtcataacacttctacctcatgcntaatcaaacatatcaacatgacgtatcatataacacataaaagtatattactgtcacatgatgttagtgttccaaagcctangcagttcaacaaaaataggcatgctgcttcagaggataaaaattctggtgagaagtcacgtgtgacagtaaacacaaaaaacgccnagaaatctgttgaggtttctttggacacatcaactgcttttgttacaccacatgatga

SEQ ID NO: 44960 - DNA, 436 bp, Triticum aestivum
  Clone ID: PAT_TA_44960
cgtccgcccacgcgtccgcccacgcgtccgcccacgcgtccgccctcttcctcttcctcttcctcttcccacaagtaaccgccacccccaccaccggaatctccccccctccgccgctcgctctctagggtttagggttccggcgagatgtcgacggcgaagccccgccccaccgccacccgcggcggcctcgcccccgccccctccccctcccccgcgcagcccgccgtggtgctgcgcaagcccgtcttcaccaccatcggcaagctgctgccgcagacgcacggccacaacctcaccgcgcgcgtcctctccgcccgcaccgtcctcgacaagcccgccgtccgcacccgcgtcgccgagtgcctcgtcggagaccccaccgtcaccgtcctcttcaccgcccgcaacggccagattgagatgctgaagccag

SEQ ID NO: 44961 - DNA, 268 bp, Triticum aestivum
  Clone ID: PAT_TA_44961
cgtccgcccacgcgtccgatacaactttgtattcctggttgctgaggatcatgattatatctcagaccggagaaacatcttggtttttcatttcactataatgtgctgtcagattattcactctcacatagaaatcagatgatttccattcattataacgtatgtacgctcaaatacccaagcctctatttccggggatgatatcttcaccatatttcaccacttgggtgaaagtgacttcaaagtgtgtggctagcaggcacgtgta

SEQ ID NO: 44962 - DNA, 222 bp, Triticum aestivum
  unsure (1)..(222): unsure at all n locations
  Clone ID: PAT_TA_44962
cgtccgtgttgatcttctaatggtgcctgaacccattgagatcactgtagcacccaagagctccggatggggggacaccactggactggccagtacagggcattccttttttacagctncagacagcatggttactgaagaagaaccttttatggtcaagacatgacgccaaatttatcacgaggacaataagtttaagtacctaagccgccgccgggcaac

SEQ ID NO: 44963 - DNA, 137 bp, Triticum aestivum
  unsure (1)..(137): unsure at all n locations
  Clone ID: PAT_TA_44963
cgtccgcccacgcgtccgcggacgcgtggggcctgcaaaatttgcaagagtctccccagcttttgcgacagcatatgttgtttcaaaggatggattgncttcagttcatgttcctgaatcataaagtggctcgccct

SEQ ID NO: 44964 - DNA, 280 bp, Triticum aestivum
  Clone ID: PAT_TA_44964
cgtccgagatagtgcatacttcaaatcaagtatgattgtggaaatggtaaccgtgacaaatgcctggtggaaacatgtgtgttactaatatgcgtcttccaaggaaaattgttaaatgagcatggagcaatgaacgagtgcatgagttgcacttattttgttctacatacgtcattcttggtcttcgtaccatctataatgtttgttgctgacttggcaatgggatgcatacatattcttttcccaatcatgcttgctggtttctgacataatttctgat

SEQ ID NO: 44965 - DNA, 444 bp, Triticum aestivum
  unsure (1)..(444): unsure at all n locations
  Clone ID: PAT_TA_44965
gcgcacgcgttcgcccacgcgtccgcccacgcattattttatacgcgatctggccttttacgtgttcctctttctcggggcgcaagtaaccggcacccccaccaccggaatctccccccctccgccgctcgctctctagggtttagggttccggcgagatgtcgacggcgaagccccgccccaccgccacccgcggcggtctcgcccccgccccctccccctcccccgcgcagcccgccgtggtgctgcgcaagcccgtcttcaccaccatcggcaagctgctgccgcatactcacggncacaacctcaccgtgcgcgttctattcggccgcaccgttcttgacaagcccgccgtccgcacccgcgtcgccgagngccttgttggagaccccaccgccaccgttctcttcaccgcccccaacggccagattgagatgctgaagc

SEQ ID NO: 44966 - DNA, 396 bp, Triticum aestivum
  Clone ID: PAT_TA_44966
cgtccggctggctagcatcctcccctttctgcttggtattcttatctgtataatttgatttgttccaagcaccgcggctggacaggatttttcgaaaatactgtagaaatcatgggggaaatccccgatccgaccttttatagaaccaccccaatctaactacatgtgtgcagtttgctggagtttttttccaaaaagaaaaaataaagttcggtttaggaggagaaccacacttaggttggaatctatattggtggtaagaggatgagacgctttcagatcttgagctgggttgggaaaacgctacttttattttgtacgagtgagtaacgtttctgttatgtgaagtggctgttttggtagtctttacttctcaaaacgattactattttgatg

SEQ ID NO: 44967 - DNA, 405 bp, Triticum aestivum
  Clone ID: PAT_TA_44967
cgtccggcccgccttccgcgccgccggatccctcccccgcatcgcctacgtcatctccggatccgccagggacgcctccgcgctgcgccgcgtcctcctcgcgctctaccaccccaggaacctctacgtcctgcacctagatgccgaggcgcccgagtccgaccgacgggacctcgccgccggcctcgcggcgcaccccgtcatagccgtcgccggcaacgtccgcgtcgtcgagcgggccaacctcgtcacctaccgggggcccaccatggtcggcagcaccctgcacgccgacgccgagctcctctggggccactccggcgccggcgggtccgactgggactggttcatcaacctctccgactccgactacccgctcgttacgcagacgatctgatccatgtt

SEQ ID NO: 44968 - DNA, 177 bp, Triticum aestivum
  Clone ID: PAT_TA_44968
cgtccgcccacgcgtccggcgtgttcagcagtaaagatcaatggccatatcatcaagtgctactgaaagcaacaaatcataatctttaagaacaatggcatataaactaagaacatcaaagcccacgcgtccgcaaagtcatgctgttatgataaattatgttgttgctgtgaaaaa

SEQ ID NO: 44969 - DNA, 354 bp, Triticum aestivum
  Clone ID: PAT_TA_44969
ggagggacgacgtacgcgtccatccccgctgcatgggagactaaggcaggcggacctagcgggccccgtctactggcgcgcgtggccggacccgaccccttcaccgccgcccgtccttgccctgaccccgaccgcatggccccagctggaccctacccctacggcatagggcccgacgggccagacccaagggctcggcgtctcactcgccgagctgcaccggccaccggtaggcgtgcctgccatggaggcaatacggctgtagtagtgctacatagtttttaaggcaaatccttcataggtgattgacatatttcctatctgtatgaactagcgtgcggcgacttgagtatg

SEQ ID NO: 44970 - DNA, 401 bp, Triticum aestivum
  Clone ID: PAT_TA_44970
cgtccggggaaggcaggcgtaacacggagtgcctctcgtggggcattgataaagaaagggttctgcgaaggcgcgaaccgccgtggaggtgtactttgacttcatgagaagcttccgagtagaatttgacgagtatttcgaggatgggatcatttcagaaattgaggttggactaggggcttgtggagagttacggtatccatcttatgcagcaaaccatggctggaaataccctggcattggagaatttcagtgctatgacaggtacttgcagaaaaatctgaggagggctgcagaagcacgaggacatgctatgtgggcaaagtcaccggacaacgcaggccactataattctgaaccaaacaacactggatttttctgtgacgaggagattatgatag

SEQ ID NO: 44971 - DNA, 400 bp, Triticum aestivum
  Clone ID: PAT_TA_44971
cgtccgcggacgcgtgggtagcggcctgcatcccccatcaagcgtgcatcggtgctggatgtgcaagcttgagcaaccgcatcaacaacgatggtgggcaagcaaggagcgagacggtggtcacgattttcagtctgaagttgcttttatgaactatcagtcaacgttagcacagagtatatatagtatttcttctgcactgagccgaatagtttagctaataattttttccttccgaagcagttgaagggaatggtaaccaaatccacctttgttggtcatggatttagaagaaagccaacagagtatgaaaaggttctcatgggactcaccctgaactgaaatctccgttcaaccttggtataattttgtgacaaaaaccccagtggtccaatatttt

SEQ ID NO: 44972 - DNA, 399 bp, Triticum aestivum
  Clone ID: PAT_TA_44972
cgggcgcccactcgtccgcggacgcgtgggcccgcctcatccccttatcgtgccctctccaccggcgacgcgcggcgccatcctccggcgacctaccgtcttccccggcgccggtggagaccacgggtagtacttccctagtccgggttgcgctatttcgaggcactaacctatccggttgcgccatactggataaaggcaagagttctgttggtgcattgagaagccacactttgattttcttagataacagatgaggcgagctcggaggcttacgtcggtgggatgactgttcatgtatgatcgtgacattgatgaactttctacggtcgtgttggagaccttcatccaaccggtatgcccggacaggcttatattctgtcggtggcatgatggact

SEQ ID NO: 44973 - DNA, 402 bp, Triticum aestivum
  Clone ID: PAT_TA_44973
cgtccgcccacgcgtccggcaattatggcaaagctattatctgacaatggaagtcaagagtttggtgattttaaacttggcatacatagaatgctgtctatgtatctctacgaaaaaagaatactggaaacagctaagtcaggtatcgaggatgattcgttctataccttgagcttattaaagagaggggtttggcatggatttgctccacagacttttgtctggtgtgtatgcaactgctcactttctaaagaaggtgctatttcagcagttcgagtattcagttgtggacatgcaacacatcttcactgtgagtctgaacaaagcaaatcatccaataaggattttaaagagggatgtgcaggttgtctctcaatgagtgaacacaagcccgaaacaaat

SEQ ID NO: 44974 - DNA, 399 bp, Triticum aestivum
  Clone ID: PAT_TA_44974
cgtccgcggggctctcagtgggttcgctggttacaaggttgcgaaaccaggggatgcgagtccttgtgccttagtgcttcccggtgtgaaggaggtaattgcacctgaaggcgagggtggttacaatcctgggcaaagcatgatgggatgcagcactcaatgtcaaatgctggagatgatggttacaaacaagggcagagtagtcaggtacacggaggaaatatcgatgattattacagtggggaggtggacggtgacgaggtacatgggcacatgcagaaccagatggaagatgagaatacagatattgacattggtcatgccgatgattccgacgagtctaatggagaagggaacccagaggatgtgccgaatcctgcatatggaatcatgactttt

SEQ ID NO: 44975 - DNA, 406 bp, Triticum aestivum
  Clone ID: PAT_TA_44975
gacaaaatcgatggtcatgttacctttcccccctccccccaggaatcctccccacttttctggtccgtgggctcaacagatctcgccaggcctccccccggtccccaatccaaaacggtggggagctctcgccagctgagatccaccggctcagccgggttttcatagtttcaacaatcctggccgaatggtgttttagcatggttatagaagggaagcctttgaaatggagattctggagctctggcattggtacacacacacctcgatcatggcaccacgcaacagaacttcatctagaaaggctctctgggtcatcggcttgattggttttggctgggcgatagtcactggagcttatctttataaaccccaacattacactggttggtacttgtgcaattct

SEQ ID NO: 44976 - DNA, 404 bp, Triticum aestivum
  Clone ID: PAT_TA_44976
cgtgcgaccacccgtgctacaattcctgatggggtgatttttcaggacatgtctcaagactattgtggaaaccattggtcgggccaaggatacaacatagcatacaacattactcatgcttctactggaggttatgatggaggatatactcgtggacatacacatgggcctcaatgtagatattctggcaattatgcacacccaagatcccatcctagagacccacctatgggcacaacatatgacaatcactttgacgatcagcatagaccatgggtcaaatcgagtggtatcccacggcggataccacgagcaatcacatgatgtacattatcagctgcatgctcgactgcatgctcatggacatattatggcacaatactatggcaatcctatgtactctc

SEQ ID NO: 44977 - DNA, 329 bp, Triticum aestivum
  Clone ID: PAT_TA_44977
cgtccgcggacgcgtgggcggacgcgtgggcggacgcgtgggctacgatcttcccaagagcataggggattacgtccacaggagtggaagaactgggagagctggaaatgctggcagtgccaccggcttcttcactgaatccaaccaccccatagcaaagggattactggaactgatgaccgaggcaaaacagaatggtcctccctggctagaggactatgcagggaagccattctatggagggtcaagcttctgcggaagaggtcgaaggtccaatggggatggtggcagcagctctggtggcagagaatatcgcggtggcagcgact

SEQ ID NO: 44978 - DNA, 240 bp, Triticum aestivum
  Clone ID: PAT_TA_44978
cggccactcaatctataattacctttcaattcaaattcttttttttttctctttaccggctattaacatcaagcgttaaaatccttgggccttatcaattatactcttcacaaatacaccttctcttattctcctcctaaacatctctccaccaaatcttcaacagatattttcccctaccacctgattctttaaaaatccccacctctacatactcattaccttttttctccttaatat

SEQ ID NO: 44979 - DNA, 398 bp, Triticum aestivum
  Clone ID: PAT_TA_44979
cgtccgagcgtcgccgctttcgaactccgggcgcggacgcaagcacgcacgcacgcgtgcgtgcggcatccacaccggaccggccccgcgagcgacccaaccctagccgcaatccccacccgccgtcccaccctcccctccccgcccgccgatgcagaccgaggcgcgggtgggcggcgtggccctcgacggccgcggcgccgtctcggcctccccccgccaggagcagcagcagcgccacatcggcaccggcgcgcacctcgccgccgggggcttcgccggcgtcgtcagcaagacctgcaccgcgcccttcgcccgcctcaccatccttttccaggtatgcattcagatgcttcagctctaaggaagtgtagtatatggcacaggctttacggatt

SEQ ID NO: 44980 - DNA, 394 bp, Triticum aestivum
  Clone ID: PAT_TA_44980
gcgcggcacgcgtgcgcccacgcgtccgccgaccaccgccccctccccctcctcctccgcgcattcccctccccgggggccggacagcggcgggcagctcccgccgcctccccgactccccggcccctcggcccccggccgcgcggctggtttctccttcgcgcggtctggtatctgcaggcgctggtcgattaagcattggcgtggggaaggtcagaagcacatttcggcatcggcggaaccataagctagacttctctaggcatatatccttcagccctcaacgagaagggttcggctattctgggatggacgctttgcacgggcaaacctcgtgtggatcattgctacaaaaactgcagttagtatgggatgaagttggtgagaacgatga

SEQ ID NO: 44981 - DNA, 263 bp, Triticum aestivum
  unsure (1)..(263): unsure at all n locations
  Clone ID: PAT_TA_44981
tcttcctctagtacctatctggctcanacgcattctcacatagaggaccaatctcangattccagaggcttatgtgatgggcagcaacaaacttccaccctcttaacctacattattaatagctatcttccacaaagtttgcctaatataacccatcaattataactaagtggcactctgcaactttccaatcatgcgcaaggcttattcttcataagttcttttagaatctccctcatttttttggctcctcccatttctta

SEQ ID NO: 44982 - DNA, 242 bp, Triticum aestivum
  Clone ID: PAT_TA_44982
cgtccgcggactcgtgggctcgctcgctcgctctagggggagacgtcgcgtccaccatggcgtggtccttctgcgggctcaacgcgctgtacgacaccgtcggcggcggcggcggctacatctgggtcaacgactaccggttccgcgtgctccgcaggctcggcgacgcctgccccgcgggctcctccggcttcctcggcaaggaggtcggctccgccgacggggttttcgacggtatccgg

SEQ ID NO: 44983 - DNA, 374 bp, Triticum aestivum
  Clone ID: PAT_TA_44983
cgtccggccgacagcggcggcggggacagagcatacaacgattctgcaccggcgaccaaggccagggcacccaggcaggtttactatgtcctcgacagccggggatgaaggtcatgctcgcggctcgccgccgtatgtccagaagcaatgccacatccgcctacaattccatccaggctcgctaatctgcatccatgtttcttttctgatctcttcccaatctgacctattcacataattttatacggccatattttagataggctcttgatgagtgcaccatgtatccatggttgcaaaatgattcctgagatttccttggtaaaatttctggaatattttaattgtacataaattgggtgtgccatcataac

SEQ ID NO: 44984 - DNA, 401 bp, Triticum aestivum
  Clone ID: PAT_TA_44984
cgtccgggccgtcacaaatggccaccttaagacggctctcgtgggcatgaacccgtgcgcgctgggtgagaccgttgtcgaggtgcccaacgtcagctggaccgatatcggtggcctcgacggcgtcaagagggagctacaagagaccgtccagtacccggtcgagcacccagagaaattcgagaagttcggcatgtcgccgtccaagggcgtcctcttctacgggccaccaggatgcggcaagaccttgctggcgaaggccatcgccaatgagtgccaggccaacttcatcagcatcaaggggccagagctgctcactatgtggttcggcgagagcgaggccaacgtgcgcgagatcttcgacaaggcgcgtcagtccgcaccggcgtgctgttcttcga

SEQ ID NO: 44985 - DNA, 397 bp, Triticum aestivum
  Clone ID: PAT_TA_44985
cgcacgcgtccgcccacgcgtccgcccacgcgtccggccacgcgtcggggcacccgcctcctcaacctctgcgacttccgtgacgaggcccactctggctcgtgggaccactccgccttcgtccgcacctatgcgctctacctcgaccagcgcctcgagttcctcctccacgagcgcaagcagggctccaacgctaatggaagcgccagcctgaacgggccatccccgcgtgaccggtggggctctcctgacccgtatggccgccggtcaccctcgtacacctcccctccagggaatgggtatggagggtacgatgataaccgtgacagcaggaatggcgccaactctgatgacaagaggccacctacccctgtgagggatatgaagccggagcggt

SEQ ID NO: 44986 - DNA, 416 bp, Triticum aestivum
  unsure (1)..(416): unsure at all n locations
  Clone ID: PAT_TA_44986
tgggggaggcacgcgtgcgcccactcntccgccgacgcgtgggccccggtccaaaatccccagagtccttatcttccggggctactcanacatggcggggcgcggcaagggcggcaaggggctctgcaagggcggcgccaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccggccggaagaccgtcaccgccatggacgtcgtctacgcgctcaagcgccagggacgcaccctgtacggattcngcggctgggagccgcggcgc

SEQ ID NO: 44987 - DNA, 419 bp, Triticum aestivum
  Clone ID: PAT_TA_44987
ggggggacgcgggcgcaccccgctggcgcgcctaccctaacccaagtgcccccacacccggagccttcctctgggggcgacggctcggccttccaccgtgacgactaggaactgccggatctcgacggatccggtggggaatggcgcgcaggcggcgaatatgaaaggaaggtggccggatcatggagctcgactggtggccggggtgccatggcatcgggtaactgcgagagaggagaggcgagcggaaagaaaagggaggacaggaggaagcagatgggaggccggagggagagagaagagagcggtgaggcatggcggcggtcctgttgctgctgcttgccgatggttcggcagccatcggccgaggtgggactcgggtgcgcggaggcgtcagggatcaggagctctcctccctc

SEQ ID NO: 44988 - DNA, 406 bp, Triticum aestivum
  Clone ID: PAT_TA_44988
cgtccgcggacgcgtggggccgtaaccctaaccctaacccctagagcagatccagccagccgcagtgcgagcgtcaccggcgtctcctccgcgccctacctcaaaaaagataaagccggagaaactggaggtaggttctttccgcctcgtcgtaacacctagcccgccgcaatgcgagcgtcgtcgggatctcctcctatcccgacctcgaagggggagggtgtgatggaagttgaatcggatcaagatcaggatgattgtgatgtgatgattgagcctgccgctgccctcaggggtctctatgcgatgatggtctcatggtgtgaccaattccttgatattgatattgatattgaggaggaaggggatagatccggtccttcccttgtgatgatccactttcccc

SEQ ID NO: 44989 - DNA, 403 bp, Triticum aestivum
  Clone ID: PAT_TA_44989
cgtccggacggcggagaatggtgcaaagcattaacaaaatagcctggttgaaatggcgtcgctgtgcgcccatatcagaaccagactggaaggaatcatcctgacttcaccagctgtgcgtgtaaaaccagcgcatccgatagttggggccgtggcaccgatattctctctgatagcacccaagttccaattcaagggagccaacaagcgcggcatcccggtgtcgcgcgaccccgccgcactgctagcgaagtactctgacccgctggtctacacggggccgatcagggtccgtacgggccacgagatcctgcgcatctcctcctacctgctgcacaacctgaagaaggtgacggtcccgttcgtggtcctgcacggcacggcggaccggtgacggacccgc

SEQ ID NO: 44990 - DNA, 161 bp, Triticum aestivum
  Clone ID: PAT_TA_44990
cgtccgtcttcttcttttctgcctaccaaccaaagccatatcccttgattcaatccatcgttgagggggctctggggcggttgtaggacctacccttaaaagcttttacttctactaagacccgtgcttggtatggcgcaaacaactgttgtggtgccgga

SEQ ID NO: 44991 - DNA, 198 bp, Triticum aestivum
  Clone ID: PAT_TA_44991
cgtccgggggttggcttctcctccccactcagtcctcggttcccggtccggtcccgttccgttcgttagggtttagtagtagcggtgaagaggaaggaatggcggacgtctagtaccgctgcttcgtccgcagcctctccttgttcttttacgaccactttttttttaatatatttttctaattatttctttctcttt

SEQ ID NO: 44992 - DNA, 421 bp, Triticum aestivum
  Clone ID: PAT_TA_44992
cgtccgcttctgacccgactgaagctgaacgattgaggttcttggcttctcctgctgggaaggatgagtatgctcagtggatagtagctagccagaggagccttcttgaagttatgtctgcattcccttcagctaagccgcccttgggggtattctttgcggcgatagctcctcgtctacagccacgattctactccatatcatcatctccaaagttggctccctccagaattcatgtgacatgtgcattagtttatggtcctacaccaacagaaaggatccatcaaggagtttgttcgacatggatgaagaacacacttccactggaatatagcgaagaatgcagttgggcaccaatttttgtgaggcagtcaaattttaggttgcccgcagatccatccactccaatcatcatgattgg

SEQ ID NO: 44993 - DNA, 202 bp, Triticum aestivum
  Clone ID: PAT_TA_44993
cgttcgctggagcagagatcccttagttgaccaattccacggctggccgggagggttttgttggtttggaacaatttcttaaagggccttcaccacaggaatttaacgcactttttattggttgattggaaagaaccgataataaaaacaagcccccgcttgtgggaggccgataaaaaccacccccctaccaaaggggtgg

SEQ ID NO: 44994 - DNA, 264 bp, Triticum aestivum
  Clone ID: PAT_TA_44994
cgtccgcggacgcgtcgttctccgacggcgcggccttcttgcgtactgcggcccgacgaacttgccgttgccgtcgccgtcacttgcatctctccctctccgcctgttcccttctactactgccagtcaccctgactgcgacctttgctcatattactcatatctatggccgctccctgcctgacacggctcttgacttgcctgacgaagccttgtcctgtgttgggctcaggcatgcacagttacctcttgtggccctggagc

SEQ ID NO: 44995 - DNA, 422 bp, Triticum aestivum
  Clone ID: PAT_TA_44995
taccggtccgggcttgccgcgtccggaattgcgtgcgcccacgcgtccggctcgtttcaaaccctccttgcgaccccagccgcgatggccgccgctatcgccggcgacgccgaaaccgacctcaccctgcccgtctcggatgacctcgacgacaacggtttccccgcgtcacccccaccgcagccaccaccagcagcttcgccgacgacttctaccgcagcggcatcgactggtcctccctgcaagcccctccttctcatcggaggaggccagccgctggaacaatagagacagtgtgcggcccgttggttcagaagaatctcttccaggcgtgggggatcgagaagccagccgctggaatggcgcagaaagtttgcggcccgcaggttcagaagaacctcttccaggcgtggggaatcgag

SEQ ID NO: 44996 - DNA, 420 bp, Triticum aestivum
  Clone ID: PAT_TA_44996
cgtccgcggacgcgtgggtttcaaccagtcaaggttccagagcccactgttgaagaatcaatacaaatcttaagaggacttcgtgagagatatgagcttcatcataagctgcgatacacagatgatgctttagttgctgcggcgcagttatcatatcagtatatcagtgaccgcttcctgcctgacaaggctattgacttgattgatgaagcggggtcccgtgttaggctcaggcatgcacagctacctgatgaggccaaggagctggacaaaaaacttcgccaaataacaaaggacaagaatgaggctgtgcgtggccaagattttgagaaggctggggaattaagagacgaggaaatggagttgaaggcccaaattacagccattattgacaagagcaaggaaatggttaaagcagag

SEQ ID NO: 44997 - DNA, 413 bp, Triticum aestivum
  Clone ID: PAT_TA_44997
cgtccggcggcgctcgccgagttcatctccacgctcatcttcgtcttcgccggccagggctccggcatggccttcagcaagctgagccccgacggcgcggcgacccccgccggcctgatctcggcggcgatagcgcacgccttcgccctgttcgtggcggtgtccgtgggcgccaacatctccggcgggcacgtgaacccggccgtgaccttcggcgccttcgtgggcggcaacatcaccctcttccgcggcctgctctactggatcgcccagctcctgggctccaccgccgcctgcttcctcctccgcttctccaccggcgggctccccaccggcaccttcgggctgaccggcatcggcgcgtgggaggcggtggtgctggagatcgtcatgaccttcgggctggtgtacac

SEQ ID NO: 44998 - DNA, 339 bp, Triticum aestivum
  Clone ID: PAT_TA_44998
cgtccgcggacgcgtgggcgtgaatgacacacacgcgctaacggactgtcatctggttttcatgctagggaacgggacgcaccacaccggcgacgacaataatgtgtgtgactacggcccagctgtcgtagccgtgcgctatgacggccatattaagcttgatgctcttcacgctaaggaggcccagcaaaagacagcgcacgctcaggaggaggctggctcagtgttgccagatcgcgatagccacagtgatacacagagcgagaactacacataaagctatatatcggatccgggcatgcgcacattgggaatttggtgcacagtgcaaatactata

SEQ ID NO: 44999 - DNA, 420 bp, Triticum aestivum
  Clone ID: PAT_TA_44999
cgtccgcccacgcgtccgcccacgcgtccgaacaatagtttcaactgttccagagttggattatatttggcagggtgattttgagctgtggaggactggaagatcacctgagctatgtgatggttttcaagctcacttatcatgttctgcttcaccaaaagtgctggaagtagcaaagaaattcccttccagagtccagcttgaagaactgcctcgtcgaaactcatggcccacacagtttcaacaaaatggacccacatatgagaatattggtgttttcttctttgctagagatgctcagagctatgaacatcattacagtaaattggttcagaatatgctaatcaatgatttggcactcagaggaaatatcgaaacagccgaattaattatattcccttctaacatcctatcaaagaa

SEQ ID NO: 45000 - DNA, 432 bp, Triticum aestivum
  Clone ID: PAT_TA_45000
tggcgtacgaggtgttcttagcggaggtcacgtgaaacgtggaccattacaagccctacaggtggctcatccttagacgacagaccacacatggccagaaggtccgacagtgcctcatggaggggcacaccaaatgggtgcacgcggcgaacatgatcaacactaaactgcggaccaccctgctatacaagctgtgcggcaacgcagtcgttgacgcacagtgatattgaacgagagacgctcatgaccatgactgcgcgatgtcactctggcgaactggcaccaaggagtatttacgatagcttctaccgtctccaaggagtgactcgcctggtacctgaacgaacaggcgaaaaataagtcaggctgtgcatcaaacgagacatacggttgctgttgaacatatagttgagatggacctttgcgcagcag

SEQ ID NO: 45001 - DNA, 423 bp, Triticum aestivum
  Clone ID: PAT_TA_45001
cgtccgcggacgcgtgggttttttttttttttttttttttttttttttttttttagaagaactgaaaaaaaaaacagatttactgcaaccagagacttttccaacaggcgataataaacataatgttgctacaacatatatgtcttgccacggttgacaaaggaaaatcacatatgatatttattagagacggtggctggctgcccatgaaggcaggggcttattagtgatcctcgttggtgtcatcatcatcatcttcctcttctcattcaattggcgcgagtcttcacgttctccggagtctcaaggaggaccataggtgcgctatgctcacaaccatgcggggttcttaagcgcggtgacgaccgccttgacttgtaggtagttcttcaggctgtcaatgcccttctccctaccgatgcc

SEQ ID NO: 45002 - DNA, 262 bp, Triticum aestivum
  unsure (1)..(262): unsure at all n locations
  Clone ID: PAT_TA_45002
aatacccgncccgacccacnctttcggggagggcgtctttctactcgtctctctccgtgcttccgatccttcgtcctcctccttccggagttcgccagcggggcagtccaccaaccacccccaccctccgtcatgtgggagtgcatttcgttccacattgtccaggccggcattcaggtcgggaacgcgtgctgtgagctttattgcctcgagcatggcattcattctgatggccagatgcccggtgtcaagaccgttgggg

SEQ ID NO: 45003 - DNA, 412 bp, Triticum aestivum
  Clone ID: PAT_TA_45003
cgtccgcgcacgcgtgcgcggacgcgtgggtccgatcacccctcctagggaatggcgccctagagggacgcagatgaatcaccgcccacgtggcccaaggggctgggcacgggcggatcgaatgcggacatgaaggtgctgctcgacaacatccactgcatgaccaagccgccgatccggcagatggctcgccggagcgtgctaaagcgcatataggtgctcatctacgaggagaccctctgcgtgctcaagatcttcctcgagaacgtcatccatgacgccgatacctacactgagcacgcgcgccgcaagaccgtgaccgtcatgacgtcttctacgcgctcaagcgccagggccgtaccctttacggcttctgcggctaggcttacctttactcgaggcggcttgttta

SEQ ID NO: 45004 - DNA, 408 bp, Triticum aestivum
  Clone ID: PAT_TA_45004
cgtccggcgtgctcaggtttgtcaatagctgtcctgatactgatctcagaactggaaacgatggagagtatgttaaggttacaggtgttcttacttacggaaatttcgctttggggttgccgttggatccggatccaagatgtgtgtacacttcaactaggctgtatgagtataggggctggaagttgaagactgcacatcccaaacatcgccggtttacctgtggattaccgacagcagagcgacatgcggtcgatttctacatttcagattttcagtctgggcttcgagcattggtgagaacaggaagcggtgcacgggtgacaccatatgtcgatgaatcggtagtaattgacgtcaatcctgagaacaaggacatgtctcctgaatttctaagatggctacgag

SEQ ID NO: 45005 - DNA, 438 bp, Triticum aestivum
  Clone ID: PAT_TA_45005
cgtccgcggacgcgtgggcggacgcgtgggcgctgatctatggatctatcattgtaagagtcgataatatatgatgagctgcctcacaccatcatttggtctttgtggcatttgagttggcaaatttgttggattcatgcgattaggcatgccatgtaaatcaatctgcaatgggaaatgggagtttgcaaactaccggagtctaattgctgagggacgaggttcgtaactgagggtcatgtgcagagctggaggaagaagttgcgaggcttggaactctccttgtgaagggctcagggacaacattttgtgcagaccgaaagaagccaaagctgaaggttggcacacatcctatctgggagtcatttttcgaagctaacttagctgacagggatacaaccaactctgtgacatcgtcattaaatggtatttcggaga

SEQ ID NO: 45006 - DNA, 437 bp, Triticum aestivum
  Clone ID: PAT_TA_45006
cggaaccacccctccagtcttccaagtttttctctccgcgatggagccacccggttcaggttcaggttcaggagctgcagaaccggtcgaggaggagcgaatccaaaaaccggcctgcaacgcctcctccaacggcgatggggccccgaccgttgctgcgccgccacctgcccttcacctctagcaggccggatgcggcgccgatgggtcgcgccccgccgcggtggtcgacctccggaagggcaaggcgatcgccgacagtccctttccgccacctgtttccccaagctccgcgggcagcatccgacgactgcgcctccgccttcggagccggtgggtcaagctcctaggcatggaggaggatgttagagccaaagtacacaacactgacgtttgactactcgcggcatttgcagaatgaaggacgagaggctcac

SEQ ID NO: 45007 - DNA, 431 bp, Triticum aestivum
  Clone ID: PAT_TA_45007
cgtccgcccacgcgtccggcaacacacagcagccaagcgaagatgtcgggtcgcggcaagggagggaaggggctgggcaagggcggtgccaagcgccaccgaaaggtgctacgtgacaacatccagggcatcaccaagccggcgatacgccgtctggctcggaggggcggcgtgaagcgcatctcggggctcatctacgaggagacccgcggcgtgctcaagatcttcctcgagaacgtcatccgcgacgccgtcacctacaccgagcacgctcgccgcaagaccgtcaccgccatggacgtcgtctacgccctcaagcgacagggacgcaccctctacggattcggcggctaggccccgcgaatcgagcccacgccaacagattagttgctgtagctagctatggttgtgtagtgttcatggtctttgat

SEQ ID NO: 45008 - DNA, 420 bp, Triticum aestivum
  Clone ID: PAT_TA_45008
cgtccggtcggacactggacacgggatgccttcttctccttacattacggcccgcccaacccgatggggaggactgggctggtgcggctcatgagtcccgatcacgcctgctgctggagatgcacatcgacgatctcccgagggacgacgccaactacacggcgctgacgccgctctggttcctcgagcgggccgccctggcccagccggacagggcgtccgtcgtgcacggcccggtccggtacacctgggccgagacctaccgccggtgccgccgcctcgcctctgcactggcgcgccgatctgtcggccacggcagcactgtgagcacaaaggctatatacactggtattgcaaaacaaggagtgacgcatttctgcgctgcgcccgtcgtcatgaacaacctcataaacgctcctg

SEQ ID NO: 45009 - DNA, 278 bp, Triticum aestivum
  Clone ID: PAT_TA_45009
tcttcccaccaggcgtgggcggactcgtggtctaccctaggattccacgctcgtgcggtgacttcgccgaggtcgaccccgtctcttccttactacgagcttgtcatggactcggtcctgaaagaggatcgtgccgtagggcgccatcgtccgtgcctacgacaagtgccccagaaaatattgtttagatcaaacgtggtgtaggaagcaatttgattccatgcactcaatttttcatcacttctggttgtgcctatggtacaagttgccattttctt

SEQ ID NO: 45010 - DNA, 431 bp, Triticum aestivum
  Clone ID: PAT_TA_45010
cgtccgcttcagttggatatgtcaactctgtagagaaaggtaataatgcatctgagcagagtcctacagaagtgaggctgaatgatgcaaatctcggcagtggaaagataccaaaactgagattcacacgcaagaaaaaggacagatccttgaaccatgaaaccagcagctttaaccctgataaccttatcaaagtagagacgatggagcatggtgctttgccccataaggttagaaatttaaatgctcaagcaactcgaagtatggaaattgatactgatcatccctcagttggtgataatcttatgaggaactctggtgatattgctatggtgcttaaaaagctaatcgaaagagggaatgctagcgtgagtgatatagcatccgaagtgggtatttcttcagcatccttggaagctgctctcgtgggt

SEQ ID NO: 45011 - DNA, 311 bp, Triticum aestivum
  Clone ID: PAT_TA_45011
cgtccggcctcgctcaccatcacgcgtacgttcacgcggacgaacgaccaaacgtatgccactccggggacccgtcgagatggcgagaaacagggtatagtgctagtcttgtgacactccattattgcttgctaatctcctcagccttactggagtgtacaagggtgacccacggacaatgcccagacatataccaccaatggagtctaaaagggtgctaaagactctgttcctgtgcttgcttggccagatcattcagatctctgtatccaatgtccagacctatctttgggtgggttattcattcttat

SEQ ID NO: 45012 - DNA, 436 bp, Triticum aestivum
  Clone ID: PAT_TA_45012
cgtccggatgattctaagaaggaagagggggtgggtgctgtaatgaaggcagaggttgaatgcgtggttatggagggagagggtgctgagaagaaagtgttgaccattaagggctagcgcgttagtggctctgacgagaggaagctcaagatgctggtgcctgcaaatgatgacgatatgggatatgatctgatggggacgaaaaatgagaagggctaactggctcaggtgatggttatgaccaaacggatgttcttgaggaattggactctgtccagctttcgcagtcatccaatatcaccaactatggtgcccaagcaggaagcaatgagcgtgcttttgttgagacccaacgtctgcaagttagaagctgcacaaaggatattatgactggaatggcatatggtagagctgtggacttgacacagctatatgg

SEQ ID NO: 45013 - DNA, 438 bp, Triticum aestivum
  Clone ID: PAT_TA_45013
cgtccgcggacgcgtgggcggacgcgtgggatcgccgtcgtagtttttttttgcgtcaaatcgtccattttattaacgcgtcgagatcgacagcagcagcaggacatgacttttgagcttaatttctcttgttttctcttctccagtagtctttactcctggcgaggaaattgtttatactctgaatgttacgatgtttattcaccttcctagcaattggttattggttccaaatccatggcgcttcatgttttttcaggtggttttcttgcggggtggattgaaacatcgaaggatggttctgaacaagctgcttcagctgtttggagttggcaagaagaagtagaggaaggattcgaagataaaaggtgatctgcccttcccgatccaacatgatttattcgtcactggttgactgctatttgaatcacatggtcg

SEQ ID NO: 45014 - DNA, 390 bp, Triticum aestivum
  Clone ID: PAT_TA_45014
gacccacgcgtccgcgcagccaaacataaacacaaggcggagtcgatcagttcacgcctcccccctgcccctccaaactcgtcgccccttcttcccttttccatttccctcccaaacacggaggtagaatcccgaaatctctagggtttgctctccccgcgtcaccacatcccccccccccgcggcggcgccctgtcaagcgcgagataaaaaacaccccccgcgaccgcgaattcccccacttcgcgtttgctctctcgatttgtgcaaatcttttgtttctcctcctccaccagcgattagtttgttgttttcggcatcactccgcactaggccggccgcgctggcctcgtcgtattcttccccaattacgccggccctccgcgcccg

SEQ ID NO: 45015 - DNA, 416 bp, Triticum aestivum
  Clone ID: PAT_TA_45015
cgtccgcccacgcgtccgggaggcgacggctatcagcattggcaagtccgtgttgagcggggcgctcaactatgcccagtcagccgtggccgaggaggtggctctgcagcttggtgtccatcgtgaccactccttcatttcggccgagcttgagatgatgcaaggtttcttgatggccgcacatgatgagcgggacgacaacaaggtggtgaagatctgggtgaagcaagtccgcgatgtgtcctatgctgtcgaggactgcctccttgatttttctgtccgtcttgagaagcaatcctggtggtgtctctctcgcaaggtgctagctcggcgctatgtggcgaagcagatgaaagaccttagagctgaggtggaggaagtcagccagaggaaccaacggttccaccttcatcaaa

SEQ ID NO: 45016 - DNA, 442 bp, Triticum aestivum
  Clone ID: PAT_TA_45016
cgtccgcggacgcgtgggcggacgcgtgggcggacgcgtgggcggacgcgtgggctgcaaggcgaccgagtcggcggccgtgccggtgatcctcgagaccaccgtccgcaccgacacagcagcagctcccaacgtcgccgtcgttcccggtagcagatctggtgctatcagttctgagactcaatctccggcaagctcctcggatatcacatggagcagcggcggcagcgacggcggtgccaatgtaccgccgagagagcgcgacgattattcgcgtatgttcgctatcgaggatgactgctgggggtggaacgcctcgccgccggcacccgctgctgctgctgcgttgctccaggagatggacttcgacggaccgatcaggtcgccggtgcacgtcgcggcagcggacggaagttggattaacgacttgttcgtgaacgaa

SEQ ID NO: 45017 - DNA, 434 bp, Triticum aestivum
  Clone ID: PAT_TA_45017
cgtccgcttattcgtctacatgcgctttggcagacaccacctcgtacctttgaattgttgggttaccgagtccttatgcgtgcccatgattctctagatcatcggtctgacggctcatttatagctaataacgtcattcactgtgcctgatgaaggtgtgccactactagacttggactacacttgttcctgcggcggctattgctgataaactagctaaaatggctacattggccattatgaccattcctgagctatctaaccttctaatcacgggtcccgtagcttacttactcgaagctggattgccctctaggggcgatgatgcctctgtcttgcttgttcctagatattatcgtgccagacgcgacgaaactgctcgccgctcatcgtgttccctatgtgctcacctggagcgtcttttcgagtctcgg

SEQ ID NO: 45018 - DNA, 394 bp, Triticum aestivum
  Clone ID: PAT_TA_45018
cgtccgcccacgcgtccgcccacgcgtccgcccacgcgtccgcccacgcgtccgcggacgcgtgggccgaggacaggccccccttctactaccgtgattacagccgctcgccgcccgatgatgaaccgagcaagagcaccggcgccgccttcggggcgcgggacttcgactacgacgactacagcgggggcgacaagctccgtggcgccgactccggggcgcgggactttgactacgacgactacagcggggccgacaagctccgtggcgccaccgatgaatacaaggcgccgagcagcagcctcgctggaaacggtgcgtccatggctaggggcggcaatgcggagactaccacggagatcttttacgaggaggcggtgcgcgtcgctaagat

SEQ ID NO: 45019 - DNA, 307 bp, Triticum aestivum
  Clone ID: PAT_TA_45019
cgtccgcggacgcgtggggaaaatttccagtgctgcccctccccggcgccggcgacgaccttcacaggcgccgcgtgcctcaggagcgccggcgttgcccgtccgtacccggcggacgcggtggcagcgatggcgaggcacgaggtggtgatggcggccacaggggtggactttcacgtgcctgacgagatcctggtcgtgatccccaccgacccgtacgagcaggtggacgtcccgcgcaagatcacctacatggccatcgcgtgccgcgtctcccgcctctgaggccgacgttttgcgccttcgt

SEQ ID NO: 45020 - DNA, 446 bp, Triticum aestivum
  Clone ID: PAT_TA_45020
cgtccgtgattgcatacactggtttactggcatatgcacatggtgtgaccacacccttggaggactggacggttactcaaaggttccgaactgatgaagttcatgcaatttggagggagaaggaggttccggttttaaataacacagattctgatgcagcggttgaagtattcatagatggaacctctgggccaactccaattgctgtagattcctgaggtgctggtgcctttcgttgattatttcggaaagattatgttgctgcagatatgaggctatgcttgatgatttgtagaaagccttgaaggctaatggcagagtgcctcgtacattttgttcgtcatgactgactggaatgtctcaccagttgcaagtgatctgtataaagacattgctaactccttcttctggtccaaattatttgaaggtctaggtttgtcccaagt

SEQ ID NO: 45021 - DNA, 440 bp, Triticum aestivum
  Clone ID: PAT_TA_45021
cgtccgcccacgcgtccgcggacgcgtgggctgaaaccgacgacgacgctaccactctcctttcttgctttccttcaccgcggctcctcccagacaaaatcccatccggaatcaacttctctccctccgatcctcttcctcccccttccccgccgcctccgccggcgagaatcggcgccgcgtacgtcgccacgacctaggagccctccttcacgggcggacctcttcccggagccaccggagggcggggacgggcggccagtctcgtccagagccggtatgcagagccagatcgtgtgccaccgctgccggagggtgctggcctacccgtcaggggcgcccagcgtgtgctgcgccatgtgccgagccatcaccgccgtgccacccccagcgccagcagtggaaatggctcagcttatatgtggtggtcggcgaacttt

SEQ ID NO: 45022 - DNA, 453 bp, Triticum aestivum
  Clone ID: PAT_TA_45022
cgtgcggagagcatcatggaccactgctcaactagacctgctcgtttctatgatgaaagagtatgcagatgcagctagatttcgtggtcagaatggatggacgaaagaaggatggaattccatgactacacgattgaataatcagtttccaagagctaatttcattgtttgtcaactaaaatttagagagcagcggttgaagagagaatattttgttgtcaaatctattgtagagaagagtggcttcggttttgatcttaatacaaaaatgccaacaaccattgatgaaaaatgggatgaattgagcaaagaacaacagaagtggagatacaaagctttcccttactatgatgacttgcatgcaatttatgatggtaaaacagcggaggggaagggctgtaagaggacaactgatgtggttgaagagaagtccagtccggctacagatttacc

SEQ ID NO: 45023 - DNA, 443 bp, Triticum aestivum
  Clone ID: PAT_TA_45023
cgtccggcgacccgtacggtcccaacagctagtcgatttacttacacagaagactgacacctcaaggtgagtgccgatcgatggcgcccaaggccgacaagataaccgcggagaagaagccggcctgcgaggttgcggagaatgccgagaagaccctcgctggtaagaagcccacggcggagaagcgtttggcggcgttcaagtgcgccaaggagggcggcgacaagaatggcccgaagaagaacaagaagagcgtggagacctacaaaatctacatcttcaaggtgctcaagcaggtgcacccggacattgggatctcctgcaaggccatgtccatcatgaacttctttatcaacgacatcttcgagaagctcgccggcgaggcggccaagctggccaggtacaacaagaagcccaccatcacgtccagggagatccagacc

SEQ ID NO: 45024 - DNA, 451 bp, Triticum aestivum
  unsure (1)..(451): unsure at all n locations
  Clone ID: PAT_TA_45024
acacgcgtccgcggacccgtggggccggcgccgaaccaggctcgggctccacggatctacgggggttgcctcaccccgaccccctcgcagcttctcccgcccctcctctccggtctctctcttactgactcatgaaagccccccaatgccgngaacacgctcgctggtaagaatcgcgcgggggagatgcgtttgccggccatcaagtgctccaaggcaggctgcgacaagaatggcccgacgacgaacaagatgagcgtcgagacctacaaaatctacatcttcaaggtgctcaagcaggtgcacccggacattggcatctcctgcaaggccatgtccatcatgaactccttcatcaacaacatcttccagaagctcgccggctaggcggccaagctgtccaggtacaacaagaagcccaccatcacctccagggagatccagacctccc

SEQ ID NO: 45025 - DNA, 278 bp, Triticum aestivum
  Clone ID: PAT_TA_45025
cgtccgcccacgcgttctgggacgtcaccaggagtgccggacgtcacctccctccttcttcgacggcgcctggtccagatcgggctcaggtcatcgcctggtccagatcgggctcatgtcgtctccaagcaggggtgaacagcgggaagcggtggggagaagcgagcggctaccggcagggagaggcggagagccacgacggtgtggacagcgggaagcggtgggaagaagcgagcggcagtcgacagggagagccacgacgatggccggcgtgagct

SEQ ID NO: 45026 - DNA, 399 bp, Triticum aestivum
  unsure (1)..(399): unsure at all n locations
  Clone ID: PAT_TA_45026
cgtccgcggacgcgtgggccggctgcgctccagttcttaatcctcagtcagaaatcacaatcccatgattccaggtgcaatggatattgccatactgctgcttctcttgatctttgcaccagcagggatgccatcatctaccagctgcccctcatccaccttcgatcatgttgtcaactcagaagctgcacttgagttccccttgtttcacaccgaccacccatgcgtccaacaatatcgcggtcgtccgacgtcaactgaaagcatcactgaaactgatgatacagacctgcccattgacttgatacggaatgacagcataaacaactttgcgtttgtaatgcccgtccagctgggcacgccaccggtctggaacctcngtgcagttgacactggatc

SEQ ID NO: 45027 - DNA, 439 bp, Triticum aestivum
  Clone ID: PAT_TA_45027
cgtccgtcgctctccaatcgcaccgcaaacccaacactagccttcatcctggacccacacgcagcggaggcagatctcatccgaggtacaagatggctctcaccagaatcggtcttgccggcctcgccgtcatggggcataacctctccctcaacattgcggagaaaggcttccccatctctgtgtacaaccggaccacctccaaagtcgatgagaccgtccagcgcgccaagctagaaggaaaccttcccctctacggtttccatgaccctgcgtccttcgtcaactccattcacaagccacgtgtcgtcatcatgcttgtcaaggccggcgctccggttgaccagaccatcgcgacgctcgcggcgcacctggagcatggcgactgcatcgatgacggaggaaacgagtggtatgagaacacggaaaggagggagaa

SEQ ID NO: 45028 - DNA, 437 bp, Triticum aestivum
  Clone ID: PAT_TA_45028
gcgcacgcgtccggcctcgtcgcctccgcggccttcgccggctcgctcccgcccgaccgccccttcgggatcgcgcccaacaggctggacgccctggtcgcgctcttcgagggcagcggggacggtccggggctagggtttcggtcggacggtgggaagaaggaggactaggggaggaaggtggaaattgtggagaaggagacgcctgggcctggggaggtgacgctgcaggagtggattgggccgtcgggcgccatcgagggctatgtgccccggcatcaccccattcatgaagggccaatgccacaggctaaacagggcaaagctagtagagctgagctttccgggaataagaatgtggattctggggctgctgttcttggcgaacataacatggcaatttcatcttcttcaggtgaagcacaagtgggcttttg

SEQ ID NO: 45029 - DNA, 476 bp, Triticum aestivum
  Clone ID: PAT_TA_45029
cggtccccaattcccaattcccgccagcgcgggcggcttcctctctctctcattaaactatttatatactacgattcactatcttcctaattttgtaagctgtcaatagctcgccggtgactccctcatcttcaacttaatcatgccctctgttgcgactgattcatcacatatacatagcgctacataagcgcgagtgataatatttcctacagctacgcatcaccttgtttaagagtccattggatctgcccatgcattatgatgtctttctccacaaactcctgattccagtccaagcacgagtacctctacggcaagatcgacatgcagctcaagctcgtccccggcaactccgccggcaccgtcaccgcatactacctgtcgtcgcaggggcccactcacgacgagatcgacttttacttcctgggcaatgtcaccaactatccttacactctgcacaccaactttttcac

SEQ ID NO: 45030 - DNA, 290 bp, Triticum aestivum
  Clone ID: PAT_TA_45030
cgtccgcccacgcgtccgcggacgcgtgggcggcagcccagcacaaattcctagcggcagccatcagccgggcgccggaagcgagcaagatggcggcggcgtgctgtggcggcgcgggcgtacgaggcagcggcgcggtccgcgctggctgcgctggagcgcaactctgctgtcggacgcggtcactcggcggtttactcgcttcctgatggcgcagagcctgcgggtcagatacctgccgacgggactgttgcaggtggaggtccttgatcttcttatcttacttactt

SEQ ID NO: 45031 - DNA, 443 bp, Triticum aestivum
  Clone ID: PAT_TA_45031
cgtgcgcccacgcgtccgcggacgcgtgggcttcccagaaacgcaacaggcccaaaatcctccaaccccggcgtagctgggcgatagcgagcttgccgatggtggcggcgggccagatccggtgcctagctgggcgattgcgcccagtggaggtccagatccagcaccccaccgtcttgctgccggcgtcctcgctgccccagcagatctcctcgcggacaaatactctgctccatcgtcctgccccggcggaccgtctcaaaggtactcttctccgacgtccagtggaaaacctcacgcattcttcacacgtcgctcgcacccccgcgtctagctccgccatctgggaacgctggagaagaaatctcccgtcttcagatgcatggtactctgacaagcggaagcatcaggactacagatggatagaaaaagcttttatcaaa

SEQ ID NO: 45032 - DNA, 452 bp, Triticum aestivum
  Clone ID: PAT_TA_45032
cgtccgcggacgcgtgggatgacaacgataagaagctgggatcctgtactcctggtggtagaagtgaacgtgatgacactgataattattccaatgagaggcgggcaacacctgactattctgctgcaccaaagagaaaagaagcgtgccagacaaaatcaccaaggcaggcaaatgaacatgatgaggacaagaaccgtatatcttttagtcctgatagaaacaactggcgtgatgctgacaatggccacaatgagcgagatgactactttacttcatcaaagagaaagggagaacgcctgtcaaaatcactaagattgtccaaagaacatgataaggataagaagcggagatcctatagtcgtgatgatcgaagtgactgccgtgatgctgataatagtttcaaagagaggcgggcaacaactgatggtggtaagagatcctgtccccgc

SEQ ID NO: 45033 - DNA, 391 bp, Triticum aestivum
  Clone ID: PAT_TA_45033
cgtgcggccgccgccgccactagctttcagcgaacagagccaatggtttgggagagagcgatggagggaggagtgatctcgttgccggcgccggcgccagtttcttgcctcgccaacagggagttccaggccacccccacccccagcccgtccgactagtcgactgtcctccgcgagctgaacgacaaggcaaagacggagaccaaagcggctgccgcggactacaaggtcaagccggaaaaagaggcggcgcctgctggtggtgctgctgcatcccccgagaggttgaagctcaacccgtaccaggggtatgcgatcaaggagaagaggatggtgaacattgaccatcggaacagctacatcaagtggctgctcgagtgggacaagaagc

SEQ ID NO: 45034 - DNA, 311 bp, Triticum aestivum
  unsure (1)..(311): unsure at all n locations
  Clone ID: PAT_TA_45034
cgtccgcggacgcgtggggttgggttggttggttgtagcgtagcctctgtcctctctcctgtcgggggttcggtcgtcggtgatggagaggaangagggctgngagaaaatggaggaggtggaggtttactactgctgtaagaagcccgaggaggggaccaagcctgcgccggtgtgctttaagaagaccgcgggcgaggacacctccattctggagaccaccaaggactacttaaagcagctcagtaacaccagcgccaacacgcactgtgactggatcaagaacaggggactacccgtcggccagtaca

SEQ ID NO: 45035 - DNA, 456 bp, Triticum aestivum
  unsure (1)..(456): unsure at all n locations
  Clone ID: PAT_TA_45035
gcgacgcgtgcgaccagaccaaaaacttcccctccccaactctctctccgcccctgcgtgaaccgcnaatcagggaaggaggagcccgtcgggctactaatctcgggggttccccctctgatccgggcggtgagttccaatccaatccgatcccgactccgcgcgcgccccgactcggtggtcgcccggattccccctcctgcaggtttcggccgttagctgctgggggaggagccgcgccggttcgtggcgccggcgtcagtggccgggggtcgtcggtccttccttggttctctcgtcatcggaaaaataaatcggtcgatctgcctctggtgagcgatttctcagattgcctcgcgcggttgggcttctccggtggggcaaaggcaggattttgagccactttgcccctaaaattaaatctgatttaatgggcgaccaatccaaaatgtgcct

SEQ ID NO: 45036 - DNA, 453 bp, Triticum aestivum
  unsure (1)..(453): unsure at all n locations
  Clone ID: PAT_TA_45036
gcggcacgcgtccgcggacgcgtgggcggacgcgtgggctcgccgtctcctctcgcaagagcaccaccagaacggtcgccctcaaccaactgatcaatggcgtcnccggcgctgggggcggggacgccgccgttcctcaccaagacgtacgcgatggtggacgacccggagaccgacgacaccatctcctggaacgagtccggcacggcgttcgtggtgtggcgccgcgccgagttcgagcgcgacctcctccccaagaacttcaagcacagcaacttcgcctccttcgtccggcagctcaacacctacggattcaggaagataggccttgacaggtgggagttcgccaacgagtgcttcangaaaggggagaagcgcctgctcggcgcgatacagaggcggaagggatctggcgccngggcgccggcgcccgcgatgatggcgacgccgatt

SEQ ID NO: 45037 - DNA, 443 bp, Triticum aestivum
  Clone ID: PAT_TA_45037
cgtccgctttctcccggcctgccgcgggcttctgtacacgagtgcgcaatggttagcaagggaatgatagttgggtatagatatagactggcttgctacttctgttcttcatttccaactgcaagtcatgtggcttggttgcttgtaagttatactagatggatggactgctcgttttagtagctttgatttgctccggcggattgataaaagcctaagcgtaaccatcactgctgtggtggcagtgccaccgatgcgaggaagtcaccagtatgctcttccttagtttcttggtgaactgccgaggaagggatttcagcgtccggagctgccaccgaacgctctggaaagtcagaaactgtaagcgatataatcgaagctgtaggtggagaacttttctcggtcgcgagctccggggtgaaagcctatgcctgacccgagct

SEQ ID NO: 45038 - DNA, 421 bp, Triticum aestivum
  Clone ID: PAT_TA_45038
cgtccgcggacgcgtgggcggcgccctcctcgccgtcgcccacggcgccatccccgcccaccgcgcgcgcgccgccggcaggagcttcatctccgggctccagccggaggaggtcctggtccttgacgcggttcggagcggggcgtacaggggcaggctctccgcggacgagctggtggaggggaagctggagaccggggcggcgcggcggcggggaggcgtgggcgcggccaagggcgtcgcggcgctggcgcctccggggagcgtgatggacgggctcggcgccgccgtgatgacggagtgcgagatccgggggaaggctgctagcatggtggtgacctggccggcgggcgccaggccctcggagcttggggtcatgcggcgcgtggcggccgagctcggcgtcgatctgaaggcagcg

SEQ ID NO: 45039 - DNA, 453 bp, Triticum aestivum
  unsure (1)..(453): unsure at all n locations
  Clone ID: PAT_TA_45039
cgtgcgcccacgcgtncgcccacgcgtacgctcctacctcccttcgtcttcctctgcctcggaaccagatcgggccctccggcaacccccctccagatcggtgggaaggagcgccctgtttgcttcgctgcaccagatcaagagaagcaatgtcggcagtaatcacaaagttcgccgtcacatctatggtgatgtggatggccccagttgcaatcatgtatgggtttatctaccagatatttccaggtgtcggtcagctttccccctcggcgcaaaccatggccagtggattccttgctgtcatctcggtcaatctggtgatcggcttttacatatacatggccatgaaggagactccccatcaagagccccagcctgatccaacctttctggcaaacgccaaagcaagcattaaccagccaacttcttctcaagtgagtgatgattcccatg

SEQ ID NO: 45040 - DNA, 408 bp, Triticum aestivum
  Clone ID: PAT_TA_45040
cgtccgcaaagtccaacgggagagggacaactcggtagcagggatgaaaaggataacaaggagggggacaggatagcacaactggagtcagagctaaaagatatgcaggatcggttactcaacgtgagcatgcaatatgcagaagtggaggctcaacgagaagaactagttatggagttgaaaagtgcaactgcaaggaagggacgatggttctaggggatgacgagcaactgtgtgccataaccgtaaggcccacagtccacagtacaggacatattttgtcgacgtcggagggtaccggcattcccagacaaccaccgtgcaagagctgagtaattccaagcaagtgcagaactggatatgtgctctgagctgcaccggaagctgtgcccccaaaaagataaaatg

SEQ ID NO: 45041 - DNA, 242 bp, Triticum aestivum
  Clone ID: PAT_TA_45041
cgtccgccacgcgtacgttcatacgtacaacttcttatcatctatgaaaaatataatatgtgtgggggacatataggagaacttaatttatatctaaaatatattcactatactttactcaactttatcatgcaatatgcataagtttaatctcaacattacaaactatttttatatttgtaattttcatctgcaatgaaaggactaattttctattaaattactatcaacttttttccata

SEQ ID NO: 45042 - DNA, 364 bp, Triticum aestivum
  unsure (1)..(364): unsure at all n locations
  Clone ID: PAT_TA_45042
cgtccgcccacgcgtccgcccacgcgtncgcggacgcgtgggcggacgcgtggaccaccgggggtggcatccccgctaggctggacctccccacacactaaaaccaccagcacccatgggaccaaaagcggcggagaaaaaaacggtggccacggccaacaaggcgacggcagcaaagaagcccaaggcggagaaacggccgccggcctccaaagaggccggcgggcaagggaagacgaggggccggaagaaaggtacataggccaagaggggcgtggagacctacaagatctacatttttaatgtgctgaaatatgcatacccaaacgtttgaatatcctcaaaggccatgtgcatcatgaac

SEQ ID NO: 45043 - DNA, 437 bp, Triticum aestivum
  Clone ID: PAT_TA_45043
cgtccgcccacgcgtccgcccacgcgtccggaacgcctagggtttgaaggagcacacgagccaccggcccaccaccaccaccactatcacccacgatgaaacggccgccaccacgcgatgacgcgacggcggcgggcagcagcggaggagggttcaacaaggggaaggggaggtgggacgggaagaagcggaatgagcagcggctgggaggcagcggcggggcgctctccctcgcggccttcgccaacgccaagtccaggagcaccggctacaacccggcactcatcaagaagcagaaggagttctacaggaatgctaaagtgattagcaagtacaagaagtcgaagaagcaccaaaatcagtcaaactatcctccacaatttccaacccttgaggaaggaggtgctgatacaacggatgtgccaaaaccacatgat

SEQ ID NO: 45044 - DNA, 436 bp, Triticum aestivum
  Clone ID: PAT_TA_45044
cgtccggggagctgcacagatttggaacaacttgcacaacagtcatgcaagcgttttggtgtgggaccactaagctgtcagagcaagatagctggcatgtcaagtccctaggccaatggtaaatcacaaattggctgatgttcaatgggaagcatcacacaataccaatgtccagtagtaatgtttgattgctcagactatgatatttccttatgttcaccttgaccttcactgcccgcgatgagtcagaaactgaagaagatgatcccttggacacagaagatgcttcctctgtcctcatcgctgcactacagtcttttggccaagctctggtgaatgacaacgaagaaaaagatatcgttaaagagggagatgtcttcttgcgtcctaccctaaatgacaggggctctcctatcagcaaaatagctactctaga

SEQ ID NO: 45045 - DNA, 407 bp, Triticum aestivum
  Clone ID: PAT_TA_45045
cgtccgggcctgctggcgaccgagctgacccacatccaggagctcctgaagcagctcgacacgtgcacctggggggctcgccccacctctgcaaactcctcccccaacacatcttcgccgtcaccgagaggaccatcggcatgatcaggtccggccacttcaacgggcccaagcgcccggccgccggcgcctaccttgactcgcctacggtgtccctcacacccagcccactaagcggcgtttgcaacacgccgttcaagcccaacaagaagaggaagacctctgagaaaggggggcgtcagatcaaggtgagctctgcggcgggaggggcggacacccccgtcgacgacggccgcatctggaggaagtactgccagaaggacatcctcggagcccagcacccaaag

SEQ ID NO: 45046 - DNA, 410 bp, Triticum aestivum
  unsure (1)..(410): unsure at all n locations
  Clone ID: PAT_TA_45046
cgtccgcggacgcgtgggcgaggaggtgctgtcggagatcgagaggtttctgatgcangaggacgaggcggcgggggcggagccggtggacgggatcagcgtggatgagttcttcgacgcgctgttcgatggtggggaggaggggggcgagaaggggaacgggagtgaggctgaggctgggggcagcaccgatggggactctaggagggaggaagaaggggtggaggtggtgactccggagacagaggcggaggtggtgacgcccgaaacggaggtcgatggcgatgatcccatcagcaagaagaagaggaggcaaatgaggaatagggatctctgccatgaactcaagggagaggaagaagtcatatgtgaaggacttggagacgaagagcaagtatcttgaggcggag

SEQ ID NO: 45047 - DNA, 391 bp, Triticum aestivum
  Clone ID: PAT_TA_45047
cgtccgcctgaattggctcctagcaccaagttctcctactcttctcacaaggctatcaatgagtacaaggaggctaaggcgcttggcgttgataccgtccccgtaccggacgcgtgggcagaaacctacagaacattgttcggaaggttaagatgggaaaatgtgaataccagtttattgaagttatggcttgcccttcaggttgtctgaatgggggaggccaaataaaacctgctaaaggccaatctcccaaggatctcattcaacaactagagggtgtatacatgcaagatgtatcaatatccaaccccttcgataacccgatcgcgaaaagattatacgatgattggctcgtccaacccggttcaaacaatgcaaagaggtacttgca

SEQ ID NO: 45048 - DNA, 179 bp, Triticum aestivum
  Clone ID: PAT_TA_45048
gcctccgtgaagaacaaccatccaccttttcagaggagttatgggccattcccaggcaactcaaacagctgatgaccgggcgatcgtatcggacccctaattatcggaaccgtggagtaagtcatggaggccatgcacgcccccgtctactttgagtcctaccacctccacggatacat

SEQ ID NO: 45049 - DNA, 264 bp, Triticum aestivum
  Clone ID: PAT_TA_45049
gcctcgtcccaaaggtccatgggcctccacaccaacaccagagggacgagccttgtggaaatctcctcgcgacgcgagcgatctccatctgttgaccaaaaaaataccagaggtcggcatggggctgcctactacaaaatcttgggcgtggacaaggcggccagcggcgaccacctcaagaaggcctaccgtaagctcgcaatgaagtggcaccccgccaagaaccccaccaacaagaagggggccgggagcaagttcaagcat

SEQ ID NO: 45050 - DNA, 424 bp, Triticum aestivum
  Clone ID: PAT_TA_45050
cgtccggcaagaaagtattcagtgtgatgaggagtgaattcttggatgcatcgaagtcggatagggctatcaaagaagaaaatgctcctagcctgggcattggggaagatgctaatatggttaacacagaaattccagacgcaagtagcagcagcatgcccttcgaattgtacatgacgcagacaacaattcttatttcaagagaaaagtttctgaatattgtgtgtgatgcactctcttcttacaagtatgttggaccaaaccagaaggctgacttgcttcttgcttgcagggtagtagattgggcattacgacagtagtttctactgattccatacgccatatgatgagaagctttgcagatgaaaagcaaaatcctcttctctatgcatcaacctaccatgcaggcgaatacttggaccct

SEQ ID NO: 45051 - DNA, 397 bp, Triticum aestivum
  Clone ID: PAT_TA_45051
cgtccgtgaagatcccctccgcctccgtcggcttctgcatcaaggtcgtcaccgagcggggcccggtcggcatccactacgccaggatctacgccgacggcgtcgaggtgtcccaccccgagctctacaacgacggccgctacgtcgtccacggcctccacggcttcctgcgcccgctcacgcactcctgcttcgacggcccgcaccaccatcacctcaccggccgctccgccgcatcctccgcggccaccgctgcctccgtgctgcgcatcatgatccgcgacgccatggcgcgactccgcgacgggggctacggcttcgtggcgctggccatgcgcgtcaagttcgccgagctcgacaagttggccaacctgacgctcttcgcgctcgacgaccc

SEQ ID NO: 45052 - DNA, 353 bp, Triticum aestivum
  Clone ID: PAT_TA_45052
cgtccgcccacgcgtccgcggacgcgtgggcggcgggctcgctcgggaacctcaccgcgctgcacgcgctcagcctccgcctcaacgcgctccgcggggccctccccgccgacctcgccgccatggccgcgctccgcagcgtcttcctcaacgggaaccgcctctccggcgacttcccgccggccttcctcgcgctccgctcccacctcgcctccgtcctccagtccctctcccaggctgagggctcatctgctgagtcaataactgcgctagcacggattgatactgtgaaacaacgcatggaagctgcatacacgacattgcaggatgcagctggactagctcagttgagc

SEQ ID NO: 45053 - DNA, 434 bp, Triticum aestivum
  Clone ID: PAT_TA_45053
cgtccgccaaagtgtacagcccacatcaaagccattgttagttttggagatgtgacgattgagctgaaaagggaagttgaacaattaggagtttcttgcttttcctgggaagaattttctacaatgggagaagacattcaagaacttcctaaaacaaaaggacgacatttgtacaatcatgtacaccagtggaacaacaggagagccaaagggtgtgataatcacgaacagggctatcgtagctggggttacgaccacagagcacctcctccaattgacagataaagtggtggacgaatatgattcatacttttcctatcttccattagctcacattttcgatcaagtaatcgggaattactgcatctccaaaggggcttccattggattctggcaaggggacattaagtacctgatggaggatgtgcaagtga

SEQ ID NO: 45054 - DNA, 432 bp, Triticum aestivum
  Clone ID: PAT_TA_45054
cgtccgcggacgcgtgggttcacagtttatgtcacaaataacttatttgtacatatgtatacacatgtactgacattcttgtccattagtgaggtcggtgaaaatgttagccctctcactaaaggcttaagtctgccttaccttacatttagtcatgtgcccaccactgcctggctgcatggtagtggtggccaccattgtgtagggaatcacaattccctctccctcctcagtccttccgtcctacctgaggacttttaaggtaatcttgtgtgcagtgaaatccagccggctgcgcagcatagcttgacttggatcgagttctgcttgtggacagttctagcagtaggttatccaatttggccatcaggttcagctctactgtggaagaatttgttgtgatttctcggttgattttgtttttacctatgc

SEQ ID NO: 45055 - DNA, 441 bp, Triticum aestivum
  Clone ID: PAT_TA_45055
cgtccggccggacctacgctgacgcatgctccgagaccggcgactccttcatcgtgatggactacggcgggcgcctcaacctacgcggctacatgcagcgccgggtccgtcttcgtcgggcgttctccgaggacgaggtgcgccggatcatgaagcagctcgtggagggggtgaaggccgtgcacggcgtggacatcctgcacctcgacatcaagccggagaacgtgctcctcgacgacggcacagaggacaggacgcagaggcccaagaagggggccgtggaagccgatgttcgcggcgaggtcaaggacaaccgcatagtctacaagatcggcggtttcgggatgtccacgaaagggcggggaaagaagcagccggaggtgattattctgacgccgtacagcgcgccggagctcctgctgcactcgcgcgagtacgacg

SEQ ID NO: 45056 - DNA, 441 bp, Triticum aestivum
  Clone ID: PAT_TA_45056
cgtccgaacatattccgatccatgctcgactaccatcggctccagcctcggcgaaggctgctcccggaccgcctcaagaagcggatctttgtgaaaaccctaactgtcccgaccatcaccctagaggttgcgagctccgacaccatatgacaacggtgaggtcatgatccacgacatggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccatgacaaggagggcattcctccggaccagcagcgtctcatctt

SEQ ID NO: 45057 - DNA, 255 bp, Triticum aestivum
  unsure (1)..(255): unsure at all n locations
  Clone ID: PAT_TA_45057
cgttcgnctatatgtanatttacgacttttaattcaattatttcggttactttataaacggcgggtgcatacctgaaaccttcacaatacacattactaccatataagactttaattacacaaactaccaattcattaacttaaaccttctctcactaatttacagtgacactttcaagataatactgtaatgctttcactcatcatacttatccctcgtccacatcatattctgtaaacaactcttcaccaaat

SEQ ID NO: 45058 - DNA, 157 bp, Triticum aestivum
  Clone ID: PAT_TA_45058
cgtccgctcagacctttcaggagggtgatttttaatgctttgtataaccgcaaactagcaagcatgaaagcaggctacacacaaaaaactgcttcacctttcgctgacatgctggcttttcgcagggcaagcaggttgggggccgcttccctactaa

SEQ ID NO: 45059 - DNA, 437 bp, Triticum aestivum
  Clone ID: PAT_TA_45059
cgtccggggacagggacctgctctgcccgatctgcatggcgctcatcaaggacgccttcctcaccggctgcggccacagcttctgctacatgtgcatcgtcacgcacctcaaccacaagagcgactgcccctgctgcgccaactacctcaccaaggcgcagctctaccccaacttcctcctcgacaaggtcgtgaagaaaatgtcggcccgacaagttgcaaaaacagcgtctcccattgatcaattccgacatgttgtgcaacagggaaatgacatgtcagttaaagagctagacagccttatgactttgattgctgagaagaagaggcaaatggaacaacaagagtcagagacaaatatgcaaatattgctagttttcttgcactgccttagaaagcaaaagcttgaagagttgaatgagattcaaactgacctg

SEQ ID NO: 45060 - DNA, 452 bp, Triticum aestivum
  Clone ID: PAT_TA_45060
ctcgcgcacgcaccacctaacgcgacccctcactgcctaggcgtgcttaaataaggagcctagggtgtgtaccaggtcatcgtcaatcgaaagcagatcgaacccaagaatatcatcatccgttagccgtcgccaccaccaccaccagcagcaccatggcagcgcccccctcctccgtgtccgtcagggccggcgcgtccgtctcggcgaagctgacccctcgccaggccgcgagggctgggttcggtggcagggtcagcgtcagctcgggcaggaagtgcggcggccccgtgcgggcgtcgctcttctcgcccaagcctgcggtggccatggacgcgaggccgaccaaggtgcaggagctgcacgtgtacgagctcaacgagcgcgaccgcgagagcccggcctacctccgcctcagcgccaagcagagccagaacgcgctcggcgacctc

SEQ ID NO: 45061 - DNA, 406 bp, Triticum aestivum
  Clone ID: PAT_TA_45061
cgtccggagcaatgtttgtacagttcgtacatatcttgttcgagtgtggtgcataccaagttattgagaaagggaaaaaatatgatgcaatccacatcgatgcagctcctagacagaaatcctacaaactttcatatgcggctcccgtggtggatggcgactaaaactttgattgccaatgtggccagttctctcacatggggctactgctcacccatgttctggaggttttacacttcatccccataacagaaattccgaacaaacacataatgtacgcgtcgacacgagactcacggtacgtgcttgctgcacatcttatcccgtaccactaagacaatgctgacaagaataactcttatgaaattgtataaggactgtgctaaagaaatgcagccctttgaag

SEQ ID NO: 45062 - DNA, 419 bp, Triticum aestivum
  unsure (1)..(419): unsure at all n locations
  Clone ID: PAT_TA_45062
cgtccgaggggatcgtggtccggttcgtgatcgggcggagcggggcggcggagggcggcggcggggcggcggaccgcgccctggacgcggaggaggcggagaacaaggacttcctgcggctggaccacgtggagggctaccacgagctgtcctccaagacgaggatctacttcgccaccgccgtcgccacctgggacgccgacttctacgtcaaggtcgacgacgacgtccacctcaacctcgggatgctggcaactaggctggccaagtacagggcgcggcccagggtgtacgtcggctgcatgaagtctgggcctgtcctgtctcaaagaggggtgaagtaccacgagccggagtactggaagttcggggacgtggggaacaagtacttncggcacgccaccggccagatctacgcc

SEQ ID NO: 45063 - DNA, 444 bp, Triticum aestivum
  Clone ID: PAT_TA_45063
cgtacgcccacgcgtacgcccacgcgtccgccttgacagtggtagactacgaggacaaacaacacagacaagctctcgcatgtgtgtactcgtcagagaccggagtatggggtgatgtcgtcttgacaccgcttccatccaaggcttctgtgcgcacgctggttattacagataagaccgctgtgctggttcggaattctctttactggctgcttttggggaatttggatggattgctggagtttgatttggagaggcaggtcctagctgtgatacggatgccaatggatttggttgccaagggaagttatgatatctgtgtgatgcagggagaggatggtggtcttggtctcttctgtgtgctgcagttggactacattgcccaattatgggagaggaagtctgattgtcatggtgttgcttcatgggtgctaggaagaacta

SEQ ID NO: 45064 - DNA, 173 bp, Triticum aestivum
  Clone ID: PAT_TA_45064
cgtccgcggacgcgtgggcggacgcgtggggccgcgaaaaggacgtcggccaggtttaccctcaacctgatcgagaacgacggccggctgtcccaggtaaccaactcctacatgaagcacacattctctccggcgagtgacaattggggcttcatcaagttcatcgagaagtc

SEQ ID NO: 45065 - DNA, 332 bp, Triticum aestivum
  Clone ID: PAT_TA_45065
cgtccgcaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgcccaacatacaccaacctcaacaggcttgtttctcaggtcatttcatcattgactgcttccctgaggtttgatggtgctctgaatgttgatgtcaacgagttccagaccaacctggtgccctacccgaggatccacttcatgctttccttctatgccc

SEQ ID NO: 45066 - DNA, 426 bp, Triticum aestivum
  Clone ID: PAT_TA_45066
ttttgaagcgaacacaactgaattccaagtccatttttacaagcatgatcgagctggcaattcccagcacctgcatatctccccggctggccataaattagtgcacccaaaaatttctgtgcctcgctgacactacaactggccgctgctaacacctgcctcctacctcatgcctcgcagttccgagatcctagatctcatgcctctgaacagtacaagatcttggccattccgcaagcgctcccggaggctcctgatttctgcggcctcgctattcttggtttccatccgaggcttgagccgctccggtcgtctctgttttcaactgcactggcggtgcaggtgcaacagcccctgccatgtggtggtgggacgaccgtctcttgtgcatggcgttggagacgcggcggagcacggcgacctgcg

SEQ ID NO: 45067 - DNA, 320 bp, Triticum aestivum
  Clone ID: PAT_TA_45067
cgtccgctctctgttcagaaatggatcgagtgctgagagctctattgactatagcctggcattcagactgatgggcagatgcggggcgacaggaccaatattcgaggtgatcatgctttcaacaccttgttaagggagactgatgctggaaagtacgtaccacgggctgtcttagtagatctcgagcccactgtgattgatgaggagaggactgatgattattgacaggtgtttgaccctgagcagattattagtgtcttggaggatgcagccaacaagctccctgcgtgatgatgacaccattggcaaggatattgtta

SEQ ID NO: 45068 - DNA, 367 bp, Triticum aestivum
  Clone ID: PAT_TA_45068
cgtccgcggacgcgtgggcggacgcgtgggcggacgcgtgggcggacgcgtgggcggacgcgtgggcaactgtcgaaaggcttccccggaaaagcgtgggggtcggcggcagcttcagattccgtctgccgtcgtcggccgcgcggcgacgtgtgttgcacaccccctgatctgctttcgtccgtcggcctcgggaagcccgtcgtctgggtctgcaatccactccggtccacacgtgatgatgtgagcggcgtttgaagctgaaggttgtgtacgaggatcgccggtagcggcaggtagtgtcaggacctgctttacgcgcggtggttaacccgctaggtgtaatggcaaatgtgtgcaggaaaag

SEQ ID NO: 45069 - DNA, 449 bp, Triticum aestivum
  Clone ID: PAT_TA_45069
cgtccgccccacccccaccctccccgaccaagctatcaggaccggggtacataagttatcaggtccgccatgtttgatttatcatgttatttgtacagaagttaccgtggtatgtttcaacaactcccccaccacaccctcgctgacaaagtttttaggaccggggtacataagttatcaggtctatgaaatttgagttaccatgttattcacacgaaagttaacggaggatatttcatccccccggtcggtaaagttagcaggaacgggaggttagctggtaggctagttgagttggctcactagtggtgcaaggatcgaatcctctcttcttcacaccaatttttgcgtgaaaaaatcttgaacaaaaaaagatctggagagggaaaaaatggatcaggaggagagcaagaaaatcggatctggagtggatcatgcgtgcatgcaac

SEQ ID NO: 45070 - DNA, 453 bp, Triticum aestivum
  Clone ID: PAT_TA_45070
cgtccgcggacgcgtgggcggacgcgtgggtgatgcgccaccgtgagttatactacagacaatcgaaagaccaaaggaatttacagcctgtttatttggtggaacaaaacaatgttggttttagttgtcgttgtcgctgtccgttaggctgtgtacgcaaggcacagagactgccgtggcaggaagttgtgcattgcgtagactctttgtgcagatttgttaaattggttctcgtttatggaccccaaacctagctagcttgcctgtgtcgtgtggggttggttgagatgagatattgagatgggtgctccttggcgagcaaggttaagaggaaataacgtgtgttttgcagggaatgcgcagcacacttcgattgttccccgtgcgtggtcccgaccgcttgtcgaacagatacgtagaaaccgcgtacgggctaaaacctctaggaaaaca

SEQ ID NO: 45071 - DNA, 398 bp, Triticum aestivum
  Clone ID: PAT_TA_45071
ttttattattcaacatttctaacagaaaaaatatatagtgaccatacagcaacaataggaaaaaaacatttgctagattcctgatacaagaaccatgccaccagaaagcaagaactggccaccaccaatgcaatctcctaccgggacacactggtctcaagaggcaaagcactttcgacttcagcttcctttgctgcagcggaccgctccgcaacagcctttgacatcccgaacatcttctggatggtcttcttgaagcaggtcttgtgctcatccatggaggcatggatgaactcatcaatgtgctctttcacatctttgaggaaggtagcatcatcatcagttttcttcttccggcacgacgacatggtagggcttttaggaggaacaggtggctg

SEQ ID NO: 45072 - DNA, 431 bp, Triticum aestivum
  Clone ID: PAT_TA_45072
cgtccggccggcgcgtcggggcggggtggcggccccccttcctgccttttggaggcctttccgcgggcgtttggtggcctgtgcgttgatgctgcagcaggaggttgcccgatctgtcttcggatccggctcgtcagtgtctgccggcggcgaagtggttgctcttgcgtgggatggcaccgtctccatgtttgaggtgcttgggccagcgcgtgtgcgggcatgtggctcttctatcgtcggctgcgtgggttggagaggtttgggatgctccggatgagaatctgcccgactttgtcggtgccgacgacgcgtcgcccatgggcgtcgttctcctcgcgggagggtcattgtggagctctttcccccctcctccatccctagtcatgtccttcgtgcggaagctcaagactccacatgagtcgggtgac

SEQ ID NO: 45073 - DNA, 334 bp, Triticum aestivum
  unsure (1)..(334): unsure at all n locations
  Clone ID: PAT_TA_45073
cgaggggggaaaaaacggcaanttttgtttgcaaatgttttaggagacaccccccgctgtgtcggcggattttactaggcttggcattcctgcaattggcaagctcatgtttgcccagtacttggagttaggaaacgacgggtgccacaatcccttgtcctacaacctatctgatggccgaaacccaagtattgactatggcttcaagggtgccgagatagcaatcggcgtcatactgctctgagcttcaataagtgagcatccctgtgacgaaccatgttcagattgaagaacagcacaaccaagatgtgaactgcgctcggattaatctcag

SEQ ID NO: 45074 - DNA, 436 bp, Triticum aestivum
  Clone ID: PAT_TA_45074
cgtccgcggacgcgtggggcccgtgagcactgggcctgcgccgtcactgtctgcgcactctcaagacgctgccgctgcccgataatacgatggactgggaagaaccggcaactttgcaggtggaggccgaagcggcagcggcctttgatttgatagcacgccaggccgtagcgggggaggaggaggtagaggcggatacatcagtcaaccgcagcatagaaaacaatcagagactcactcctattgcaaaggttgtcattacattggtaggagttgaaaaggcatttcaacctgctagtgctatcaagattcctgagagtattaatggagtgccaattattgtgatggaagcgcgatctagaggactatgctaggatgcttcgagaaggacttcgagtagccaaaatgcgctcgccatttaccatgtcaagggaag

SEQ ID NO: 45075 - DNA, 315 bp, Triticum aestivum
  Clone ID: PAT_TA_45075
cgtccgcgtaacaccagccaccccatcagaacaaccgcgtatttgcaggtggtattttgatccagcgtctgcatggccatggccgcggacgatgagatgctgcgccggtacctccgctggggcctgcccatcgagagcggttttaggtacaagttaaccccgaggccggacgagcccatctatgtcaccggcgtctacctgctcgactcggcgagcgctgtcggccagggcgccgtggacgcccgcgtccataccgacgacacgcgggacctcggtagcgccttgctgaccgcagaaaacccccgcgtggagcta

SEQ ID NO: 45076 - DNA, 444 bp, Triticum aestivum
  Clone ID: PAT_TA_45076
cgtccggcaagggtgagggtgagggcgaggatgaaggcgagggtgacggttctgaagagagcgagtacgaggaggaggggttcgatgaggacgaggaggtggaggatgtggatctagacccggcagagtacgaggacgacgaggcttatgcgcgggcgcttcaggacgctgaggagcgtgaggttgccgcgcggcttatggctctcgctgggatcagcgattggcgggcggtggagcatgtcgaggatcagataaacgacgcgcaggattcatggcaagaggttgatccagatgagtactcttatgaggagttagttgcattgggtgaagtagttggcacagaaagtagaggtctctctgctgatacacttgcttgcttaccttcaggaacttacaagacaaaagatatgcaagatggcaacacagaacaatgtgtaatttgtc

SEQ ID NO: 45077 - DNA, 447 bp, Triticum aestivum
  Clone ID: PAT_TA_45077
cgtccgatttgtcttaagaattccttgtgggcttattcagggctcttcgataactattattggtactcctgggggtcttctgggtaattttaagatagacttgactggagctgcagtccctggtgaaccagaccctccaattgtgcttcattacaatgtccgtcttcttggtgataaacttacagaagatcctgtaattgtccaaaatacatggactatagctgatgattggggttctgaagaccgttgcccatcttctgattcggatgctaaggacagtgcaaaagtggacgatttggaaaaatgtagcagcatggtaggcaaagcccacaaacagatcttggcctcaaagtcacattctaatttttcaagcatgcaacctacaaggaaaacaactgcagaacctaaaaaacattatcccttcaaacaaggatatcttgctatagc

SEQ ID NO: 45078 - DNA, 369 bp, Triticum aestivum
  Clone ID: PAT_TA_45078
cgtccgcccacgcgttcggcaggacttcaagaccgacctccgcttccagagctccgccgtctccgccctgcaggaggccgtcgaggcctacctcgtcaacctattctaggacaccaacctctgtgccatccacgccaagcgcgtcaccatcatgcccaaggacatccagcttgcccgccgcatcatgtatggagcgcgcctatgccccttgcttgccattggtaggtgtttacgatctgttcccgacgcgttccatatatgcgacgatactgtgtaactagcttgtggcttggctaccatgcttaaaatgaaatatgggttccagtcaccggtgcggatggagatcggcaaagaaaaataatggcagcc

SEQ ID NO: 45079 - DNA, 461 bp, Triticum aestivum
  Clone ID: PAT_TA_45079
cgtccgcggacgcgtgggggaggcgctgggcatacctgccgacggcggccacggcccgctccagggttcttcccacggcgccctcatgccgcagaagctcgggcacggtggcggcaaccccgtagacatggacgccgccggcttccagcagctgcagatggtatcgttccacgctgggaacaacgagggcctactcgagcaattctcatgggacgaccccttccagacgcagccagggtgcggcggcttccaatgcgtcggcggcaactactcggccggcggcgacgcgatgctctcgccaggcgtcgccaatgctgactacaactactcggccggcggcgacgagatgctcacgctagacctcgccaatgctgactacaactactcggccggcggtgacgagatgctcacgctaggcctcgccaatgctgactacaactactcgggcggcagcgacgaga

SEQ ID NO: 45080 - DNA, 416 bp, Triticum aestivum
  Clone ID: PAT_TA_45080
cgtccgcttagctagattacttcacttcgttctctcccctttcttcaccgttggagccgctggtggttaattgcagcgacggcagcagcgccgccgccggccaccaccatgctctctccggttggctaccgcagctcctctgcacaagctggacttgcttagcctaggccctggatattctgtggctcatcgtgtctcgcgttggattgtgagcattttgtttgtcgattttgaagtcttgagttgcacatttcgaacaacatttccttccaatgaacatctcatcataaagtttgcaatagtaaactccacgacgatattgaggttgattgctgtactgtgcaggttagtggttgctcccctggtggtactcttcttcctaggccacaaatactggacaacaaggatcacaatcg

SEQ ID NO: 45081 - DNA, 304 bp, Triticum aestivum
  unsure (1)..(304): unsure at all n locations
  Clone ID: PAT_TA_45081
cgtccgcccatccgtccgccaccaccgaacccatccatccgtccgccgtcgcgatccatccggcccgaccagacccacaagccgggccaggcggcgggcgacgaccggggaggaggaggcggcggatcgggggacggacgggcggatgggcggcgggcagtaggacggcggcgggacgcggctggagcggcggnaggagggcnagggcggcggcggtggcggcaccaccatgtctgcggtagtctgcggcaagaggttctcctccatcttagcggacgacctgctgctgcaacagggcttcttc

SEQ ID NO: 45082 - DNA, 449 bp, Triticum aestivum
  Clone ID: PAT_TA_45082
cgtccgcccacgcgttcggcggcggtgtacgtgtgccgggacctgtggcacgcctgcgcggggcccgtcgtggcgctgacgcgccggggcaacgccgtcgactacctgccgcaggcgcacctcgcgggggccggcggcgggggggacgtgccggcggacctgccgtcgcacgtggcgtgccgcgtggtggacgtcgagctatgcacggatccggcgactgacgaagtctatgcgcgactggctatggaggcggagggcgaggtctttgaaaagaacatgcgaggtggtaggtatgaaggcgaagatgacatggaggatggcgatggagaaaggaagtacaggatgctgcacatgttctgcaagacactaacgggctctgacacgagcacacacgggggattctctgttgcccgacgcgctgtcgaggactggtactatccactggacta

SEQ ID NO: 45083 - DNA, 315 bp, Triticum aestivum
  Clone ID: PAT_TA_45083
gatcgcccagcgggccgccttcagggccataatgccggaacgcgtctcctgctgtctttttttttaatcccccctgtttcgggctgtcgtcgttatgcgttccatcaaccccaccacctacttctacttcttattccaagatctcctacaccacttggtgtcttattctcggtcctcgcaaactccccttgactcattccaattagatcccgtttattgctggtgccagggtcggacataatggctgcttccatcggatttggataaaacaaaaaccgtatcggaaagcgggacgctggtatccttcctcccatt

SEQ ID NO: 45084 - DNA, 341 bp, Triticum aestivum
  Clone ID: PAT_TA_45084
cgtccgcccacgcgtccgcccacgcgttcgcggacgcgtgggggcaggcatatgtggaactctctcccctgagggaatgggctcatgcattaccagttctgctgatcatggccaaaagataggtgccacacgaatggagtatcttatagcaactccagaggcagacaagatctttgatgaggaagatgatctcttagaccaggaatgcgaaggtgactcggttgatttgaacgacaatgataagttactgttcattgaagctctggataaccatggtaaggttttagaaagaatctttctctatgggaagagcaagtcatatgagcagcgctcggtttttt

SEQ ID NO: 45085 - DNA, 261 bp, Triticum aestivum
  Clone ID: PAT_TA_45085
cgtccgtccacgcgtacgcttctagaaccataagaggccagaaccctaccatccatggcggcctggctcatatggcgcgccagctcgggcgccttcaccctccggggcggggcccgggttctccccacggacagggggatagtggcgcgcgccagtaggacggcggcgggacgcggttggagcggcggtaggagatcgagggcagaagcttcggcggcataaacatgtttgcattagtggggggatagaggttaaagctga

SEQ ID NO: 45086 - DNA, 413 bp, Triticum aestivum
  Clone ID: PAT_TA_45086
cgtccgcggacgcgtgggcggacgcgtgggcgcggccatcagcttgaggaatctcattctgcgctttactgggccagagatgtggattctacccaatctgaagaaccagttttctctgatgcccaatctgaagaagctgcttgttgcggatgtgccatcctcctgggatgtctcatggccgcgcatcctcatccaggcagcaccactgctggagagccttcatgttcatgtttcacagtcccagtcccagtcccagtcccagtgccaacatgaggaggagccaggtcgtcagaatgtctcctcctacttgcagacgcagcagccatcatcgtcatcttcttggcagcgccaccgccatctgaaggagctggtggttgttggctttcagagcacgagcaggatacatcatcagc

SEQ ID NO: 45087 - DNA, 395 bp, Triticum aestivum
  unsure (1)..(395): unsure at all n locations
  Clone ID: PAT_TA_45087
cgtccgctggctctgagaaaacgttgcaaaaaaaaaaacatgcataacgagcgactgggggcgggggctgctcgatgcggaacgacgccggcggctgggggcggcggctgctcgatgcggaacgacgccggcggctgggggcggcggctgctcgatgcagaacgacgccggcggctgctcgatgcanaacgacgccggcggctgcagcttgcaggggccggatccgtgcgcggaagatcctggggaggcctatttggaggcggccggcgaggcaggggtcgccggtgacgatgaggaaggctggagcatggtttccctggcagatccatggaatccgcggttcctgggcagaaagaagaatggagatgagggagagaagaaggaagaaaggaggg

SEQ ID NO: 45088 - DNA, 323 bp, Triticum aestivum
  Clone ID: PAT_TA_45088
cgtccggccacatcgaccggaacagccgcgtcgccgcgagcctctccggccgcgaggaggggcagcggcacctcatcggcggcgccaacaccctccgctccgaggaggagggcgacatcgtgtccctcaagaactacatgaacgcccagtactttggggagatcggcgtcggcacgccgtcgcaaaaaatcaccgtcatcttctacacccggaggtgcaacctttgggggccctccgacaagtgctaagtctagattgggggctacctccacgcacgatacaaggcgggtgcgttcagcacctacaagaagaatggaaaggct

SEQ ID NO: 45089 - DNA, 396 bp, Triticum aestivum
  Clone ID: PAT_TA_45089
cgtccgcggacgcgtgggaaaaaaaaaaaattaaaaaaaaaaaaaaaaaaaaaaaaaaaaaaaaaaaaaaaaaaaaaaccggggttggggggggcgggcccgtttttcttgggcaactgcggcaaggcgaacaccgacgccatggccgagctgttaaaccccgggggcctgctactcctgcccgggggcctactcctcctaatccgcctttttttctccgaccggggcgccgcggagttcgccaacgtgttcgccttcggcggtttgcccgacgccgggcaccgcgtagggggctccccaatcgggggggcgctcatgctgattctcatcctgcccctcctttactaccgctccgggctcttcgggggcggcggatacgacgacaagtaggcccct

SEQ ID NO: 45090 - DNA, 451 bp, Triticum aestivum
  Clone ID: PAT_TA_45090
cgtccgcggacgcgggggaattcgatgctgtcctgggctgcacaaaatctcggtgcatagggactgggtataatgtccaggcgatctacaatatggcggcataagtatgcacttgtatatggagcagacattaatgatccccacggacaaagtgctccctcggggaaggatcaacctgattagaagcctttgtcggaggttgagatttgcctcggcatggatgccatagggggaccagggaatgaactgagcgaacctattgatattgctgacgctgaagatcatatatttggcttagaggtactggcacgattggagtgccagagatattgaagcctgggagaacatacactttggacctttacttgtgaaaagctgcaggacatctggataaccttggattgtgaccctggatgcctgaagccttttgctgtgaggatcctaagcagga

SEQ ID NO: 45091 - DNA, 428 bp, Triticum aestivum
  Clone ID: PAT_TA_45091
cgtccggcgacgcgtgggccgacccgtgggcagccaagcaatccccacacacatctatccactccccgatttctttctccagcgtcgccatggacgcctcagccatcgtagccaccgggaaggggaagaagggcgccgccggtcgcaaggccggaggccccaggaagaagtccgtgtcgcggtccgtcaaggccgggctccagttccccgtcagacgcatcgggcgcttcctcaagaagggccgctacgcgcagcgcgtcggctccggcgcccccggctacctcgcggtcgacctcgagtacctcgccgcctatctgctggagctcgccggcaacgccggcaaggacaacaagaagagccgcatcatcccccgccacctgctgctcgccatcaagaacgacgaggagctcggcaagctgctcggcggc

SEQ ID NO: 45092 - DNA, 202 bp, Triticum aestivum
  Clone ID: PAT_TA_45092
cgtccgcccacgcgtccgcacacacatgcgtagggaccagactgggaaccatatcttgaaccttgtgctgaaggaggggttcctgctccgctcgcagctccgcgcgcagctcacgcgcaagtgcactctctactgcctgttgtgcgacccggcccgctatggtaacagattgctcaagatctggaacaccgacaagggcgcc

SEQ ID NO: 45093 - DNA, 238 bp, Triticum aestivum
  Clone ID: PAT_TA_45093
cgtccgcacgcataatggatcatgttgttacacttgaggaaattcaaaagtactttgtagatttcatgttaggggactctctcggtgcaatctcaactgctcacctagtttatgcggatcgttatccaatgaaagcccgaagccaagagtgcctgcagatagctggtatgcatccgatcgcggtcgacggtttcatgactggaactaaaactttaatgcccgggtcactgagactaaa

SEQ ID NO: 45094 - DNA, 289 bp, Triticum aestivum
  Clone ID: PAT_TA_45094
cgtccgctccctggtgcgccgactgggtccggggtggccgcgctgcaactcccggtcgcgccatcaccgacgggcgagcccgaggtcgacacgacatatcaagcgaccgcgttgcatctcccaggcgcgcgaccacagccgcctagtccgattacgatcttccccgaccacgctcaccttccgcctcaggccgacgcggtctgagacaggagcttgctggaggccctccaactccgcggtccgtggccggttgtctcaagcatcttccacgtgttccagggcgcgtgga

SEQ ID NO: 45095 - DNA, 421 bp, Triticum aestivum
  Clone ID: PAT_TA_45095
cgtccgtcaaagccaagggttttcgtcggagagcccatccattcctctgcttttgctgcccaccgacgggtgctggtcagtgaggtcgttggacaggatcgatcttcatcgagtttggagaccgctcgccacgacaggagcgtatgggagttttgagaagtcagtggagtacttcatggtgatgattagattgcagcgcatttttcgctcactctcttggtgttttgttcgtgcatccctgtcgcccgtaccgtcgtatgcatggttcggcagaaaagtgccgaattccatcatgattgccagttcattcatatttttcgacgaggacagcctacgggaattatgggagcatctacaggatgttggtttggtactacggcaaatccagtagtactgacatttcaaacttatttcatggttc

SEQ ID NO: 45096 - DNA, 323 bp, Triticum aestivum
  Clone ID: PAT_TA_45096
cgtccgccgtcatacactttatatattattcacgacttattatattgctgttttggctttccacgggggggttttcgccgtcatactcgtctttatttcttacctcctcgacactgggatcgggcagcacgctttggaccctgtcttctaatataaaagagttcgtgatctgtattcaagcttattctattctgcctatcatcgccaaatcagattactataactactaccaccacgacgatgatgatgacgacgacgattattacgaccacaacgactactactagcattattgctgtgactgtgattgtcttcttcttgta

SEQ ID NO: 45097 - DNA, 404 bp, Triticum aestivum
  Clone ID: PAT_TA_45097
gcggacgcacgctttcgtggacgcttgtggctaactggaagctcctctctaatcactggaaactccttgataatggggggcaataaggcatagggaaaggtaaagcttattttgaaggggaaccaaactctgcgctctgggctgtggattgtgtttgacttctgtaaactatgtgaaaaggttccatggaattacctgtggagcctgaagcagaactggaacacagcttacttacgcagattgaaaattttgatatgaacctgagtgaggtcgacgcccaagttaagtcactgaaaactttatgtaaatggaaagcgaaaactggaaaggaagctgaacactaataatgaagtggtgtcagaaacttatcaataaaagaattgatagttacaaaggtacataaa

SEQ ID NO: 45098 - DNA, 238 bp, Triticum aestivum
  unsure (1)..(238): unsure at all n locations
  Clone ID: PAT_TA_45098
ccgtccgcgaacccgncggcgccgccgacgaaatccaccctagccgtcgagctcgtctcgccgtcggcgcgctctatgcttttgggatggaggccgaaactgcggctaagagggcgcgggagaacgagggcgctgcggcggcggacggagccggggagcaggcggtgatctccgccgtcatccccggatggttctacgagatcagccccatgtggcccggcgaggcgcactctctcaa

SEQ ID NO: 45099 - DNA, 318 bp, Triticum aestivum
  unsure (1)..(318): unsure at all n locations
  Clone ID: PAT_TA_45099
cgncggctcgggaggtccttcaccggggtagtttttgctgtgtttctcgccgagtcccgtttgatagagagctactatgactgcaaggacgcgcaggagaagctggtggacccgatcgtgaagggcgcagggaacgtgctccggtcctgcgcccgggccgcggtgccggcccgcctggtggtgttcacctgctactgttccagcgtccggtatcgacaccaacacgtgcacggaggggcccgcgctgcgctgaacgagtcctattgtagcgacgccgactactgccgtacgtacgggctgaggtacgcgtacgccaag

SEQ ID NO: 45100 - DNA, 421 bp, Triticum aestivum
  Clone ID: PAT_TA_45100
cgtccgcggacgcgtgggttttttttttttttttagacaaatatacagctgggcccaaattagaggtagaattcaacaacaaaaggattcgccgttacaagagctatctccagcaatctagaaccaagctgcttgtaaggtggtgccaaaatggaacagaaacaattatctacctgacattgaggtaactacaattagcttcagagttaggggatgcggtgcgctatcatctgagcggcttccacggtacgtaagacctgtacagtaactttacaacagaaagcaatgttctgcagaagatatcatcatccttctcccgaatttgaaggatgagcatataaactgccttgaacatcaggtctttgctgctgctgctgctgctgctgctgagtctgaagttgcagccgagcctgctgttgct

SEQ ID NO: 45101 - DNA, 332 bp, Triticum aestivum
  Clone ID: PAT_TA_45101
accggggatcttttttcccggctgctctccattaatttttcctatctgtattctactttttcgcttttttttttatcttatctttttttttaggggggaaaaaatttttcccaaatgaaagggccctctaagggatactagcccccattagggccaagaacccccccccccccccccctgtgcggacgcatatggataccaaaccggggggcccccaggggattggcccaccaccccaccagggaggacccccggggcgagcccccctaaaaaaaaaaactttgccccaaacaggggcccccccaacccaccgaatatagcccgcccccccc

SEQ ID NO: 45102 - DNA, 431 bp, Triticum aestivum
  Clone ID: PAT_TA_45102
gcacgcgtccggcaaagttgaaagatcaactgggcccaacaatgcagcagttcgccataccagctctgaagagtctagaagcagtaacaaccaaggaatgccaagaggagttttcacaggaatcattagaaactcttggggattctttcctcaagtacgtcgccacacaacatttgtatggcaaatacaagcttcagcatgagggaacattaaccaagatgaagaaaaacctgatctccaatgcagctctatgccagctggcctgcagcaacaatcttgtgggttacattcaaggggaagagtttaacccaaaaggttggatcattccagggcttggttacgacatgtgtggtaacagcaaaatttcatttttaagctccaatgatatgcacactttgagaaaaatgtctgttagaagtaagagaatagca

SEQ ID NO: 45103 - DNA, 440 bp, Triticum aestivum
  Clone ID: PAT_TA_45103
attttggctaaagtttcatttacgcctaattaacatcgagtagaccctgttattgtgagaattcttaattcaagagggatagggagggacttatgtcaccacaaacagaaactaaagcaggtgttggatttcaagctggtgttaaagattataaattgacttactacaccccagagtatgaaactaaggatactgatatcttggcagcattccgagtaagtcctcatcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatg

SEQ ID NO: 45104 - DNA, 429 bp, Triticum aestivum
  Clone ID: PAT_TA_45104
cgtccgaaaaggtttacctctgcacccgaaaatctttaggacactgaataatttccattttacaagagaatcatgataatctgggatgcgaccatcatggccttcaaactgtgggatacttatatctcttatctaaattcattaatttcctgtaagttactctgttgccttaattctcgagcttaggttgccaggttcaagcggcaaaaggctgcagaaacgaagctccaagagatcaaagagagaaaggaaaggcgcgggcgttcattgagagcaacggctttatcagcacctattgaagccggggaagaagatgatttggaggccgatggagaggaagaaagggaggcttggcttgctactatctccttggctctctgcaaggcttttgatctcgttgacatgttaaagaaggaagaagagatgctt

SEQ ID NO: 45105 - DNA, 383 bp, Triticum aestivum
  Clone ID: PAT_TA_45105
cgtccgggaagtgtatagaaatgtcaaaagggtggataggatgaaaaatgaattgcatgaaagagatgaaaaggagcttgaacggacaggtcagccactctgtatatacgaacccttctatggggagggaacttggccctttctgcatcaaagctctctgtatcgtggaattggcctgtgtgtactacagagatatccttggcgaatttggagctttctttgctctggctaacagaattgaccggatacacaagaattcttggataggatttcaatcctggagggtgactgcaagaaaggcgaacttgtcaaaaaatgctgaatctgcaatgttggaagctattcaaactcaaaagcatggaagatgccttctacttttgggg

SEQ ID NO: 45106 - DNA, 419 bp, Triticum aestivum
  unsure (1)..(419): unsure at all n locations
  Clone ID: PAT_TA_45106
cgtccgcccacgcgtccgcccacgcgtccgcagagccgtaaatgggatctgcacaggctgtgggatgatgagaagtccaataaatatagatgatggtcattccatctttctggacccttgttgctgtcatggtttaggtcactgccatgttggaattttattcaccatgtgttggattaccttatcttccttttgcggtgaatcttccgaatgaatcgtgccattcagtttgccgcttgtctgtctggtctaccccaggtcaaggtatttggtacagaataatcacagtgtctatagaatttattcatgtattcagtctgtataagtttgccaggccaaaatagttggcaatataacatgttttggtaggccanattcactcaatatttatcttggtattgtactggtgctttgaaaat

SEQ ID NO: 45107 - DNA, 184 bp, Triticum aestivum
  Clone ID: PAT_TA_45107
aattttactttcaaaacctttcaatactcttttttaactacacgccacccacctacgcgcccctttttaaaaccatacatcccacccccacaactcacaaccccaactacctcttcatcctatactacaacaacactaacatatactctcacaacaaacccatcttcatcaccattcccaccca

SEQ ID NO: 45108 - DNA, 428 bp, Triticum aestivum
  unsure (1)..(428): unsure at all n locations
  Clone ID: PAT_TA_45108
cgtccgcggacgcgtgggaagcactttcgtcatcagctacgtgcttccgcggcacccggagatccactacggcggcgccagctcgaccaccgccaatggtcaccagcgccagctcgaccaccgcctccgccagccttcttccgcggcgctgccacgggcacgggctgccgtcggcccactcagaagggcaccgactgatggctggtgcaataattgcctagcgctaaccaggggggttttgggctcgtcgcccttgtgcgatgtttgctacaaccgcctcttcgtcgccggcgacgtgcctccgcagcacgcgcagaccggcggccacgtgcttccgagtccggtccctagctacgcctacgcgggtgtgccacggnggccagtccctgccggtgagcagcagtaccgggctgcggccattgggcctt

SEQ ID NO: 45109 - DNA, 326 bp, Triticum aestivum
  Clone ID: PAT_TA_45109
cgtccgcgtcagcccgcacgccacgcacaagctacgacccctccctccttctccgccgccctaggggggcggcgatggcgcacgggggccagccccgccgcgccccgggcggacgccgccccaagccttccgcgtccgcgcccgcgccctccgctgaccggaagcggaatcgcgccgccttctttaagaccctgccgctcaagaaccaaattcgtttcaccgagcggctgctccgcaaggaccttttttatgacatgagggttggtcatgacaagagattggaagaactcaagatacagctggagatacagactcattacgccatg

SEQ ID NO: 45110 - DNA, 428 bp, Triticum aestivum
  Clone ID: PAT_TA_45110
cgtccgcccacgcgtccgcccacgcgtccgcggacgcgtgggcccagatcggcggcgtcgtctccgtgcgcgtctgcagggacgtcacctcgcggaaatcgctcggatacgcctacgtcaactacaacaccccggccgacgctgcacgggctcttgaaatgctcaacttcactcctatcaatgggaggcctatcaggataatgtattctaaccgtgaccccagcttgcgcaagagtggcacagctaatatatttattaagaatcttgacaagtcaattgacaacaaagctttgtatgacacattttgtgtgtttggaaacattctttcatgtaaagttgcaacagatcctgctggggaatcaaagggctatgggttcgttcagtatgagcgggatgaggctgctcatgctgctatcgagaaactcaat

SEQ ID NO: 45111 - DNA, 455 bp, Triticum aestivum
  unsure (1)..(455): unsure at all n locations
  Clone ID: PAT_TA_45111
ggaananccgggccgaccgacgcgtacgntcagctgtgcctccctcacccgcctctacatcggcgtttgacgctggcgcttcccagacgcgacgccccaccgacccgcctttcccaacctccacgagctcggacttttccattccatcatggaggacagggaagtcgatgccttgctcgcgcactgccccaaattaaagatattctcgtttgccatggcgtacggcccccctccccccatctgcagcagggctgacagtcactgcttcctacttggctcggcgggcggctccccttttcgcttctgtgtcaggtcccgcagcctccgtatcgtggtcgaatggatatgcaacttcgatgaaatcatcgccgaggatgtcccctgcctggagcgcctgctcttcgaatgcagttacgatcagaggcccatcaagattctccatgtgcccaggctgg

SEQ ID NO: 45112 - DNA, 356 bp, Triticum aestivum
  Clone ID: PAT_TA_45112
cccgacggacgcgtacgcagcctccgttccgtgcctgccaaccccaaatctaccctccctctgccgctctcaaaatggggggagcattgaccatggcggcctactgcggaaagtacaaggatgagctcatcaagaacgctgcctacattggcaccgctggcaagggtattcttgctggcgaccagtccaccggcaccattggtaagcgcttagccagcatctatgttgagaatggtgaggacaaccgtcgcgccctccgtgagctactcttctgcacccgtggagccctccagaacctgaatggtgtgatcctgtacgaggagaccttggacccaaacaccaaggggggaaagcct

SEQ ID NO: 45113 - DNA, 203 bp, Triticum aestivum
  Clone ID: PAT_TA_45113
cgtacgctcgaccacgaaaacgttaaaccctttctggcgtcgccgcaagacaaggacctcttcttcgggggccggctcgcgggctactactcacttacccttctaatcgcctgcgactgcggataccacagtgcggaattctgtggcgcgaacctgattcacccatttgttgaaaacttgaacatgtcttatgctttttatta

SEQ ID NO: 45114 - DNA, 421 bp, Triticum aestivum
  Clone ID: PAT_TA_45114
cgtccggttattgtgataatcttttttgctgatgaaatatgtcacaatatttgtgctttgcaagagggtgtggctactatgttgtgctgcctatatgcatgattatgtaggattctgttctgcctttcacgacatatatcattcttttggcattatgctacccatagttagttaagagagctacaaattatcttttccttaggttggataattttgattgattagtgtgtgcttgagcacgtacagctgagagcacctcatgtattttatatagatgttcattaaagctattatccgcgtcttctgattattcactgtaattgacatctccactgtatttgtgaatatatgaatctaggttgtaagagtaatcttaacgagtttttgttttgctgctgtttagaagcctgtttgttttatt

SEQ ID NO: 45115 - DNA, 342 bp, Triticum aestivum
  Clone ID: PAT_TA_45115
cgtccggctatgccaaaaggcatttttggtacgtagaccacactaataaaaacatgcatactataatggcgacataggattgggtctactcacctaacattcctctctgtctaatggtaccacctcctcacctgtctggctcctcccaagccgcgaggcacagacgaaacgcagtacaacatggtgcatgtgacccagacgcacgcgattgattacttcaagaataagactactgacaagacgcgactaatgaaggctgatggaactgccgacagtctctcacatgacgacgacatggactacaaacaaattattcacaacgctatagaagctggccgaatc

SEQ ID NO: 45116 - DNA, 336 bp, Triticum aestivum
  Clone ID: PAT_TA_45116
ggcgacgcgtacgcccacgcctccgtggacgcgtgggttaaattctatgtgcgccaggtcttcatcatggacagggggggatgatcttatcccagagtggctgatctttgtcaagggcattgttgactctgacgatcttccactcaacatctttcgtgagacactccagcagaacaagatcctcaaggtcatcacgaataactcttggaaaaagtgcattgagctcttctttgagattgctgagaaccagcgagactacaacaaggctttattgaggttttatccaagaaccttaagcgtcggcgtccatcaagactcccacaacaagaccaatct

SEQ ID NO: 45117 - DNA, 275 bp, Triticum aestivum
  Clone ID: PAT_TA_45117
tggacgcacgcgtccgcggacgcgtgggcgctcatatatccgtgcccgcccgctgacgcgacgtacaccgcaccaggggccctgtggaccctccgccggccgcggctgtagcgactgccacgcgcgcacggtcttacgtgccgcccaccgcccgggaccccaattcccaaacgagaccacgactatcctcttggtataagtgctcccccagcaccgcccaccgtgtttacccgctcttcgaaccgaaacccctattcattcgtccgcccggggag

SEQ ID NO: 45118 - DNA, 416 bp, Triticum aestivum
  Clone ID: PAT_TA_45118
cgtccgcccacgcgtccgcggacgcgtggggctgcttctagttcttcccacatgcacccccaaacagagtgcacctagcactagcaggcaccaacacacacatctcatgctgaacgtgcatacgataagaaaagttgagtcggcatgcgaggtataggaacatctagatgcgcatcagcatagggcaattgaacttcagttttgtttcccacatgtcgtgtctgtccacaagatcgacacgttattgaaaaggtgtaggtggctgagcccaggtacagatcacccatttattttgatttttttgaggggacagatcacccgtttatatcagccctggcaagccatcgtgatgtatgtcctggtcagaggggtgcaggagcatttagaggccattccactttaacagtgggtttgac

SEQ ID NO: 45119 - DNA, 423 bp, Triticum aestivum
  Clone ID: PAT_TA_45119
gggagcgacgcctaggatgtcgtcagccatggcaagaccagacgcctcgccttccaagtatccccgccccccggggtgaactccttcccgcagatccccgagatggggcagcaattcatgtccttctcccgcgcccaccagccggccttccagtgcctcaccaggctacgcctcaagagccttgcgttcggggactctgacgttgccgccctcatcgctgcctccgataagctcgagcatctcaacatgaactcctgcggactggtcgatcagcgccacgtgctaaagattgacacaccgtgttctgtgatccaggagctcgagtttaagcgctttcattgcaagcgcatccacctcatctccgtgcccaggctcaagacggagctgtgccattcttggcgctccaacaaccctccgatgcgc

SEQ ID NO: 45120 - DNA, 389 bp, Triticum aestivum
  Clone ID: PAT_TA_45120
ggtacgcggtcggaggttcggcccacgcgtacgccgtaaatgtattttatgtgtgatgtgaatcgctggactcacagcctgctaatattaggcgctcacgagcaggagtgcggtgtcatgatctacttggcactactgtgaggggtgccgatagcgttagatgcgtagcttctgagacgctccatgctcaggggctcgctaggggagctggtctacatggactcaaacgagggtcaggagtacacagtctgccacgtagagctagagcttacaattgcaggcgcttgaagcgctcatatccttccctcggggagactgtgaaggcgacagcctcgaggggtccatacctgtacaggggaatgttgacaaagatgctgcttatgcattta

SEQ ID NO: 45121 - DNA, 394 bp, Triticum aestivum
  Clone ID: PAT_TA_45121
cgtccgtgggactttaacaagaaaactaatgtatcacctgagggatttatatgttgcttatgatgggactggtagaagttcttacgggcagcagataatgcagttcacttatgatactgctgaagacatgtgcagtgatcgcgatgtggaaggtgaactcggtgcccctgttggttcgtgggctgcttgttccatttcagaagctgcatatggagctttggatcacccagtgaacagcttggaggaatctcctctcatgaatttgcaggatgtattgaagtgccagaagggtggtacttctatggatcatgttggtttgcttttcctgtcaaagaatctaaaaaaatatagatatggtttggagtatgcatcgctagaagttaaggatcatctc

SEQ ID NO: 45122 - DNA, 286 bp, Triticum aestivum
  Clone ID: PAT_TA_45122
cgtccgcccacccgtccggtggggtgagagctccagaacccgttattactgtacgtcctattgcagcggcgggggagcggagcccagtgggccgactcacctcatatgattactactctcgccaagggttaaagcacacttaatgtactttccaccaccctgtcgtgctgaagttctttagacagtttcagcttgccttcagcttctcttaaggtgttcgtgctcgcaacatttgtccttctgtgccatcctatgagaggcgctttaacacaagcatctacatgac

SEQ ID NO: 45123 - DNA, 437 bp, Triticum aestivum
  Clone ID: PAT_TA_45123
cgtccgcccacgcgtccgcccacgcgtccgcccacgcgtccgcaagtggcaagatgtagcactagtgttcaccaaggagcagaccctcttggcaaagcagcggctgtcttctctttggtgtatgcgtgtgtgtgtgtgtggagtttcaccatgaccgtgtagtgtgtgttcttgagagagacaaagagatatggagattgggttgtgagaggcagctcaggaggaagaagaagcggtgctgcaaggagagatggcgccaacaattggcatcagagccttgtcgatccgaggcgacgacggcagtgcggcctactccatgtgaggtggaggacggcggcgcaaggtggaggctgtcggtggcgtgatgccgctggtggccggttgcggtgcgatgccgcaagatgttgacggccgtgcgatcggcgccgccatccacg

SEQ ID NO: 45124 - DNA, 196 bp, Triticum aestivum
  Clone ID: PAT_TA_45124
cgtccggttggcttctcctccccttccggttcgggttctggttcggttcgggttcggttcgagagagaggccgagtagctagcctagtcttaggtttggtagagaggaagggagatccatggcggagactgagtaccgctggtttgtgggcggtctaacctgggccatctacgacaacaacctacagcatgccttg

SEQ ID NO: 45125 - DNA, 424 bp, Triticum aestivum
  Clone ID: PAT_TA_45125
cgtccgcgctgcggctagcctctctctctctctccccctctcccccgtgcgcgacaagcggctagggtttcgccctcccacccccgctccgccgtcgccgtccttgcctcccgcctcccgcataccatccccgccgccgttcctcgcccctccgccgaccgcgtcctctgccgccggctgcttccaccgagctcccgcgccagcagatcgacgccgccgggcccgtccgccccgactcgccgccgcccagctcgtccccggcctccagctcgcctccgcccaggtctgtactctgagagttacttccatttgcgttgaaagctctgcgggtcactttgacagggtttgtgcaattaccctgaacagacttggcagaagtgtgcttgtgaggtcttgtgtttctcttctcgtatacgagccaact

SEQ ID NO: 45126 - DNA, 437 bp, Triticum aestivum
  Clone ID: PAT_TA_45126
cgtgcggggacgcgtgggcgccaccccctgcccatggtccaacgcgccttattgagccggcgaacccccgtaccaccgggcgcacggcagatccccggagtcccgcgcgctgctgagacccgacattcgagcgcgccgtgccgagatttggttcgggcctgacgagttttcttggctgccggcgcacaggtgtggagcggattcctatccaatgctactgcgaccaggtcacgctgtggctgctcaaatcgacggtcatgacagccaggggagggcgggtacaccgtgtatactgtcttggacggcagcaatgctggggatcgagccgtacgacgtggaggtcacccacggtgtagagctgctcggcatggattccaagaaccgacacatacaacagatcgagctgccgctgtcctgattttgggggtgcagagatc

SEQ ID NO: 45127 - DNA, 384 bp, Triticum aestivum
  Clone ID: PAT_TA_45127
cgtccgcccacgcgtccgcccacgcgtccgcccacgcgtccgcccacgcgtccgcccacgcgtgcgcgccgacggccacagacctcgcccccacgaccatgcggctccccggcggcgcccgcctcgctctcctactcgaccgacggtccctttccaccggcgtcgcctgctgcgcccgatcgtcctacatccacgcctaccgcgcgcacagagctagatggggcgacgcggcccgcgcggcgccctgctggaggtcgtccttgtcatcgtcgagcaggttcttacaacttaccaggcctgaggcggggagggactaccactacgcgctctgagaaaggaaggacgatctccagtgctcgtttataaaggcatattacccacccg

SEQ ID NO: 45128 - DNA, 431 bp, Triticum aestivum
  Clone ID: PAT_TA_45128
cgtccgcgagaatggaggtccaattatcatggtgcagattgaaaatgaatttggttcatttggagatgacaagaattaccttcattaccttgttcagttggccagacgatatctggggaatgacattgttctctgttgatttttcaactggtgatgatccatggccaatattcagattacagaagaaatacaacttaccgggaaaatcagcccctttaagtgcggaattttataccggatggctaacacactggggtgagagtattgcaacaacagatgccagcagcacagctaaagctcttaaaagtattctatgccgcaatggttctgctgtactctatatggctcatggagggacaaattttgggttttacaatggagcaaatactggtcaaactgaatacgagtataaggcagaccttacatcttac

SEQ ID NO: 45129 - DNA, 441 bp, Triticum aestivum
  Clone ID: PAT_TA_45129
cgtccggaaacacagagcaagaagagaagagagaagctaagcttgagatggcgcaaaccatggcgtccatgaccggcctgtcgcagggcgtgcgtctcccatgcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacgaggcaagggacttcgacctgcccctgaagaaccggttctacctgcagccgctgccaccggcggaggcggcggtccgggccaatgagtcggcccatgacatcctcaacctcatgccgctcatcgaca

SEQ ID NO: 45130 - DNA, 437 bp, Triticum aestivum
  Clone ID: PAT_TA_45130
cgtccgaagctgcgcaaacaggacttgtgggcataaatatctactccttctggagttacccattcacagattccaccgcggatttagaagcaactcaaagatgcaaggacttcatgtttggctggatactagagcctttggtgtttggggactacccacaaatgatgaagaaaaatgttggctctcgtcttccatcgttcacaaaagtccaatctgaacttatgaagggttcttttgattttatcggaataaatcactactattctctttatgtgagtgaccgccagacagaaccaggtatccgagactacaacagggacatgtcaatttattacagagcttataggacagaaccgtcagctgggcagggagccccaacaaatgttgcaagtgatcccaaagggttgcaacttgtcctcgagtacctgaaggaagcc

SEQ ID NO: 45131 - DNA, 343 bp, Triticum aestivum
  Clone ID: PAT_TA_45131
cgtccgtccgtacggaacgaactaaatatccccatcttatctcgcggccgatcaaacttaggcgtggggaatcctgggctcgagccgtctctagatgcaaatatttgctatgacatcgacatgcatgaccatcacccttgatgtggagtcctctgacacattcgacaacattaatgtcattatccaagacacggagggctttacttcggaccagaagggcctcattttttacttgcaagcaagcttgacgatggcatgacccttgctgactacaacattcagatggagtacaccgctttacctttgtactacagccttttgtggaggcaatgcattatttttt

SEQ ID NO: 45132 - DNA, 273 bp, Triticum aestivum
  Clone ID: PAT_TA_45132
cgtccgggtcgggcatggcgagcgcgccctgacgggcctccctcgcgcgagggagcgtcgggggcgggcggcgtgggtggatttctccggtgcggtggtccacggctaggggcgcagcggcgggacggagcacggccggatcttgcacaggaggcgcgggagggtgtttccgttcgggaggcgccgccgtatgagagtggtggcggcgcggttcggccatggcggtggcggcgcggctctgtcatgatggaggcggcgcttgttctgttgtgc

SEQ ID NO: 45133 - DNA, 438 bp, Triticum aestivum
  Clone ID: PAT_TA_45133
cgtccgctttgccgtcggctccccctgctctgccgccggctcccctgccctgcggctgtatggttggacacaagtagccaggtagggagctgatcatatttggacgctgattacttgcatttcttaatctcaggccatgttggagaggaggccacagctatggaaacagaagcatcgtgggaaggcgttcatggcactggttttcttcccggtggtcgtgctcctcagcggcagtagccgaacaatgtcgggcctatcgacatcagcgctgatccctccggtggagggtaacttgccggttcggcaccggccgatcatcgtccaacggagcgataagctacttcaacgtatcatcccgatggacaaggaagagctggccatgggaaggaatggcacggcccaatgtagcaaaagcagagtccagaccgttgccgatgt

SEQ ID NO: 45134 - DNA, 105 bp, Triticum aestivum
  Clone ID: PAT_TA_45134
cgtccgaccactcgttcgggtgtctatgatgccttacagaaaagatatctaaggaccctactattctgagtagcgccagaaggaggaagcgcccatgatagaata

SEQ ID NO: 45135 - DNA, 449 bp, Triticum aestivum
  Clone ID: PAT_TA_45135
cgtccgcggacgcgtgggcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaag

SEQ ID NO: 45136 - DNA, 436 bp, Triticum aestivum
  Clone ID: PAT_TA_45136
cgtccggcgcaacacctgtcagagccccgtcggctccgtcgatctgccagacctaggtcgccggtgtggctgctgtctcaggcgagaagaggagtggtcgcgttaagacacggggagggggagcagccaaccgtgctcaaggccgtccgtggcggctgcaaatcgaggcggcggctacaaattgaaggtcagtgcacggcggccctctctccttctcatcccctctcgctcgagagaaagttgcggacatattggcggtggcctgtccgcggcgtcgtcctcagccagagaaggggagaggagggagagggagatggtgagtccacggagaagcgccaccgggagcagatccggccatcggcggcaagaaaggccacgccctcctctacctccgtaccgtcacccaggttcaggcatagcatactgatgcaattgg

SEQ ID NO: 45137 - DNA, 256 bp, Triticum aestivum
  Clone ID: PAT_TA_45137
cgtccgtccaaacatctatatcgagtgccagctactcatgggaggttttgttgaagtccagggttgtggcacaagctgtcaggatagcatgcaatctgttactatcagggcaaagatgccatcctggagtatgggctcatgcttacgcgtgaagaaagcagtgaaggctctttcaaagattgaaattgacgatgaagacgaactgattgacgaagacagcctcttgactgaggaggtctttgaggaaccacagctt

SEQ ID NO: 45138 - DNA, 447 bp, Triticum aestivum
  Clone ID: PAT_TA_45138
cgtccgccgccctcccctgtgtgctcccgccctgccccggcggccgaactccgccgtccggccgcagtttcccaggccgccaggcacgagaagctgccacccccccggcgaggggtggtcgcctcaacggctccgctcaaccggtcggttcggaggctcagggtttagggagggactcgatttgtttcaatcatcaagtcgagtggattctgtactgaaaggtgtgctcgctgacaatggctcttctcatgctgagctgtgaaggatttcagaagcatgaggatagattccaggcaacacatattggccatcggttgctttactcccctgctgctgataatagctacagggacgatgtcactgctgctgctgctgctgctgcagatgataatataatagatggcagcattctcagcaagaagaatcttcaaagtttgcccgctaatg

SEQ ID NO: 45139 - DNA, 236 bp, Triticum aestivum
  unsure (1)..(236): unsure at all n locations
  Clone ID: PAT_TA_45139
taatttccnnttcgggccctctcgtcctaaaattctatacagagaagagagtctcgtcacatgcctttggcaaaaattatcgtgtgcgcgtggggtgtcttaattagatgtgatccgaccctgtggatagaattccaacactacattataaagctaggtcgatttggaagcctctcttgcccgggggtctatcacccattaacgcctcggggtgatcgatacggacgctggggggc

SEQ ID NO: 45140 - DNA, 426 bp, Triticum aestivum
  unsure (1)..(426): unsure at all n locations
  Clone ID: PAT_TA_45140
gctncttcttatcctcttacgctgtgccacccctctcggccttcctacacgccgcccgacctcccaccgtggcgcactctaccgctacaggtctcaccctccctcggctgcaggtcgcggcctcccgcggctgcaggtcacggattcaaccttgtcgctgcacatagggaccgtggccttccccgcgtgtggtcgccctccgtcctgcttcaagcccgttttcagccgtccatagactggatagaactgatgggcttgatccccttccacaatatcagcttcaccaatgttgccgatcaatagtgcatttatctgaggggagaaggacaaaaactaatgtattcagttcataatgggcattccttggaacagttcttaatataggtttccatagatttattacaggggatatttttgtaaaaattt

SEQ ID NO: 45141 - DNA, 121 bp, Triticum aestivum
  unsure (1)..(121): unsure at all n locations
  Clone ID: PAT_TA_45141
cgatcctnaattccctgggggacgccacgcatcctaaacccccaaggctcggatgcctcgaacaagttcttaggctccctatcgcggggggaagggcagataagtagatcccccacctaaa

SEQ ID NO: 45142 - DNA, 349 bp, Triticum aestivum
  Clone ID: PAT_TA_45142
tcttacgcaaaaatagttgaatatttcatcttttatgcgattgttgtgtagatgacgggcggtgtggggtttttatataaccttgactccatctgaaatacttccagaagaattggaagctgagctgaaggggggtgtgtaattatcacgggtgcagaattcattgatcttgtctctcataatcattagggaactgtgtgatcaagtcactggctttttctgaggtcagagcccagctatattgactatctattaagtagtatggattccagttctctcaacttgactggactggtaggagaactggttggtgctcgtcttattttctatggtagtagtttgattaatt

SEQ ID NO: 45143 - DNA, 419 bp, Triticum aestivum
  Clone ID: PAT_TA_45143
cgtccgcccacgcgtccgcccacgcgtccgcccacgcgtccgcccacgcgtccgcgcatctggagcgagctcccaccgaataaacccccaaaacctagtcgccgccgtcgccgtcgccggcgccgccgcagcagccatgaacgccttccggttcctcggggacatgacccacctcttctcggtcatcgtcctcctcctcaagatctacgccaacaagtcatgctcaggggtgtcgaggaagacgcaggagctgtacctggcggtgttcgtggcgcggtacctcgacctcttcacagactacatctcgctctacaactccgtcatgaagatcgtcttcatcaccacctccgccgccatcgtctggtacatgcgccgccacccgcaggtgcgccgcacctacgaccgggaccaggacacct

SEQ ID NO: 45144 - DNA, 358 bp, Triticum aestivum
  Clone ID: PAT_TA_45144
cgtccgcccacgcgtccggcgataccacaccagatatgtcacctgccaccaaggccgccgagctgaaaggttccaagggcccaaagattgacggtggctgcggcaagcgttgaaagtcaattacgccataaacatacaattgtgctgcctacccttgtttcctatcgtactatcatagaccgttgagaagttcttacccgagaatctggtgtcggcaccaaaaccgccaggctgaaggaggtcgacgacatgaatggcctgaagagagccaataaaagcgggaagacgcacatgatctacatctgccaggtgctgaagcaggtgcaccccgacgtcggcctctcctacaaggccatgt

SEQ ID NO: 45145 - DNA, 439 bp, Triticum aestivum
  Clone ID: PAT_TA_45145
cgtccggtgaactccgcctccatcagctccacttcgccggagcaatcagtccagaggaggaggtgtagccggtccacctgatctccgacgtcttattctaactccaaataaattcttttctagttctattcttagtcacatgtacacatgcaggttctaaacttcttgtctagtcattctagtactgatgaagatcgagttgactgaaataatatagtcaattcttgagacccttactggtccttccatatatagaagttgtgcctgatagccaaacataacttttctctttgttgcctgcttgcttattttggtgatacatttggacctttgccttgtcagtacaacaacacactccacagccgagcactccacagccgagcacgagaagagctgcatgcaggccacccctgtgctccgtcctatatccggctcagtc

SEQ ID NO: 45146 - DNA, 304 bp, Triticum aestivum
  Clone ID: PAT_TA_45146
cgtccggtcgacgccagggaccagctcacgcggacgccgctccacgtcgccgccgaggcgcactccaagaggtgcatccagctgctcctctcagtctccaggaacgcacggacggacgtcaggctgctcgacggcacacacctagtcgcgctcgaggtcgcgctcatgagcagaaagggtcaagtcgattgggcactggataacttagacgaggatcttctggcttatctgcaacaaaaggatctgaacgcggtgaggcttctggcagagaagaccagggaggctggggaggtggcttacagat

SEQ ID NO: 45147 - DNA, 372 bp, Triticum aestivum
  Clone ID: PAT_TA_45147
cgtccggaagggcgcaggcaacgtgctccgatcctgcgcccgggccgcggtgccgtccctccgcgtggtgtgcaccttctcctgcgtgagcgtccatcacgcgtcaccaccatgtgcactgcggcgccccgccgacgctgaacgagtccgcactggagcgacgccgactactgtcgcacgtacggcctgtggtactcttacgccaagacatgagctaagaatgacgcgtgactgctgtcgaccgagcacgggctgtacctcgtggtggcgaacccgttgatcgaggtcgagacggatatggtccggacggcgcccacgagcaccatgctgctggtgctgaccctcttaatgaagacctgctaacctccccac

SEQ ID NO: 45148 - DNA, 356 bp, Triticum aestivum
  Clone ID: PAT_TA_45148
cgtccgcccactcgttcgcccacgcgttcgtccacgcgtacgatccaccgccgcagcttgcggatgctggattccggcggcgacgcatccgcagcagctcgccacccacgcctactacccgtagaccagatggtgcagctgattatattcttcgtgcatgcttttatacaaacacccaaaacatgtctcctttgctgattctacgcatagatctgcggaacactgtatatattgcttctttctagaggatccctggttacatcttcttggtggatatgtatcagagagatcctagtgtgcgctagatgctaaatcacatggctctagccgtgtacaagtcgagcaccacaaaactc

SEQ ID NO: 45149 - DNA, 406 bp, Triticum aestivum
  Clone ID: PAT_TA_45149
cgtccggtcctctgttgggtgcgtgaagcaggccatacactactctctttttgtttctgagatattagagtacatcaatacaaaggacacatgttgcgtgaccgattttgcgaactaatatagagatagctgttggaatttgatctcaggtcgtaacagaccaagagaaaagggggagctcttctacacgttttgtgctatgatcggagacacacagaaagacaacttttggttttgatccctgtcccttagcatcaagtataaaaggaggaggtggtgccccttgggcaatgacacacgcataaatgtgttaacccccaacaaactcctaactaccgatcctaaaagggtgcataaagggatcagaaggccatcaccatagtcggccaccgcaaggatgtgctga

SEQ ID NO: 45150 - DNA, 392 bp, Triticum aestivum
  Clone ID: PAT_TA_45150
cgtccgcacatgtttactgtggtgctcactatcagacgcacgggggcgcaaagagagacgggactagggcacgagctccagcacagagaccgagagagagaggaagggcgagagagattgctggagctgtatctgggccccgatccggctgcgcagaccggtggacgtcatgaacaactaatcgaccctcatttattatgtatttgcaccagctattgaagcacatattgactggcgctaacgttttctgtaacatttccacagagaacactacagcgaactctttctggcactctagctcactgactatagcgctgaagatctatccatacacctctctatatacccagcttgagagcgacaatgtgtgtgatcttagcaacactctaaac

SEQ ID NO: 45151 - DNA, 270 bp, Triticum aestivum
  Clone ID: PAT_TA_45151
cgtccgcccacgcgtccgaggacgcgtgggctgaccctcagataatggagaacactacgaggtttcagctctcgaattgctggtaaggacgaatgcaacggccatggcggtcaccatctaccggatccggctggagaatttattttgcactccacgtatcccatggagcttggtgagcactgcaacttgatcatcggtcagaacgtctggggagagagcgcgactttgactgctgcgcgtatcgccatctgctgtagcgcaaagaacacg

SEQ ID NO: 45152 - DNA, 445 bp, Triticum aestivum
  Clone ID: PAT_TA_45152
cgtccgcccacgcgtccgctcagacggaggtgctggagggtctctgcccacccaagcatctggaagcactgactatccactcttaccatggcttgagatacccgagctggatgatgggccagcacgacggctgcccgaagtatctcaaccaactcagcctcttccattgcagcacagagcttggccaagagcttggtgggttttggcctcacctccgttccttctacatgtgccgttgcagctcgtccaccatgccggatcacatggagcacctgacgtcgctcaagtacctggccctcgactggtgcccgaacatccggtcgcttccgacgctgccgcgttctcttgagcacttcgatctcagcttctgcaatgagatgctgatgagttcatgcagaagagctggagaccccaactgggaaaagattcagcacgttccttatgt

SEQ ID NO: 45153 - DNA, 442 bp, Triticum aestivum
  unsure (1)..(442): unsure at all n locations
  Clone ID: PAT_TA_45153
cgtccgcccacgcgtccgcggacgcgtgggctggaacagacattattcgacccagaggacaaggtcatccaacaggaagctctcaaccttatttcggcccttctcaaaagcttgattttgaacttgagatggctgccattgttggaccaggaaatgaactgggcaaacctattgatattgctgatgctgaggatcatatatttggcttagtggtaatgaatgattggagtgccagagatattcaagcctgggagaccatacctcttggacctttccttggcaaaagcttcagtaagacacctgatatcagcagtataatgtttttaggataagctttgaatcacgtgttgtacaaaagttgaaatgctgcanagagaagctgatgagtcatgcagaagagctggagaccccactgggaggggcgccgctctagaggatccag

SEQ ID NO: 45154 - DNA, 400 bp, Triticum aestivum
  Clone ID: PAT_TA_45154
cgtccggtgagttcaccccctcccccctcctcctcctctccaatctgctctgactctcaccctctccccagatttggtgcagcagacgctgtggggttgaggtgttcttggacgatttgcttaaggtatgtttctatacattggcatgatatctaagacaagtctttgaccataggattgtcatcaattttgttatttagttatacagaactgcataacatagaacaatactgcttctaaatggatgttgccattgacaaggttactaatataacttggtgtcgttgcaggcagtgtagtttacactctatattagtttatctagctatttacagctcactttgatctaattagataaatgttgaacataagccatctactgttgatgtcctgttggaca

SEQ ID NO: 45155 - DNA, 382 bp, Triticum aestivum
  Clone ID: PAT_TA_45155
cgtccgcccacgcgtccgcacggaagggaagcttccagagcgcacgcaaccaaaacccgagttccccttcccctctcgcgcgcccgcccgcccgcccacgggatttcctttcttccccgcctccacgcgccctcttcagatccatccatccgtgattccgtcgggggcgggccacatggcggcggcgctcgcggtgacggacgagctggccctgcctctccgcgcggtgggggacctggcggcggctgccggcgtctcgcgggaggaggtcgtcgtcatcacgcagtgcgcctcgctcggtgggaagttgccttttgatgacgcgtccgtgggcgctgttctgtctgttataaaaaatgttgagagctttggagataagttg

SEQ ID NO: 45156 - DNA, 353 bp, Triticum aestivum
  Clone ID: PAT_TA_45156
cgtccgcccacccactctctcggatggtttgttctcagagggcgcgacacgcaagacgccgagacgccggatacccctatctcgccgtgccacatcccgcaaggctaggcggatatcgttgttactcggctccacgcgcggtggatagatgcatccatgctccattgcacgcaggccgggccacatggggagggaccatcgccgggtcggaccagcaggcctcaggctctccgcgcagctgtgcacccagctgtgggtggcgcgttctggcgatatgctgaaggaggaagaactcaactggcataagacgaatgcaaggttcgataagatgacgcatctccaaaaggaagcat

SEQ ID NO: 45157 - DNA, 379 bp, Triticum aestivum
  Clone ID: PAT_TA_45157
ttttacaaaaaaatttccactagtgcaaagcttgacccgaccaaacactattgttctctaacacacataggaacttatagcaattggtcatttgaaccaagagcaatagaaataagaaatgtgtacacggatacaactttgcatcatcaaaatctagagttagaagacatttacatatgatgaggtttctcaatggtaaaatacgcatatgatgcgcatgtagcagcagacaatctggtttccgtgtgcattaaaaaatcttcacaataaaacttcactgagaagacaaaggctacatttactgaatgtgcaatagcaattaacaaagaattaatctgcatgaacaacgacaagcctgaagctcatcaatactaaagct

SEQ ID NO: 45158 - DNA, 440 bp, Triticum aestivum
  Clone ID: PAT_TA_45158
cgtccgcccacgcgtccgcccacgcgtccgagcgactcttcctctcgtctcgcctccgagctaggtttagcgccgccgccgctgccgccgccgcccccgtacctgctgctccgtcgttgcccaccggaggaagggcccctgttcagacccgctccttccccgagttaggccgtctgcgcgccgtcgtcgtcctcgtaccttcgtacgcggcgctggagagacggatgaggagctcgagcagttcgtgcattcatccctcttccctcgaccatcgacgtctactgcgacaagatctgccacctcgtcgacccaccccgacccacgtcatggggcgcatctccttccaccgcctccacatcaagaacgtctgccgcctcgaggggatcaccaagatggccgatctggtgcgccccttcccatctcccctcccttcgccgctc

SEQ ID NO: 45159 - DNA, 166 bp, Triticum aestivum
  Clone ID: PAT_TA_45159
cctcacgtaccgtaccgaatcgccgggtcgagcgaggcgacgcccatccataatcagcccatgccaccgctaccggggctcgactcgcaccccgagcaagctaagggggtgaagcttgcgatggcgtctgccctattgttcgtcggctaaggaaacctctgacgat

SEQ ID NO: 45160 - DNA, 445 bp, Triticum aestivum
  Clone ID: PAT_TA_45160
cgtccggcgaaatcccccgaagccgtccgtacacttgcagcagatcggccggcggaagccagcaggatggaggtggcgtcgctgtaccggcgggtgctgccgtcgccgccggcggtggagttcgcgtcggcggaggggaagcgcctcttcgcggaggcgctgcagggtgggaccatggagggcttcttcaacctcatctcctacttccagacgcagtcggagccggccttctgcggcctcgcctccctctccgtcgtcctcaacgcgctcgccatcgacccgggccggccgtggaaggggccctggcgctggttcgacgagtccatgctcgactgctgcgagcccctccacaaggtcaagtccgagggcatcaccttcggcaaggtcgtctgcctcgcgcactgcgccgtcgccagggtccagtgctttcgcgccgaccagacca

SEQ ID NO: 45161 - DNA, 428 bp, Triticum aestivum
  Clone ID: PAT_TA_45161
cgtccgcccacgcgtccgcccacgcgtccgcccacgcgtccgcgctcctctccctcctcctgcctcctccctcccacgcctctccctcctcctgcctcctctctcccgcttcaccacagccgccgatcccctccctccctgtccatcctctccctctcgttagccgctgctgcacgaacctctcggatgggtgccgggtagaaggtcgcgccgagtctgccatgaaggaagcagcagggacttggtggatgtgtttgctctgcaggggagtgaaagaaggagatgagggagaaagagagaggaaagaggagacggaagtgcggcggttgatgggacatggttgacggcggctcgatcagctcttggattgagagctgccaggaggctggggcttgggcgcgatgcacgggaggctgcagtccacctct

SEQ ID NO: 45162 - DNA, 387 bp, Triticum aestivum
  Clone ID: PAT_TA_45162
cgtccgccccttccctgtgtgttgtcggcttctcctgcaaagtcttggcctccttgcttggtgctggtgccggatagcaagatggcgagggggtctcatacatctgtatagatcctgctctcttctctggggcttgcgctactctgcttcacctgaggaggcaccgtgctgctggccagagcacagaaaacgtggcgcatggggacaccatgctcagacgagaaggtcctgcaggcaagcattaactactcgtgctccaacgagagctgcgccgtgatccatccacgcgggccgtgctacaacccatacaacctgctgctgcacacctgcgtgaccatgaacattttctacgccgacaacggcgcgacactcctggaactgctactt

SEQ ID NO: 45163 - DNA, 225 bp, Triticum aestivum
  Clone ID: PAT_TA_45163
agcgtccgcggacgcgtgggctggttcaagtacatgcaacgcgtttcggaggctgtacacacggcgaaccggcggtgctgagaatccttctgcctcagcttcgcaacgacctggcgttctcaactcgcggcagggagcctgacttcaccggaggcggcttcgagtgcactggacagcttctcaacgccaggagtggcggcgggaaccccacgagggtgcgccgga

SEQ ID NO: 45164 - DNA, 360 bp, Triticum aestivum
  Clone ID: PAT_TA_45164
cgtccggttcattcaaaagagagttcagtgactccttctgcagtcaccttattggagggtggtaagaggaagagagggcggccgaagcgtgtgcctgatagttcagtgactccttcaagtcattctggcctttcagtagatgttgacagtggtgacacatcaaaacgtggccggcctaaaaaaattgacacaagcctgttgcacctgccatctttgttttcagacgatcccagggagtccgcagataatgtgcttatgatgtttgatgcactgcgacgacggctcgtgcaggtggatgaggtgaagcaagtagcaaagcaacagcaaaacttggaggctgggagtattatgatgaacgct

SEQ ID NO: 45165 - DNA, 306 bp, Triticum aestivum
  unsure (1)..(306): unsure at all n locations
  Clone ID: PAT_TA_45165
ccgctttgccatggccgtgncnncccactgntttttccgtcgcacacacacacagacacccttacaacaccccgtagcccgcgccaggagctcgcctcctcttcgccatggcctcgagcccgattccctcgtccttctcctcctgtcaccgcggcctttctcgctgcatatccgccgccccaggacagctcctccggcctccccgtcctttgtttcgccttgcctcgcctcctgctcccgcgtgccttgcgaaccgcatgtgtggccgcatccaatgcctcccgctccatctgccatggcctccct

SEQ ID NO: 45166 - DNA, 244 bp, Triticum aestivum
  Clone ID: PAT_TA_45166
cgtccgggagaagcaaaagtttaagttcatgctcaagacaaaggatgacgagagagcgaggtctaggagtggggtactaattattgggactgttgcaccccagtgagagagcctactgttgttgaagccgaaggttggccggcatctgccttgacagtcccatagactccatgggaaggcagagataccactgtttctactacgaatctgtccagtaggttgcgttgttgacatcgtttttaga

SEQ ID NO: 45167 - DNA, 362 bp, Triticum aestivum
  Clone ID: PAT_TA_45167
gcgtccgcggacgcgtggggccaagggaagagatatggcatctgacacagctatgatcttaaatgaagacaggcacttcgtgtaatgtaggatgccacggaaccatcacaagttctttgaggcgaatgttgataacatgagggctcttcatgtgcataataacgatgatccttcaactagcgaagccagatgttcacgtggcacaatgttgactgcagatatattgggagcaagaacaagaagcccatcccctggccgaaaagcccatgcctttgctgggaataatgtacattcaaaagaattcagctttagcccaaggtcaccattgacattgagtgcgggttagagaagaccggctcatt

SEQ ID NO: 45168 - DNA, 353 bp, Triticum aestivum
  Clone ID: PAT_TA_45168
cgtccgctttcttctagtgtttgcatgacttcgttctcctatcactcgccggctgtgtgtgacgggttatcatcttggtcgagtcttccagggcagtagtggagcaccgcagcgtgcgagccaacgcaggcatggcgacggcggaggcagacgtcggcgcccccgcgagcgtgaccgcgccgatgatgctgcacgggcgcgtggcgatcgtcacgggcggtgccggcgggatcggctcggccgtgtcgcggcacctggcgtccctcggcgcgcgcgtgggcgtcgcctaacattgggaccccgcgccggcgcgggacctcgtggccggcattaacgccgtcgtgcacggagcc

SEQ ID NO: 45169 - DNA, 310 bp, Triticum aestivum
  Clone ID: PAT_TA_45169
cgttcgtttactcgtgggtttttgcccgagacttttagatgacaagagagcgaggtctagggataggatacttattgttcggactattccaccccaggattccccacacctcttgttccaatcgaatgaggggcggacttactcttggcttctccgatgaattcgtgggaagccagaaataattgcctgtccactgcgaaactttctagtgcttcgagtacttgattaggttactagggaaccatcatgagcgtccgaagcgccagtttcctctcagatccaccccctctcgactggcatttccctttga

SEQ ID NO: 45170 - DNA, 429 bp, Triticum aestivum
  Clone ID: PAT_TA_45170
cgtccggagcccgcaagggcatggcgatggcgacgcacacgggggtcgccgcctccaaggtcctcatgctcgtcggcgcatgcctgacgggatcgatcgtgcttaagaatggccgtctgtcagatgtattggcggagcttcaggagcttatgaagggcgtaaatcaaggataaggcttccgtgcatatgacatggttcttatacaagctcatattcagtatttatgccaagaagttatagatttaactttgtcaaagcccattaccatattgagtggcttattggtctcgtgaggctgttttttgacctacatacttctttcctctgtatttcgtgtatttgattccattttcttatttttgagtacgttggttgatttctttttatcggattccattctttctcttgtattttgcttgtatttatttc

SEQ ID NO: 45171 - DNA, 297 bp, Triticum aestivum
  Clone ID: PAT_TA_45171
cgtccggcccgcctgcccgcgccgtcgtcgtctcctttcgcaggagctccctccccgcgggcgcgatggtgtacatcaagaaccataatacaagggcgtactctaagcgtttccaagttaagttcaagagaaggcgccaggggaagaccgactacagggccaggctgatgctcacgaaccactacacgaacaggtacaatacctccaagtaccgtcttggtgtgcgatttagcaactatgcagtcactgcacactgtgtctatgctaccattgctggtgatacgacgatggctggtg

SEQ ID NO: 45172 - DNA, 231 bp, Triticum aestivum
  Clone ID: PAT_TA_45172
cgtccgcccacgcgtccggcacaccgcagcttgagctcggtcgtatccctctgggccacgccaagtgtcaggaacaagcaccgaacccctcctcccccacctgctagcccatggcggcgactcctcccgccgccgccgccgccgcgggcggggcgcaccacagcgtgttcgtctacgggagcctgatggcggaggaggtggtcaatcacactactggggggcgctcatttc

SEQ ID NO: 45173 - DNA, 360 bp, Triticum aestivum
  Clone ID: PAT_TA_45173
cgtccgcccacgcgtccggagaaatccctggttggcttcagccggcgctctgcgtcgtttgcttcttgaaggggccggcttggcagctctatgcggttggccattatcgggccattcattggactttgccatggacgcctccgagtacccgcacatgcaagggggcgcgtcgtcttcgtcgtcgatctgccgcgccgccgacgccgtcgcctgggacgccgtgcagcaacagaaacgccagcgctgccagggatcatcatccggtgataaaggtggatcctgtacagaaaataactccttcaaagcatttgaagccgagccttaaaatttttactctggtgaaaattgatgggaagatta

SEQ ID NO: 45174 - DNA, 309 bp, Triticum aestivum
  Clone ID: PAT_TA_45174
cgtccgcaagagtctagaacggttgctggtattatccttaagaattcgttggacacaacggattctgcgaaagaaagagctgctgattcaacagagggtcaccctggatccatctgtcaaagtcaaagattaaggagtcattgttcagaacactagaatttttaatgccttatgcgaggcaggcctcatcacaagtcatttcataggttgcatccattgagacctcattgccaaattactgggcaacatggtacagcacggtgcatttgctgcattgcagcacggcacactacaggttctgggttattc

SEQ ID NO: 45175 - DNA, 322 bp, Triticum aestivum
  Clone ID: PAT_TA_45175
cgtccgcccacgcgtccgatcgtcttctccctcttctctccccccgtcctcctcctgcgaacacggcggcgctccgtgccacttctcgccgacttttttggaatcaggcaaagatgacgagcaagcaggagccctggactcgactttcccacagtacgaagttaccaggatgggtcgcgtacaatccaaggaccatgaggcctccaccattgagcggcgacaccaagcaaatgaagattctatcctggaatgtcaatgggctgagaaatattgtacagtcaggaggtttctcttctgcattggctcagagggagaatattta

SEQ ID NO: 45176 - DNA, 204 bp, Triticum aestivum
  Clone ID: PAT_TA_45176
cccacgcgtccgaccacacgtacgagcttatcaagataactctggccacaagccaggccagcgttccggctggtgctactggcccaatggtggtaccaatgcttgcaatcaggattgcctatgaggcttcccatgctgtgttcagtgctgcttacaggatgacactgttaaacaagcttttagagcagcttttgctgtctttat

SEQ ID NO: 45177 - DNA, 232 bp, Triticum aestivum
  Clone ID: PAT_TA_45177
ggtcgacccacgcgtccgaggatgtcatactaatttcttatgagatcatccacaaaaaggatcctggtgctgttgctcgaattaagcaaaaggaagtctatgaacaacagaataaacttcttttaattggggagcgtgctgtgcttcgtacacttgattttgtcttcaatgtgcattacccatataagcccttggttgtaggaatatgtatactcactactgcttaaatgga

SEQ ID NO: 45178 - DNA, 104 bp, Triticum aestivum
  Clone ID: PAT_TA_45178
acgcctgcaggtactcgttctcgtatttctccggtcgtacccacgcgtctcggtacatcgtagaggaggtacgtctcccactcggactcaagagaggtagaacg

SEQ ID NO: 45179 - DNA, 372 bp, Triticum aestivum
  Clone ID: PAT_TA_45179
cgtccgcccacgcgtccgggagctacacgcacccaacgatggcatcgaacagacggtagccaccgccgtctgacgtaaacggtggaagacggcgagcgccatatgctgtgagcttcttgcgaggccgacggaaactttcagctgtgcgataatgagcgcgcttatccgcaaagcgttagcgaccgagatactgctcatgccccagtcatgggagggccgcttccaaactcaaagaggttgggctggcttgcaaaaaccatgagcaaactactcgttcggcgagaactcgatgctctcttcagccgtgtccaatgctgactacaactactttttcgttggttactagattccacgctagaccttgtcattgct

SEQ ID NO: 45180 - DNA, 220 bp, Triticum aestivum
  Clone ID: PAT_TA_45180
cgcgtccgcggacgcgtgggcggacagcgtgggcctgaaacggaagcaagcaagagagcgcctgtgtagagcagcgatgtctggcctttgtggactcgagagcatcatctggggcggcaacgtttgaagccataggtaaggtggcatgggcaagttgttctcgctcgttatgggtctatctgtacaagtttttaccttagcttaagtttgtttagattta

SEQ ID NO: 45181 - DNA, 180 bp, Triticum aestivum
  Clone ID: PAT_TA_45181
cgtccggctacacaagactttacttgctcattataatcgtgtccatgtggcacctacacgggtgtggaatgatttgttagactcttcccattacctaatacacttcaatgcccctatatttaatgagtgccaagctgataaaccaatatatgtggagcggagcccttttataatatagtg

SEQ ID NO: 45182 - DNA, 389 bp, Triticum aestivum
  Clone ID: PAT_TA_45182
cgtccgcccacgcgtccggtcgcctctccccaggcggcgccagggcccccgaaaccctagtgccgccagctccctcttgccgccgctgccgcccgcggtggcggcgggcccggtgccgaaggtttccgggcgggtggatgtggcggatcccatctgaggcggcggaggcggcttctctcgtgagatgcaacaacagcggctgggacggcgaatccgggctgtgcggcttccgagggaaaccctagatttgggtctaccggatcggacgatgacggtgccttcggtatcgttatccctcatgggggcattgttttggagcaagtggtgtttggaaggtacaagatgagagcggttatttatttggtccattgttgaacacaagatcttgg

SEQ ID NO: 45183 - DNA, 434 bp, Triticum aestivum
  Clone ID: PAT_TA_45183
cgtccgcccacgcgtccggtttattattactctgagaccgctccaagaaaaagttggtctactctgagaagaggggctcaataactccatcgattccgatgggcaccactgccagccgctcatcgccggcggtcaagaatacgcgcatcgtcaccgtccctgtcgccaagtacctcgagatgacgacggttgatacgatcgacttttgcggcaacctgtggcacgtcaacgtgcaccctatgggccacctagtgtgcgtcatggtcacctgcgtcgacaagcaagacccatactcggcctcggccaccgacgtctccattgaaatcttggacgagactggccagcacacatgttccacagcgagtacggacacatgctggtcaacatgagggagatggaggcgttctcttgcgtcgacggggatggcgccttga

SEQ ID NO: 45184 - DNA, 183 bp, Triticum aestivum
  Clone ID: PAT_TA_45184
cccacgcgtccgtctctcccccctttcttcttcctccccacagccagccagccgccccggacctagaggtttccccagacaggcggcgacgtacgaatagcatacaagaggaggaggagatcctcacgcagaagacctctgggtaccctcgcaaggatcgtatcctaaacaaagtttgcattt

SEQ ID NO: 45185 - DNA, 413 bp, Triticum aestivum
  Clone ID: PAT_TA_45185
cgtccggtatagagagaacggttcaaacgatgtcgatctggagcacgcgttctacgcccctctccctctccctctctctcacgggaggcgagtgctaggtcggaggcgaggctagtcgcggccggtttgatttgtggatccttctttgctcgttttttttgttttttgttgtctatttttttagttgtcttctgttgattctttttttttttgtgttatcttttttatcgttactgtttcccttttgttcatctatttgttgtgtttgtttctcttttttgtcttgtattacccattcttgtctctggcactggctttttattgttatttttttgtgatttttcgtttcttttttttatattttttttgactcttgcttgttttctttagggtttgtgggttttttttttttt

SEQ ID NO: 45186 - DNA, 320 bp, Triticum aestivum
  Clone ID: PAT_TA_45186
cgtccgcccacgcgtccgcccacgcgtccgcagatgcttttctttttggggcaaggacagtttacagagatgttttcataggggacggtggttatgtcatttgctacgaaatggaggacatatagaaaaagcttggttttggcaggaaatcactgatatcatttgcgttgctttttggttgtgattattctaatggagttcatggctttgtcctggaagcagcatgccgtcttgtcaaatttggtgaacatgattctatcttgtattagattttatctgatggagtaaaaggctcacggaatgtgtatagggagaaaggc

SEQ ID NO: 45187 - DNA, 226 bp, Triticum aestivum
  Clone ID: PAT_TA_45187
ccgcaggtcccggttcccaattcccgcctcgccccacgcgtccgcggcgagcccttcgccgccaggccgtcgcactccgaccggatcggaccaggggcgtccccctccgcccacgacgcgtggccggagatggcgtccccgaagcggctcccgtactcctccgcgggcgctggcggcggcggtggagcgaggcgcggctccggcgcgctgccgtcggtggaggtcc

SEQ ID NO: 45188 - DNA, 189 bp, Triticum aestivum
  Clone ID: PAT_TA_45188
cgtccggaaaataataggcgcgaagtggttcgtcaaagggtaccaagccgagtacgggaagatgaacacgactgacatccacgagtacatgtcggcgagggacgccgtctgtcatgggacgcacactgcattcactgctgtcggcgctctagtgcccgacgctaacttttggggtcttgccagtggtgt

SEQ ID NO: 45189 - DNA, 168 bp, Triticum aestivum
  Clone ID: PAT_TA_45189
cgtccgcccacgcgtccgctggaagatcctcccctggggcgaataggcctactccggaggcagcgccaacgccccccgcggcgactcctcatatcccaccgctcgcatcttttgtaaggccgactacgactttagcgtcaccgctctttattggtactctttgttctt

SEQ ID NO: 45190 - DNA, 106 bp, Triticum aestivum
  Clone ID: PAT_TA_45190
cgtccgcggactcgtgggcggctcattaccggacgctcctcttcaaggactaggtcggctgaacgcgccgtaggtgcttctttttccacaggcgctactagctctc

SEQ ID NO: 45191 - DNA, 428 bp, Triticum aestivum
  Clone ID: PAT_TA_45191
cgtccgccgcaagccatccttccccgccctctcacctcctctcccacctccttccactccctcctgacatctcctccttccactccaacctccactgagccgctgccatggcgactgagctgccattcgtccctctccctcctcgcgcctggaacgctagctcgtggacatgccgaccgtacgcgccgcaggcagggcaagaactgcagcaccccaacacgtcgacaagggaggttagcaaagattggacggggatggacgagctagacatggatggcgtcaacgtggccaagcccgagttcgcgtaccctactggtcgtattctgaataatagtgcaaggtactttgagaaatggtctgcaaatcagcgcatctggagtgctaggatgtgtggggacaaaaagatgccattgcatacgcccgccggc

SEQ ID NO: 45192 - DNA, 242 bp, Triticum aestivum
  Clone ID: PAT_TA_45192
acccacgcgtcacgcgcacgttgggctccaaggggctggacggcgtctgggggctcgtcgcaggcaggcgctcagccggcgggagtggtggcggaatagggcggggactaggtcgactgccactgttccgtgacggagtcatggcacggcggctctcatctctacgtgtctctcaagatggataacgcgcggatcatcggcgacctggtgccgcacacctattggtgccgagcccaacattg

SEQ ID NO: 45193 - DNA, 205 bp, Triticum aestivum
  Clone ID: PAT_TA_45193
cgtccgcccacgcgtacgtccacgcgttcgctcctgtccgcggcttgccgagctcatttccgggcctgctttctcctcgtcggcctctgcttctgctgcgctgcatcttgcgagcggccctcggcttctccggcgagcgactgttccagctcggggaggcgagaccctggctgttcctgagctcaggggggcagactaatttctg

SEQ ID NO: 45194 - DNA, 417 bp, Triticum aestivum
  Clone ID: PAT_TA_45194
cgtccggttggatacagttacagaaacaataatagaagagttcatggttctagtgtaactggactggcctcaatgtttttacctgatccttggctctggctttacacatggtttggtcaattagcctcttgctaactctagataaaatctgatactgtttcctacatcggaagtcgtagctgacacatcaagttatctcccttccagtttccgtgaattatcttttgttgaaggagccaattggagttggctgggtataccaatgcagattcagctaggcctttctgatggggtcatctccttcatccgttgcatcacagtagagggatattgatcattgtccttgccctcgtatggtatttcgagtctgggtaacaggtaagggtggttatgggtgaaatggtaagatcatccaat

SEQ ID NO: 45195 - DNA, 115 bp, Triticum aestivum
  Clone ID: PAT_TA_45195
cgtccgggtgctttgaggcatcgacctggagatccgcagcgtcaagctggccagtgtgtggttgccatgatcgacgcctccaagctcggccttgtcctcctcgagctctaccacc

SEQ ID NO: 45196 - DNA, 168 bp, Triticum aestivum
  Clone ID: PAT_TA_45196
cgtccgatcaccctttctaactctagtctcctttttttcttctcctccccgtccgcgttcggatgacgcgtaggcgtcgcccgacctcttcctttctgtcccgacccgactccatggcctttatgcgcacttttttcaatgcatcctctggcatgggagatgcttttg

SEQ ID NO: 45197 - DNA, 220 bp, Triticum aestivum
  Clone ID: PAT_TA_45197
cttccgaatactttcaagggcaaggtgtgcgtcactgcagcctctggctttgttgcctcgggtctgggcaagcgactccttgagtcagtacatcatgttctagggtcagtcagagacccaggcaatcataagatagtagcacaccttctggaacttagcagtcgcttaatgtgaggcttcagctttggtagactcaccttttggaagaagggtgcttcgt

SEQ ID NO: 45198 - DNA, 246 bp, Triticum aestivum
  Clone ID: PAT_TA_45198
cgggcgcggactcttctttagaaattaaagactcaaatgcacgactccggacatgctgaactcctgaggaaagaaatagatattcttctaacatcactactttttatgcctgcctgtttcggatatggaacatatatttattcgtaccagcggataaccgttggtactgcagcctgtgcagctgctttaaaggagttccaaatttgtgtggaagccaaattctgtatcagctgtcaactcaggatt

SEQ ID NO: 45199 - DNA, 103 bp, Triticum aestivum
  Clone ID: PAT_TA_45199
tcctctccacttatctcattcaatgtctgaaattaacggtgtttattgttctactctacctgctcgggtgggagttgtagcatctatatggacctttgttcat

SEQ ID NO: 45200 - DNA, 306 bp, Triticum aestivum
  Clone ID: PAT_TA_45200
ggtcgacccacgcgtccgcccacgcgtccgctccacagcgttcgcccacagcgtccgaagtgagcacgctgatgtaaatgtgactggcctgcgtcgtattgaagatggttcaatgatctcaaatgaacacacgatcaaatggagaatgtgcactgataaagcacgagagtttttcatggaaggaaaactagatgaagcctagaaattattcaaggcagccttacaagaaactaaagaaggatttgtactcaaagatccacattctgtatcagctttgtacaactttgtaatatttttattaggtta

SEQ ID NO: 45201 - DNA, 299 bp, Triticum aestivum
  Clone ID: PAT_TA_45201
cgtccgcggacgcgtgggggtcaccaagctgtgcgatctggggccgagggacagcgtctgcgccgtgcactggacgcgcgagggctcctacctcgccgtcggcaccagccttggagatgtccagatttgggatagctctcgctctaagcggattaggaacatgggagggcaccagacccgggcgggggtgctagcttggaactcaaccatcttgtcctccggcagtaggtacaagaacatattgcagcttgacattcgtgtccttactgactacattagcaaattttctggccacagat

SEQ ID NO: 45202 - DNA, 444 bp, Triticum aestivum
  Clone ID: PAT_TA_45202
cgtccgcggacgcgtgggcggacgcgtggtcggacgcgtgggcggggctgcagctcgaactcctggcatccgggtcttcaggcatgggcactggcaccttcccgctcctcttcctctcttccctctcggcctccctcccctccccttcccgggcacccgccttcctctccctccgcgccctcgccccacaggcccgcctgtcgacctcctacgccgtcttccctatcggagggttcggagcctcggcgtcgaccggaaggtttaggaggaggaggctgcatgtggtgtgctgccgcccagcctcccaagactggaaggcaggcggactctgtcaagaagagggagcgttcaaatgacagacaccgcattcgtaaccatgcacccaaggccgagatgcccaccccggattaagaaggttttcagagcccttataaagcttatgaa

SEQ ID NO: 45203 - DNA, 125 bp, Triticum aestivum
  Clone ID: PAT_TA_45203
cgtccgttgagttacgtggttccaccagttgcaaaggcatttgaccaagagggaaaacgggcgaagggtgcttaggggtgttggtctaagaataatgttcttgtaaaacccttggaacaaaatgg

SEQ ID NO: 45204 - DNA, 413 bp, Triticum aestivum
  Clone ID: PAT_TA_45204
cgtccgggaaggcgcttgggaaggacctttgattgagcttgccatagactttgacctaagcattggcgtaacagggtttgtgggaaccgtcatcggctttgggtgcttctttggcggcgtcattatcgccaagctcatggagtacctgaacctgggcgggctgctctgctgcgtgctgtcgatcctgctgtggatgcagttttgcacgtacatctttaggcacttctttggcaacttcatggttgaggttaactttgaggctgagatctttctgggatacatggtgtacgacacgcaggacatcatggagaggacgcaccacagggacatggactacatcaaggcacgcgctcacgctcttgaccgactttgtcaccgaccttgtccggatcctcatcatcatgctcaagaac

SEQ ID NO: 45205 - DNA, 375 bp, Triticum aestivum
  unsure (1)..(375): unsure at all n locations
  Clone ID: PAT_TA_45205
gccccagtcccattccctaatggccgggtccactccacgcttcctcngtactcttgggctgactcgtgggctcccgcctcggcagctccgcaggccgggggtgctggccatacccactgccgtctcccccgtaccgccccgtctcccttcgtgcttctctcgctcgctcgcctgaagctggtcaggctacccctaccgcgccggcaagatggagctgaagcccggcatgtcagccctagtcaccggcggcgcctccagcatcgggaaagcactctgcatcggttttgcacaaaaggatctatttgggactggggttgatttctctgaaacaaatggaagagaagtcacttcggtaagtcaaaaggaaaacaaaat

SEQ ID NO: 45206 - DNA, 407 bp, Triticum aestivum
  Clone ID: PAT_TA_45206
cgtccgcccacgcgtccggccgtccctcttcctccctctctctctgctgcgcctccaggggtctgggtatcttcaggtcgggcgcgccccaggcccctccctcgctccatctcctgcacagggcgccctcttcctcgctccacatcggccctgttcctccctccctccctccctttattgctgtctctcctgcgccaccagccctttctttccatggatctgggtggacggcttattcatttcattctctcttcaatctggaggatacaaggggaacaaggcatgggtctaggtgctactccggcacgggggcacacccatctttctttaagctttgcccgcccagcaatttgtttgtagcttccgcacttgtgatacccctactttcccagtcactccttgcccac

SEQ ID NO: 45207 - DNA, 401 bp, Triticum aestivum
  Clone ID: PAT_TA_45207
cgtccgcccacgcgtccgctttgtcgtcctcttcaccagcggcaggcggtggtggcaggtgactgtgactagcaggagcgcggaggaggggtccttcggtcgccatggctcagatcttgctccatgggaacctccacgtcaccatcttcgaggccttctcgctctcccaccccggccgcgccagcggcggcgcccccaagttcatccgcaagtttgtagagggcattgaggaaactgtcggtgttggcaaaggaagctccaagctatatgccaccattgatctctagaaagctcgtgttgggcgtaccaggatgttgggcaacgagcccgtcaatctcttgctggttcgagtctttccacatttactgtgcgcaccttgccgccgatgtgttcttacgctt

SEQ ID NO: 45208 - DNA, 206 bp, Triticum aestivum
  Clone ID: PAT_TA_45208
cgtccggtcgccttccgattcgaacctcccccaaatccgcagcagtccacaggaggcgaagccagggcgatggcccgtacgaagcataccgtccgcaagtccaccggcggcaaggcgccccgcaagcagctcgccaccaaggcggcgaggaagtcggcgccgaccaccggcggagtgaagaagccccaccgctacaggcccgggac

SEQ ID NO: 45209 - DNA, 302 bp, Triticum aestivum
  Clone ID: PAT_TA_45209
cgtccggccttctaatcacccacacccaaacccctccggctccaatggcccgcacgaagcatacggggcgcgggtccaccggcggcaaggcgcctaggaagcatctttcgaccaaggcggcgcgcaagtcggccccggtcaccggcggcgtgaagaagccccaccgcttccgcccggtgaccgtggcgctccgggagatccgcaagtaccagaagagcacggagctgctcattctcaagctcccctttcagcggctggtgcgggagatcgttcaggactttaatacctacctgaggtttcag

SEQ ID NO: 45210 - DNA, 206 bp, Triticum aestivum
  Clone ID: PAT_TA_45210
cgtccgcccactcgtcctcggacgcgtgggctacatactcctgcctggagttccccgctttctcacttcttggatgattttagggatgattgagggttcctctggatcttttgtttctgtgactacttacaatgcatacttcttatagcctgtttgctgaataatgtttactaccaaaaccttttccatattttccatatgacctt

SEQ ID NO: 45211 - DNA, 214 bp, Triticum aestivum
  Clone ID: PAT_TA_45211
cgtccgcccactcgtccgcggacgcgtgtgttttcctttatccggcaaatccttttgcgggaagggggcattggagaggtgtattgctttctcttctatgcacgtctcgtgtatgcctacatttggctgatgcgctgatattggaactcctgggatggttcaaccatcatcacagtgtactagatccgtctttggtgtaagcggtaacctacac

SEQ ID NO: 45212 - DNA, 354 bp, Triticum aestivum
  Clone ID: PAT_TA_45212
cgtccgtttctttactgtatttcaaatacttgatcactaatttgctagtatgccatgatgacgaagaggtggggataatcttgagttagtgataatatattgcgctttatatgcattatctgattctacacctgataagcagatagggttggaatacgcctctttttaaggttcttattactatcccccccccccctggtgtgtggaggtttataatattagacctgttagggagtagctcgagtcgtatacattgaattctacgtttagtagttccatacagggtcagaccattgcaaatggtaaatcttacagaaacaccttttttgaacgaggcgtcatacccaacctgac

SEQ ID NO: 45213 - DNA, 272 bp, Triticum aestivum
  Clone ID: PAT_TA_45213
cgtccgcagcgatctaccatcgctccaccccgtctccccccacacctccggccccccaggggaggggaccttcggggcgcggcccccgtcgcctgcagaagatggaggccccgggctccccttacgcctccatgcccgagtccgcgcctaagcgcgcgctctgttccttcccgccgtcgccggccccgcgagaccgtcacgactccgtccacgacgccggcgtccttgattatgacatggataattcatcacatttgaggtttttggtggct

SEQ ID NO: 45214 - DNA, 186 bp, Triticum aestivum
  unsure (1)..(186): unsure at all n locations
  Clone ID: PAT_TA_45214
tcgtccgcccactcgttctgangactcgtgtgcgacgggatacacatccacattttcagccgggtgggcgggtacgacgccaacattcgcaccggttactactgctttttctgctgccccggtaacttcaacctttggatcgagcgcgtcggctgggtgccaagccacagcataagcattgggagg

SEQ ID NO: 45215 - DNA, 446 bp, Triticum aestivum
  Clone ID: PAT_TA_45215
cgtccgcgcatggccgcggcggggtacggcggccggagcgccaagcggtgcaaggagaagtgggagaacatcaacaagtacttccgcaaggccaaggagagcggcaagaagcgccccgcgcacgccaagacctgcccctacttcgacgagctcgaccgcctctactcccgctccgcccacggctccggcgcctcctccgccgccggcaacaccagcgccaaaaccaacgccaatgccatagccggcgccgacaacgcggccaacaaggccagctccgagctgctcgacgcggtggtcaagtaccccgccgacacccactacggcccaccgccggggttcccgaccgacggcgaccgtggcggcaatgcagaaaccaaggacgacggcgagggcgacgtggacatgggcagggcgtcggtgagagcaagcgacgagcatgacgacga

SEQ ID NO: 45216 - DNA, 247 bp, Triticum aestivum
  unsure (1)..(247): unsure at all n locations
  Clone ID: PAT_TA_45216
cggcncttnttcctttctcttctncttggcctgctctggtggaagcctcagactggcaactatgggcgattagaggtaccaggtggggggcatcttctacatctgcatttttcttgacctctttctcgctcttttgctccgtctacttgttccccttcgagaagctgggccttgttaaggagcgcatggccgacttggaccgtctcagcgcctactactccagcatcaccctttgctactccgtgcc

SEQ ID NO: 45217 - DNA, 371 bp, Triticum aestivum
  Clone ID: PAT_TA_45217
cgtccgcccacgcgttcgtgctgagatttcgtcaccacctgctcctactgttcctggaagcacagcgggcgtcagatttgtgctaaaagagcaacgcacctctggccaaagtttacacctgctcggggatatgccacccctccggctcttataaccggcaggcgcgctcgttatggatcggttctaaggccctgactgccacagcaagaaagatctacctgacaacagagtgcttgagttcaagatcttgctacaagattactcggaaaagatgccttagcaagatggacctaatcgaagcctacagacaggggaacccacacagacattggcggtctactaacattgcattaacgcgaagaatcataaag

SEQ ID NO: 45218 - DNA, 284 bp, Triticum aestivum
  Clone ID: PAT_TA_45218
tcgttcgcggacgcgtgggcgccgaggagccctccccctacgcccaccaccagaagccccagcccgcgtacggcttccggccgcagaacgagcatcatcagcagccctcctacggccgcgaggatgactccggctacggatccaggcccaagcccaagccccagcccgcatacggcttccgccctcaggcggaggagcagcgcccgtcctacggcggcggcggggaggacgactccggctacggatccaagccgcaggccggctacggctttcgcccccagcag

SEQ ID NO: 45219 - DNA, 365 bp, Triticum aestivum
  Clone ID: PAT_TA_45219
cgtacctaaaaaaggggattcaattaattttcctcctcaagatcaaagaaacaaaatctggtgggcgatgatagaagggtgcacgacttcacgttaatacaccaacctattggttagggccatttaaaacttatttttggggggaaagggtcgtccatccttattaaaaatattttaaggggttgtaggtgtccggttgggggaaaccattttaagggtctaattttctaattaaggtatccacgaaacatgattcttggattctaaacttttccctcaaggttggggctccctcaaactttccgtatttggcacacaacacaccacatagattcatgttttccatgctggttgtcttgaaccaa

SEQ ID NO: 45220 - DNA, 451 bp, Triticum aestivum
  Clone ID: PAT_TA_45220
cgtccgttttcccataaaacccaaaccagcccgccgcttttgtcttactcctcctgctcctcctgtggatggcggccaaccgcagcaggcgccggcgtcctcttctccccaaagcagccgccggcgtgctcgtctcccccagccccaccggcgatctcaacgccgctagcaccaccggcgtccccaccctttttttctttcctaactaggcgccagacccacccgagtagtagatttggccgcggcaaccacgcaccggcagaggaggacttcttcttcaccggcaccggaccctccttcttccgctccctagctgactgcagcgttcagcctccacaacgccgtttccttctcgccccggaaaccctagcccgcgggcatgggtgatcgagcgcagcacagacctcttcgtcaagacaacaccttgggcactggcaagggtggtatgttt

SEQ ID NO: 45221 - DNA, 231 bp, Triticum aestivum
  Clone ID: PAT_TA_45221
cgtccgtgaaaacctataaaagtgtaacatattggctaaacttgagcatctagaaatatacaattggcccaacttgaggtttaaactgtgtcttcctagatcattgtactggtatatatccaggtctgacaatgtgctatcatggggacagtgtgcctggaacacagcctcatcttgtcctgtgagtgaacttaaaggtgactcagagatgcctttgtggcattggagttt

SEQ ID NO: 45222 - DNA, 332 bp, Triticum aestivum
  Clone ID: PAT_TA_45222
cgtccgcccacgcgtccgtgtctctctttatatctcattttgggacctgctctcacatacggtcggggcaacctaggttaaggtgccctactttagcaacaacaagacgagagatcaaagctgcttttacaggaaactagtaagaaagtgaaccttcctagcggaccacccgacagaactgtcatgaaatgtgcctggcctggttccaacttgaaagatctttctgtctacaccaaggcaggatgacttatgtgcttaaggctatatcgaatgaacttcaatgcatcttaactaggattaatgggccatatctgctcactattatgcctttt

SEQ ID NO: 45223 - DNA, 434 bp, Triticum aestivum
  Clone ID: PAT_TA_45223
cgtccgcggacgcgtgggttgcccccctccaggtgatttctctatgatttgaacatggctgcacaggggtgcccttagatgggtgggtacagtatgaggttcatcatgaggagccatctgatgagaaaaatgagatcttcacagatcataggagaaagaagaggggatgagcttggctgggcaggagaaaagaagaagagaagtgtacatgcttgtttgctgcgtgacaggaggcgttagtgaggagtagcagctcgtcgccggctagtctccgctgccgccggccctgggtgagtagctgctaggtacgcatccaccagtcgccacctggtgtgagctcgggagagaggaactaaaacttgtagggaaaggaagggagcactggggttctagggttgcttctgtctcttaacttggcttaagtggctttatat

SEQ ID NO: 45224 - DNA, 419 bp, Triticum aestivum
  Clone ID: PAT_TA_45224
cgtccgacgcacaggaagacaggggatgccttgaagagtctcccttccatcgaagaaactaaatctgaggagagcagatagaacgttgactgtcttgctgtactacacacactatcggttgagactttaaaacataactttggtgtggaatgagagaacatgcttaattcagaatatttttaagtgttgctaccgttccgttgtgagggaacaatttgatggtctaagtctttaattaatggatccacgagacatgtaatctgtgattttaaacttttttccctcatgtttgggcttcctctaactttttcgtttattgccccaacacaacacatagatttctggctttcatgcttgctggcttgtaacaaacaaaatggtgggatgggtacctaatttccttaaatgatttgaactca

SEQ ID NO: 45225 - DNA, 254 bp, Triticum aestivum
  Clone ID: PAT_TA_45225
cgtccgggcggtactcctgtccgggaaacgcctatctataatggcggccaacttctggacgtcgtggcacagcaagcatctgctggacccggaggaggtgtacgtggtgccggcgcaagaccgggagcggtgcgtcacgcccgtggagtttcgccttgtcaagatccacatgttctttcatatatggcgggtgggtccacaggtcaaatgttagacaaagaggttatagcttactgtatttacgtaccttgaga

SEQ ID NO: 45226 - DNA, 333 bp, Triticum aestivum
  Clone ID: PAT_TA_45226
cgtccgcggacgcgtggtcggacgcgtggggaaaagttaaaaccaatctgaccgtttaggtagacggtggtcaccctggcggtgaccggacacattgacgattattttttgcctaacgacagcatatgcacagacgtgcaagggcggctccgctacacgcagtttaccacagactaggaaacgctaaaaaagtcactgtcggtggttagacctttaggcacatcggttcatgtaagaccatattccacaactgacccaggctgatgaccaataaggccaacgggcataccaaggaggcaaggttcacctacagcacaatagatactcaactcg

SEQ ID NO: 45227 - DNA, 140 bp, Triticum aestivum
  Clone ID: PAT_TA_45227
cgtccgctcgtagatagcaatgaactacaaggttggtgtgatcacggcatgggacactggagccgggtataggtcaactctgcgatacatgagtgtggagcgtcttaaggactcgctgagatgcatcactctattggagg

SEQ ID NO: 45228 - DNA, 413 bp, Triticum aestivum
  Clone ID: PAT_TA_45228
cgtccgccaactccggcctcacgccatcccggccgccccaacctcccaccgcccagtctccttccgaaggacctcctacagtgctactacggccagatccacccaccatcgtcgggatatggccaaccactttgcgctcagccaacacacactgccgtccggccttgccaccaaccaccccacgccacccgctgtcggtcaccaccctgtgccatcctgcttgaccaccaaccactccgtgctacccttctcggccaacaaccaccctgcaccgtgtgcccctacaaccactccacgctttttgtcccgtgcgcatccacgtactgtgccgctgcactcttggttgtgttggccctttttatctgctgtaaaacttctctttccatttcgcttctaaaaccggcgagtatcca

SEQ ID NO: 45229 - DNA, 118 bp, Triticum aestivum
  unsure (1)..(118): unsure at all n locations
  Clone ID: PAT_TA_45229
caggtaccgnccgaattcttttttacctacgcgttcgttactttttataatcgatagactttcttcttttctctgaaataaccattcttgggggggcttgatttattaaacagttgcg

SEQ ID NO: 45230 - DNA, 351 bp, Triticum aestivum
  unsure (1)..(351): unsure at all n locations
  Clone ID: PAT_TA_45230
ccccccttnccgttttcnnntcccgccacgcgtgccgcgtattcattctctcacacattacattctctccttctttcttttcaatcatccccatccccatagcttaggagtggcccccaaggcatctgagaacaagccggttgagaagaccctgttgggtaagaagcccaaggcggagaacatggttcccgcgttcaaggagggcggtggtgacatgaagggtatgaataaggccaagaatagcgtgtagacgtacaagatctacatctttaaggtgctgaagcaggtgcacccggacatcggcatctttttcaaggtcaagtccatcatgtacttccttatcaaccacat

SEQ ID NO: 45231 - DNA, 415 bp, Triticum aestivum
  Clone ID: PAT_TA_45231
cgtccgctgacgcgtgggtgagatggcactgcttaaagcaacgctgctcgagacgagggcgaagctggtggtgcgaggcgggttgttcgacagcggggaggagctgtgcaggacctgcatcagcatcaggacggtcatgcttggccacgaccatgcccagacattggcggctcatgagacgctcgcaaaggtggttagatacaggagcaaaatctgagatgacgcggaaccgtgcgagctgttccacataggtagcatctagatgttgtatcttgttctttgctgtgtctgtgaatcactactcgacattctttattgtgacactttttttgctagatcactgacatagctagtctgattatgagatcatttgtaacttgacaacttatatttaaccaacttgctgtgtacaaat

SEQ ID NO: 45232 - DNA, 333 bp, Triticum aestivum
  Clone ID: PAT_TA_45232
gggaggcacgcgttcttatggatctttatgtattgacacttcatctttatgttttgagtcattataaccgggggggggggatttataggagagtggatggttcactctttctttcaaccttaatataattgttaagtacaacagaatatgacttaatcttatgatagggaacctagggatgtgtcggtctatagtaccgaggaatagatacctattttactaaatttggtcaggctcgactagcagatgctgatccaaaactagttatgtgttaaggagttatttgatgtatcagtggattgatctatttcaacaattagagtatcaatttta

SEQ ID NO: 45233 - DNA, 412 bp, Triticum aestivum
  Clone ID: PAT_TA_45233
cgttcgcccacgcgtccggccaaccattcctcccaaatccctcccccaacctagggtttccggctgtggctgctccaccatggcgggcgccaccgtcgtcgctccgatggacatcgaccgcgctgccgcgcccccggccttcaagggcaaggcgccggtctccgtcgccgcctacgtcaagtcctcgtcctgggtcgagaagcaccggccccagtccctcgccgacttcgtcgtccaccgagacattgtcgacaccattgatgggcttacagatgataatagggccctccatctgttgctttacggtccacctgtcactggtaaaacatggacaatactatcttgtcttgaggaggatatacggcgcaccagttatcaccatgattctggagcccattgcatcagttgaacg

SEQ ID NO: 45234 - DNA, 410 bp, Triticum aestivum
  Clone ID: PAT_TA_45234
cgtgcgccccaccctcccagtccatcccccgtcgccctcacgctcttcgtgctcgccgccttccttcgcgagcggactcatggcttccatcgccggatctgccgtgttcttcgccaagcccgtcaaggcaatcaacacgaactcgctctctttctctggtccaaggaggggcaatgcatttcttcgcctgcagccagtgccgatgagacttgctgtttgctgctcagcaaagcacgatacagtggataaggtttgtgaaattgttaataatcaggttgctttttctgaaggcactaaagtttgtggtaccaccaagttcttttgaccttggagctaattcactggacacggtcgtaattgttatgggcctttaggaggagttccagatcagtggtgatgagaccaatgcc

SEQ ID NO: 45235 - DNA, 298 bp, Triticum aestivum
  Clone ID: PAT_TA_45235
cgtcctctcaccctttctcaaactatgctccatctcacttactgctcttattatacgcggctcatccttacggtggggtctcaacatatgaagagagcgtccaccataaacctataccaagtccctcaattacatcctcacctcctttctctatttttcatatgcggagaatgacaatatctttctttgcacacagatcctgtcataaacagtaagtgtttgaacctacacatcatatggcccatgcaacatcaaatgaggcacacttatcaaaaactctgaattccctgaattggcc

SEQ ID NO: 45236 - DNA, 271 bp, Triticum aestivum
  Clone ID: PAT_TA_45236
cgtccgtattcttcttttacccctcctgatcttcaaggcggcgtcttcttcttcttgacctttctcgagagggggttcacgctctcggggtgcgcgcctcccacttgctctatctaccctgtcaaaatgtctacctatgatcccaataacattctcataactggtgctgcgggttctattgcatctcatgttgcgaaccctcttattagtagcttttctcactacaacattgtagttctcatacaagaatgactactggtttaaccttatt

SEQ ID NO: 45237 - DNA, 436 bp, Triticum aestivum
  Clone ID: PAT_TA_45237
gcgcacgcgtccgcctgcccttcctaccatctcccatccgatgataagaccgtacccgactccgctgggaaacgggatcctattcactgtgtgccgttctctcttcttcccaatctggagaggcacccgtacgcagtctttaacgccgcctcggtctcgacacgctcgtggaccaccccatccctcccgaatgcacccaagagatgctcctctacttcctctacctccacagcaaccagctcgagctagagcgccccggacccacctccatggaccccttcttttttaccagggacgtctgctctgcctcgtcgatctgctaccatcgggcctcccttaaccaccctgagctcgtcaccggcttaccctcgactacgagaccgatgtcgcttctggtgccctgaccgactacgtttttgatgacccttacttgtta

SEQ ID NO: 45238 - DNA, 367 bp, Triticum aestivum
  Clone ID: PAT_TA_45238
gggaggcacgcgttcgtggacgcgtgggcttacatctgcttccgtcctcttctgttttcttgctcccaaagcgagggggtgcctcctttggggcctgatcgcgatggtcgtcttcgacgtctgcgtctactgcaatatcgacaacctctgggacgccgtcgccaagctcggcgagatcagctagaacgagaaggccggtttcatcagccttgtttcgcgctaccttagcggcgaggcggatcagattgagtggagcaagatccagaccctcaccgatgaggtggtggtgctctacgataccctcgcgcccttttctgaagatctcgacgccttaaaggctttgctcgacaagctcgtggtgcttaag

SEQ ID NO: 45239 - DNA, 277 bp, Triticum aestivum
  Clone ID: PAT_TA_45239
cgtccgcgtacacttagaggaaaagaaggcagaccgtcttatgatgctaatgcatcatccatttccggggtggttcggagcgaatggcagattcatcattaaattgtccttaccaacttactccgatacgcccgttaagagaaatacttaagatgccttgtagactagtatcctactgtaaaccaaaattaacaacattggtgcatttcttgaaagaatagaaacttctgcaaacatgtactattatatactaaaggccacttacaacacaaatgct

SEQ ID NO: 45240 - DNA, 493 bp, Triticum aestivum
  Clone ID: PAT_TA_45240
cctgcagtaccgttccttaattcctctttcgaccgacgcgtccgggataatggaaggcaataaccttcctcctggaaactttatgcaaggagcaacttattgcaggggaggcttgcaccggaatcccatgcaaatgcacggtccaagctactataatccggtctttaaccactctcagatacttggcaaattccccatgcctatgaaccatgttacagcttctgaccacttggctgaatttcaattcataaaacaaaggaaggctgatcaccaccaggttcaccaccaccactattccaagaaggactccatgagcgatgatgatgagcatgggttgaacgaggataccactgatagccacagcggcaagggaaagaagggctcagtatggcatcggatgaagtggactgattcaatggttaagcttttaattactgcagcgtgctacactggtgaggatccaggagctgatttatgatgtgtaatgaggaac

SEQ ID NO: 45241 - DNA, 448 bp, Triticum aestivum
  Clone ID: PAT_TA_45241
gcgcgcgtgcggtacggggagatagttcagaaggtcatcatcaacttcaaattgaacattccgcatcagtagctggaggaacaaggacccaaagtgagttcttcattctgagatgagccagtggctgccgctggcagatgcagtgatggcaatggtggtcgaatgcactcctgaccctgttgtcgctcaaggggccagggttgcaaggcttatgccaaagagggagcttgcaacagaggatgctgctggttgcgctgaggttgtcttggaggcagagagggtgagaaggtgtgtggagacctgtgacgcgggtgcagattcaccggtggtggtgtatgtgtcgaagatgtttgcggagccatgtaagatgttgccaccgaagggggtgcatggcgagttgctgaaccaccaggatgcaagtgaatcagaggagtgttttatggcattt

SEQ ID NO: 45242 - DNA, 452 bp, Triticum aestivum
  Clone ID: PAT_TA_45242
cgtccggacaaatcactcaagtatatggcttctatgacgagtgcttgcgaaaatatgggaatgctagtgtaaggaagtactttacagacctgtttgattatttgcctctcacggctcttatagaaaaccaggtgttctgccttcatggtggtctctctccatcattggatacactagataacatccgtgctcttgatcgcatacaagaggttcctcatgaagggcccatgtgtgatctattgtggtctgatccagacgatcgatgtggatggggaatttcaccaagaggagcgggttatacgtgtgggcaggatatcgcacaacaggtcaaccatacaaatggcctctctcttatatcaagggcccatcaacttgtaatggaaggattcaattggtgccatgataataatgttgtaacggtcttcatggcaccaaactactgttaccgatgt

SEQ ID NO: 45243 - DNA, 458 bp, Triticum aestivum
  Clone ID: PAT_TA_45243
cgtcccctctttccttttaattacatacgacatatctcccgtgctctccaacatcggtgaatagtagggtagggtcgtcttccgcctgcttcgacgcttcattcccacattaggcctccttaccttctgcacatagtcaatatattaggggaggaggaccgataaaacattctgcgtgcgagggaaactgtcaaacctgcgttaacaaacccatttcgtgtttcttgggctgaaccacttgagcgtagaactcactattgcaactgaacgccctgatctacctgctaatgcatcagctgagcaacgtgtggaaacaactgttggctatcttggtggtagctttagatgtggagttcacttgtagaaaattttctgagtaaacttgctgtcattcaaaatatatgggtgaatgtgtatgacgttcaaatgctttagagtccatggccatgtttgtatct

SEQ ID NO: 45244 - DNA, 399 bp, Triticum aestivum
  Clone ID: PAT_TA_45244
agacccaccgcctttcgcgttgttttttttttttaacacaaatcattcatgttgcaacaaaccattgagtaggagccaacgacaggtacatattactgcaatagctctcaggtataccttcaatgacagcaatttaaaacaaggttttgcgagttttactatcaataaactaggaaaatttacaggacctatacaaggttcacaactaccataaatacattcatacttctctagaacataatacatagcagccttggcaatttcaatttttaggcaagggttagttcaggggagggtgaaccgttttcatttgtaagcttgcattataacttacttattactaattttcacatgttataattgtgtgacttggttatatcattacgtttttccaactac

SEQ ID NO: 45245 - DNA, 443 bp, Triticum aestivum
  Clone ID: PAT_TA_45245
cgtccgcccacgcgtacttagactcattgtcggttttctataagaataccgattggttcaaagagaggggtttggtgtacaacaccgtgacttaatactttgtgaccgattaccgtatgcatatcaaggggtggcggtcacgctactgttccatgtacccacacacctttattaacaccgcacccatcaaccttacagaaaggctcttccaggtgcttcgattggccacggacttccttgagatctactttttcaagaacaactccttgttagtcagtacctacctacatccgatgcagtgcatcgtctacatcaacattaccacctaccccgttaccgccatttttctcatattatacaccaaccgtgccggcgctgttcttagtcactgaacacttcattgagcagcgccctaacaccatgttctacgtttacctggatat

SEQ ID NO: 45246 - DNA, 458 bp, Triticum aestivum
  unsure (1)..(458): unsure at all n locations
  Clone ID: PAT_TA_45246
cgtccggaacaaatctacactacagaggtgcgagggtatggcaagcagttatggaagatctgctcgctaaaggaatgaacaaagctgaaaatgctctaatttcgggatgttctgctggtggattaacttcgatactgcactgtgacagatttcatcggcttctgccggcggcggccaatgttaagtgcctttctgatgctggcttcttcatcaatgtgaaggacattgctggagtaaaccatgctgcggcctttttcagtgatgtagttaagactcatggctcggccaagaatttaccatcttcgtgcacttccaagttgcctgcaggcatgtgcctttttcctcagaatgaggtgaaacagattcagacacccctgttcatcctgaatgcagcatacgattcatggcaggtacggaacattntggtgcctggaggttctgatcctcgctggcgaagc

SEQ ID NO: 45247 - DNA, 461 bp, Triticum aestivum
  Clone ID: PAT_TA_45247
cgtccgtttcaccctccacagggaagcgtccgcctccgtctccgtgcccgccacccaccgcgccggcaaggacactgccctggttaccacgggtcagcatcgctctaatgatgctcctgccgccgctcgcccgaatccatgccaggccatggccttcgggggcggatctgccggcaaccaacaggccggtggcattgccattggccacgccgcgtatgcgcaagcccaccaccacattggagctggaccatcaaatgcagatgcagccgcactaggggggcctggacccagcaagaggaggaacaagaagaaggtaacattcgcactgggagcgcctggtgcctccggcgccggttgccccgcccaacccggtgctgctacccacagcagcatcatcggcagcgccggttccacgcccaacaagccggccaagaacaagaaagctgtcaacgggcagcagc

SEQ ID NO: 45248 - DNA, 417 bp, Triticum aestivum
  Clone ID: PAT_TA_45248
tgcttctgccttactctcttttccaccctcctcattgggttgagcaggcattggacgggggagctgctggccgcggcaatcctgagcgtgaagagggcgggggtgatggcgtccctggtagctgatgctgttcctgctcaccggagggtactacgtgcagcacatacccaagttcatacggtggctgaggtacggctccttcatgcactacggcttcaacctgctgctcaaggcgcagtaccacgggcacgtcacctacaactgcgggagccggaccgggtgccagcggctgcagtcggggacgtcctttgacaccggggacctcgacggcggcatgcgcgaggtctgtatcctgctcgacatggccgtcgagtaccggcttctcgcctacttgtggctcctgaagaggatcaccct

SEQ ID NO: 45249 - DNA, 246 bp, Triticum aestivum
  Clone ID: PAT_TA_45249
cgtccgtccactcgtgctgtaacacgttctcttatactgtgaagatatttcgaattacattcccagcgggtagggtaatctggggaatggggttcatatttgctttaatactcttagcaccatcatatgcattccatcatgaaatctgttctgataacttgtcagatttacagacacttcacatctctggctatactcacctgatatcactaggtggaccaaagtctattaatcattttgaaattg

SEQ ID NO: 45250 - DNA, 453 bp, Triticum aestivum
  Clone ID: PAT_TA_45250
cgtccgcgcctcagccgtcccgcgacctccccgaggacaggggggaggccaatgtgctcatcgaggaggcccgggggtcgccgccggccaaggaggcggaggcgggcggcgccgtgggctgggtgctgtccccggtagcgtggttccggatgctggtcagggagctgcactggagcttcgtgctcggcgtggtggccacctacggcatcagccaggggctcgggggcggcatctcgcgcgtcgcctccgactactactggaaggacgtgcagaaggtgcagccgtcggcggcgcaggtgtaccacggcgtcacgtccatcccgtggctggtcaagccggtctggggcctgctcaccgacgtgctccccgtcgccggctaccggcgccggccctacttcgtccttgcaggcataatgggagtgattgctatgcttatagtctctctccacagca

SEQ ID NO: 45251 - DNA, 438 bp, Triticum aestivum
  Clone ID: PAT_TA_45251
cgtccgcccaatcacacggaaaatcacagtgaatggacacactagagagcacactagaaagacaaggaggctcgcaagaacacgcaagagatgacggaactcatggtctggctcgtggttgcgtgcgtcgttgtcggcggccttgtggccggggccgcgtccgcgtcgtcgtcgtcgttcaccggggtgttcaacgagaggggctaccagagggcctggcccgagtaggagacctacaaggacacctacaacaacaaccgcatcaacaaccgcgaccacgtccattacatgcaccataagaactactagaagaacgacgtgacgctcgaggactacaaccactactacaagcacagggcggcgctcaggccttgaggtccacctggagaggttccaggtcagagctgagggtctaacgtaacgtcatcatctacttta

SEQ ID NO: 45252 - DNA, 457 bp, Triticum aestivum
  Clone ID: PAT_TA_45252
cgtccgcccacgcgtccgccgaccccctccttgcggccatcttcgccggggcgctacccctacccgaagtgcgccaccccgcgggcttgcaccggcgacgacacacgacgccgtgctgttgccggctccccctcccctgctaccacggtgctgccgggactcctccccgttgttttgacctcggcgttggttcccccaaacccgtcgggttctctcaccggccacaactttctggcgcacttcaccaaccgacagaccaggtcgccgcgcctcccatggctaacaatcggtggtaccccagtgtatgtttcccacccgaggggcttatgtcgtgtatctgcgcgccactacccgacctttcctttttgagcctcattgctttcctcctgtttcactgcctggcatgtgccacgtccaatcttgactaacaggacaaccatttccagccatatgcgcc

SEQ ID NO: 45253 - DNA, 166 bp, Triticum aestivum
  unsure (1)..(166): unsure at all n locations
  Clone ID: PAT_TA_45253
cgtccgcggagccgtcggcgggtctgggtcaggtccggcctcgttcgtcccgcggaggcggcggcagggcgcgcgcgcgcggttggagcgtaatctttgtttcctgaagctgtantacggctgtgtcatggcggtgtcttgttgcgcctcggggttctttcccacg

SEQ ID NO: 45254 - DNA, 409 bp, Triticum aestivum
  Clone ID: PAT_TA_45254
ttttatctaagtaatgatgaatggattagaaaaaactgcaaacagattcaactcagcatcaggttggactttgcattcgtcaaacctgcaacgagcacgatacgcctctgtaaattattggaaaactagaatcaactaaagtatgcttcaaacgaggaggtaaaagttgtaaggaagtttgggctgagaaggtcaggtagacagcaccgattccaattatatcccttccaagatggtttctgcaagagctgagaatgacaaactaaggcagagaaacttgtctggtgtgttctaattatattattgatgagtaagaaaatgttgggccacagaagaaccgtcgtgccgagggaaaactgggccacccgctaagccgtgtgattccaacatctgaagtaccagcaacaaa

SEQ ID NO: 45255 - DNA, 421 bp, Triticum aestivum
  Clone ID: PAT_TA_45255
cgtccgcggacgcgtgggtagaaggcggcatcgtcagcccacgtcgcgacgctagccgccgggctggggttcatccgttccgtgctcgccactgtcgccgcgcaacatggcaaggccaaggccttctgcatcagccaggtcgccatcgccagtcaggcctgctccatcctgccgcccagccccccggaggacgaccatcaccaccaccacgacgatgatgatgacgacgacgacgacgatgatgatgactacgactactactagcaccatggcggtgacggtgaccgccgcctccgtggacgccatggtcacgcggcggacatcaacatctctgtcccttaggctgaaggcggcaaacaatgacagcatcggcgttcacgttgcaagaaacggcaccggtcaccatggtggctactacacc

SEQ ID NO: 45256 - DNA, 441 bp, Triticum aestivum
  Clone ID: PAT_TA_45256
cgttcggcgacttctgcttcttcctgtcccatgaagcgttcttcaagctgcccccaattgcccactgtgttctgacctccgtctcacgaccgaggtgagatggagaggtggatgggttcccttggcatcagcttgatgttttccctttgtttctgacgacaggtgagacctgaaactttgtgtatgcagtccaatgttatgcatgcttattgatccttcttgttaatggaattgtggcacgggtgtggctgggagaaaatgttgagcaggaagggaagcagttggatcaccacatatgccgaggagaagcccacaaatgaatcttgggttccattttgaagttatagttggtgtactgaaagaaaaggaactcttttctctgcgaaaattcaatggaaatacacttgccaggagagggctcggttgttttgacgccttaag

SEQ ID NO: 45257 - DNA, 282 bp, Triticum aestivum
  Clone ID: PAT_TA_45257
cgtccgcccactcgtccgaggaagtaatatcatgagtccataggcatgaaggccaacaagaagcaggcgggggattcctgaattcttttgcatgcatgtcgtttcttgtgaatatgcatccaaagatacagattataggcgaggaaactggaccgcgcttatagtcaacttgaccatgttcgatctgcatatcaagtgcgaggacaaggagtcctaccacaaccactacaagatcattcattacaaaactgtgaaggacgaccacatcatggagggggagga

SEQ ID NO: 45258 - DNA, 462 bp, Triticum aestivum
  Clone ID: PAT_TA_45258
cgtccgctcttcgccgccgctgccacctacctcaagccgatcccgccacccacgcccacgcgccaccacccggaggagcagaccccacgccgctctttctctgcccgccgacccaccccgtcccggaggcctcgctcaccgccttccaccgcggggccgccgcgctcgtccaccttccacccccttcctcccgttcgcgatccaaccggaggaaacacgcaaccgcgatcgcagagcatcgcatggcgtccccgacgcggccagcctccgtctgtggcccctttggctccgccccgacctcgccatcttctccgctccgaccacgacgccgcggccggatccagcccgtgcgggcgcgacggcggctggatccacgatggcgacaacacgcagcggtccccgtcggccagatcaggtggggagaggaaagacaaggaggaggaggaggaggagcacgaggag

SEQ ID NO: 45259 - DNA, 270 bp, Triticum aestivum
  Clone ID: PAT_TA_45259
cgtccgcggacgcgtgggaaggcattggtgtccgttggtcgtcgccgcgacatgatcgcgggtcctgcggtcatgatgagctagctatccttgctgcatatgccgctgccgctgccgctgcacaattttgatctgtatggtgtaaaagcatttttataaccaacatgtacattagagagacagaggaggggtggaggactggagagggaggaaggtacttttgagtgagtgagacattcatttatagttggattggttggtgagacacat

SEQ ID NO: 45260 - DNA, 439 bp, Triticum aestivum
  Clone ID: PAT_TA_45260
cgttcgctcgctcgtccgaccgcgccgtcgtcttcttcttcatccgcaggagctctctacttgcaggcgcgatggtgtacatcaagaaccagatgacaagggcgtactccaagcgtttccaagtcaagttcaagagaaggcgccaggggaagaccgactacagggccaggctgaggctcacaaaccaggacaagaacaaatacaatacccctaagtaccgttttgttgtgcgatttaccaacaaggatgtcactgcacaaattgtgtatgctaccattgctggtgatatcgtgatgggcgctgcttactcccatgagttgccttgctatggtcttgaagttggccttaccaactatgctgccacctactgcactggtctgcttttggcccggcgtgtgctcaaaaaccggtgtctttgttaggagtattaaagcattgt

SEQ ID NO: 45261 - DNA, 259 bp, Triticum aestivum
  Clone ID: PAT_TA_45261
cgtccgtatccacacaaccagacagagaaagttcttctgttttttctcagcgagtgcacgcgcaggaagagcatgccggcggctgtccgctggctcggcagatgctgtcccctcgacctcgtgagcttgcgttgaagaaatcattctctccgtcggtgacttggactcctacatgacccttcgttccgctgcgttgcatctgttgtgcaatcaccgatgatgtgagctgcctaagtccgtcgcttctagccctattgat

SEQ ID NO: 45262 - DNA, 133 bp, Triticum aestivum
  Clone ID: PAT_TA_45262
tccgtttcgtcccattccttcgtacttgctgtcagccttatctccctgtcgccttcgtccccgacgcgctcctgtcgttcacgcgccggagtgatggtcgttcgacctgagatcgctcgacttctatcaactc

SEQ ID NO: 45263 - DNA, 165 bp, Triticum aestivum
  Clone ID: PAT_TA_45263
tctccatttcctcctttgcttactagctatccagccattattatataatgtgctgagacgggctcttccacccagccctgtattccaagtccttcttcttatatctcctgtccactcaccctctcatccccagcatgagcagcggatgtagctcttctccagcgt

SEQ ID NO: 45264 - DNA, 363 bp, Triticum aestivum
  Clone ID: PAT_TA_45264
tcccctccggggaaacttgatgaattatcaatctcacaagtcaataacactgtgcaacggcagagtggaggggatgagaatttttcatcgctgctctatgaaactttaagaatccttaggtctcacatagcggatggtactgcatgatgtggcgcacaccacatatttacaaatgatacactgaaggaaattacactcggataccatggacaaaagaagaacttttggagataaatggctttggcttggtgaagcttaacaagtacggggatcgggtacttgcaaccatagaggagtctctcatccaattcccaaactgaagcatgagaagcatcatcagcggctgcagtaacgatcaaaatg

SEQ ID NO: 45265 - DNA, 178 bp, Triticum aestivum
  Clone ID: PAT_TA_45265
ttcctgtacgcgtcttttttattctgccttcacggtcttacatgcctccaggcaccgtgttgtgaagcgggggatattatgtgagcgggggggcggtctcttccactgcatatcctgaggcgcgccgcattggcggaaagaaacccgtcctctgcccagctaccttcagccgtggcgc

SEQ ID NO: 45266 - DNA, 350 bp, Triticum aestivum
  unsure (1)..(350): unsure at all n locations
  Clone ID: PAT_TA_45266
tcctcacctacccctccttaattcccgggtggacgcctncntnctgctctatctttattattacccctaccggctcgtccatcactctggagtttctgagctgggaggccatctattacgggggggcgggcatccatcacattgatttcattccttcggaccatcatcgccttatctctggtaggcatgcagctggaggatggcctcaccctcgcggtctataacatccataaagagttcaccctccatctggtgctccttctcctgtgtagtaattaatttgccttggcttcaacctgctggtttatcctgagtccactggtcggtggtaccttgccgttcatttgaac

SEQ ID NO: 45267 - DNA, 343 bp, Triticum aestivum
  Clone ID: PAT_TA_45267
tccttcttaaaacctcagccacatcatcggaagctctctcctcaaccccgcgggctctcttcggggggccgtcagtcctaccacggtgctggccacgccagcatgattaactccgtcatcgaccattcgtgtcatggccgccgcctccgcctagccggccggcaaggccaatccttctgcatcatcctcgtagtcttcacccaataagatccttaatatgaatcccctctactccatgaagaatggacagatcgtgcgagtctataaatatatataccttatcagcatcaattacctgtcacgtgtgcaccctccctatctcattgggctatacctacatata

SEQ ID NO: 45268 - DNA, 281 bp, Triticum aestivum
  Clone ID: PAT_TA_45268
gggagccactcgtcctgtcttgagatctactcaccattcgcactcatttactacaccttcataaagtacttgttgagggaccccaccttgtggtgcagggagtcgcctacccaattgatcgacctcttgctctaatacaatgtactgtgatgaaagtcattccgatgcctctatagttccaacaattataacctgttcataagagcttatgttcttacttaggaagagatgtttatttcctctaatctgttgagtaggactaaatcaattacatccatatt

SEQ ID NO: 45269 - DNA, 388 bp, Triticum aestivum
  unsure (1)..(388): unsure at all n locations
  Clone ID: PAT_TA_45269
cttcctatcctctatctattcttaaccctccctccttccgtctcatctccagatttccttccccatgggggcnatctatatcgggatggagggtttctacctaatccgcaagcttgtagccagtgtttcactccatatcccctatgtcaagctcgtcaccattaactaccccttcatcaccaccgactacatgacctacattttcaagtattacactgtccaccgacattgtaagcaccatgaagttatagtgaaggactccaaaacccttctcttctatgaaaaagatgttgcggtgttttgctgcaagaacccatatgaattcccattgtcttttgctggttctaaaatacattttttaaatccaccccgtttttttcacttgaca

SEQ ID NO: 45270 - DNA, 340 bp, Triticum aestivum
  Clone ID: PAT_TA_45270
ctaaacacatcctcctaccttaattcacaaacctcactacaaataactcttttcctgcatttacttcgatgtacatacttcaatcatacatatatcacttcatgctcttttacaagaaacttttttatcacatgaactatcatgttctaataattattctaaccaacgttttaaatcatattaacatgtcaaccatccttaaactcatcctcatccctatttaacaatatctacattttaattatataaaacataatgacatcctattttttttacattatcatattcatgactcatacattgcttttatctacaataggatcactttttatcctatttc

SEQ ID NO: 45271 - DNA, 417 bp, Triticum aestivum
  unsure (1)..(417): unsure at all n locations
  Clone ID: PAT_TA_45271
gccacncttcctcnnactcttttttttacctttatcatcccattttcaagaccttcctactttctatagggcgctgtctattatgaggcgaggaggtcaatattccattgcattaaatatcatacaacgattcacatgaaataaacatatcttatacatctttaagccatgttatcacaatcttcacatactttttaaccaacttatattttatttagttaaatgctagaacagggaaactgtcatatacttttaactccatagatcattctatatttcacattcctttctatatttctttattcaaataaatctattctatatttcttatgacatacaatatcctattacccaatttctcttatataaaacattttcaagactacttccaattaataatttatttgtatttattct

SEQ ID NO: 45272 - DNA, 194 bp, Triticum aestivum
  unsure (1)..(194): unsure at all n locations
  Clone ID: PAT_TA_45272
tctttcncttactcttgggttctactacatctgcgctgtggttctcattcggcatcctactgacgcgggacacttatcagttggtggggtctccatcaatactaactctccaacggctttcaaccggaacgagcgctcctccagtactctacggcttctcacccctcgtcaatccggcatcaaatctgcccctg

SEQ ID NO: 45273 - DNA, 315 bp, Triticum aestivum
  unsure (1)..(315): unsure at all n locations
  Clone ID: PAT_TA_45273
tgggacgccacncgtcctcttactcttttattgacccttattacttttactttgcgccagtttctgaccattagcggggcatcactacataggaggtggggcttttcaatatccacatgtcctcccatatatagcggttggcgcatcttgtgaaagttatacatatagtcataactacttccatatcttacttcattctttgtaattcaagaaatagcttaaatttttatcacccttttttagttttcctgacttgtttatatttatcatcatactgtatttgtattacatatctttcaatttttttctttttta

SEQ ID NO: 45274 - DNA, 348 bp, Triticum aestivum
  unsure (1)..(348): unsure at all n locations
  Clone ID: PAT_TA_45274
ctcgtccttgggtaaaggcttccacgagctctcgtctctactgccgccacctgccgggcganatngctatccggcggggctcctccttctccttcctctccctgctcgcgctcgcctccgtctccgtcgtcaacgccaacttcttcttccatgataattgcgaacatggctgggaaagccggttggtcaagtctatatggaagaaagactagaacatggccgtgtaattgaaccacacatctggaaaatggcacggtgatgcttaggtcaaaggtatccaaacctcattagactacagggtctactccatctccgcggagtaccctttatttcatctaccaatagaca

SEQ ID NO: 45275 - DNA, 402 bp, Triticum aestivum
  Clone ID: PAT_TA_45275
tcgtctctttattcatttatgcacctcctcctgcctttctccaatctccaccatctcaccatcgggggcgccatctccgtcggaggcctcgaatgatgatccccctatcctttatcacaggccaccaaataagcagttccccctttggtatcttcagcccccatatccaagcatcatcagcatctcctttcctagcatctaccggttttctaatcattcaagctgttccactccgatcctgagacagcaatcctttccgtattacaatcagatacatgccctctttcatattcattctcctgtgttccattggtggctggcatcctagtatctatttttaaattcttcctggctgtttccacatttcctctcaattttatgtatagactacctacatttttt

SEQ ID NO: 45276 - DNA, 329 bp, Triticum aestivum
  Clone ID: PAT_TA_45276
tcccactaaccctctcgactagtaccatctctggttcaaggacatgattcacatctgcgggatcaattattatggaggggtgccctccttctccctcttcaacaatgttacaggctatgccatcaagcactcccaatgcgttggctaccctgtgaatctggtgccatacaacgccaactaccatgacgattcatttttgtggacttagagcctctacgtgggcgcctgcttccggttcatcctcatggtgaacaacatctaccttaactttgactcttttcacggcgacatagagcactgtgggtttctcgactgcaccttcctctttc

SEQ ID NO: 45277 - DNA, 287 bp, Triticum aestivum
  Clone ID: PAT_TA_45277
ccactccttctcccactcttcctattactctttaacaatcttagaccatcattatagtggggtttaaaatctgtgggggaggacctcactttgacaaaacatcttattagcgatttacattcaactcatgggatcaacaatttcattccactacttttagaacattttattaacataatgtttcacttttactttttctagaatttctatttttttttctcaattttttatatctacctaaaatctatgcttcatctgatgctcttactcttcatatttatttgtta

SEQ ID NO: 45278 - DNA, 397 bp, Triticum aestivum
  Clone ID: PAT_TA_45278
cgtccgccgggccaagcgggccgggggcatctcgtcgctcgtctcccccagccccgtcacgcccggggggctccccaccccgcgcatgtccccctcccgcgagggcctctccgacatggcgcatcagcaatggggcgtcgacggatacggctccatgaagggcctcatccgcctccgcgcctcctccccccgccaccccggggacgccgaaggcgacgacgatgactccagcagcggcagcgacgtcgaggagcacgttgaggtcgagcgccgcctcgaccacgacctcagccgcttcgagatggtctaccccggcgggatggccaacggcggcgcctacgtcttcgaggacgaccagtacgtgcacgtggccaggctcgaggaggagaacctcacc

SEQ ID NO: 45279 - DNA, 422 bp, Triticum aestivum
  Clone ID: PAT_TA_45279
cgtcctatctcatttcccatcttattcccacacacacaccataacacctttcccatcccaattggggggggtcgcatccatgggcggggtgcgcatcccataagaatcccttgaagaatacccttgctgacaccaatcccatcgcgaataacaatgggccgacttccaaggctggctgctacaagaagggcaacaagaagggcaaaatgagcgtggaaacctacaagatctacatcttgatcgtcctgttgcagggtctcccagacatcggcatcttcttcaaggccatgtccatcatgatctccttcatcaaccacttcttcaacaacctggccggtaattcctccattcgtggccctctacatctatatttccaccatcacgtcccgggagatccatatctccttccagctcttcctccc

SEQ ID NO: 45280 - DNA, 312 bp, Triticum aestivum
  Clone ID: PAT_TA_45280
acctctccatctcttccaatttacttttactaattctcgcgaggcaaaccaaagtcgggggtagtggctcaaactaatcacactgctctcaattccactatactaaagtctccaaggaatcaattattcaccaaatctcacctaaaatctaatcctaccactttattagtaaataatcctcacctctaccctccttaaactattgttcttccagatatcctcaaattccaaactatcactcatcttctcataatgaaccttcctttacaaaaactttttatgtagatcccccattacttcaatacttaccta

SEQ ID NO: 45281 - DNA, 234 bp, Triticum aestivum
  unsure (1)..(234): unsure at all n locations
  Clone ID: PAT_TA_45281
gcctgcagtnaccttccntaattcccgtggggagccacgcttccgtcctccttctccttcataatatatccttccatcctgccaagcctatatcagagcatagggggggaatgagactgggggggggagccctctccatgatgttctccatccaggtcgactccttctcgccgtcacagttcaccccgtcgcataacgccgccttctactcctcccccaacattttccggggcg

SEQ ID NO: 45282 - DNA, 305 bp, Triticum aestivum
  unsure (1)..(305): unsure at all n locations
  Clone ID: PAT_TA_45282
cgttcnactacttactccatcgtgatgatgatcaagatgattgacaaggaataaatgttccacgaagattgctatctaattgaggagggtctggtaatattttccctacaataacctacaataaaaacacattgtttactcataatcaaaataataatcatataaccattaatctaaataatatcattgttttattcagcattcttttttttagcaaatggttctaaacttatctcatgtataatatgcaatcacaatatggacccattgccttaattctcatatacatttatctatcctgatct

SEQ ID NO: 45283 - DNA, 368 bp, Triticum aestivum
  unsure (1)..(368): unsure at all n locations
  Clone ID: PAT_TA_45283
ggggcgccacgcgtccnccacacaccacgcctgcctcatctctcggagcaagaggaggaggagcttgcaggaacagtgacggcccagggtctgtggggtctgggaggcatctgctggggaggcctctgcagtcttccatctccaggtcgtcttcctcccggaagtcccccttcgtcgtcagggcatcttccagcccccctgccaagcaaaatgacaacaggcagctgtggtttgcgtccaagcagtccctcacctacctagacggcacgctgcccggtgactttggcttcaaccccttggggctggccgacccatagggcaccggcggggtcatcgagcccagggggcttgcctacggggagatcttc

SEQ ID NO: 45284 - DNA, 189 bp, Triticum aestivum
  unsure (1)..(189): unsure at all n locations
  Clone ID: PAT_TA_45284
cttcttgggaaaatccntgctnctgggggggatcatgcgtggggggagatggaaaacctaaaagccttttggaaagattctggttctgcagaagccaattatctagcacactgggatcttaacttccggggggaaacgactgggggaatctaaatatgacatccactgaggaaggggtgcgcccttact

SEQ ID NO: 45285 - DNA, 243 bp, Triticum aestivum
  Clone ID: PAT_TA_45285
ctcttatccctctggagccacgcgtttctccacgcgtctctgcctatccttttcatcttatcccaatctgaccattctcaaaaccctaacgggggactctccttctaggacgggggagagtcacgtcgtgctgatgccttatatggccgctctgtccttatcatttttaaagctattgcggtggtgggggttttctgttaccctccagcggtctctcttttacctgccctttcccgttggtat

SEQ ID NO: 45286 - DNA, 320 bp, Triticum aestivum
  unsure (1)..(320): unsure at all n locations
  Clone ID: PAT_TA_45286
tcgtcctaccatacaattattttgcttccctcntttgacttcttcacggtttcgcctccatctatgggtactctaatcttctaggggggggcctctaacaaaaataattacctatttggatggaaccgaggatgatttcccatggtgagttgtaaactgtgcttataactgcctatttccaaaagtgaacacaaagtgtgacttttatttacatccacaccaacactcacctgcaccaaacatatcgcaaggcaaacttaactctccacggatactgcgttttctcaattttctaactatttatagataaactttttctt

SEQ ID NO: 45287 - DNA, 298 bp, Triticum aestivum
  unsure (1)..(298): unsure at all n locations
  Clone ID: PAT_TA_45287
aagagaatcatctatctagacacccaaatatacgaagctgggccaaatgtgatcagcagtttatcataatccaggagagtaccagatgaagggtggatgtacaatgatataccataagaccctctaggaataggtatgatatacaatgagatttagtaattaacatcttgacatgactgattgtcaagtttatgctgagaactgagaagtcacttatccgannngctgctgtcaggtcataatattattaaatcatttgaaagttcaacatctaatttttttntattcaacaaaaatt

SEQ ID NO: 45288 - DNA, 448 bp, Triticum aestivum
  Clone ID: PAT_TA_45288
cgcgtcctcttctgtttgtacataattaaccttgtgagctaacatttcaaatctttttacattatacgtggggtacaaaataattgagaggggggtcatccattaaaaggtctcatttataatataaaaaccatctgatgcaccatatatgtttctctatatcgcagcaagcatcccatttatttctgttataactgtatcataaatatagacttttattggatgttatcttaaagtgaatacatttgaatcaacatacatggcatcaatcttctctagataaataaaaagtgtgaccggtacaccattaagacaggaactcacacctatggaattctacataatcaaccctcccagaaggtactcacttaatgttgtctgattgctctacggagacaggttttgccctctagatgaagacaattcctaaggtctacttaccaatttt

SEQ ID NO: 45289 - DNA, 337 bp, Triticum aestivum
  Clone ID: PAT_TA_45289
gccactcgtcctcccactcttcctcccactcatcctcccactcgttcttccactcattcatccactcatgcggtgccccctttcttgggagagactcaaactataatcttcatacatatccttctaagcaaactttattttaaatctgagccctatcctaatatctttgacaactctaaaaatctattccgcactatacttttctaggatcctactaaaccactcttctcttattagatactttgtcacccaataattctatattatactatagcacctaataaacctatttattcttgttttttagcaatactaaaacatttttcttcatataaca

SEQ ID NO: 45290 - DNA, 491 bp, Triticum aestivum
  unsure (1)..(491): unsure at all n locations
  Clone ID: PAT_TA_45290
ggaggcactcnatccttttaatcatcatcttcatcatcctctcctcctccagatccccaacccaaaccctcggggggtgaatccagagagggggtaggcgccgactacatccaatatttttctctgctctatacccctttatcctatcaatgaggctttttacaatgagcttcactttcacctcatcatcatggcgggctgcatcttcttcatcctctccgccccctacatcctccactacctcaccctctagccctgcatgactgagctcaatctctatctctaaggcggcccctctgccccccctcccccttaagtgcgacttggatttttaatttactctcatgatcaagcttttaaataccttttaaaacattaaattagttttcctttattatttcatctttctatagctttataattcaatgacaatgtcttcataaactcttttggtatttattaccactggccttgcaattttgtggatttta

SEQ ID NO: 45291 - DNA, 408 bp, Triticum aestivum
  Clone ID: PAT_TA_45291
acacttgattctatcgtttccttaataatggccaatacacccaggggtgtatctccaacacgggggtctacctaactgcctttctcaattacctctccgtctatctattatagctatcacacatcttcttcaatgacaacattaatatcctacatctattctctccacctactattatacataattaactactattatctctgcaatcttctcatcagcattaccatcactcacatggtttttatccccaacatctaccacatttcttcttcccaagaatacctcctataaatccccttaagagtccaattcatccaagaaaaactgcatgtaccccaaaaaagcttaatatcattacttaactaatctttattaacctttcatttatatatattgtttaattaatta

SEQ ID NO: 45292 - DNA, 496 bp, Triticum aestivum
  Clone ID: PAT_TA_45292
tttcgcgcacgcgtccgctttgatgcatcgtgaatcttcatcgtctcgactttgtacacaagtgggaaagatctagggtgggcgtatacagtaactggggtgatggtgctgtagttttgttttactatagttacgtgcaaggcttggtaggacgcataggcaggtagtaatatcttgaattggctttatcagaacctgctggtacacaaaatgaagtgaataagtatgttaggtcttccattattaaggtggaggacataacttagttttgataatcattttggttgcaatcaataatcagtggtgaatttttacaatgttgcattcctggtgcacttacgggtttctttgagtatctacattttgatcaatccatatttcattaggaaacgagggacctcttcttttttttgtgtctataaagatttctatggtaatggggctttagtttgccccttacatttgacattttgtatccctaactgattaaaactgt

SEQ ID NO: 45293 - DNA, 202 bp, Triticum aestivum
  unsure (1)..(202): unsure at all n locations
  Clone ID: PAT_TA_45293
tcttcctccctcctttactataaatctgtcaccatctctcacatccaatccgtccctacccttagagagtcnacattcttggagatagagcatcttcatccatcattttctaatcttgatatccatatctctgttaccattaactttaaatggaagcagctcgaggaccattttcgtttcctttatcattctctcaataaaa

SEQ ID NO: 45294 - DNA, 227 bp, Triticum aestivum
  unsure (1)..(227): unsure at all n locations
  Clone ID: PAT_TA_45294
gcctcgtaccgtccnaattcccgggggacgcacgcgtccggcggcgaggagcggcggggcctactaatactagcttctgttcccggggttcccgggcggcagtccgcgcaaccctgggttggggggggtgccctgaagcagggtatcttctccgccagcgtctcgctttaaggcgtccacgccgcgcgtcgtcggcggcttgtcctactttttgatcctgctttctg

SEQ ID NO: 45295 - DNA, 271 bp, Triticum aestivum
  unsure (1)..(271): unsure at all n locations
  Clone ID: PAT_TA_45295
ctttcttcatcatctttcccaatccctttacaccgtttgacacatacacatggcggcgcccatnaaataggaccgggtggatgctccttcttcttctccctcagacttctcctgatgaggctcggaatactggtataagccctacgctccgcccatggaatcggactcaaactcttcggacttcgactacgaatgggactccgtcgactatctccgaattcatgccctggaacgcgccctttctgatcaggctgtcaactacgaatcccac

SEQ ID NO: 45296 - DNA, 282 bp, Triticum aestivum
  Clone ID: PAT_TA_45296
gcccccctccgcaagaagcggtgcatgcggtatcccggcctctgtatcaaacaagaatccatccacctggggggctcatcaagatctgggggcggggcggctctttgttgaggtgagtctaccggccattgctttcatggcctgtctcccgtcccacatggccttcccgtcgcctttcgtcgcgcataggagggcctgcaatggggcaccgccggtgggggccatggcctccaccatgaacaatgttaaaacttgccaaaagccctattctcccccacgtga

SEQ ID NO: 45297 - DNA, 214 bp, Triticum aestivum
  Clone ID: PAT_TA_45297
cgttcgcggacgcgtgggccgaaatatagcatgcagagcgattcttatcatggaagataaattggggggggaccgcacattattaatgtgcacgggtacaactgcggtttgcggattgctggcgtccgcgatggtggccgcctctttctgattccccaaaccgtttgcccctttccctgtatcgaatctcaccttccgaaccaactcgtgctcg

SEQ ID NO: 45298 - DNA, 213 bp, Triticum aestivum
  Clone ID: PAT_TA_45298
cgtccgggcaacacaaccaaacaatgctccgggattatttgggcaagggaatgcaccattggtttctggaatgcagcatggatcaatgtataattctggatcctacaaagcacgccaacaagctaagtaatatggaggcattactcctaattggggttctgctggtcgtagatttaataatttcgactacaactccagtcaacaaagggggag

SEQ ID NO: 45299 - DNA, 371 bp, Triticum aestivum
  Clone ID: PAT_TA_45299
cgtccgcggacgcgtgggtccggcgcgccgctcccgttcccggacgcgctgctcatcaacggcatgccctccgccaccttggtgggcgaccaagggaggacgtatctgttgagagtgtccaatgtcgggatgaagacgtcgataaacttccggatccagggccatgctctgaagctggcggaggtggaaggtacgcacccggtgcagaacgtctacgactccctggacgtgcacgtcggtcagtccgtggcgttcctcgtcaccctcgaccagccgcccatggactacgccgtggtggcgtcgacgcggttcaacccggccgacaccagcccggtaacggcggtcggtacgctgcattacagcagcgccac

SEQ ID NO: 45300 - DNA, 245 bp, Triticum aestivum
  Clone ID: PAT_TA_45300
cgtccgggacgccaagttcttccccctcaacggcgacttcttcaagtctcccagagtgaccatgggccgcgcgggctgctccaagcgatgggtgctcgccaagcagcccaacctgtcttacaccttggggagccccaccgagagcggggtcgtgttcacctccgctggcccgatctttgagaccccgaaagcgacggtccgggtggcgcgcatcgagtttgacccgagcgagctcaccgactacc

SEQ ID NO: 45301 - DNA, 308 bp, Triticum aestivum
  Clone ID: PAT_TA_45301
cgtccgcggacgcgtgggctttattgatttcggaggactccttgctgggcttgctcaagttcgaaggctcgttctaaataaatgctacccacccgtcacaaaaggtcatatcctggaaacactttcttgcacctttgacaacctaaaaaagttaacccttttgacctcacttttaagaaacccccaccattttgtcaaccctttgtttacttaagaatgcttcttaccctggaaaacctgatataatgatccaaggtttttttgaccaagaaaaaacaaattgggagtttcagaatgcacaatggact

SEQ ID NO: 45302 - DNA, 330 bp, Triticum aestivum
  Clone ID: PAT_TA_45302
cgtccgcccagatcagctcatgaagtgatagcacatttggtcagtcgtctttcacgatgggatgacagattattccgtaaatatgtctttggggaagcagatgaaattgaattgaagtttgggaataggagaaatagtgaagatctgaacctagtcagcatcatattgaatcaagaaatcaggaggttagcaacacaggtgatcagggttaaatggtcactgcatgcaagggaagagatcatacttgagcttcttcgacatttaaagggaagtgccacaagaatcattttagagagagaggaggaagtctgcaagggagatgttggagga

SEQ ID NO: 45303 - DNA, 128 bp, Triticum aestivum
  unsure (1)..(128): unsure at all n locations
  Clone ID: PAT_TA_45303
cgtccggttctctcgtgtttgcctgtctcgccccacctgatagcgttttgctctttgttgctgacatatatgtatgttacaccattttcatattctagttggntctnataagtcataattgaaggacc

SEQ ID NO: 45304 - DNA, 132 bp, Triticum aestivum
  Clone ID: PAT_TA_45304
gacaaacatccctgcgaatctgagatgcaggaagggtcccctcaggggccgggggtcaatggcttccgctactgcttacatctcgtcgcactccatagacctgcgcgaacttaaagccgggaggattggagc

SEQ ID NO: 45305 - DNA, 363 bp, Triticum aestivum
  Clone ID: PAT_TA_45305
ccaggcggacccacgcacccgctcgtatttgataagtttatttacttggagttgcagccatatgcatcgagcaagactgagatccccatacgccagcattagccttctagcgtatcgaaaggtaccgaccgagggaaccgatggccacaggattgaccgcgtccgccagcttcttatccgtacgccccttcacggtccggccacgcaccgacttcggcggggccaggcgggtttccgcggtgacaccccaaggaggcaagtggtgggcgccgctcgtcagctggttcgggaaggccgactacatcgaggccgcgccgccggtggtggccgaggaagagaaaccccagaggtccttcgtgggcg

SEQ ID NO: 45306 - DNA, 380 bp, Triticum aestivum
  Clone ID: PAT_TA_45306
cgtccgcccacgcgtccggtacacacaccctaccttgcctaatcccttcccccctcttgctcttaagtggtagaaatccgtccaccttgcgactccaatcattgagtttgagaacgtgtctatgccaccatacgacgtggcaacgccgccccacttcgaagtggtgcccgttgttcaaacatcgtctgaggtaatcgcgcacaaagatgcggcgctcaaacactaggtccgtgacaagtgtgttgtcgactctactttcatgtgactctggaacacgccaacacccgccttcccttcaaggaggcgccacacttcgttgatatgccggggaaggccaagaacgcgaaagtggtcctttttgatctctcgaagggggtacc

SEQ ID NO: 45307 - DNA, 272 bp, Triticum aestivum
  Clone ID: PAT_TA_45307
gcgccacgcgtgcgtgttgttaacctcgcaacgcaacataggaggatccccgcgcccgattccccagcgcctgaagcatagaagatgttctctgaggcgctgatcactactccaatggctggaccgccgcctattgcgagcgggagtatgattccgtgcgcgacacaacgttttgcttctgttgctagaacatggggagagcgcctttcacttggtgtctgccgactgccgacgcggtactatgcccgctggtagagtcgtccttcacccta

SEQ ID NO: 45308 - DNA, 181 bp, Triticum aestivum
  Clone ID: PAT_TA_45308
cgcgtccgcattgaccgctatatcattgccacggctccttgctgctatgtaactctttatacggtggataacgggagcggacttaacatatgaaactgcgccacagatcacaccttcgcatatcccaaagtatatgtatagcgcgctcttagaaaccagtggaaccagagcccatttttgt

SEQ ID NO: 45309 - DNA, 154 bp, Triticum aestivum
  unsure (1)..(154): unsure at all n locations
  Clone ID: PAT_TA_45309
gtccaatcggaggcggagatggcgctgcggtgggcgctgcttatatcggcggagatctctcccggtcncaaggctgggacttagtacttgcattctctatcaaagctccacccactattggttatttaaactccaaccctgtaagacctggcaa

SEQ ID NO: 45310 - DNA, 446 bp, Triticum aestivum
  Clone ID: PAT_TA_45310
cgtccgaaccctagccgtctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatcctcgacaaggcgaccagcacgctcacgatcgtcgacaggggcattggcatgaccaagtcggacctcgtcaacaacctcgggaccatcgccaggtcgggggccaaggagttcatggaggcactcgctgtcggcgctgacgtggccatgaatgggctggcgtgggtgtgttat

SEQ ID NO: 45311 - DNA, 425 bp, Triticum aestivum
  Clone ID: PAT_TA_45311
cgtccgcgggaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccaaggattccttgtcttcaaccctgttggaagtggtactggctctggccttgggtttcttttgctggagc

SEQ ID NO: 45312 - DNA, 226 bp, Triticum aestivum
  Clone ID: PAT_TA_45312
cgtccggcaaatcatcaactttcgcctccttgagtcatcgtcccctttagctagaccctatccggtgagacggttcccaccggatgggaatcgtacaaacaggatgattcaaagcaaggagttatttgaggctacgatccggcaaccgcgcttttgcaacacttcttttgtgctggtgctgaacaagtactaccttgttcaggagaagatcaatcgcgccccgctt

SEQ ID NO: 45313 - DNA, 187 bp, Triticum aestivum
  Clone ID: PAT_TA_45313
gcgtccgcccgctctccctaagtcttcctccctcctctcctcggcggcgcggcggcgaagtccaaccaggccccaccggagctccgaccatgggcggcgagaaagagaaccttgacctctccgacctcaacagctccctccccgccgtcgtcgacgtccttagaagcgtggaccgcgtttggttttt

SEQ ID NO: 45314 - DNA, 147 bp, Triticum aestivum
  Clone ID: PAT_TA_45314
ccacgcgtccggttgcgcctgcgcgaacccccggctcttgtgtctactagggaggcaagcgtataattgggactaggtccatcaaaactgtggagtcgttaattgatccaacaggagcttgatcatgtcattgaagagcttgaaaag

SEQ ID NO: 45315 - DNA, 170 bp, Triticum aestivum
  Clone ID: PAT_TA_45315
tcccggtcgaccacgcgtgcgcccacgcgttcggacccgaataccatttggaccgaaagacaagtatctagctaaagaacatctcttgccttacgtgcaagaatttgttgatggggcactcaatcatatagggcacatggcaaagatcataggtgaagaaatcgggtggg

SEQ ID NO: 45316 - DNA, 300 bp, Triticum aestivum
  Clone ID: PAT_TA_45316
cgtccgctgctcgcaaagcaaggaacgtctttcatgtgtgcaaagcgctatataagtaactatgcagtttactaggtaatgaactgagtggaagtggaatcggtgcaagcgtgggagctgaacaatgcggaaaagacctggttgaacttcaaaagatcgtcgatcagttatatgaaaactctagcaaaccattggtgctagccccaggaggattctatgacaaacaatggtttgctaagctccttgacgtctctgggccaaatgttgtcagaggaatgactcaccatatttacaatcttg

SEQ ID NO: 45317 - DNA, 352 bp, Triticum aestivum
  Clone ID: PAT_TA_45317
gcgctgtcgcctgcagtgaccgtcctgattcccggtcgaccacgcgtccgaattacatacaattaaaaaaaaaaaaaaaaaaataaaaaaaaaagaaaaaaaaaagaagagtgggaaaaaatatggggatatatataaaaaataaaactatagtctttcaacaatttctccttgtggtggttaaggggaccgcggctcttaggttttcatttaacatgctttttctttgtgttggggatcttcttttttataggggcgtctgaaatctttgccgtgccgagttcttataccctttgtttctttactactttggcgcttggagattttttactttttttcattcttccttttt

SEQ ID NO: 45318 - DNA, 196 bp, Triticum aestivum
  Clone ID: PAT_TA_45318
cgtccgcgcaaactcaaccaactcgtgcgaggatggcgcacgctctcgcccgggcgcttcggtcggtgcgcgccaaatgctctaacaaatgggcctgcgcccccgcgggtgtccgtttcttcgtctggcttcgcagagacgatgtgggggagaagatccgaccaggggcgaagctgttcctgtatgactttgacct

SEQ ID NO: 45319 - DNA, 393 bp, Triticum aestivum
  Clone ID: PAT_TA_45319
cgtccggtcccaatcctcgatctgttctcagaccctcctccgtccgtctcagctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaagtgaaggactccaagacccttctcttcggtgagaaagaagttgctgtgtttggctgcaagaaccctgaggagatcccatgggctgctgctggtgctgagtacgttgttgagtccaacggtgttttcaccgacaagga

SEQ ID NO: 45320 - DNA, 335 bp, Triticum aestivum
  Clone ID: PAT_TA_45320
gcgtccgcccacaattctggagacgcgttgacaccctcctttgtgcgtctcagctccagatttgcgggcccaggggtccgctcaagatcggtatcaaccgtttcggccggatccgcaggcttgtggccagggttgcgctccaaagccccgatgtcgagctcgtcgccgtcaatctaccccttcatcaccaccgaatacatgacctacatgttgaagtttgacactgtccacagacagaagaagctccatgaacgtaatgtgaaggactccaaaacccttctcttttgtgaaaaggaggttgctgtgtttggctgcaggaaccctgatgagatccc

SEQ ID NO: 45321 - DNA, 308 bp, Triticum aestivum
  Clone ID: PAT_TA_45321
cgtccgaagctcgacctctagccaacaagcagccaatgggagctctaactcggatggaggaggattggtaacttcacagtcacgcgagtcctcgtatggttccaagagtcagcagggaacagaagtttcagcagaaaagcaacggctagctgcttcactttttggttcctcagctgctaaacctaatcggaagggacatactggtcggaaggcagcaaaagagagttcctcgactgagaaagtaacacctcagcctgctaaggagcaagtaacccctgctgccccaccaccagatctgttggatctgg

SEQ ID NO: 45322 - DNA, 408 bp, Triticum aestivum
  Clone ID: PAT_TA_45322
cgtccgcccacgcgtccgaaaaaaaaaaaaaaaaaaaaaaaaaaaaaaaaaaaaaaaaaaaaaaaaaggaaagggcggccgatctaacaaaatccaaacttacatacacgagcatacaggggggggcccttttaaatggtccaacctaaattccgctggctggccaggggttttccctttttttgggtggcaaaaccctaatcctccggcccttattttacaacgaggggattgggaaaacccgggcgtgccccattttaatggggtgcggaacatccccctttcccaacagtggcgtaatactgaagaggccctgaccgttcgcctttccaaaaattttaaccaccttaattgcgaatgggacccccccttttaccgccctttaagcccggggggttgggggggttc

SEQ ID NO: 45323 - DNA, 179 bp, Triticum aestivum
  Clone ID: PAT_TA_45323
gcctctcgtacgtctattttcgtagaaaccgaggggcgaggcctaaagaaggcagggtttttcggcgggggcagaaaaggaatctcccgagcatcaaaagaaatggggccaaaattcagattcaaggtcaagctattcaaggacagatcatgatgcagcggttacggctgctgcggcgg

SEQ ID NO: 45324 - DNA, 270 bp, Triticum aestivum
  Clone ID: PAT_TA_45324
cgtccggagagagggagggagggaggagcagttggttgagacccttggcttatatagaggtgtgggagaggagcacaacctctattaaggcggatccccttggggaggaccatcacaaggaagcctttaggatcgagcagacagcacgagcaggagacccatcaccgaggcctagggcttaccttcagacccccgttcgccaaacgcaggtttggaatgtttccaatgtctagcccttcagcaaattccagacaggttaccattttttta

SEQ ID NO: 45325 - DNA, 229 bp, Triticum aestivum
  Clone ID: PAT_TA_45325
cgtccgtccgtccgtattgtcatgcaggcacacccgccccctacccctccctcttccagctccgaccgggaggaggtggatgacgaggaggaagaggtggtggaggtgaagcggaaggcgaggccgtacggtggtaatcgcgagcccaggtggtctgatgttgccaccttgaggagggccgcgtgtaatggcgtttaggcgccgaggttctcgtacgtttgctgtaaca

SEQ ID NO: 45326 - DNA, 427 bp, Triticum aestivum
  Clone ID: PAT_TA_45326
cgtccgaggcagtcaggccccacccacagacagacggacctctccccccttctcgtcgcccatggcggaagccgacgcccaaacccagagcaacgcgcactcctcctcgccgccggcggaggcgtcgggcgagccgatccggccgccccaggtaggcgctccaagtgctgcttctcccacgtttccactcatgtacccgatgctcgtgccagggatgttctcccagcagggtatggatgatcagcctcagggtccagggatatatgccatacaggagaatcagttcatgggggcgatgggaggttacgctccaaagacattcataccgctcgcttacaatataccaactgaaagcgtcggtgcattggctggtgaagagcaaggacaggatgctaggcagcaaaaaggccctcaaagacaagttgtg

SEQ ID NO: 45327 - DNA, 428 bp, Triticum aestivum
  Clone ID: PAT_TA_45327
cgtccgcccacgcgtccgagaccactgagctagctagcggaagaaccatcgagatggaggatgcgtgtggtgagcgcggcgacgggggccatgggacccgttatggggaagctggtcgctctgctcggcgatgagtatcggcgcctgaggagtatacacaccgagatcaagaccctcactcgggagctcgaaaccatcgatgctttcctcgagaacatggcggaggcggaggaaccgaacccgcaggacaaggcgtggatgaaggaggtgcgggagctgtcctatgacgtcgaggacaacctcgatgagttcatggctcgcgtcgtcgccgacaaatccttcaagccggaaggactcgtggacaatatcaagatcaagctgaagagactcaaggctcgccatgagatcgccaaggcgatcgaagatct

SEQ ID NO: 45328 - DNA, 367 bp, Triticum aestivum
  Clone ID: PAT_TA_45328
cgtccgatctcactgaataaacaacggctggtaaaagctagtggtttctatggtgctgatcatggtcagcttatcagtttatttagttgcaatccgaaacttggtgattgggaattatcctcaagaaaattcgtaggtgcaacttaaccatttcctcataatagttatccatacatggaggcggccatggtggcgttcatgccggaactggggccgttcgatagctagtgtgttcattgaggctgctggattattgccgtgacattaaatatctagcagaagaagttcaagccttgctcttttgtccttgtaaaacatttgttgaatgtaccgggccgcactcgaatatatgctcttggttgggttt

SEQ ID NO: 45329 - DNA, 394 bp, Triticum aestivum
  Clone ID: PAT_TA_45329
cgtccgttcgtcccgcccgtggtaagccctatccgccgcctccacccaaaccctaacggtagttggtccccacgccgccggtgtctccttcacctagcctgccggatccccgccgtcgtcctcgcgtgcacatggcaggtgctccgcctcttccttccatccggccagacccgcggcgcacgatctctcacgcttgctcgcaaccctcagtcgtggcttgggtttcgggctgggcatcgccttcgtcgccggcgcggctctggtggattccgacggcacctatacgtcttcttccttgcccccacacgcgactgcacttcccgctgttcatggggcttgccggcagcagagccctccttccttcctggctgccggcgtccggagcagcgccacc

SEQ ID NO: 45330 - DNA, 422 bp, Triticum aestivum
  Clone ID: PAT_TA_45330
cgtccggtttttgatgctctagtaatttatttattgggagtgcagcatgttgtttactggttcgagttaattgaggcaagtagtcaggttgcggttggtgctgctgcccccagcatggcaccttgcccatatcgcgtgagcgctttcaagaaggcagttaggatgtttgcagagaacccgagcaataatgttatcactccagcgcttgggacaagtatcgactcacttggcgaggcgtacaatttataggacttgtattcttgggaaaggggttcttggatttgacatggaaagagcaggttgaatgtttagagaacgaaatgcatgcaggaaatagtatgcggatgctcggtacgtatgacatgtggagcactatggttacttatttggcattcatttaattggggttgatttttaattga

SEQ ID NO: 45331 - DNA, 337 bp, Triticum aestivum
  Clone ID: PAT_TA_45331
cacgcgttcgcggacgcgtgggtgcggatcctggtgaccggcggagctggcttcatcggctcggaccgggtcgacaagctcatggagaacgagaagaacgaggtcattgttgctgacaactttttcactgggtcaaaagacaacctgaagaagtggatcggacacccaagatttgaactcatccggtacgaatgtaccgaaccactgctcgtggggggtggacaaatttaacaacttggttggccttgcttaccaatcttttacaagcacaacccttgcaagaacattaagaccaatggcattggaaccttggacatgcctggacttgcaaaggggg

SEQ ID NO: 45332 - DNA, 179 bp, Triticum aestivum
  Clone ID: PAT_TA_45332
cgtgctcggactcttgggcggactcttggcctgacgctttgcttcacgtccaaccccctataagcgtcgggggattgcttcacgctggtgcgcttgcactcactgtggttgctgcgccaataccactttccttagcgccaacactatagacggccggcggaaggggagatgaacaaggc

SEQ ID NO: 45333 - DNA, 284 bp, Triticum aestivum
  Clone ID: PAT_TA_45333
cgtccggacgaccagtccctccagaacgccttgttcaagtacggcgacgtcatcgacggcaaggtcatcactgacagggagacgggccgatcccgcgggttcgggttcgtcaccttcgcgtcggacgaggcgatgcgccaggcgatcgaggccatgaacggccaggacctggacggacgcatcatcaccggcaacgaggcgcaatcccgtcgctccagcggaggagagcggatgctgcttctgtggtagtcggttgcggatacgttggccagcgccgtttgggc

SEQ ID NO: 45334 - DNA, 282 bp, Triticum aestivum
  Clone ID: PAT_TA_45334
cgtcctcccactcgtacgctgacgcgtggcggacgcgtggggcagatacttgatatgggcgatggtgaagctcattttcatatgaagcatagtgcattcctctacaatcttggttctcagacattgccaaaaactcatcactgtttctatatgagggtgacattggaatatttcaaatccccttcattggattctgatgtttatccggctcgcaagtttaataccccaaaccataggcactatgttatactatctaagaatgtccttgcagcttttgttgtc

SEQ ID NO: 45335 - DNA, 404 bp, Triticum aestivum
  Clone ID: PAT_TA_45335
cgtccggcggccggcaacgagttcagggcgattgtccaggacgagctatgtcaagattaggggggaaattatcagccataatcttgacttagcgtgatccgttggcacaacgtcgttgtactcgccgagactccgcgcatgaagttgggcagccagacgtgcagcagtttttggcgcgtggagaggctcggtcttgcggccgttgaggagctgctcaagtgctggagccatgcatgtagctagcagtagtttgttactgcatgtgcgtgtgcatgcatagttggttaggtaggcgtgagttagttgagttagtggccggtggtggcggtgtcatgcgtgagtgcgtgcgtgcgtggtgacctttagcgtggtagctagctaggtgtgtgtgcgcgttgggtata

SEQ ID NO: 45336 - DNA, 406 bp, Triticum aestivum
  unsure (1)..(406): unsure at all n locations
  Clone ID: PAT_TA_45336
cgtccggtcgggtcggggtcgaagcatgccgcgggcgggagcggcggcggcggcggcggggagaggcgcaagtacccgatccgcgccgaggactacgaactgtacgaggagatcggccagggcgtcagcgccatcgtctaccgcgcgctctgcaggccgctcggcgagaccgtcgccgtcaaggtgctcgacttcgagcacaccaacagcaacctgaacaatatcatgcgtgaagctcagacaatgattcttatagaccatcctaatgttgttaaggcgatctgttcatttgcaaataaccaaacgttatgggtagttatgccgtacatggctggaggatcttgtcttcacataatgaaatcagtctatccggatggnttcgaggaagctgtcattgcaacgctgc

SEQ ID NO: 45337 - DNA, 404 bp, Triticum aestivum
  Clone ID: PAT_TA_45337
cgtccgcggacgcgtgggtgggacctcgtcaagtccaccgcctggtttcgcgaccactggtaccaccagcaccagcagctcgacgatatggccgactccctcatcgccttcgaggccgaggacgccatcgctgtcgaggcttcgcagccgcagccgcagccgccagcggcactcaatattgacggggtgctcaaggcgctgagcctggcgtccccaagcccaaagggcggcgacgccctgcgtggcttctcggagaagcctaggtacaccgagaagcccaccaagtacgccggcagcccgaggagcggtggcgcaccgcgcttcatccaccagcctcgctaggttgggatgtcaagcttcaagaatcgagcaaatcctacgctttctctgcctgcagtgatgca

SEQ ID NO: 45338 - DNA, 426 bp, Triticum aestivum
  Clone ID: PAT_TA_45338
cgtccgcggacgcgtgggtctccgtataaattatcatgatattcatgggacatcgtctgcgccgcaatttttggtggattgcaaatctattgtccacagatacggtggtacatttttgagactaccgaaacaaatttcttatgtatttcatgaacctctagcctttacccatttcagaaggacccaactttcaccggcggtacaagtttggatgaatggttaggcagtcctaatagtgccagtgagtactatcaaacaaattaattgcagttcctaataatatttgttcatgcgtccattgagagtgagtttcttcacatcaggtactgcatattttgctgaaatagtttatcaaccacaatgttgtaggccttttcggtaggatgaaagctgtcccagaaaatgtaatcataagcatttgggcat

SEQ ID NO: 45339 - DNA, 402 bp, Triticum aestivum
  Clone ID: PAT_TA_45339
cgtccgcggacgcgtgggcaaccacccgcgtcctccccccgcaactggcgcccccatcccttgggtcctgccctcaccacctgcccaccaccgacgagctcctcccctcttcctcgccccagatcgaccagcagggccagatcctaccgccattcatgcatctcgccctcgtcaccggccgccgctgccgtgcccccctcccccccgcgcggtgctgaggtgcgtatggaggctttgggccagggcagccggcagcgagatgcagagaagccctaggtataggtgacaggaggcgatgggtggcaggtcgagccgcgatgttgggacggctatgtgaagaagagagaggttgtctctccaactatttgtgtgatggggggcagatgaaagggaacaactatg

SEQ ID NO: 45340 - DNA, 439 bp, Triticum aestivum
  Clone ID: PAT_TA_45340
gggggccacgcgtccgggcagcggccggcgcgctggagcacctctacctccggatgggaagcatacgggcccgcatgccggagctggccagcttggtgaccctggttctgtcgagggtgcgcgtcaccggggaggaccttgggcacttgctctactcgtgccacagactgcagagcctcaagctcaagcgctgcgaggacctggcgtacctcaaggtgccgcctgatcgtctgaagcaactgaggactcttgtggtgaaaagctgctggtcgatgagggagatggacatatcgggctcctccgtcgagtccctgcggtttgaaggccgacacatgccgggaaccctgctttgtgggtcaggtggacccgccctcagggtgacaagtgcggagtttgacctcgagcaactgattgcccccgccgaatctgaagccaccga

SEQ ID NO: 45341 - DNA, 386 bp, Triticum aestivum
  Clone ID: PAT_TA_45341
gccggcggcccgtcgccggagttccgcccgccgcccgccgcccgccgcgcccgcattttcctcaccgccagtatgtatgcgcctccccgcttcttctgcagtacgggccctaacgccggcttcaccatgtccggcactgaacgcgacatagcggcacttggtataaaccacaatcgtgttctcaaggggggctcgggacacccacccacaccctgacactctggaacgcctccagcgggtgctgctgggcgtcatgatgcattgtctctccgatgacgcggattcactcagaaggatgatggatgacttccttgtcaaattcagcaacttcaccaggaagatggaccacatcagcgcgcgccttcaggccacgcgcagccctaaag

SEQ ID NO: 45342 - DNA, 345 bp, Triticum aestivum
  Clone ID: PAT_TA_45342
acgcgtggggccggttctcgctccgccgggccttcccgccaggccagagggaccggtggctccgcgccgggtcgctcgcccgcctgcaggatctcgaaatcgcctacaccagagtgcacggggacgcatgccacccgatgccgccgtccgcgctctgcttcgcgccgacgctccgcgcggccaagttcggcggctgtgagttccccgagttgaccgcgccgtccccgaagtttccgcgcctcaagcagctcaccctgtgccgcgttagcatctcggaggactctctccacggcatgctctccggctgcattgccttggaaagcctttcgctggaccggaacatcg

SEQ ID NO: 45343 - DNA, 206 bp, Triticum aestivum
  Clone ID: PAT_TA_45343
tcgttcgtacaagtcttggtaacttctcatcactgatccatagtggcttccctcatagcgggcgggggggtttggatctcggtgctgctatcgctcgacgtcctgctgtccgtcccttcagccagcgcggtggacgctgccacaacctaggaatccggcgatggcttcagagacacgtactgacccttaacgcggacaatttttat

SEQ ID NO: 45344 - DNA, 328 bp, Triticum aestivum
  Clone ID: PAT_TA_45344
cgtggggtgtagctctagtcaagaaaacagttgatccagaactagtgccctggtcactttttaggtcaatttcattaacttctttcgattacagagcatacgagctacgagcaactgcattgcagtagtgctacttacaactacagtatgccatgttcgagtcttcgagaaaggacaaagagtcatataacgcctcatttaattcacttgaccaagttaaaacacaatacaatttacgcgatcagcttagataggataccctgcagctcatcaacattacttacgaaagccttttatccaaaacaagcggaagcttgcgcttccaaac

SEQ ID NO: 45345 - DNA, 295 bp, Triticum aestivum
  Clone ID: PAT_TA_45345
gaaccctgtcaccacaaacaagtcgtatttggcaggggaggaaggcttgaacccccgccggctacgcgaaacccctaagccctcaaccaatccgttcaattccattggacccatcccccatatccgggcggggcctggggatccgccagaaattctatcccccaggcgatcgaccgcgggcggggaccggcgggggacgctgtacgggctggggacgggggtgcacggacagggggggagctgaggaaggagtggtgcctgctcacagggtttgacggatgcgggagcggaggtc

SEQ ID NO: 45346 - DNA, 315 bp, Triticum aestivum
  Clone ID: PAT_TA_45346
cgtccgcccactcgtccgtcacactccaccaccccaacccatccatccatcacagaagagagagagagagagagagacagaggagagccatggccaaggaggtgagtgaggagccggagcacgccgcgccggcgcacaaggactactccgacccgccgccggcgccgctgttcgacatgggggagctccggatgtggtccttctaccgggccctcatcgccgagttcgtcgccacgctgctcttcctctacatcaccgtcgccaccgtcatcggctacaaggtgcagtcggcggccgacccgtgcggcggcgtcg

SEQ ID NO: 45347 - DNA, 422 bp, Triticum aestivum
  Clone ID: PAT_TA_45347
cgttcgaaaaaagccgacaccatagacggaaaggcacggagcggggcacgaaagcccgcgcaagatcctcaccctttccggcggatttgacggcccgcattcccctcccccgggagccggccgttcgtgctacgcgccgtagcgggcggttacacgagcctgtatatcacgccgggctcccgggccgtcaaacggccacccgcgcccgcccctccctcccatggaacagggggcagcgcggcaagacgaggcacgcaaggagcgcgaggcgccgccgccggtccctttccccagggaaaacttggagagagatctgaagctaccctctcgtgtggtttctttggtctttggcggggatatctcaacaacagcacaagcattcgagaaatgggtgtcattggtacgtttgcggagcgggacat

SEQ ID NO: 45348 - DNA, 332 bp, Triticum aestivum
  Clone ID: PAT_TA_45348
cgtccgcggacgcgtgggggccgccttccgcctcctcttactcctgcttgccttggccgccagctgcaacagcactgctgctgctagcgcgatgtacaaggcgaaggccagtgtgattttcaggcatgatgctcgcaccatcgaggtcaaattcctcctccccgccagcaacagcccagtcgccgccggggacgaggacctgcagctgcggcaggaagccatggcccaggccgttaccgtgatctcccgccacaggccagagaccagcgacgccgagaagctcaagtgggcgctgggggtggtcaaccctcgagggcccagcggtgggaagc

SEQ ID NO: 45349 - DNA, 461 bp, Triticum aestivum
  Clone ID: PAT_TA_45349
cggaacgacccacgcgtccgacaggatcttgaggagttcttttgtgtcgtattgctttgaaggtgaatctcattcctcggattttgctctgttgtcgtagcactttcagatttgaagttatgtttctcaagtaagaagtagtatctttgtgcttttagcaatgagaatatttgaggaactacctatgacaacatgattttgtaggaaaattagatcataacaagagacgatgaatcatttattttgtttcggtggggtagggtcaaattttgaatcaccaagcttttgtatgattatgattgaccaggcttgcttgctgcttgcttgtcaatcaagctatgttggtcgattttagagacaaacttgtcttcgaataagactatctagaagcagcagggcgaagacatccattgcattactaactgggataattctgactcgatagctacaccctgtggatg

SEQ ID NO: 45350 - DNA, 311 bp, Triticum aestivum
  Clone ID: PAT_TA_45350
cgcctgcagcgtactgcccgggaagacccacgcgaccgaccacgcgttcggcacgggttccgactggtttaggtcgttcgacttttgcgagcgcaatggatacgttatgggcgtggtaacagatgtgatacacgagccgtggcgtggagcgccgatgatcaaggtgaccttatggcacccggacaggtacaagcaccagacggagctctacgtcgacgccgaggctatgtacaccgaccagttgcggtactgcggacgccaggccacgctctgagctgcaacgtactcccgatacgctccgcgcctgaagg

SEQ ID NO: 45351 - DNA, 246 bp, Triticum aestivum
  Clone ID: PAT_TA_45351
cgtccggcacgatcttgggcgacgtctttggagactattggttgcgccagcgagatctgctccggggagactgggtctctgaccaccaacctgatgaaattgaagagctggtggtgatcggagatgccctacggaaagttaggagcttaaaggtggactgcacgtcgtatgatcccagtgttggcccggggcccagatcttctgctgggaggaggaatgcaaatcttgagatgatcgcaaaggttg

SEQ ID NO: 45352 - DNA, 350 bp, Triticum aestivum
  Clone ID: PAT_TA_45352
cgtccgcccacgcgtccgcggacgcgtgggtttttttttttttttttttttttttagaagtttttggccccatgagataccggacgcctgctagcactaattaaaaacaccggcgtacttcgatccaatggtgatcggaccaaagaagtaaaggagttggacgaaattgccatgcccgcaccgcgtgctatgggtgccgaagaactgaacatggtcccggttagtggaatgctccggcgattgactactcgtggagggcggcattcaatacgtgcttcggtgattggcccttattgatagagaaaagaaggaatgttttttggaacggtggcggaataattagaagatgc

SEQ ID NO: 45353 - DNA, 313 bp, Triticum aestivum
  Clone ID: PAT_TA_45353
gcgacccacgcgtgcgcggacgcgtgggcggacgcgtgggcggcgatgttgcggatgccctcgaggcctcttgctcttctcccgtcctccaggtctcgcgtcggtgacctcagggagacggcgaagttgattcggtgaccgtggtggcacatgttgatgggcggcgggatgggcggtgcactatgattcgtctggggtggtggtgggggtataacagaaattgatggcaggcagatcagggctgccttgagcggcgatcttcgctgggtttggttcgacatgcactttggcgatttgcctggatcgtttgagg

SEQ ID NO: 45354 - DNA, 373 bp, Triticum aestivum
  Clone ID: PAT_TA_45354
cgtccgagcaccgcttgtccccatctcattcgcatcgacctagtcgtgctgcgccacggctgggcggacggccgcgcggccctcagctcaactcctccgctggaggacaggcctcttgcgtctgtgctcccacccgcgatgtccagcaacaaggtagctgatcattggtgcctgtcagagcgacaagggcatcatttgcaatccaatggtgcaatagatcttgaactcgatggtgggactgcaagtcttcattcagaaataggagtcacaaaaggttatactcgagtcaaacggagtccccaaatggctgatctgatggtgcctgttagaacgattcggccattatcctgcatttcaagggggcaattgatct

SEQ ID NO: 45355 - DNA, 486 bp, Triticum aestivum
  Clone ID: PAT_TA_45355
caccggcccgtaccgccccggacgacccacgcggacgcacacgtgctggcattgtcaccaaaaatgtgctacaccagatcgctgcgaaggccatctatgtgctcctactcaagatgcagatctttgtgaagaccctcactggcaagaccatcacccttgaggttgagtcctcggacactatcgacaacgtcaaggctaagatccaggacaaggagggcatccctccagaccagcagcgtctcatcttcgctggcaagcagctcgaggatggccgcaccctggctgactacaacattcagaaggagtccaccctccaccttgtgctaaggcttcggggtggcatgcaaatcttcgtgaagaccctcaccggcaagaccatcacccttgaggtcgagtcatctgacaccattgacaacgtcaaggcgaagattcaggacaaggagggcatccccccggaccagcagcgcctcatcttcgctggcaagc

SEQ ID NO: 45356 - DNA, 354 bp, Triticum aestivum
  Clone ID: PAT_TA_45356
cgtccggtcaaacttggaaaataggatctacgacgggactggagcaaacggatcacggcggtggcggcggcgaaaatgctaaggctggctcacttgtggatcatggggcggctggtggcgtaattggcttcgaatcttgtggggaccgactacactgtggcgatggtactgaacaggatccacgcggaccagcctccgtccgtggagaagtgccaacaactctacaagcgaggtgtttacacgcgcatctttagtctaccaggccattatgaagcattgcggacggaggttgatggtgtcacgcatctacgaaagaataggaccgagctctaggggaccgaccttgttactgca

SEQ ID NO: 45357 - DNA, 288 bp, Triticum aestivum
  Clone ID: PAT_TA_45357
cgtccgccggatccatccatccgcccctcgctgccgctgcgtctcgtctccaccaccccacttgcccccggactcaggaggatcgtcggagatgtccgacaccgatgagcaccacttcttgtccaaggccgactccggcgccttcaagacctacccgcatcaggctgtcgccatccgcaagggtggacacattgtcatcaatgcccgtccttgcaaggttgtctgagattccttctttcctatttgatactatgtttattctaaatgtgttcactttttttgtgtata

SEQ ID NO: 45358 - DNA, 147 bp, Triticum aestivum
  Clone ID: PAT_TA_45358
cgtccgcggacgcgtgggctacagctgcaaaatggacgaacgcgcgtcagtgcacgaacgtgctttggtggtggatgacgagagatgaatgagagtgttatgccaaagattctatggtgatgaatgctatcaccatgacatcggcaa

SEQ ID NO: 45359 - DNA, 142 bp, Triticum aestivum
  Clone ID: PAT_TA_45359
cgtccgcggacgcgtggggttctttgctagactacgctgaggcacacctcaagctctacgaattgggatttggggaggcggactgctgttgatacaagcacgccatgtgaaggacggcggtaatgaataagaagaacatcat

SEQ ID NO: 45360 - DNA, 357 bp, Triticum aestivum
  Clone ID: PAT_TA_45360
cgttcgctgacgcgtgggccccactcccttgttcgcactccgcccgacgcgccggacggaccatggacgcgaccgccgacgatgcctgaagtgcattcatagttgtatagttctaaatgtgtctaattatctaatgggggttgaatgtggttatttactactctatttttgttacactacaatgctatgtataaaggttatttatgcattgtaatgactttttagaagttattatttataattaaaaatgttgtttcaatattttaattgttatttcttttgtttaaaagaatgttttattttaccattaattattttttttatttgaaatcttttttgtttactatttagtatttt

SEQ ID NO: 45361 - DNA, 316 bp, Triticum aestivum
  Clone ID: PAT_TA_45361
cgtccgcggacgcgtgggctccactcagtaccttctattctgttcgccctgcccgacggacatggggccggacatggagacagaggaggccgcctccctcagtcccgacgacgcggtgcttttcttcggcgtggtccttgtgctgggtatcggctcccgtcacctactccgcggtacccgcgtaacctacaccgtcgcgcttctcgtcctcggcgtcgtcctcggtggtctatagatcggttatgaagcatgggctgggcatgctcggatccggcattctgatgtgtgctgccattaaaacttgattcttcttctt

SEQ ID NO: 45362 - DNA, 523 bp, Triticum aestivum
  unsure (1)..(523): unsure at all n locations
  Clone ID: PAT_TA_45362
cgtccgggctctctccatcccaatcccgacctaccgcccgctcccgcaagccatggacgccacggcgcaccggcgccaaggggaagaagggcgccgncggtcgcatggtctttggttcctatgaatgattttctgttacttctggtcctttgtttgttcttttcttttctattttccttttctgtatttctttttttttctctttcccttttatttcttgtctttgatttttttttacgtttttttatttatcttttactctttcttcttcgttttgttcttttctttttttttttttcttttctttttttatttccctttttttttttttattctttcttttctcgttcttttttcctttttttttattttttttttcttttctttttttattttttttttttctctttttttttctttttttcttcttttttttttctctttttttttttttttttatacttttctttttttttgtcttgttgtaattcttagcttttcttctttttttctattctttttt

SEQ ID NO: 45363 - DNA, 247 bp, Triticum aestivum
  Clone ID: PAT_TA_45363
cgtccgtgcattgagagtttgagactatgggcctgtttgcatcacagccagcaacagccttacaaaagcattgtctggctcgttggcctttgattggaagcagattctttggctatgcgccaaagatgcgaatgccgtgtgaggtctcgacgctgtgcaggggatattttggaccctgttggagggggaaaaatttttacagagccatactgaagaaatggctcccgcttgcttttttgcaccggcg

SEQ ID NO: 45364 - DNA, 395 bp, Triticum aestivum
  Clone ID: PAT_TA_45364
cgtccggcttcccagtccgcagcagttccgcaccgacaccctcaccctccccatagccctaaccgctcgcccggtccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggggagaagtggcgcaccatgtctgatgaggagaaggcaaagcatggcgggaagatggcatatgcctcatcaagcaaggctgtgtacaagaaggagagcaccagtctccaagaagaccaagactaa

SEQ ID NO: 45365 - DNA, 320 bp, Triticum aestivum
  Clone ID: PAT_TA_45365
cgtccgcccgagtccggagaaggttgttgatgctgaacttgaaactagattcaacattattattggtctgtcgaaggccgacatcaccaagcattctatatattattattgactatctctctatacaatgtatatattttattacatttattctgttatctttttaatcttttgcgtaattttatatattaactatttatttcttttatttttttatcttttcaaattttgttctatattattattttttatttatttattctttcttacttagtaatactttattttattatattatttatttatatctttattatctt

SEQ ID NO: 45366 - DNA, 323 bp, Triticum aestivum
  Clone ID: PAT_TA_45366
cgtccgcggacgcgtggggtcggtttgccctgtctggtcttcgggttttcacatgggggatggatgaggccagcggggctctcacatcgggtgtgccaatgagccagtggtggtccgccggaatatgattcgcaaagcccaacaatgcctgttgactgacattttacatttaatcaggtattcagttttcatgttctattattttgtactcaatccttagtcttgatataccgcttgttttatagcattcgtattttgttccttaatccttaattctttcattatgtatgcttctgttccttttagtctttatgttctctatt

SEQ ID NO: 45367 - DNA, 387 bp, Triticum aestivum
  Clone ID: PAT_TA_45367
cgtccgttctcttcttgaggggaagggggaacttccaagagatcacccaagaaaaacccttcttgtgcttgactggcccatctcgtgcaattttggccaaggaccatgttgacctcgaagtccaactaaaacttaaaggcccaacagagtctgaagacagagtgttgatcactaaaagatgccagtacagtggctatcataccgataacggtttatatactcttaccttgaataaccgtctttgcacaacagagttaagcctgcagcaactgtactgtcaatcggtccaagcaactttcttgcgtgtcggtggctttgttaaaggcaatacatcccctttcattcatggaggccgagttgcctgcttcttaccatcttatggaggcc

SEQ ID NO: 45368 - DNA, 285 bp, Triticum aestivum
  Clone ID: PAT_TA_45368
cgtccggtcatcaacatttaagaaaacgtaacctctggatttattattgacattggagcaatgtgatgagctacagatatcaaaagcatgagccagcaacgagtccgtgactgctgaaaaagggctcgagggtaccgaaggatgcatgacgcactacaccggccagggccacctcgtgaagctggtgccgaacaaccctgcgaaccaggactagttggtttttacgactgagagcctcgacgaggcgaagggctacggctgcgtgcgcatggctgaacaacattt

SEQ ID NO: 45369 - DNA, 208 bp, Triticum aestivum
  Clone ID: PAT_TA_45369
cgtccgcccacgcgtacgcggacgcgtgggcgactgtccagcccgctcgtcccgcacgctttgcgctcctccaagctttaccccacctgcctcccccgtctccttccccgccccattcgtgcactgatcccccttctagaacctcccataagccgaacgagagagcccgtaggtgcggcgcacgtgcatggcgatggcgacgcacacg

SEQ ID NO: 45370 - DNA, 247 bp, Triticum aestivum
  Clone ID: PAT_TA_45370
cgtccgtggacgcgtgggcggacgcgtgggcggcggctggacaagaaaaaaaccaggggaatgggggaacacagagcatctcaccaatttctgcccgcccgacctatcgatcgaagccccggatttcaattcgcaagaatccctcggggaatcggaggagcgccggtccttctccgtccggatccaaggaccaccgttcggctgccgttttcggcgcgacgtcaaaaccttaagtggggatggcgga

SEQ ID NO: 45371 - DNA, 236 bp, Triticum aestivum
  Clone ID: PAT_TA_45371
cgtccgctcgccacggctctcacgcggccacgccgtcaggccagtcgcctgaccgacgcagttgatcgtaatacgcctgtaaagatttcctccgcatgttacgcgagacagaagagcttgtcactgcaagcctataggatagaatatatgaagacagcgagcactgtaggatatccaaactcacgtacgcatgcatgctacgacatagctgtgctatagagtcacctatatgcaat

SEQ ID NO: 45372 - DNA, 170 bp, Triticum aestivum
  Clone ID: PAT_TA_45372
cgtccggtcgaccaccatctgaaacacacaaccacaccgaggccaagcgaagatgtcgcaccgcggcaagggagggaatggtctgttcaagggcggtgctaaacaccagcggatggtgctctgcaacaccatacagggcataaccaagccggccctgcgcgctctagacc

SEQ ID NO: 45373 - DNA, 148 bp, Triticum aestivum
  Clone ID: PAT_TA_45373
cgtccgcggactcgtatgctgacctccaagaccgtccggttcggcgagcaactacagggagctcatgggcggcctcgccaacctgccaggcctgccggttgggcggaacgccatggtgcaggccgtgcgtgtcctctacgcctatgac

SEQ ID NO: 45374 - DNA, 403 bp, Triticum aestivum
  unsure (1)..(403): unsure at all n locations
  Clone ID: PAT_TA_45374
cgtccgggataacgcggtcgacgagatcaaaactggagctactagaatcatggtggacaaaatcgttaacaagcgaaacggctcgccagctttacttgttcaagatgatggcggaggcatggaccccgattccatgaggcgttgcatgagctttggattttccgacaagcaatcgggttcttcaattggacaatatggcaacggtttcaagactagcacaatgcggctaggggcagacgctatcgtcttcagtcgttgcatgaagggcagtggacctacacaatcggtgggtcttctctcttacaccttcttggcggaaaccggtcaaaaggatgtcgtagttcccatggtggactacaagtacgatttattgacaggngacgctatacagtatgagcgacat

SEQ ID NO: 45375 - DNA, 273 bp, Triticum aestivum
  Clone ID: PAT_TA_45375
cgtccgcggacgcgtgggcggacgcgtgggcgcgaacgccctactactcccctcgtgcccacgagcgccgacgccgacggcgtcgccgactgtagtcatgtcgctgatcgcgggtgaggagttccagcacatcctgcgtgtgctcaacaccaacgtagacggtaagcagaagatcatgttcgcgctgacctacatcaagggtgtgggccggcgcttctccaacatcgtctgaagaaaggctatattgacatgaacaagaaggccggggagctt

SEQ ID NO: 45376 - DNA, 307 bp, Triticum aestivum
  Clone ID: PAT_TA_45376
cgtccgcggacgcgtgggcggacgcgtgggaaactcccacgatcattctcttccaaaagtgagacacaaaaatgaagatcagttagaggagggttttccaattcctacttgcctcgcgcttccagtagttgccgcattgttccttccgttccatacttccatcatctcttccccccgcagactgcggcgggttcttgcattcgcgaagatggcgctagctctgcggctcctcctcgtgttcctggcaattggatcctgcatagctgccgaccatatcgacctgtggccgatgccccaagacggtgtc

SEQ ID NO: 45377 - DNA, 157 bp, Triticum aestivum
  Clone ID: PAT_TA_45377
cgtccgggaacagatagtgtcccttcgttagcaagaacaaaacttctcatatgtgttgtgtttgaaacagtgaaacagtggatcggaacagacagtatattgaacactgtgtacttgatgatttaccattgcaaaaaaaaaaaaaataaataatata

SEQ ID NO: 45378 - DNA, 344 bp, Triticum aestivum
  Clone ID: PAT_TA_45378
cgtccggcaacacctactgatatgactgcgaggcaacttgctggcacatcatcaagcggcgttgtcaataatgggatacagtttgtggatattacatgcccgaggaatcctggagtttctccattcaaggttgtggttgataaagactgtggacactacaaatattatgacactctgattgctgaagaggaaaaggtgcatgctcagacagaggatgctgacgccttaaaaattgttaatttaagcactggaagcttcatagcacatactggtcacacagaagcttatttgaacacagatcttactattaaacgcctgcttccgctttatatggtgcatatgaa

SEQ ID NO: 45379 - DNA, 377 bp, Triticum aestivum
  unsure (1)..(377): unsure at all n locations
  Clone ID: PAT_TA_45379
gcggtaccgtccgattcgggtcgacacgctcgggacctggtcgagccagggatccagatgcgacagcggcagggatcacgccagtgatcgatcagcgggagagaccacggcacctgagcgtgaatggggcggcgatgcggcgatctgctgcaagtggaagggtgggacgcgaatcgacgatggccggcgcctcatctgctggacactcaacaacgacgccgcggcatttaagttgggttgcgggtgagcggtccatggctccgctgctgtccgtcgaaaggtaaccacacctaagcctncctgccgncccttctttcttgagcatcattatgttgaacctaattttcgctttttgtgctggtccacatcatggtttt

SEQ ID NO: 45380 - DNA, 356 bp, Triticum aestivum
  Clone ID: PAT_TA_45380
cgtccggctcaccagatattgtgagtgcagagctctaggctcacaatgcggtactggttgcgggtgtaatgcttccaagtgttccaataggatgcgcgtcgtcaaggaagaaatagacgatgaaccaccatccgagaaggaagggagcgagtttggtaacgtttcttcttcagggaatgatgccaaaatgaaggaagaagtgaagcaaggaatcatgcttctcgagaatgctgtggctgagaaggaaactcagcagccaaaatcaagaaagccattggcggacattggaaataacgatgcaaaacaagctggggcaaaacctaagcagaggaagaactggcgcaagtcggcaacaa

SEQ ID NO: 45381 - DNA, 451 bp, Triticum aestivum
  Clone ID: PAT_TA_45381
cgtccgcccacgcgttcgcggacgcgtggggtccttcccccgtcgtcgcggctccaggtagggtgtctcgcccccgtcctcccgccccaacggcgggcccatgcggcatgtctaaacaaggaggaaaggccaagccgatcaagcaggccaaggtgagccagaaaggactacaacaagaatgacctgccatacctacagaaaaagaaggatgagcaaaaggccctgaacgagctataggccaaagcaggccaaaagggtgctctaggaggatctggtctcaagaagagtgggaagaaatgagtctgcccacccattctgaatacccagaaaatgataatgtatctatatacctatctgagtcgcgcttcactatctgtgggtggaacagactaacctcagttgggtcgaggattgtgcatcgacgcagtatgtcgctgaaacctatggcatg

SEQ ID NO: 45382 - DNA, 247 bp, Triticum aestivum
  Clone ID: PAT_TA_45382
gcgcgtccggcgtccctcaagattagggccctgctgggatgctcttcttccggagcagcattgtgctggcggcggcgccggagatgcatctccccgactgcaaccggctatccagactttttctaactgtgggggtgtgggaggagatgcttcccctgttgaagatcaagagcgaccagggcaccctcatgttagggtggcccatcagcgacgatacatgcactggccacttgttcctctgcgacag

SEQ ID NO: 45383 - DNA, 395 bp, Triticum aestivum
  Clone ID: PAT_TA_45383
cgcacgcgtgcggctattaccaacgagagggcgggactttagtttgacctcgacaaccatggtcattactggtgcattacttcattgaaaaaagatgtttggaaaggcactctctggtttgagagatcactttacgggtttcagcacatgaccccgtacactcttctggggggagacactctgtctgtggcggcgtcacgggtcttgacagaggtcacggggcaaaaagtggaattcttgtaattatgctgctggcggcgcgtctttcgaaaaaatatatcttctgcaagatacaacagatgttttttttgttgaccatcttctgaagatacgcctattttttttactatcttcaccacttggtcgcacatttaaaccccccccccgggtttttt

SEQ ID NO: 45384 - DNA, 348 bp, Triticum aestivum
  Clone ID: PAT_TA_45384
cgtccgcggacgcgtgggtccggcggcggcggcggcggcaatggcccgaaagagaaagacggacgccgcgcctaggttggacgatgccgacctaacgctatactgcaggttctgtggtgctgacaattccctatttcagctatactctcaggccatggcctaatataagatgtttttctaggctggtgagcggtaagctcttgaaaagttttaccaatggatcttgaggaagcattatgaggtattgtagtttactgttgtgtacattatgttacacattcagcatgtgattgactatggaggttactgatgatcattgtattttttaagagtttattaagtattttt

SEQ ID NO: 45385 - DNA, 332 bp, Triticum aestivum
  unsure (1)..(332): unsure at all n locations
  Clone ID: PAT_TA_45385
cgtccgggcgagcacacacgcttttctngccgtcaagatgttcgggcctcaggcaccagcacaaggaccaggcgccggcggcgtttgtccccaaccagatcttcaagatctactgccgggcctcggaggactactgcctcgccgtccgtgacggcgaggtggtgctcgcccccgtcaaccccaaggacgagacccagcactggctcaaggacatgcgcttcagcaccaccgtcaaggacgaggagggcatgccggccttcgcgctcgtcaacaaggccaccggccttgccgtaaagcacttcatcggccagtcccaccccgtgaagctggtg

SEQ ID NO: 45386 - DNA, 313 bp, Triticum aestivum
  Clone ID: PAT_TA_45386
cgtccgcggacgcgtgggcttagaaacaatgctttaactactatacatgggattgaaaatctcacgtcgcgtgtgtgggccttgatctttcttacaacatcatatcaaatttctcagagttggaaattcttggcagcttttctttgctacagaacgtatggttggaaggcaatccaatctgctgtgctcgttggtatcgagcacgtgtttttagttttttccataattcagaaaatttaaagtttgatgattataggcatggtcacacaagaattctgggataagtcagtttgttttgaagcagacaaaaaca

SEQ ID NO: 45387 - DNA, 181 bp, Triticum aestivum
  Clone ID: PAT_TA_45387
cgtccgcggacgcgtggggtcacctgcagcggcatcagcttcggcccgtgcggcgggggggggggccggatctaccttccgagctttcgtgccagcaccaaggtgcccgttctggtctactttcacggcggcgccttcgtgtgtggagttggggtttaaccctatttactacgtcttcctt

SEQ ID NO: 45388 - DNA, 297 bp, Triticum aestivum
  Clone ID: PAT_TA_45388
cgtccgcttatggtcactagctatgaaaggtaggcatatttgaaacagatataggcagataagagtgcggtggtggcttaatgagctcctctggaaaatgggggggcactcagatgacctgttctagtggaatttgatgatactcaactaaaatcattgaatggctttattgcgggttgagattaaaagtttgggtagtgctgagtctcccctgggctcttttaggaatcattccccacttgtaggctacctgggttgcaaggagtttgagattatcagttctgtttgattacaact

SEQ ID NO: 45389 - DNA, 192 bp, Triticum aestivum
  Clone ID: PAT_TA_45389
cgccgatgaccttttcccgctcttcgacaagtacggcgaggtcgtcgacatctacatccctagggaccgcaggactggcgactcgcgagggtttgccttcgtgaggtacaagtatgaggacgaggcgcagaaggcagttgatcgcctggatgggaggttggtggatgggagggagatgatggtgcattttgt

SEQ ID NO: 45390 - DNA, 449 bp, Triticum aestivum
  Clone ID: PAT_TA_45390
gtcacgcgtccgctcacgcttccgtggtcgcgtaggtcccgtccttctagacggagggaacttttcacaggggtacgtggtgcggagagatatgtttagcatgaatacaaatgggcaggaggacgagtatcccgaggagcgcgtgccgcacctgtcgtggatgctgcaccccgtagacatctactccttctccggctgtcccgtcacgagcctccaccgcctcgaccccagattgtcagaagtggtgcaggggatgggaatttgtatcttttttcccggttcaggtttttacatggctggaaacaattggtcctggtgcttttcagagggatatctgttcaactccccaactgggtccggcaaaactcttgcatatgccttgcctattgtgcaaatgctttccactcggaaagtaaggtgcttgcgtgcttttgttgtgctacctacac

SEQ ID NO: 45391 - DNA, 158 bp, Triticum aestivum
  Clone ID: PAT_TA_45391
cgtccggcggtagaccgcgccgcaggacgcgtccttggacgactacgaggacgagatcaggcgggtggagttcgagccggggcgcggcgcgtcctacgacgccacggtcgtcgcagccgcgcccgggcctgccccgggaccggcgacggcggtgaggg

SEQ ID NO: 45392 - DNA, 328 bp, Triticum aestivum
  Clone ID: PAT_TA_45392
cgtccgcccacgcgtccgcggacgcgtgggaaaatctcttccacaatcggaggggaaagcatctgcgagtttcgccctcgcgcgggcgacgggcggcggcggcggcggagatgggctgttgtatcagccggagttcgtactctgtgttcatccgtgttacgctctgtttctcctcctgttattgttatttttttttttcttctttttttattttctttatttttttttatttcttcttttttgcttttttttttattattaatctttgatttatttgaagttattttttattcgttttttgtgtttatttccatattttctctttttt

SEQ ID NO: 45393 - DNA, 219 bp, Triticum aestivum
  Clone ID: PAT_TA_45393
cgtccgcggacgcgtgggcggacgcgtgggcggacgcgtgggtggtcagcttgctctggcatcgatagcttcagtggaggttgatgaaggtttaagcagtcaagatgccagagcaaaggttcaagataagataaaatagttgcatactgtaagagagaaaacgcttactcagagtctaaaggatcgacttcagccatatgtggatggtttaaaggatga

SEQ ID NO: 45394 - DNA, 251 bp, Triticum aestivum
  Clone ID: PAT_TA_45394
cctccgaggacgactgggcaaaaacacatatccttaacagtcagatacgtatcctatacgagcaggtgtgggccgcacgaagcagacggcccgtatgtccaccgcctggaaggcgccgaggaagcagctcgtcaccaatgcggggcgcaagttggcgccatgccaccggcatgtgtgaaaaatccccaccttttcatgccggtaacggtcgtcctgcgggagatccgcaagttccagaagagcacggagct

SEQ ID NO: 45395 - DNA, 167 bp, Triticum aestivum
  Clone ID: PAT_TA_45395
cgtccgctgatcctttgtctatgccgctgacacgaccagttggttcttcaccttctaaggcggcgcagagaggtgacatttctcctgccaaggttgttgacattactcctgtgaaggtgatgcaaaagggtgaccccctggtgcgatccaaggtgctacgaagagag

SEQ ID NO: 45396 - DNA, 229 bp, Triticum aestivum
  Clone ID: PAT_TA_45396
cgtccggtcacgcgtccgaaaaagcgcagcgatatttattggaaccggagaacacattggcgagagcagacatttgtgatgtgaaaccattaggctgccgactgctaggtatgggagactcgactggcttaatggacacgacccaggatgttatgcctgctgatcaacagcctgagcttctggcaaagctggctgaaggaaccttcactcaaagactttagtctgagca

SEQ ID NO: 45397 - DNA, 193 bp, Triticum aestivum
  Clone ID: PAT_TA_45397
cgtccgtcctcccgtgagacttcttcgttcgaccactctatcgatcccaccttccttgatagatgggctactatcccttctgttgcgttaccagccagtcagctccgtccaaattccgatcgcgatgaacgcgttgaagtatatggacatgcagatctttgggcttgcggaggcgggcgcggcattgtggcct

SEQ ID NO: 45398 - DNA, 153 bp, Triticum aestivum
  Clone ID: PAT_TA_45398
cgtcacgcgacccgtgagtcttagttcacagcaaagcaccattcttgtctttcattctactcaaggcaaaggctcccgttgatcagatctaccgctaggctgtcagatccattcatgggccgtcttgaagaagtcactgtctacaccaaggag

SEQ ID NO: 45399 - DNA, 297 bp, Triticum aestivum
  Clone ID: PAT_TA_45399
cgtccgcccacgcgtacgtccacgcgttcgcccacgcgtccgatcccaccgaccttgatagatgggctactacccctccccttccgtcaccagccagccagctccgcccaaatcccgatcgcgatgaacgcgtcgcagttcatggacatgcagatcctcgggctcgcggcggcgggcgcggtatcgctgccttcctgcggtgggagcaacggcctcggccagctgttcgatctgatagtccctcacccacaagaggtcggcccgatggacttaccattttgatttgtcctaatgtct

SEQ ID NO: 45400 - DNA, 168 bp, Triticum aestivum
  Clone ID: PAT_TA_45400
cgtccgaaacgagcggggacgagatggacggcggcggttgccgtggtggcacaagcggcgacgacgggaagcaggagaagcacctggtgcttgcccacaagctctttctggtcttccaccccgatgttggcgacctctcgaaggtggaccttcgctccacgttctatc

SEQ ID NO: 45401 - DNA, 267 bp, Triticum aestivum
  Clone ID: PAT_TA_45401
acgcctgcaggtacgcggtcaccgaatctccagattccgggccacgacgtacgccccacccgacccaaatgggagacacgcttgactgtttgactgttgattaacaactgggttaactacatattaaagtctgcaatggataacgggcctgaagcaactgcaagtgaatatatccgctactgtaagtgacacacaacggaagcgactcatcgtcatcgatcggagaggacagatgcgggctgtctcgctctttgaacacaggggaat

SEQ ID NO: 45402 - DNA, 446 bp, Triticum aestivum
  Clone ID: PAT_TA_45402
cgtacgcctattacaaatccccaacccgccccacttttctccactccacccagcgtccggatccgatctcacctaacggcgctcatgggacactccggctcgcgctctcgctcacgctctgcaacccacctgtcgacgcgggtgttccaactggagcttgggcgtatctaattaagccaccgggttggaatcagaggcgatggggcaggaggggatgggctacagcagcggcaaggcccgcggcggtgggggaggggccctgccgatgacagcggcgcgggcgcgtggggcttcgccgctcagcacccaccatcgggcggggaagatcagccgcaccttcaacaacgtcaagatcaccgtgctctgggggctaggcaccatcctcgtgcttcggggtaccattgggctcaacctatacctttcgggccaacccttcgacgccgatg

SEQ ID NO: 45403 - DNA, 434 bp, Triticum aestivum
  Clone ID: PAT_TA_45403
agattcgggccacgacgtacgccccacccgacccaaatcggagccacgctcgacggtgtgactcttgatcaccaacggggctaatctactatactacaagcctgctctggataccggacctgcagcacctgcgagtggctgtctccgctactcttggcgcccgcgacgggagcggcgcatcgccggcgaccggagaggacagacgcggggaggctcgctcttcggacacggtcgacttggccgtctttctagagccgtgggcgcacacgcggaggggctaggagtggccacggacactgtccactctaagctcggactaacacggtgaaaatgccatgggtgagcatttcatcctacgcgtgccccctttagcggcacactagatcgagcgttttatgaacgaatctgctggcggcttaacctcgaaccccaag

SEQ ID NO: 45404 - DNA, 385 bp, Triticum aestivum
  Clone ID: PAT_TA_45404
cgtacgccccaccccacccaaatcggagccacgctcgccggcgggatccttctccaccaccgccctaatggcttcctccaagcctgctctgcatcccggacctccgccactgcggagtggctggccggggactctaggcgccggagacgggagcggcgcatcgccggcgaccggagaggagagtcgcggggaggctcgcgcttcggaaacggtcgtcttcgccgtcgtcccggagccgtgggcgcacgcgcggcggagctaggggaggccacggccaggggccactgcgagttcggtttcccacggtgtaattgccatggaggagcagttgatcctgcgtgtgcccccttttgcgggagagcagacagagcgttttatgaacgaa

SEQ ID NO: 45405 - DNA, 292 bp, Triticum aestivum
  Clone ID: PAT_TA_45405
cgtccgcggacgcgtgggcggacgcgtgggcaaacccccaaaaccctacccccccccggggggggtgccatctggcgtcggggccgccatggactccgtctccgccgcctcccttccgacctcctccggcgccggctagaacctgctcctcattctgtacattgtattgtattacacccgcctctttatccgacgggaccgccagctggggggcctctctctctgtgtttccggtacggtgccgttcttctacctctagggcctgctcgccctggccatcgatctctccggt

SEQ ID NO: 45406 - DNA, 369 bp, Triticum aestivum
  Clone ID: PAT_TA_45406
cgtccggcgtcgcagcatccgccggcggccggtgctgccatggagctcgcctggtgcgttgctggagtggaccatcgccgggaccgctggagctgcaatgaagcatcgtggcgtcgtcgaaagctccgccgagttgctatgaagcgtcgccagagctgcattgaagcaccacggagggcattgaagcttcgccggggttgctttgaagcgccgtcgacgctgcaatggagcgccaccgggagccattcgtgctgtgtggtgctgccatgtgagctggtgcgtggtgctggcttgggcctgcagatcgtgtggctgggagagtctgaatcggactgttctagggacggtttaagtctgtctaaaatcacc

SEQ ID NO: 45407 - DNA, 457 bp, Triticum aestivum
  Clone ID: PAT_TA_45407
cggcagcgtgacacggtccggaatgacaccacgcggttcgaccggtttaagattagtagacacagcattgcaattataatatagctgggggaggccgtactaaactctagaactgagcagtggagccatttttatagattttgagagcacattaagcatactatgtacataataaaactctgtagatccgtgacagtagtcgacaggcagttaattaaacattcatttaaaatggtgcaaaatgtggaaactacagttggaaatggaaatgttgtagatgctattcagtttggcctatgttttgtcctgctgcatataagacgaatgaaacgagtgtagaaggtcgatgtaaaaatatagcataaatgagaaacaatgcaaagtggtttcaaatggatgaatgccggcaccgggttgtatggttctaatgggtcatgaaaataggcctagagcatat

SEQ ID NO: 45408 - DNA, 304 bp, Triticum aestivum
  Clone ID: PAT_TA_45408
cgtccggcctcctacaacccgagagcgaggagttcaggccgcgtctccggttaccatggagccggccaagaatgaccattgcaccaagtgcgttcgacctggttgttcctcgatttatccgcaggtaccagatgactgatctaacttggaggaccctggcatgccaaaggacactttccgtaagaagcgtaattagacttacagggggcataagccgactctgagattgctgtttgttctcaataagaaggtgaatgtgaaggcttgtggtacttatagcaggaacactgcggccaaggggaaa

SEQ ID NO: 45409 - DNA, 318 bp, Triticum aestivum
  Clone ID: PAT_TA_45409
aatgcccggaccgacgcgctcacttgtcggcgggcgggctcacggtgcgaccagtgttagcacccaaggatgctgccttggcggctcgacctatgatatagatcatacaactgtataaacctgtaaactgttatatacaagatatggaaacaaacagatatgctcctatataggaagtgtcccagcgcaggagagaactttgaaacatgtatgaatatgatgatgactatgaaactgatattgattccaataaagcatccacgtactctttaagtttcaaattttgaattggaccttcccttctgctttttggaactt

SEQ ID NO: 45410 - DNA, 424 bp, Triticum aestivum
  Clone ID: PAT_TA_45410
cgacaccgcccggaccgacgcgctcactaggcggcgggcgaccttatggtttacgatgaaccctaaccacatgaggctggcttagcagctcaagatattatataagatcatacaactgtgtaaacttggccaacaggaggatacaagatttggtaacaaacacatctcatgctatatccgaggtggaccaacacaggctagaactaagaaacatgatgcactatcatcatcactataaaactgatctagattgcacctaagtatacacgaactctctaagtttgaattttatgatggccccttccctgctggtatatggaagatgctgcccgatcttgaagagaatgaatggcggaagtccataaactttatactcttacaatcgctgggggttggcgtcatgaacaatctttacaaccgctaa

SEQ ID NO: 45411 - DNA, 417 bp, Triticum aestivum
  unsure (1)..(417): unsure at all n locations
  Clone ID: PAT_TA_45411
cgttcgcgcgaccgcgcctttcccgtcgttatgggcgcaccaggtccgcggtgcggcgacccatggggacttacaccacgccatcgacctctcgctccggttgcccgccgacaacgccccatccaagacccggtcccacacacatatgctcctatatagcaggattacaagcacaggtcacaactttgaaacatgtacgaatatgatgatgactatgaaactgtttttgattccaataaagcatccacatactctataagtttcgaattatgaatcgcnnntaaccttctgctttctggaacttcctgcccgttcttgaagagtattaatggcggtagtccataaactttatactctccaattagctgcgggtaggcatcatgattaatctttacaaccgttaatctggcttaaaat

SEQ ID NO: 45412 - DNA, 349 bp, Triticum aestivum
  Clone ID: PAT_TA_45412
cgtccgcggacgcgtgggttttgcaatcaagagaagcacagaaatgaggagagcagctcggtggatgcatctcaatggaggaacatcaaacagcatgtgctaccttatggttcttcaaggccactaacccgcaagctttccctagacgcatcttcaagtgattcaagaggcatggaggcatcaacaagcatgtcatcagagagcacttctgtggtaatcaatgttcccaagttagccgaggttagggaaatcacaacgcttgattattgctaaatataccaactgaagttagatgattcatatctgttgttaatgacagggtgttggatttgggtgagtaactcatatg

SEQ ID NO: 45413 - DNA, 308 bp, Triticum aestivum
  Clone ID: PAT_TA_45413
cgtccgcccacgcgttcgcttcgcagtaccatcggctgcctgcgagattcccctccctcctccacccgctccactccaacctcgccgatctcccgccccgccccccctcctctcgggaagatggccgcggcggcgctggcgaacggggacgtgcgcgccggcggcggcggcgcggtgccgcggccgacgaacccgatggtcacgcccctgctcaccgacctctaccagttctccatggcctacgcctactggaaggccggcaagcaccttgaccgcgccgactttgatctttactttcggaagagccc

SEQ ID NO: 45414 - DNA, 377 bp, Triticum aestivum
  Clone ID: PAT_TA_45414
cgtccgcccacgcgtccgaaatcccaatcccttctcccgtccgtcttcccttctccatcccctcccttcctcaacgaacgaacgaatccaatccccctcgcccacgcatctcgcccctcctttcccctcccccgcaagcaacgacgggcagagagcggcgcggggatcgccggcggcgccgatgaggtcgacggactcctcgtcgcggttcgtgcaggagctggtgctgtacgcggcgagcgcggcgctcagctgcctcgtcctcttcgccggcctccgccagctcgaccccaaccgcgagtcctccaagaaggcgctccagcacaagaaggagatcgccaagcgcctcgggaggcccctcaattccaccaccccct

SEQ ID NO: 45415 - DNA, 364 bp, Triticum aestivum
  Clone ID: PAT_TA_45415
cgtccgcggacgcgtgggcggacgcgtggggccgatggtggggcgctggactaggcaggcaccgccgccgctcctgcatacccgggggcgagcgaggatgcaggcatggccgccgctcccgagggagtggatctaccactgctggtttcagtcacatcacctatgctataatcccacccatatacatggctgcctgaaggaggtgttcaagatgaatgggtaccgacaacagcgggcagatcaactacgaggagctcaaggctgttctggagcaggtgggtgcaaggtaatatccgactcttcatgttgatctgcccgctgctccccttctcctagatccacagaaggtgatctggctaacatg

SEQ ID NO: 45416 - DNA, 362 bp, Triticum aestivum
  Clone ID: PAT_TA_45416
cgtccgcggacgcgtgggctccgcccctctcccgtgctcgccctccgcaccgcaccgccgcgccaccgactcccggcggccatccaagatgttctactcgcaccagctcctcgcgcggaaggcgccgctcggccagatatggatggccgccacgctccacgccaagatcaaccgcaagcgcctcgtcaagctcgacatcatcaaaatctgcgaggagatcctgaacccgtcggtgcccatggcgctcaggctctccgggatcctcatgggcggcgtggtgatcgtgtacgagaggaaggtgaagcttttctacgatgatgggtgccggctcctgattgagatcaaccgggccttggaagatc

SEQ ID NO: 45417 - DNA, 385 bp, Triticum aestivum
  Clone ID: PAT_TA_45417
cgtccgcgcgcgtccttctcgaggctcctccggaaggtgtccatcgaggacgccaaggagtactccaggatgtcctacctctgcaacatcgcctacatgatccccaaaattcagccaaaatgtctccgccggtacagtttacagtttgtgacaacatcagtgcaagagaaggacagagctaatcctgataggaagcaggagcagagcactgagaaaggtgaatctccagataaaaaacctcgagttgtcaagaatgctgccgctgcgttgggcagcaaggaggaagaaggaaatggcctggcgataaacccttttggtgcataccaagtcatgtcatctgctgcctcatatttacatttccgggccatgggcattaatccctttg

SEQ ID NO: 45418 - DNA, 376 bp, Triticum aestivum
  Clone ID: PAT_TA_45418
cgtccggaaactttggttgcagcgaaggtcttattggtgacggtacattcgactgcagtgttgatcatgagaaatattctagcatgtatggacctacaactggtgataagattaggcttggtgataccgatctttttgcggagattgaaaaggactttgctgtttatggtgatgagtgcatatttggagggggaaaagttctgcgtgatggaatgggacaatccgcagggtatacagcatctgcctccctggatacagttataacaaatgctgttgtgattgactatacaggaatatacaaggctgatattggtataaaagatgggcttattattgccattgcgaaagctggaaaccccgagtcatggatggtgtg

SEQ ID NO: 45419 - DNA, 284 bp, Triticum aestivum
  Clone ID: PAT_TA_45419
cgtccgcggacgcgtgggcggacgcgtgggcgaggctggacgggggcgtggggaagggggtgcccaccaccaactacgttatgccgctcgacacgaccaccgggatgacccgcccgctcgtcgagatcctcagggacctcaacaagcgcgtacgcgacaagatcatatacccctacaccaacactttgccatggtaccatgccaacagaatgctcagcttttatgcaccaggttggtgtggtgaagctcgttatgttctttattacaacagtctatctgtgacc

SEQ ID NO: 45420 - DNA, 290 bp, Triticum aestivum
  Clone ID: PAT_TA_45420
cgtccgcccacgcgtgcgcggacgcgtgggtgacatttgctttgaggtctgtgatggtggtctgcacactgatgctattcacaggggtggaggtcacgacatcccaacagccaggaggggcatttacgcttctcagctcactgacaagccaaggctgctggagcctgtgtacctggctgagatccaggccccggagaatgcactcggcgggatctatggtgatctgaatcataagagagggcacgtgtttgaggagatgcaaaggcccaggaccccgcttgtcaacattc

SEQ ID NO: 45421 - DNA, 353 bp, Triticum aestivum
  Clone ID: PAT_TA_45421
cgtccgctcgtgttgcgcaggagtattggctggattgtcatcctggagagaggaggagaaggacaaagatggcgccatggaggacaatgaggacggcgccgtggacgacgaggccatccgcagcaacactgatgggttggctggctctatgtccatcgtcgagtaggaactaggaagaaggcagtggaagaccgtttaattgtactggcgcttgtggcctgggccgcagttagttcagcgttgtttttcttccttctttatgtttccgtggaacctgtcgattcttctgattacaagttttgtgttgaataaaatataaataaggtggtcttacccttatcattgtgtaaaaa

SEQ ID NO: 45422 - DNA, 375 bp, Triticum aestivum
  Clone ID: PAT_TA_45422
cgtccgcccacgcgtccgggctaggagggcaacgccgtcgtgcagcccccttccaagagagccacgcccaacccctggtggtggtgcaccgcacggcgtccccagctgcactgaggtgttgcttcgggcacggggtcgagctactgctgctgcttgcatggcgtcgagccacggaggagcggcgtcgagctgctgtggctgtttgcacggagtcgagccagggatgagcggcgtcgagctgctgtggctgcttgcacggcgtcgaggagctgccgtcgagcagctgcggagccaagcactcccgttgcagtccgtcgggctgtggatagggcgccaccgtgccgggcggatggcaacagcgtggcggcggcgcgt

SEQ ID NO: 45423 - DNA, 302 bp, Triticum aestivum
  Clone ID: PAT_TA_45423
cgtccgtggagagagagatagggagagcaagaagaagaatgggatggcgatggcgccgccgcgtctgctgcggggcctcatcgcgccgctgtcgccactccaccaggagctggtgacctccgccgccctactgcaccgatggtggctggcgcgcctccgctgctccgacggattcaagctcttcctcgtcgttctcctcgtgttcggcgcgcttgcacgggtccgatacgtcggctacgcgtccatggcgcccaccgttcgtaccgtggaccgctccggcccagaaaaggtgagctacatgt

SEQ ID NO: 45424 - DNA, 436 bp, Triticum aestivum
  Clone ID: PAT_TA_45424
cgtccgcggacgcgtggggcagacatcaagctgcaagtcgagagatggccatgtcggacgccttgcccaacgtgctcgaagatggcgacctcctcatcgagatcctcctacgcgtcggctctcccaccaccctggtgcgcgccgccatagtctgtaagcgctggtaccaccatgccttcgatcctaggttcctccaccgttttcacgagcttaacccgcctcgcctgctcggcttctacttccaggccatgagggctcacacggctccacgtttcattccgatgctgccgcagcctgcagagctggcctccgtcatccgtcatgaaagtttcagcctggagagctaccacaatagcttcgtcatggattggcggaacggctgagtcttaattctggtcaacagcggaacctaccaggcacttcaagtgcatagctt

SEQ ID NO: 45425 - DNA, 134 bp, Triticum aestivum
  Clone ID: PAT_TA_45425
cgttcgcggacgcgtgggctctcctcttcctctttcccgatgctcgaagccgtccgtcggcgtctctgtgcacccagtaatgatggcgtaccacatcggcgggtacgcacgcgtgctccctaagagggagctca

SEQ ID NO: 45426 - DNA, 305 bp, Triticum aestivum
  Clone ID: PAT_TA_45426
cgtccggtgacgatatctggagcgaactctaaagaagcgttacttcaaatatggctggaagtgagggcacattggccttattcattggaagaaaaaggtgttttgcttgcgccggcgttttcatagactgcaatgggtccaccacaagagttctaacttctgcaagtgtggataggacttccgatgatgaaaacactgctgctgataacctgaagattgtagtgtgccttacagatagtcgacgtaccacagggacattgcagcattacagtttacattatcacattgctgtcgttcacatcatg

SEQ ID NO: 45427 - DNA, 305 bp, Triticum aestivum
  Clone ID: PAT_TA_45427
cgtccgcgtgaaccaccccgagttcccgtcggtgacggtgaggcccggccaggtgtacaagcacgacatgcgcttcactttctccttctagctaggctggactatggctgcgctatggtagtagtagtgccaccattggttaatggattgtagatgtgttcattctggatttggaggtggcgcgattcgtgggactggatgctggtatgccgctgagaccatagcggctaccgtgcttgaaaaataaaatcatgcgtttgtgcagtgcaaacgataatatgcaaacgttagccctttaacgctgc

SEQ ID NO: 45428 - DNA, 360 bp, Triticum aestivum
  Clone ID: PAT_TA_45428
cgtccgcggacgcgtgggcggcttcacgcttgaccccatttccagtgctcaggacaagcgtgcaggaactcccatacatgcagtatccggcagcaatcatgtccttcccaggctgcagtacttcctccagagtcacggtgtcttggttcttggtccatcgtcgataaaaagatcagctgggacaggcgcacgtacccccatcaaccatcgtcgcttctctcatctttgccatggccacggccaacaactccccggccgtcgttaataactatggcctaccggcgacgtcgtccagatcctccacggagagcttcaccgccgcccacgatttcgaggtggccaggtacccgctgctcgacg

SEQ ID NO: 45429 - DNA, 216 bp, Triticum aestivum
  Clone ID: PAT_TA_45429
cgtccgcgcacgcctgctcgcaccgttggcgacgtctccttacgtaggagcttccctactcgcaagcgagatggggaacatcatgaaccagaggacatgggcgtactacaagcgtttccaagtcaagttcaagagaaggcgccagggcaagactgactacaggtccaggctgaggctcacaaaccagtacgagaactagctcaacactcctaagta

SEQ ID NO: 45430 - DNA, 282 bp, Triticum aestivum
  Clone ID: PAT_TA_45430
cgtccgcttgaagagaagagatggacggatccaccgtcaaccgactcgtcatcctcttcctccttgtacttggcctcgccaccagcaacagcgagcatggacacgcaggagccgttgatgcggtcaacgttgtcgtcgtccgggtccggttaatcggtcgcggtccggatgacaagaccaccgtggttgtgcagagacacgaccttttcttcgccggctttaccgacggtagcggccattggttcgccttatctggtcttgtgcttttttttcccatgttca

SEQ ID NO: 45431 - DNA, 298 bp, Triticum aestivum
  Clone ID: PAT_TA_45431
cgttcgctggtctgcgtacgaacagacttttatcttcagccgacagagctgtaattccccggaacgcgccgtgcagtcaagatgggcgaccataacctggtggagaaggagacggcgctgatcgagcaattcaagatcaccgggacggaggtggtcaagaagatgacggccgccatgagcttcatgagcttcaagatgagggagctctttctggggcagacttccgccgacaaggtcgttgaggacgccacctacgagactctgggggggcccgactgggccatgaacctggagattt

SEQ ID NO: 45432 - DNA, 383 bp, Triticum aestivum
  Clone ID: PAT_TA_45432
cgtccgcagctctatatccctccacctcctacgccatgtatcagccatctgtcctttcttgaagctgctgctcatccaagtggccacctgatgttgccgagcgaaccatgctcactcgcgccttcgcccaccagtaccaggattttctcgtgtctttcaagttgaataccggggagatggaggagatggtgccatggcgggctactatggtggtggcagttgggcctatctgaagagcaataatgtaatgcttttgagcttaagcacatgaagttgtatttaaaagcggacgagatgatgtttgtcaacaccaaactgaaaagggatgtgaaacaatactggaggaatttggatctaatgcaagggtcatgagatctatgggg

SEQ ID NO: 45433 - DNA, 252 bp, Triticum aestivum
  Clone ID: PAT_TA_45433
acgtacgcccacgcgtaacggccacacgttcgatcaagatggccgtctatggtggggaatcatcgggaggtgaaggctgcagcactcactcatgtttatttaggcctccgagctctaaatcctgcaaatctacgcaggaacccgtattaaaaaactgagaggcgcctttatagtttccgaacgtctattgagtgatcaataaagcgaacaacacaccccttgttcctgatcgctaaatcctcaatgaaaaag

SEQ ID NO: 45434 - DNA, 372 bp, Triticum aestivum
  Clone ID: PAT_TA_45434
cgtccggaacgctccaggcctctatctgtttgatctcgcgtccgacgggcccatcctagtacacgactgagccctgcccgtgctcgctcattcgtcgcctccctaggattgatccaccgcgccggcagcatggcggatcagatcaccgacgaccagatcgccgagttcaaggaggacttcattctcttcgacaaggactgagaccgtttgatgaccaccaaagagctgggaacagacatgcgtacgctgcggcataacccaacgaaggctgagctccaggacatgatcaatgaagtccatgctgatgagaacggcaccattgacttcacaaagtttcttaacctgatgtgccgcaagatgaaggacactgac

SEQ ID NO: 45435 - DNA, 423 bp, Triticum aestivum
  unsure (1)..(423): unsure at all n locations
  Clone ID: PAT_TA_45435
ccgttccgagccacgacgccacgctcgctcgcacccgtcgnttgctcgctctccctatcctctccctcgccggcctctcctctccggggccggccactccctttcctcgtctccgcctccctcctctcctcgtcgccggcctcttcctcttcccgtcgccggcctcttccatcgcccctttcttcccaccaccccgccttcactcacaccggtaaaaaaaattgattctttttgcgtcttcgacgagcttctctgcgacggaggcatggatgtgtagcggccagagttggatacgggctaggaggcatgaatgtggactggcgcacaagcggacctagagcggcagcggagcagcggaacggcgccggagcctccacgtcgtcgtcgtgcacatctcgtcgttgtcctcacacatcgacgcat

SEQ ID NO: 45436 - DNA, 238 bp, Triticum aestivum
  Clone ID: PAT_TA_45436
cgtccgcagcagctagccagctacccctgcttgctttgctttgcttccccgtcgaggaagaaggagatggggggcgtgggcgtctcccttgcgctgctcgccgccgtcgtcctctccgccgctgctgttgccccgcagcttgcgggcgctgccatgtctgaccattccctatgtttcctccaggtcggcatttttcagtcggtcaacatgggttcctttgcccttttttcggcttttt

SEQ ID NO: 45437 - DNA, 171 bp, Triticum aestivum
  Clone ID: PAT_TA_45437
cgtccggccaacaccattgattcgctagctacagtatctgcagataagcaaacgatcgatccgtgcaagatggacaactccggcgtggatcctctaacgcggaacctacactccgtgtctgagccccacatatctatcgggtttttttttatttacaaacaaattcctttc

SEQ ID NO: 45438 - DNA, 383 bp, Triticum aestivum
  Clone ID: PAT_TA_45438
cgtccgcggacgcgtgggttcaaggtgacacagacaggttcacttcgtatgggaggatgggatatgttcacatcgacgacgttgcatggagccacattctagtgtacgaaacacccgaggcaagtggcagatatctgtgcagttcagtggttctggataacaatgaattggttggcttactcacgaagcagtttccggtattcccaattccaaggaggctcagtaacccctatggaaagcaggcgtatcagctcaacacatccaagctccaggggctgggtctcaagttcaaaggagtgcaagagatgttcaacgactgcgtcgagtcgctgaaagcccagggccatttgctggagtgcccgttgtgaatatagagacaacac

SEQ ID NO: 45439 - DNA, 227 bp, Triticum aestivum
  Clone ID: PAT_TA_45439
cgtccgatcgcctcgcgcccgcaccccaagaaggtaaggtcaagaggcttttctgagaagctcaaatgggtcccaaagtgtgctgttgccaaaaagggcgataccaatgcccaggccgtcaaggtttccaaagctgttaattctgtgtcaattaagaagacggcaaataagatcctcacttttgcgacatattatccggcccaagaccctctttttggccttggacc

SEQ ID NO: 45440 - DNA, 300 bp, Triticum aestivum
  Clone ID: PAT_TA_45440
cgtccgggggagccttcccaggcgaccgactggtcctccctccctccggacatcacccgggtcatcgccgagcaactgctggcggaggacgtgacggattacatgtgcttccgcgctgtgtgctcgcactggcgtgccttcaccaccagcccctgcgatctcacgctgcaggaaacccgcttccgtcctcgcgggtggggcgccctctgtgacggcgatggcgtacgcccagctgatgcctgcgagatcaccctgtttcacacgttcaccagcaggcgccttcatgttcggttgttctat

SEQ ID NO: 45441 - DNA, 274 bp, Triticum aestivum
  Clone ID: PAT_TA_45441
cgtccgcggacgcgtggggaaaggggatcgccgccgccgccgccgccgtcgcccaggatgacgtggatgctgtccgcgttctcctcttgtttctcgaacccacgccttatcccgctggcccgatatccacatgctcaccatctccaaccgcctcaagaactactgcctgaggtacgacgacctctatgacccctacttctatctgtacatcaagtatgcgctcttcaagctgcccctttttgttggccttctccttttcttcattattttttta

SEQ ID NO: 45442 - DNA, 298 bp, Triticum aestivum
  Clone ID: PAT_TA_45442
cgtccgcggacgcgtggggttgcagtgctctccccctccagccccctcgcgccccagccgacgcggccgccgccgtcgccgtcgccgactgcagcaatgtcgctgatcgcggtcgaggagttccagcacatcctgcgtgtgctcaacaccaacgtcgacggtaagcagaagatcatgttcgcgctcacctccatcaagggtgtgggccgccgctttttcaacatcgtttgtatgaaggcctgcatctacatgaacaagagggcctgatagcttttcttggattgaattggacctgctt

SEQ ID NO: 45443 - DNA, 413 bp, Triticum aestivum
  Clone ID: PAT_TA_45443
cgtccggtcacaacccagcctcccctaccatcagcacctacccgaagccaagaagcaccttccggccctgcaccacctggccggcgagaaccaccagccttcccgaccccaacaccgacggatcaggcgatggcagtggaggccatggcagagaagaacaccggcgccggcgccggcgcggctggcggagtagccccggagagcggggacaggcgctcccgcttcaggcggatctgcgtctactgcggcagcgccaaaggccgaaaggccagctaccaggacgccgccgtcgagctcggcaaggagctggtggagaggggcatcgacctggtctacggaggaggctccattgggctcatgggcctcgtcttccacgcagtccatgatgggggacgccatgtgattggggtcat

SEQ ID NO: 45444 - DNA, 177 bp, Triticum aestivum
  Clone ID: PAT_TA_45444
cgtccgcggacacgtgggtccgtctgcccctcgccgtctacccgatgaccttaaccagccgccggcgaggtggcccttaagcgaggcgacaaggcacctgtcccgtcgaaaaacaaaccggtcaaggcgaccaacccggtgctctagaagaggacgaacaccttcgccatcgccggc

SEQ ID NO: 45445 - DNA, 174 bp, Triticum aestivum
  Clone ID: PAT_TA_45445
cgtccggtgcacatcatattggaatagcagttgccacagcgtttcattcctatgtgcccccacacggagccgcttccgttcataccaattacaccacccttcatcaaattacatcttagtctatattttctcacactcgcaatgttcttgacaataataaccactctccatttt

SEQ ID NO: 45446 - DNA, 183 bp, Triticum aestivum
  Clone ID: PAT_TA_45446
cgtccggccaagaccaactgccaggccaccgtcgtcgccaggctctggggggacggcatgctggacctcaccgacgtcagcctcgaccacaaccacccgctgaacccctccgcggcgcgcttcctgcggtgctacaagacgctgcccagcgggatgagcaaggacctggtggtgaggtccgcc

SEQ ID NO: 45447 - DNA, 394 bp, Triticum aestivum
  Clone ID: PAT_TA_45447
cgtacgcgaagaggcgtccttgcccagtggtcctgcacatgcaaagtcagatcagataagtgctagtaatttattggctggtctttttaagggtggattcataccaaacacaagtgatcatgctgtcccacattcacatgggttggcatctcttccatcttcctcggccagcgaaaatgcccctttgaagcctcatgcaccaaactctctccgcccacctttgccaccaggtccgccaccaacacacagtgctgagaaagctgctgcaccactgtcaagtcttctcagttctctggttgcaaaggggctaatttcttcaccgtccaccgattcggctgctgttgcaagaaagcctggtaaatcaagtccgagcacatcagatgtcagtgcttca

SEQ ID NO: 45448 - DNA, 413 bp, Triticum aestivum
  Clone ID: PAT_TA_45448
cgtccgcaccctcacccgcctctacctcggcatgtggaggttccccgacacggccggcctcccgcgcgccacctgcttccgcaatctccgtgacctcggcctctacaacgtcctggtggagagaagggatctggacttcatcctcgacaggagccccgtgctggagacgctctgtgtccagggcaatgtgctcaagcttcgcatccggctcgtcagccaaagcctccggtgcgtgcagatcatcgggtgcttcatcgaagagatcttcgtgttggacgccccaaatcttgagcggttcatctattcagatgcttggcaccctgttggcaactgcaccaccacggtcaagatcggccatgcccccaagctgcacttgttgggatacttggctttggacccacgaaagcatgtcc

SEQ ID NO: 45449 - DNA, 145 bp, Triticum aestivum
  Clone ID: PAT_TA_45449
cgtccggtcattggtgtgctgcacatacgcagctgtcggagggcatcttgaggtttgcaaatactgggtggaggaactcgggggagatgtgaatgctcctgctcctggagtaggagactttgcaggtgatacaccctttatgtca

SEQ ID NO: 45450 - DNA, 347 bp, Triticum aestivum
  Clone ID: PAT_TA_45450
acgtggtcttgaggcccgtcgaaggggggagtaaggtccgctttaccctactccttacttctgaaaaccctcgcattacataccttaattcaaggctcccttctttacattgctctttttccataattctctttttttatcagattttttctctatattcttttacatatctccttttttaatccctattttctttttttttttattattatattttatcttattctttttattttatgtattatctttattatatgttttacttactcctattatctttttattcttttaatatttttttctctatttatttttatatttattctctttgtttttatatttatttt

SEQ ID NO: 45451 - DNA, 403 bp, Triticum aestivum
  Clone ID: PAT_TA_45451
cgtccgccgcgactcaagtctccaaccaaattcccttccgattcctccactcctctcgccccccgagggacactccccaaaccctagctctcccccctcccgcgtcgtcgcccccgcgccgagctcgagcgccgcagatgggctccgactccaaggagctgctcgggatcgagcccctcgagctgcgcttccccttcgagttcatgaagcagatctcgtgctccatggagctcaccaacaagaccgacgactacctcgccttcaaggtaatcggaatcaaattgttcccagccttcgtcacagcacgcagctctgcgattgtgtacaaagtgtctgaatttgatgccgcatttggtgaaatggcgcgcctcttagggcaagacgaccagccccaagatgtact

SEQ ID NO: 45452 - DNA, 186 bp, Triticum aestivum
  Clone ID: PAT_TA_45452
cgtccgcccacgcgtccgaccacgcgttcgagaatagctgtcccgatcctcgatctgtcgtgaagcctccctccgtccgtagcagctccagatttccttccccatggctccgatcaagatcgggatcaatgctttctgccggatcggaagccttgtgctcaggccctctctccacaggcccaatgt

SEQ ID NO: 45453 - DNA, 412 bp, Triticum aestivum
  Clone ID: PAT_TA_45453
cgtccgcccacgcgtccgcgccgccgtcgcccgcgaagaagcccctgccaccggagatctcccgacctctcccctcgccgcccgcccggagatctcccggcctctccctccgccatcatgggtaagacacgtggtatgggagccgggcgcaagctcaagacccaccgcaggaaccagaggtgggctgacaaggcatacaagaagagccacttgggcaatgagtggaagaaacccttcgctggatcgtctcacgccaagggcattgttttggagaagatcggtattgaggccaagcagcctaactctgccatccgtaagtgtgctcgtgtccagctggtgaagaacgggaagaagatcgctgcctttgtgcccaatgatggttgcctgaacttcatcgaggaaaacgacgagg

SEQ ID NO: 45454 - DNA, 409 bp, Triticum aestivum
  Clone ID: PAT_TA_45454
cgtccgcggacgcgtgggttatattacaggaggccagtgcaattccctttgctgcgttgactgcgtggcgtgctttatatggtactgctggaatttctaaagggtatgttctattgcacaccacagtttgacaagttgcctttgttgctgtttcttgtgaattggtcgcacattggttgatttactgaatattgttaatatggccactatttactgctatgttcatgatctaggtatgtatgcattagatggtttctgaattatgctgaatttctttagcagttatgtttgtgctccccccatttgcgtatttagcaacttacccgaaagcatgctactggcaaaagttaactcattggagttttaagaatatttgtaaattttgcgctacagtaccttcccggttttt

SEQ ID NO: 45455 - DNA, 404 bp, Triticum aestivum
  Clone ID: PAT_TA_45455
cgtccgctttgcgccggcgtggggacaatactggcccccaacgtcgccgcgctcaccggcatcggtctctcgcgctctgacatcgcgcgcctcgtcttggtcgccggcaaccagttccgccgtagatccatcgtcaccaatctacactactgcctgtgcatcttcgggtcctacgagaatctcctcactgctatcaagcgcaaatcctacattctcatgtccgacctcgagagggtggtcaagcccaacgttgggctcctgcgagagttcgggcttggtccttgtgatattgccaagctgtgcgtcgcccacccatggctgctcacctgcaacgtaaagcgtatccgggcgacggtgttgcgtgtcgatgttctgggtataccccgatggtctgggatgttttg

SEQ ID NO: 45456 - DNA, 258 bp, Triticum aestivum
  Clone ID: PAT_TA_45456
cgtccgaaccacactgatacaaacagtatatctacgttggaagagtactccaagccactaatggaggtcctcattacgctgggcgagaacgagaaggctgttttggccggtcatagttgtacaggtgcgcagcctgtcatatgccgcggaagagtgcgccccctcgacgtacaggacgtatatgcttacccacacaacggacaacgctcgccactggcccttctacgcgttctctgtagagctcgagtgcacccatgt

SEQ ID NO: 45457 - DNA, 404 bp, Triticum aestivum
  Clone ID: PAT_TA_45457
cgtccgctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctggtgacaatgtcgtcttcaacgtgaagaacgttgctgtcaaggatctgaagcgtggttttgttgcatccaactctaatgatgaccctgccaaggaggcagccaactttacctttcaggtcatcatcatgaaccaaccttgtcagatcggcatcggctacgccccagttgtggactgccacaccttccacattgctgtcaagttttggtgagctggtgacca

SEQ ID NO: 45458 - DNA, 374 bp, Triticum aestivum
  Clone ID: PAT_TA_45458
cgtccgcctctttctctctccccgatctagtttctatgatttccaagggtgctgctcgggtcaatggataatgaagaactatatgaccaactttccccaactccaacatctgctactaacaatctacctgagcaggctgtaaaataactaataaggagaccccatggttgttcgcttatttggattgcgacttctttgaaaagaagagggcactttggtacctgagatcaaagaggagggtgagaagggtgagaagaaatgaaagaggaagaagaggaacaagaagagcaaggaggacgttgccggtgacaatgtggggaggtgcctaagttcctcattttcaagcttttggccggctcgacttgatgcgggcc

SEQ ID NO: 45459 - DNA, 121 bp, Triticum aestivum
  Clone ID: PAT_TA_45459
cgtccggctataactccgatcaattgtcaagggtagcatgaggcgcaccatggcgccgtcacgggccaagtcaatgctcttccggggcatcaacaaggtcctcgtagtcacccagtgcgag

SEQ ID NO: 45460 - DNA, 271 bp, Triticum aestivum
  unsure (1)..(271): unsure at all n locations
  Clone ID: PAT_TA_45460
cgtccgcccacgcgtccgcggcgaccagactaacacnatcaccaaggcgatggcgactgctctgaaccgggggctccgctccgggatccgcctcctagccaccggcgccgaggccttcaagccagcttcacgtggattccatgctaccggggtgaagaggatgtcagggcacgggccatgatgagccatactaccttcacgccaagcacatgttcaaccttgcacagggtgaagccatataatgctgacttgcatggtcttttggtgctgg

SEQ ID NO: 45461 - DNA, 191 bp, Triticum aestivum
  unsure (1)..(191): unsure at all n locations
  Clone ID: PAT_TA_45461
cgtncgaccacgcctctttcgaaaaccctagctctcgaccccgacgctnnanggncgttcgagtggtctttttaccgccgtcatcgcctcatatgcggacatggaagaatacggtttctagtattctgtacgatagccggaggagcaagatttttatattgagaactatggactacaacttcaataggtat

SEQ ID NO: 45462 - DNA, 194 bp, Triticum aestivum
  Clone ID: PAT_TA_45462
ccgtttcgacccacgcgtacgcttgaccttatccccgcgccccaggaggtctagggccccatggactcggagatcggcgagatggagggcaacttctgcgtcgcctgcgtctaccaggccgccaaggaagtggccctgctctacatgcgtcccggcgacagtgccgaccagttcacctgggcctgggcaggcca

SEQ ID NO: 45463 - DNA, 403 bp, Triticum aestivum
  unsure (1)..(403): unsure at all n locations
  Clone ID: PAT_TA_45463
cgtnctgacgcgcttntcagctcggctctgcctctcttgatctcctctccaaaccctaaccctaaccaccagcctccactccctgtcgcgccgccgcctccgctccctgccgcgccgccgcctccgcttcctgccgcgtcgccacctctgctcgccctcgggtcgtcgcttccgctcgccctcgcgtcgtcgcatcgcctcctcctcctcgccatctcggtgctcaccgggaggagcacggctcgccaccgcagctactccgcgtcgctgctcccccattgagctcgtgcgtccccatcgcctggagaagcggaggctgcagctcctgcatctgctcggccctctttccctcgtcagtgagcggctcatggcagtttcagatccactgtgcagcacatgttgt

SEQ ID NO: 45464 - DNA, 258 bp, Triticum aestivum
  Clone ID: PAT_TA_45464
cgtccgcaaacacatgtcatttagcaggatccgcacccaagcacaacttgttgcagggcctagccttttataccaagcgatcccatcacagccactattgaagagaaactgattgtaagcgactgaagagatggccatggcactaactgctaggtccaacacaaccttggtgttctggtgcttaatgcttcagatggcattatcccctaccatctttgctgggggtgggaccacttaaactcattcttcaacgccacc

SEQ ID NO: 45465 - DNA, 358 bp, Triticum aestivum
  Clone ID: PAT_TA_45465
cgtccgtagaaatagtgaattagttgctatgggcatatcttttccagtagaacagggagaattagaatgagcgatctgctaaatacgcgagaaagggcgaacaccctgtaagcctaagagtcaattaatggccgatatggagctggtgccgagggggaaagagtgagagcgaactaccaactggctggtgctatagataacccgccatcacaggctaacggtgaagcatatgaggcgcctagcgtcgccctacattatagcagaggaccatttgaaggctgagcctgtgaggtaatgagcactggggcttgaggcattatgcgttggcgcttttgagagggggcagaataacttagat

SEQ ID NO: 45466 - DNA, 404 bp, Triticum aestivum
  Clone ID: PAT_TA_45466
cgtccggcgcgcctcttcccgccaaattccggcctcggatccgctcggattcgaccgggcggagtctgggggctcatctgtcgccatggcggaggcgacgctggaggggagcgagccggtggatctgtccaagcacccctccggcatcatccccacactccagaatatcgtgtcaacagtcaatttggactgtaagttagacctcaaagcaatagctctgcaagcacgtaacgcggaatataatccaaagcgttttgctgcagttatcatgagaataagagaaccaaaaactacagcactgatatttgcgtcaggtaaaatggtatgtactggagcaaagagcgaacagcagtccaagcttgcagcaggaaagtatgctcgtattattcaaaaacttggctttc

SEQ ID NO: 45467 - DNA, 233 bp, Triticum aestivum
  Clone ID: PAT_TA_45467
cgtccggccatggtggccttctgcgggctgcgcgcgagccggttccgtgccggccgcgccgtgctacccaagtggttcatggaggacgtggtggttgaagggttcgaggccatgaggatgagcggcgccgctggcgggcggagagtgtgcgtgacgaggcggttgccgagagtgatggtggaggggctcctgagggattacctcggcgccgaggctgtagtcgtataggatat

SEQ ID NO: 45468 - DNA, 290 bp, Triticum aestivum
  Clone ID: PAT_TA_45468
cgtccgcccacgcgttcgcagatctcaagctcagggggcgactcccgtctcatctcatcggggctcggggcaggtccagggagggggatggactccaatcagccgtcgcagccgccggcgccgtttccttatgcagaagatgccgtcgtctccgtctataatcatctgtctttcgaggcgccgccacagcctgtgagtgaggagtactttcaaaatgccttcaagtttctgttccaccccaaggtcaggtgcttcttctttatctaacgcttctcttttctctagaacta

SEQ ID NO: 45469 - DNA, 402 bp, Triticum aestivum
  Clone ID: PAT_TA_45469
cgtccgcccacgcgtccggtggctgcctccgccgtcgcctcctcctcccttccccaatggcaggcgccagcctcaggcagctctgaccgccgcgcggggccttgatccggcgccaggcgggcgggaatcgcgcgggtgccccgttcaattcggcgcggactccagctgggaggtcggagtagcggagatccggtcgccggacttacctccaatccgctggtcgccgtcgtctccgggagacaattcgaggaggttcgttcgccggcgcgtgctgtgcgcggtctcgtggatctgtggctcggcgacttgtgaccgggtctttgccggaggaaagggggctgctttggacaccgttgttccctaggtgtttgtccccataggggcgaccagttcaagagagcg

SEQ ID NO: 45470 - DNA, 154 bp, Triticum aestivum
  Clone ID: PAT_TA_45470
cgttcgcggacgcgtgggccgcgcgcagtcttatggtggagcacgccgtccgccaccttcggcggcgggttctcgttttcggctggttcttctcctttttcggtattccttccaggcactgaacattgtcttcactcctaccggactttttttc

SEQ ID NO: 45471 - DNA, 306 bp, Triticum aestivum
  Clone ID: PAT_TA_45471
cgtccgccgtcccgtgcgcactcctggtcgtgtccctcgatctcctggtggatgcctcgctggagccggaggcccgcgccgcaaccatgcctgcgttccgttctaaaggaggaggcggagccaaacccgtcccctaagccatcgaccgccgagcctgtggagaccgtggtcgactgctatgtccgtagacaatggcgtctactacatctctaaggaggagttctgtgtgagcggatctgatgatacggtcggtgaggactttaaggaggaaagtcctcttagaccaaggtctatgatattgatttc

SEQ ID NO: 45472 - DNA, 364 bp, Triticum aestivum
  Clone ID: PAT_TA_45472
cgtccggaaagttgagattttcccggttaagaatacgagcctacagcaggaaggtgcgcgtgcgtgccggtgcgtgatcatgaagccgcgtgggcttccggcggcggcggccggtgtgccggcgaggctccgcccgcaccttcctcgggtcacagccttcctgattgtcttctccgtcggatactcgctcggcatcgtctcgtcgtccacccgcccgtccacgcccaagccgtcgcagacggtcatacggccgcacgccgcgcacctcaccgcggcatcctcgagcggcgtcacggcgtcgtcgaacggcacgggcacgggcgcggcctacccgcggtcgccggcgcacgaccctgtccggttc

SEQ ID NO: 45473 - DNA, 366 bp, Triticum aestivum
  Clone ID: PAT_TA_45473
cgtccgcggacgcgtgggcaccgcacgacagacagcacgaggaaggcgagccaaccaccaccgccgcgagactagcaccacgagcgagctcggccgattccgattccgtctgcgctattaaggtttgtttggaggaaggggaggaggttcggaggtggagctgatagagagaccggagggcgtggaggccggcaggaagaaggagaccatggagctctttccgcagagcgccggtctgcaggacgccgccgcccctgacgctactagggaggaagacaagagcctgctgaccatcttctatggtgggaaggcgctcgttgttcatcgatttcccagccgtcaaggcccagggcctgatgctgttgg

SEQ ID NO: 45474 - DNA, 404 bp, Triticum aestivum
  Clone ID: PAT_TA_45474
cgtccggcaaggccaaaaagaagaaagacccccatcagcagacagatcctccatcaatccctgtggatgagcttttcccttcaggagattttcctgagggagaaatccaggaatataaggatgataatttatggagaacaactagtgaagaaaagagggaacaggaacgactacaaaaaccaatgtacaattctgttcgccgagctgcagaagtccatcgacaggtacgaaagtacatgaggagcattataaagcctggaatgctaatgatggaactatgcgagactttggaaaacatggttcggaaacttatcaaggagaatggactgcaagctggcattgcctttccaacaggatgctcgttgaattgggtcgcagctcactggactccaaattctggtgat

SEQ ID NO: 45475 - DNA, 395 bp, Triticum aestivum
  Clone ID: PAT_TA_45475
cgtccgcggacgcgtgggctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtcgacgagttctttcactgtgttcaccttgtcttatgggagaaggagaatgtgtccagtgaggcttttgaggctgcccgtattgcttgtaataagtacatgaccaagcatgcaggaaaggatgccttccatctcatggtcagggtttacccgtttcatgtgctccgtatcaacaagatgcttttgtgtgccggggcttataggc

SEQ ID NO: 45476 - DNA, 404 bp, Triticum aestivum
  Clone ID: PAT_TA_45476
cgtccgcggggctccatcgaaatgtcaggcgactcatataagggattggggaggcaaaatattacacaacttgggaaggtagaaatcacgcgagagttgcgctcttggggagggcaaggattgctgggcgcttgatttctggaaggggattcgtgagggaatcgctgatttggattttcgggaggcaaacaagcagcctcgagcatattccccatgccagatgaagaggaggatggtggagggaaggaccagcgctggtggtggtcgtatggcaagggcgattggtggagggaggaaaagagtaaggcgactgcttccttctctcgcatccgctttctcgcccgtgttaccgtgccgtcaggaggactccgacagtgacgattccagcgaagcatcagcggaag

SEQ ID NO: 45477 - DNA, 379 bp, Triticum aestivum
  Clone ID: PAT_TA_45477
cgtccgcggacgcgtggggggacattaaggactaatggtcaacacttaaatcttgctttatattcagttcagttccaagtagtctgatacatagatggagatgtgagtgctgatttggggttgattttggtaattatatattttccttgatgactgtcattttgttgtcctacatgtgccatatgatatgcataacaacttgacagcacctttgctgctcttgatgtgcttcgtcatgcagctttttatagtgtacaagcaagcttgcgagtgatgacaactactatgacctacaaaccttgaatcaaggtttttggggttgaacataggggcactgcgcgcttttcatttagcctgtgaagcttatgaatggtaaagt

SEQ ID NO: 45478 - DNA, 232 bp, Triticum aestivum
  Clone ID: PAT_TA_45478
cgtccgctcacgcgtccgaccacgcgtccgaaaaaaaaaatactttaatctacaacatacaaaaggagcagcagacaaatacgaactgagacaaataaaaaaagtaatataaaatgccatgaacacgagagaagatgcgaagtaaaaggggggggcgcgttttagaggatcaaacgttaccttcgctggcttgagcgagttgtagattttttagtgggcaacctaatttaaa

SEQ ID NO: 45479 - DNA, 396 bp, Triticum aestivum
  Clone ID: PAT_TA_45479
cgtccgcggacgcgtgggtccgtctcctcgccagcgttatctagcagtgagcagcggggcgcgtgcggtttttgtgccgagagcgactcgtccgacttcggcaggcgccttctgatcaccaccgtcttctcctccgcaatggcgaacaggggagggaaagggtcctaccccccgttcaagtcaggagcaccgaacggaaggcagaacaattctaatgatggtattcacctttctgattctgattctgattctgatgattattctgaagaagaggctccctctcacacactccaagtcaaatgggtaagcttcatctgacacgtctaaaatctgttggaaagggcttatccttttctaatggagaatgcttcataggagggaaggtatttattgctt

SEQ ID NO: 45480 - DNA, 300 bp, Triticum aestivum
  Clone ID: PAT_TA_45480
cgtccgcggacgcgtgggcggacgcgtgggcggacgcgtggtcttgaattccaaattcctacacggctccggagtccctccatggatgccgcccaaaaccctaggctgaactgaaccccttctcgggacgcggccatggcggagccggccctccttgaccccgccttctacttagaccttcggcactacccggccgggctttttgtcccggacctctccctagcggacgacgacgaccacaggctgcccgttcggaatttcgggattgggcttggcgcggggcggtgactgcgacgacct

SEQ ID NO: 45481 - DNA, 375 bp, Triticum aestivum
  Clone ID: PAT_TA_45481
cgtccgggaaccctaaatcgatcgagttcctcccatccagcgatggccctggcggcgaccacaaaaaagaagaacaaagcaatggccccggcggcgcagggggagtggttcatcatgtacggcattcccaaggtgtcgggtgagatgagcaaggaattccccaatgcggccttcaccttcaacgaggttccgctcctttcccacctaaccgtcccgggtaacgtcgctacccccgccggaagcgtcgactacccgtacatcgaagctaccgacgactgcggccttctgctgctctgcggttacacctttgtcgggctcacctactacatttgcgacccgtattttcgtaggacgctgggcattcttccccccgac

SEQ ID NO: 45482 - DNA, 300 bp, Triticum aestivum
  Clone ID: PAT_TA_45482
cgtccgggaggagagagcaggcgagacacaatcccgccactgaaaaaagtctctccctctccatcctcctcgtctccggccggctgcggcggccatgggcgctcctctgtcctcctggccgtgggcaggcctaggcgcatacaagtacgtgctgtacgggccgctggtggcgaaggtggcgcaggagtggcgggagcagggcggcgcgccgacggactcgtggtgcctccacctgctgctcctgctggcgctccggtcgctcaatcaccaactctggttctcctaccgcaacatgctctt

SEQ ID NO: 45483 - DNA, 122 bp, Triticum aestivum
  Clone ID: PAT_TA_45483
tccgaattcccgattcccagcccacgacgccacgcgttagcgaactgtttcgagttcggagcaaggaagggagcggtgtgcgccagaagcatggagacgaagcggataatgggggcttattt

SEQ ID NO: 45484 - DNA, 312 bp, Triticum aestivum
  Clone ID: PAT_TA_45484
cgtccgtctatttgcgctacgatttgaagaaattaaggatgtggaggtttggcatgatacagttcgtctcttctctgtttgggatgcaagttcaagtgatcttttgggttactttttccttgatatgttttccagggaaggaaaatatgaccacacctgtgttgtggtacttcataatggatacatgtgttctaatggctcacgtaaggtctcggttgcagccttattatctctttgccctaaagagtttgatgggaattcactcttgcttcccgttctctggtatttgtgaggtaattctcattgattttc

SEQ ID NO: 45485 - DNA, 187 bp, Triticum aestivum
  Clone ID: PAT_TA_45485
cgtccgggtcgtactccccaagagccttctcgcttctcgtaataccacggttcttcctctcctccttgtctgagatccttagcggggatgggagaagccaaggacgccgaggtgtacgaggaggttcttgtcgactaccaagaggaggtggagaacgccgttgacggttcagtcgccaaccctttcg

SEQ ID NO: 45486 - DNA, 142 bp, Triticum aestivum
  Clone ID: PAT_TA_45486
cgtccgcggacgctagtgcatacgccgttgcgctcgccttttccgaatcacagtaccaaaaactaagacagggacgaccatactcactattaaagttagctgtgattttacggcatggactaaaccgtaatactagctctgc

SEQ ID NO: 45487 - DNA, 229 bp, Triticum aestivum
  Clone ID: PAT_TA_45487
cgtccgcccacgcgttcgttattttatacctagcgccacaatggggctgcgcatctttagttccttcttccttctcttggaccaaccccgctcctcctctcttgggcaatcgagttacaaaaactctcctacccttgggcttcgacaagacgtaccatcgctttggcttccacggccatggccaaggtctcgtgaggttctgagtgaccctttgagactttggccaagg

SEQ ID NO: 45488 - DNA, 213 bp, Triticum aestivum
  Clone ID: PAT_TA_45488
cgtccggtgatcattgatcgatattccggtgatgtatactatgaatatcagcccatatttcctaccgtggtaccttcagtcatggttgtggacggtagacacatgatgaacctgatggtgtactatgatgatcaacacggcacgagacggttacggatctgtcatcacgttttgagcatccgtccggattctggagggacggcgtgcagagct

SEQ ID NO: 45489 - DNA, 228 bp, Triticum aestivum
  Clone ID: PAT_TA_45489
cgtccgctgactccacgggaaatatatttatgtcataccctgactggcgcaagacagacatgctgatcatggccaaggacagcacgacgcctatagaaagactgtataatgagggggtgtacacagagctgttcaagcgcctgcaggagattcacggtatatacttccaaggttatatagagacaaagatcgttcctctagtttacgactgacatgtagacacatcaa

SEQ ID NO: 45490 - DNA, 349 bp, Triticum aestivum
  Clone ID: PAT_TA_45490
cgtccgcccacgcgtccgattagccgtgtgcggtgcccccctccaccatattacacctggataataccgttgcggagcttaggctaagccctgctgtcggaggaacatcattcatcgtcaccacgccgacgtgctgacgaaactcttcctcaacactcggatggatcggagtttgagggacgtcatcgagctgaacgtgtgtagaactcggaggtgtcgtacgttcggtacttgatcggccggattgcgaagacgttcgactacatcaaccgctttgtgataacgctaccgctgttgttatattagggtacgtgaacatctctatcctttacttgtcgtatatgcaata

SEQ ID NO: 45491 - DNA, 270 bp, Triticum aestivum
  Clone ID: PAT_TA_45491
cgtccgcggacgcgtgggttttctcatgatccgtccatccatgatcaggttgtggaggacgaggcgttccccgacggcacgatgctgaagaagggcaccaaggtgatctacgccatgtactccatggggaggatggagaggcatctggggggaggactgctgggagtacaggccagagtggtggctcaaggacggtcgttttatgggcgagctcttctacaaattgaccgtatttaacggtgttccgcgcctatgcctcggcatggactt

SEQ ID NO: 45492 - DNA, 326 bp, Triticum aestivum
  Clone ID: PAT_TA_45492
cgtccggagctcgtgtcttttggcgcaaggacgccaggaatccaccgtgcgtccgtgcgtgatgcctaaaggaggattcgtgtggaggggttcattctgcgggaatgaagaggattgcagtcgagggattcttctctcgccgctgaaatgctgatcggtttatcttactcagagtgcctgacggaaagatcgccggagttggcctggttcctcgaagatggcaaatcacggaaggcgccctgtaaacaagtatgcatttgccaccgccgtgctcttgactgcgacgcccatcttcttggactacgacctggtcatggtgagcagtt

SEQ ID NO: 45493 - DNA, 155 bp, Triticum aestivum
  Clone ID: PAT_TA_45493
cgtccgcccacgcgttcgaaaaaaaataactcggcgagaacgaaggccatcgtgactcggctgtttgtcaccgtcgaatgcgacgtccagagcgagacaaccggcgccatgacgatgctacgatctgccataggaactgccctccgtcggtcgga

SEQ ID NO: 45494 - DNA, 194 bp, Triticum aestivum
  Clone ID: PAT_TA_45494
cgtccgtcagagggaggggagggatcgccgtagggagggcggtgatgctggcgactagcttcgggctgatggacaaggcctacttcgcgggtcggtccaagatcctcagctgggttcatgccacgctgcatttctctctcaataaggtgggcggaggcggtctttctgtcggttcagctgccattgctggacat

SEQ ID NO: 45495 - DNA, 423 bp, Triticum aestivum
  Clone ID: PAT_TA_45495
cgtccgcggacgcgtgggtcctaatgcaccagttgatgacaaaattgattttgctttcaaactctatgatctcaaacaacaaggtttcattgaaaagcaagaggtgaagcaaatggtggttgccacacttgctgaatcaggaatgaacctttctgatgaggttatagagggtattatcgacaagacatttgaggaagcagatacaaagcacgatggtaaaatcgacaaggaggaatggcgcaatcttgtcttgaggcatccatctttgttgaagaatatgacactcccatatctaagggatattaccacaacatttccatgctttgtcttcaactctcaggtcgaggatgcttgagaatccatgttttaggttaccactgaagcttttgaaaggccccggcagaccatgtcctatgtggtcct

SEQ ID NO: 45496 - DNA, 234 bp, Triticum aestivum
  Clone ID: PAT_TA_45496
acctatcatggcggtgcggttcagcgacgaggacatccagtccatgttagaggaaggcatcgacccacttctgtcggagagcctgaggaagctgcagtgcagggagagcgacatgctacagaacaccacggagttccactcgcacgcggcgctggactggtcggacggtgtccaggtcagtaccgtgagggccgatccagagcatttaagaggacgcggcggactatcgggacg

SEQ ID NO: 45497 - DNA, 336 bp, Triticum aestivum
  Clone ID: PAT_TA_45497
cgtccgcctgtcgctccctcccgcctccctcccaccaaccaatcgccggcgacctcggcccctcgccattaccgcgctccgtcgaggtcggcgccgcacctctactctccccgccagtcaatgcgatgcccgccgcgtttcccttctgattttgccggtcgcctgagggtggcgtagggttcctcctgcctctgcggcggcgggcggacgacttcttggctccggcggttgctcctgtccagtccattccgcttggaggtcccgaggacatcaaggatgatgcttagatgacatgtgccctgtttcttgtccgaggctggtctgaataggaaagga

SEQ ID NO: 45498 - DNA, 283 bp, Triticum aestivum
  Clone ID: PAT_TA_45498
tcctccgacctaagctaaacagcagcgagcaatggcgtccaccttctgcttcctccaccagtccaccgcgcgcctggccgactcggcgcgccctgcgcccgccgtcggtcgcactcagcttttcgtttgcaaggcgcagaataatgacgaggctgcatctgacgctgccgtcgtcaccagccggcgcgccgtgctgtccttcctagacgatgccgtcgtcatcgccgttaaggtcttcctctgcgcctgtcgctactgagaaggatgcaacgggttctgcaag

SEQ ID NO: 45499 - DNA, 294 bp, Triticum aestivum
  Clone ID: PAT_TA_45499
cgtccgcggccaccgtctctcgctcattgtctttcagtgtacgcccacacagaaccgaacgcaaacacccagagcgcacggagcacgaggctgcgctagctggctgcctcgcgcaagcacgacatggccgacgcgaacggatcgccctcgccgtcgccgcagcactcctccggcggcgaggccgtgaccggcgacttcgtggcggtgccgggcgccggcccgcacgcgtcgttccaggcgctgctcgcgtccgtgggcggtcacgacccgtacggcgctcgtggcgaacgttct

SEQ ID NO: 45500 - DNA, 221 bp, Triticum aestivum
  Clone ID: PAT_TA_45500
cgtccgttttatccctcgttcccccttcgtcctagagcgactgctttgtcttgactccatttgtgctttagtcttttgagtagtcgtccttacacttaattcttcgtcgtggtctggattacttgctccttcgtgcatgttggagcgctagacggcgttttggcaaccaaattttgaggaataacacttcaactttgtgataattggacgtgggttgattg

SEQ ID NO: 45501 - DNA, 244 bp, Triticum aestivum
  Clone ID: PAT_TA_45501
cgtccgcggacgcgtgggcttgaacttgcccgcccgccgggcaccgaacaggtcaacaatgggatagaacgtcacggccaccgccgacgccggcgacgaggtcgtccacgacttctctccggtcctcctggcccacaggagcggccggctcgagcggaccctcgtgatgccgcccgtcctgcccggccactactgccgtcaaggacgtcgtgtccaacgtcgtgttgataatggccttttactt

SEQ ID NO: 45502 - DNA, 319 bp, Triticum aestivum
  Clone ID: PAT_TA_45502
cgtccgcggacgcgtgggcttacgcttggcgccaaatccaccttatctccgctttctatacttcttctctcaacccaaatccggatcccaaatcccaaatccccaacccgtcgtcgttggctcgctgctgccgccctgttaggaacggctgtagcggcgttttatgcgcgcgctgtttcctgggattcctgctcaagttcctcgtcttcttccaggtcttcgacgccgtctccgtcgagctctacgccgtctacatactttcccgttgggcgcgtcacctcgagctgtatcttgaccattttcttccagacttctggtt

SEQ ID NO: 45503 - DNA, 141 bp, Triticum aestivum
  Clone ID: PAT_TA_45503
cgccggcaccgccgcgcacgtaactgccgcgacccacgcgtccgcggacgcgagggctaccatctcgaccactcccgtgcactccctcgctccctctatggtgctggtgagtcctgacacactctacaccccacatatccc

SEQ ID NO: 45504 - DNA, 446 bp, Triticum aestivum
  Clone ID: PAT_TA_45504
acgccggccggtaccggaacggcattcccgacccacgccacgcgaccaacagatcgaggggagaagaggcgttacgagacgcaccgtcgactgactcaacgatggccaagcgtcggcgtgaggggtcaagccagaagcgctgccactgggggaaggggggtcgcaagcacctctacctcgtcttggacgactgggacaaaggcttcagcattcacaagatcgacgccctcagctttctggacgactctgacgactcggacgacgacgccggcgggaccctcaggcgtctccctgaccctccggcggtgcgtatcaccgaggcgcggcactcccctatgctctttgccggcctgtgcaccaccatcttcttcgtcaacaagaaacagctttcccccaacgcaaccggcgccctcatttacgacacggagacggtcgccatggccatg

SEQ ID NO: 45505 - DNA, 381 bp, Triticum aestivum
  Clone ID: PAT_TA_45505
cgtccgcccacgcattcgcccaatctcaatatccatctccaaaccgcagcatcttcatcctatccctcgtcttcggtcggccccagcagctcctatggcccggaccatgcagacggaccgcatgtccaccggcggcaaggcgccgaggaagcatctggtcaccaaggcggcttgcaagtccgtcccggccacccgctggagtgaagaagcctcaccgattccgtccggtaaccgtggcgctccgggagatcctcaagtaccagaagagcactggagctgttgatccggaagctccctttgcagcgccttttgcggtagattgcgcaggactttaagaccgatcttaggttgcagtccttctgcgtgtccttccttgatgag

SEQ ID NO: 45506 - DNA, 213 bp, Triticum aestivum
  Clone ID: PAT_TA_45506
cgtccgcccacgcgtccggtcgccatggccgcacggagagcggcgcttcaggtggcggtggtcctgctggcgctgtgcgcgggcggcattggcgcgtcgccggggtgccgaaagcacgtgcggagggtcacggagtacggggcggtgggggacggtaggacgctcaacacggcggcgttcgcgcggtccgaggctggacctgggcaggcgcgc

SEQ ID NO: 45507 - DNA, 337 bp, Triticum aestivum
  Clone ID: PAT_TA_45507
cgtccgaagtccttatgcttgatcgccgcaacgcttgttccgacgatcatggtgcgccgcggatccgtgatgcgggtggctcgtcctcctggtcgctattatcgccgtctctctggtcccatcgtgctcggccgctgaggtaaagaccagcccgacggagtggagcctccacctcaacctgcccaccggcgtcaccggcgccgagagcctggcctttgacgcgcgcggccagggcccctacaccggcgttttcgacggtcgtgttctcaagtggggcggtagctccgtcggatggactaccttctcccaccaccgccaactacaggaagttccccat

SEQ ID NO: 45508 - DNA, 159 bp, Triticum aestivum
  Clone ID: PAT_TA_45508
cgtccgctagctgcttctggccgcaatgatggcgtcatccgctagcttggagaagaaggcgtcccccgcgggttgaagccgctcgttgacggggtaaggctcgtggaccgtgactctgacgtggccagtcttcaccgtctggtctgctgctcagcggtt

SEQ ID NO: 45509 - DNA, 439 bp, Triticum aestivum
  Clone ID: PAT_TA_45509
cgtccgcattatcttgatcaactccatctgtggcatccttgcgttctgcattgctgtcgcactgtactatgtcaccgagaaagagagcttccttgtaacgccactttctggcttccatggcgcccttgctggctttctggttggcctgaagcagctcctgccaaaccttgagctccccatgtgctttttctggaaaataaaggctaagtggatgccattctttgccatgtgcttctcgactatcatggccttcattgtgccggattccatcaacttcctgcctactttgttgtctgggatgtacgtcagatggctatacctgagatactttcagaagaacccgctgacagggcttaagggcgacccatgtgatgacttctccttccccagcttgtacccagatgccatgcggccagtcacagacctagttgctaatctg

SEQ ID NO: 45510 - DNA, 351 bp, Triticum aestivum
  Clone ID: PAT_TA_45510
cgtccgcccacgcgtccggtaaaacaaacaataagagtagattcgtagtacttgatgatgaagacgatgatgatggtgatcaaaatctcatcggtagtaaaagtggtgctgctggattgaaaacacagaattatggttcagaaccttcaaagccacatcactattgttccctgcccatcgatgaacctatttggagtggaatcattaggataggcagcggaaaatttgtttcgttggctgcacatttgtcaaccaaatactgtgagaaggtgtggaaattgtcaagatcacttgagccagtggttgaagtatcaaagctttttagactggagggttggtcgaagagctttg

SEQ ID NO: 45511 - DNA, 422 bp, Triticum aestivum
  Clone ID: PAT_TA_45511
cgtccgattatgcgtttaatgctaaaaacactccaactacaccatataatgttgccaaagcttatgggggtatggaaaataactctctcaaggatagagctaatgccgctcatgctttcagacctttggtgcctaatatgaagactgcataggcgacacggcctaagaagctcacaattacagaacgtgctcttggtttatgccatagaatcagcgaaggcactcaaaagttgagaaagacacgctcgtatgacatggactgggcttgggcagcttaaatattaattaagatgtgtgaggatgatccagaaagcctggatatgcccctggaaattatttaccgcgcataaggctaattatgaccacaatgtggattcatgaagatttcctgctataccagcaagagttgtaagagcacaagc

SEQ ID NO: 45512 - DNA, 258 bp, Triticum aestivum
  Clone ID: PAT_TA_45512
cgtccgcggacgcgtgggggccgccgtcgcatcagcgatcacggcggtgctcctggccgcgataatggcacgagcgtcggcggcggcggcaggaaaagtctggtccgacgaggagaagggagcacataacggtacggcgagaagacaggtcacgtacgacggcagatgcctgatgctgtactgctccaggaggatgctctttaccggggttatacactacctatgtagcacacctgagatgaggacaagactcataaa

SEQ ID NO: 45513 - DNA, 125 bp, Triticum aestivum
  Clone ID: PAT_TA_45513
cgtccgcccacactttcgtgtacgcttttgcgatcggatcgatattaaggtttacacgagctcacgtcttgactgtcgccgtcgaccgcccgagatggctaaccgtcttggcttctactgcgccg

SEQ ID NO: 45514 - DNA, 120 bp, Triticum aestivum
  Clone ID: PAT_TA_45514
cgtccgcgctagccaagcaagacccgttcaaggcacactctctagcaccagcaggccgtacgtatgcatcgcaagcacaacaaccgaatggccaccatcagcgccgtcgtggtgacacac

SEQ ID NO: 45515 - DNA, 309 bp, Triticum aestivum
  Clone ID: PAT_TA_45515
cgtccgccctactgcgcgctcctccgcgcggcgctctttgggcccgacacgcccgaccgcctcggctacttcgtcggggcctcctcctcctccgcggcctcccccgtcggctcccccgccggcggcaacatattccgctttaaggccgaggtgccgtggaacgccaagcgggcgctcttcgccggcggggacgaccaggacctgctcttccccggcatcttcacccccaagggctccggccccaggaagatccccaggtcgccctacaaggtgctggatgcgcccgcattgcatgacgacttctacctc

SEQ ID NO: 45516 - DNA, 429 bp, Triticum aestivum
  Clone ID: PAT_TA_45516
cgtccgcggacgcgtgggctgaaactcagaacgagctagctaaacttcagattgtatacgaagatgctgcacaaaagagtgaaggtactgccccatcagtttttatggccaaggaaaatgatggcagcttcccaggtgcaaaacacgagcttgcccttgtcccgctgcaccaagtaaatgctgcgcagtctcctgctatgcaattccaaagctgcaatgggcttattctacagcagcttgtgcctgtgtcttttagcaaccaacaagaccagtcacgttcgaaccaacctactgtttactgtatgcaaaatcaaggccagcctgagcgcaggcaggcccaaacatttcaacctgcaccttagtctatgcagccgcaggcccagaacccttagccacagactgtatgtgaggcaccagagttctaccttc

SEQ ID NO: 45517 - DNA, 434 bp, Triticum aestivum
  Clone ID: PAT_TA_45517
cgtccgctcaatcagatagaagcaaatattttgacatcacaggctcagaacaacattgatcttttccatcgcacaagaagtaacatcaataatcttctacaaagcatgagccaaatacctggaataatgagcaagatgcctaggttgcctatttcagtggatgaaaagctttgcagttatctgctcccgggtgttaatttggtaaatgctcttctgctttgacctgcatggtgggaacgatcagtgttctagcgctgttcagattgttaagtttgagtaatcaatatctcagcctctgatgtacaaccatgaatctaaatacctatgtgaaaatctagtgtactgttagaataaaatgcttatccgaagttgccaattgacactggcctttaatacacaggaaaaaaataaaccaagcacttcgctactgagac

SEQ ID NO: 45518 - DNA, 232 bp, Triticum aestivum
  Clone ID: PAT_TA_45518
cgtccgataaataaaaaataaaaaaaaattaataaaattacaaaataaaaaaaaaccatggggtcgggcgcttcccttctatggtccacctcctttctagtagcaggatcatttaaaaactctcttaaggtaataatctctcccctctgttaccaccagtgtgagaacaacttcactggtattaccttactttttcctattttaatcccgctttattacttcaaccttcttt

SEQ ID NO: 45519 - DNA, 383 bp, Triticum aestivum
  Clone ID: PAT_TA_45519
cgtccgccctgacgttgcacgcccgccgcgcaccgaacaggtcggcgatggcaaagaacgccgcggccaccgccgacgccggcgacgaggtcgtccacgacttctctccgctcctcctggtccacaggagcggcaggctcgagcggcccctcgccatgccgcccgtcccgcccggccacgacgccgcaacgggcgtcgtgtccaaggacgtgtcgctctcgcccttctcgttcgtgcgtctctaccgcccgcccgaaacgggcgccggcgccggcaagaagctccccgtcctcgtgtacttccacggcggggggttcgtgatcgggtcggccgcgtcggccgcttaccaccgctggctcaacgacctcaccgcggcctgcgcc

SEQ ID NO: 45520 - DNA, 410 bp, Triticum aestivum
  Clone ID: PAT_TA_45520
cgtccgcggacgcgtgggtgcggatgctgctgacccccgcgtgctccaccgcgccggccgccccacctttctccgtcggccgccccgcctctctctgtcggacgaccatatgctcccattgggggctgcaccacgccttccccgcaccgaggtcaccgtggccctctcctccccagatccggtgagccccccatggacctctcatccccagatctggtgagccccccggcggctccatccacctctccctcctaatctgttgcggagcacatcaagcacgcatctttactttggcgttcgtggcatgggtgctgcagtttgctgcctcccatgcagcagcactccggcgggcaacgtgcagttccctgctccctcgacgacactttggcaagtggttcagatgacgcccc

SEQ ID NO: 45521 - DNA, 393 bp, Triticum aestivum
  Clone ID: PAT_TA_45521
gcgacgcgtccggcgaactaactcattggaggaggtagattagtgtctgatgacttgatgaacagccccgggtggggcgtatgagaatgtggagctcgtgcggaatactgtatatgccggagtaggaggaatgtggttgagatgatgccttatgtaggatgtaaaggttgatttttgtaaggtgggattcggcagcgggccttgaatatagtgtcagtgggagacttgtgggattgaagatagtgtcagtggccttgaacaagctatccgaccaggagaatgcaaaatacttgaaatattagaagacttgtttttcaccgggcacagaatttttgtagaggtgtagttgatcaaatctcactacatacttttggctttttgaggcttgaatca

SEQ ID NO: 45522 - DNA, 358 bp, Triticum aestivum
  Clone ID: PAT_TA_45522
ggcaggacgtacgcgtacgcgtgagattttgtcaagaagtatcataggtatgagaagaggcgactccaacatggggaggtgacatctccgcctggttgcgtgtcaaggatgactgatcattccgtattgtcagagtttacatataggatacaaatatgtttctttgcactaactttttttccttagcatggccaactcaatatcaccatgtgttaacatgccaaaacttctctcgggcttcgggcaccggtcatcatcatttgctacttttctttacatcggaactatggaggcgaataacacagaaccataacctaaacaaaacgctaggacaaagcacattttagatgtttttggt

SEQ ID NO: 45523 - DNA, 270 bp, Triticum aestivum
  Clone ID: PAT_TA_45523
cgtccggggaggatgcgtgttcccggtgcagattctgagcgcttctgaaagggtggtgccactgagagttttggccgcgtgcttggtcctttcggtagctgtgttcatcctcatgtaggcgaggcagggcagtgagaactggtacatcaaactgctgtcagaagctgttactacatgacacggtggggagcaccggattgcaagagtggattttttgttcgtgctacaagagtctgtaaggcaaagctggtgggtgattgaagacagagt

SEQ ID NO: 45524 - DNA, 415 bp, Triticum aestivum
  unsure (1)..(415): unsure at all n locations
  Clone ID: PAT_TA_45524
cgtccgccgntcctngacctccatccgctctctcaactcgaaccaaggcgagttcgtcagcgacgatgtgcgggcgcggcaagggaggcaaggggctgggcaagggcggcgccaagcgccaccggaaggtgctccgcgacaacatccagggcatcaccaagccggcgatccggcgcctcgctcggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggataggcgccccccttcgtcagcaactctgccccgctgtggcc

SEQ ID NO: 45525 - DNA, 449 bp, Triticum aestivum
  Clone ID: PAT_TA_45525
cgtctcttttaccctttatcttctcccttgcccttctcctcctactaccggccgccggctccacggggccggaggccatcccccatgaccggcgaatattaacaccatcctggcgtcggagacgatggagatcccggaggaggtgaccgtgaaggtgtcggcgaagatgatctctgggacggggccgaggtggactctgacccgcaacttcaagcacctcaaccttgactttcagctgcaggatgtcgggcgcaagctcatggtggacgcctggttcggcacccccaatgaccatggtctgcattcgtaccgtcatcttccacgtgcagaaccttattatccggggtcaccaagggccttccgctacaagatgccgcttcgtgtatgctcactttccccatcaacgcctccatcaccgtcggcaacccggggcatcgagatcaggaact

SEQ ID NO: 45526 - DNA, 381 bp, Triticum aestivum
  Clone ID: PAT_TA_45526
ggcacgcgtccgcggacgcgtgagcaatcctgtcttcatgctaggaggggctgctgctgttctctctatgagggggtggttcattacgcattgctgaacgttttattaagagactcttcccttatacgaaagtacttatatcatcctcccacatggtgaaacctcaaaaacatattcaatgccgcgagggtgccatggtcagattaccggccttatcactccatgactgttggtctgtattccgacagcttgtttgccaggccaccagggtggcagataggcgtattttgctctgatgcacgcgggtgctcacattcgtggtgtgcttgatggacatcaagcacatgctgatgatccacgccgtcggatacaggaagaggg

SEQ ID NO: 45527 - DNA, 325 bp, Triticum aestivum
  unsure (1)..(325): unsure at all n locations
  Clone ID: PAT_TA_45527
gcgacgcgtccntttttcttcccttcttgtctacttcctacaccgtcgccttcggcttcgccttcttaggggtggggactctgcgatgcctgcttcgtctcctcacgcgcggtctttcccctcacgccccgcagcccctcgcgccggcctctatcgcggcccggaccctgacctccctgccccggtccctcgccccccgcgccgccgccgcctcgctccggctctcccccccgcgctgccacttcgcgacccgctcgtccgacgatgagggggacgacgaggagcactactaggacgaggaggacgggagcggtgacgagtgggg

SEQ ID NO: 45528 - DNA, 284 bp, Triticum aestivum
  Clone ID: PAT_TA_45528
cgtccttaagccttttactgtcgccttcttacttcatctttatcaacggcttgggccctttcggggcgggggttatgttctatgtatggcgcacgtaccgtcttctcgtattgaacgtggtcacgaggacctctctcaactttcttttccagggccacaatctacttctggtggaggctgtttgcacctacacactgtagaagcactactcgttgtttgacgttcacccctgccaaattctatccgttctcgttgcggtcaacctgacgcccaaggcgtattac

SEQ ID NO: 45529 - DNA, 431 bp, Triticum aestivum
  Clone ID: PAT_TA_45529
cgtccgcggctggccaagtcgacgcggcggaccatcatcaccaccatccaccatccgggcagccggatgttccacatgttcgacaagctgctgctcatctccgagggccacgccatctaccacggcaaggccagggactgcatgcaccacttctcgtctctcgggttcacgccggagatccccatgaacccggccgagttcctgctggacctcgccacgggcaacctcgaggacatcagtgtcccggggctgctccgggacggctcgccggcgccgcaggagttcaggtcccgcgtcgtcgcgtacctccaggccaagtacagggaccacgccggtgaggaccaggcgaagcatccggcgaggaggcccggggagcagctgaggctggccatccggatgcgcaaggaccggatcatcaactggttccagca

SEQ ID NO: 45530 - DNA, 402 bp, Triticum aestivum
  Clone ID: PAT_TA_45530
gcgacgcgtacgcgcacgcgtccgctcatatttcctctccccttttctcgtccgttatttcctctcacaaggcagggacactaactgaggtgcgggagctgtgttctcctcttatttcttccctagcttcattcctagcaccacgcagaggcagccagtggcgtgttggtcgcccccatgcttttatccaagactttcggtcaaaggccgcgggttttgccgcttgtagagtcacttaatgaagtctctgattatggtcttgctcctgccgtggtccctgctttgatcctgccatccatgcttggagccaagcacaggccaggccaggcccctgtcttgctctctctcgttgtttctccggcggcatttgggtactgtgcatggaaaggattcttgcggcct

SEQ ID NO: 45531 - DNA, 410 bp, Triticum aestivum
  Clone ID: PAT_TA_45531
ggggccacgcgtgcgcccacgcgtccggtaggactagcggatccaggctcaaacatgggcctctccgtctctggcctaggccggtagcagtgggaatggggatggatcgccgccatgggagctcgatgcggatgcaaccgtcggggatagacgcgagaggggcggcaggagcatgacgggcatgagcgaggagctggtgaacctgacagggcggctgttccaggagccgcacttcagctggtacatcgcgtacgtgttcggtctcagcgcgcgggtcgacctggccggcatgctggccgggcccgaagtcatcctcgcgcaccacccacacttgtgaaacaggtgcttggtgggctggtcggctcgtcgttccgtatgagccagtctactgcatcttcttacaccacttt

SEQ ID NO: 45532 - DNA, 440 bp, Triticum aestivum
  Clone ID: PAT_TA_45532
gggacgcgtccgcccacgcgtccgcccacgcgtccgcgacgaacacccgccgcaaaaatcccaaatcacgggccgggtcccctcctctcccgcgtgccgacgagcaccagccaccagacatggacgcctcagccaccggagccggagcgaaggcgaataagggcgcggcggtgcgcaaggctggcggccccaggaagaagtcggtgacgcggtccgtcaaggccgggctccagttccccgtcggccgcatcgggcgctacctcaagaatggccggtacgcgaagcgcgtaggcacgggcgccctcgtctacctcgccggcgtcctcgagtacctggccgccgagctgctggagctcgccgggaacgccgtcaaggacaacaagaagtcccgcatcgtgcccaggcacctgctgctggccgtgaggaacgaccaggagctc

SEQ ID NO: 45533 - DNA, 420 bp, Triticum aestivum
  Clone ID: PAT_TA_45533
ggccacgcgtccgcggacgcgtgggcgagcattccccgacacctccggccgcagatccctcccggcctccgggtcaggctcagcctgtggccgccaccgccatgccctcctagcgcgcctccctccccgccggccgatttagcccccgtcccccttcttttatggagcccccgcgcgggcggcgcactcgcaatgccggcgtccccaccggctgcttcctcctcctcctccccctcctcctcgtcccaaccctatcccccttcggccggcaccacgccggccccaggcttcgtcacgtcgtgcaccgggcgggcctctcctccccgttctttgccgccaggccgcggggggactgccaggagctgcaggcgctgcacggcgcggaggcccggtgcgcctaccttctgtcgcacaccccct

SEQ ID NO: 45534 - DNA, 370 bp, Triticum aestivum
  Clone ID: PAT_TA_45534
cgtccggcgacgctctcgtagtcaatcaaattacaaaccagcgtccaagttcgtccgcgtggtggacgcgcagctagagtaggcatggccaccgccgtgaacgagcacgtcctgctcagccaacccgacaagctggtcctgctcgccgagatcccggccgcagactcgtgcggctcgtcgcagcccgacgtcacgttccggctgctcgtcgagcaatgcagcgactacggcggcggccccttggacgtcgacacgatggaggacgtttcctgccgcgtgccggtccgcgacctgggccgccggggcgcctcggaccggtcgtgttcgggcctcggggccagggctaacaacccgatgctgcgcccggagg

SEQ ID NO: 45535 - DNA, 426 bp, Triticum aestivum
  Clone ID: PAT_TA_45535
cgtccgggactacaacatccagaaggagtccaccctccacctggtgctcaggctccgtggtggcgggcagatcttcgtcaagacgctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctggtgctgaggctccgtgggggcatgcagatatttgtgaaaaccctcaccgggcagaccatcaccctggaggtggaggcatctgacaccatccacaacgtcaaggcgaagatccaggacaaggagggcattccccctgaccagcaacgttttatttt

SEQ ID NO: 45536 - DNA, 437 bp, Triticum aestivum
  Clone ID: PAT_TA_45536
cgtccgcccacgcgtccggttttacccctccctcaggtggtcattttgatcattctgcctcgtcttcagggctcacagttcatgaaagccaaaaacatcttgatgcttatagttatatgccaatatgtacctcggctaatccggataaggccattatatcttcaaatcactagatctgctgggataattacagagacagcatgggctggtgctgccttcaatctaataatttacatgcttgctagccattgctgcaggtccttggagcagtttggtacttgctttctattcaacggaaagatgcctgctggaaacatgaatgtagtcttaaaacaggctgtaaagctgcatatctatactgtgggaatggtgatacaaatgctggaaatgctttcttacagaatgtttgcatttcaagtacgcccgcagacaatctt

SEQ ID NO: 45537 - DNA, 379 bp, Triticum aestivum
  Clone ID: PAT_TA_45537
cgtccggggacacctgcacactgacaacaactacgaccctggtgacacggtctgcttcagccggatgatggccatcgagaactggtgcatgtgccacacatcggcgcgcatggcggtgtacatgacctgggtgagggacgtcaagaagctcacacaggtggagggctgtgaggtcaccttcgagtgccgcggcgccttgttaccgttgggctgatctcattacattgatcgattgattgcgattatgtatggttcaccaaatcataagttcacattccttacacagagatcgaattgatccatatatattgtaataaagattgattaacagacgttggactatcattgagaagaagatataaattaggactacatccct

SEQ ID NO: 45538 - DNA, 122 bp, Triticum aestivum
  Clone ID: PAT_TA_45538
cgtccggcaactccttctctgcatccaccaataagtcccctccgatgctttcttccaggagtgggcgcccctcctctccagatctttttcgagatcctgagatatggccgtaagcaaccaag

SEQ ID NO: 45539 - DNA, 372 bp, Triticum aestivum
  Clone ID: PAT_TA_45539
cgtccgcggacgcgtgggttccagtggaaagactcctgcaaatggcagccctggaaacgacagtccagacaagaagagagtgaaaaggccatatcagactaaaaccttcaaggtggagctgagttttgcagctagaatccccatgagtgctattgcaatggcactcaaaggccaggaatcagagcacacgcaagaagccattcgggttattgatatcatattaagacaacactcttccaaacagggctgcctgttagtccgccagtcattttttcacaacaatccttcaaacttttgggacttgggtgggggtgtgatgggctgccgaggtttccactcaaagctttcgagccacacaaaagcgggcttttc

SEQ ID NO: 45540 - DNA, 383 bp, Triticum aestivum
  Clone ID: PAT_TA_45540
cgtccggtcaaacgtgattcggatgagaaatcgacccgtttggatgcagaggataaaacctgtggtgttgaagttaaagaagagtcaggatctgattctgatgaggatccccaaatttggtgaagaacttccagcgcatgctgagagacgccggagagccaataagcagcacatagctagcatcactctagttgacatagccccgtactttcatcttccaatcagagaagcatccagggctctgaagatcggtgtcagcatactgaagcagaaatgcaggcaatacggaataccccgctggcctcacaggaagatcaagtccctccattcgctgattagtgatctggagtttgtgatggacgacacaaatggagatgttgtgc

SEQ ID NO: 45541 - DNA, 432 bp, Triticum aestivum
  Clone ID: PAT_TA_45541
cgtccgcaaggctctcctcttgaatctgttcaccgctgggacggacacgacatcaagcacggtggaatgggcactggtagagctgatacgacacccagacgtcctcaagaagctccaacacgagctcgacgacgttgtcggaaatggccacctcgtcacagaaaccgacctgccgcaactcaccttcctcgccgccgtcatcaaggagacgttccggctgcacccgtcgacgccactctcccttcctcgggtggccgccgaggactgcgaggtggacggctaccgcatccccaaggacaccaccctgctcgtcaatgtgtgggccatcgcccgtgacccggcctcatggggggatgacgtcctagagttcaggcccacccgatttcttccaggtgggttgcacgagagcggggacgtcaagggaggcgacta

SEQ ID NO: 45542 - DNA, 197 bp, Triticum aestivum
  Clone ID: PAT_TA_45542
aaaaaaggaaaaaaggggtttttttaaaaaaaggagattaaaaaaacgagatgaatatttaagaaagttagggttacacaaggataaaaaaaggtattttcggggaataaaccgatgtaaaaaaaataaagtttatcattaaatgttataaaagacactattgggatcgttttataattaaatgggtatttatttag

SEQ ID NO: 45543 - DNA, 433 bp, Triticum aestivum
  Clone ID: PAT_TA_45543
cgtccgctcgctggagctggagtggctctccatggaaaatgctctcgccgtttgggaagaggaagaagagacctcctccttgcccctttgcagcgctgttagggtataaataccattgccctgccgcgcgaagctctgactccctcgcctctcgccactgctgctggcccctccctccttccggggaagcagttttgcaaggtgtctatatagaagcctgtggtgatcgataccacatacacacggtgaatagacaagatggggagttcgcgcaagatcacctctcttctcctcatgttctgcctggcggtgctggtgagagcggagtatgccaagtacaaggatccgaagcagcctctcgccgttcgcatcaacgatcttcttggccgtatgactctggccgaaaagatcggccagatgactcagattgaga

SEQ ID NO: 45544 - DNA, 161 bp, Triticum aestivum
  Clone ID: PAT_TA_45544
ccgcctgcagtccgtcccgattcccttccccacgccccgcctccggtgacctgaacaatttttaaggaaatataagttttcggaatgtcaacgtaactttgcgaggatcttgcatggaataaataaggatttctggagccatcaaccaccatagaggggcc

SEQ ID NO: 45545 - DNA, 250 bp, Triticum aestivum
  Clone ID: PAT_TA_45545
cgtccgcggacgcgtgggcggacgcgtgggcgcgttctccttcgaccgcgactcggccaacgcctgtcagctccacgtctgcgagtcgctcgccttcaccgacaagcgggcggggttcctttacggccgcgtcgacgccgagaccaaggaggtgctggtcgacttcatctacaagccgccgcagcaggggtcctcagacgtggaccacctgatgcgggacgcctacgaggaggcccgcgtggacgccatt

SEQ ID NO: 45546 - DNA, 377 bp, Triticum aestivum
  Clone ID: PAT_TA_45546
cgtccgcccacgcgtccgttccgatcggatcgggggaaaggcttccacgagctctcgtttcgactgccggcgccgcccgcccgagatggcgatccggcgtggctccttctgcgccgtccctggcctgctcgcgcttggctccgtcttcgccgtcagcgccgaacgttttttccagaaaaggttcaaaaggctgggaaagccgggggtcaagtctgagtgggaaaaggaccagaacctggccggtgaatggaaccacacctttggaaaatggcacgggaatgctgaggaccaaggtatcccaacctcagaggactacagggttctacgccattcttgggcggagtacccctgagttcagcaacaaggacaaggacact

SEQ ID NO: 45547 - DNA, 165 bp, Triticum aestivum
  Clone ID: PAT_TA_45547
cgtccgcggcgccgtcccctttccgttaacgtcccatcgagcgccgtcgttctggttcctcgccggcgagcaccgtcctcctatccacctacaccatactctgccgtccccgttactcttgcttacaaccgtattcagaggactccttcgtggtcgccgtgttct

SEQ ID NO: 45548 - DNA, 165 bp, Triticum aestivum
  Clone ID: PAT_TA_45548
cgttcgtcgatctagcgcatccgccgtcaacacctcactttgagagcccttatcttcgtagaagcagcatgcaagcatgatggccggaaggtatgggcgtgtgctaggaattaggcggtgacccgtttcgtgaaggccggtctctagttccctgacttccgcatt

SEQ ID NO: 45549 - DNA, 436 bp, Triticum aestivum
  Clone ID: PAT_TA_45549
cgtccgcccacgcgtccgcccacgcgtccggtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgttgcttatccattagacctattttgaagaggagtccgtaactaacattgttacttctattggaggta

SEQ ID NO: 45550 - DNA, 253 bp, Triticum aestivum
  Clone ID: PAT_TA_45550
cgtccgcggacgcgtgggcggacgcgtgggctgccccttgcctcagtctcatcctcccggccctctcggtcctctcgcgatagccccgccccggccgccccccaaatcggaagccgcgcatcccccggatctccgccgccggccgccccgccgagccgcctagagcccttcgccgtccccgctctgctcgccccgcgcggggcggatcggatgaaatccgagccgaggaggttccttccgccctggtgggttc

SEQ ID NO: 45551 - DNA, 393 bp, Triticum aestivum
  Clone ID: PAT_TA_45551
cgtccgctttgcctgcttccttcctccctccctccgctccgccgctgctatttctctcccctcccctcccgtcccgtccggagagaccacgccggccgaatccccatagatttccatcccatccccgccacggctcgctcgctcgctcgatcgatctgccctccgtcggggtcggttcttggcctggatcctgcggaatctcttcttgattgttttccggttgttggggttccaaatctcttccgcgccggtctcctccccgacctccaggcgggctcaattcaaggggatttgcttcttcctttcttccttccttccttccttggatctccttcccgcctctccgcgccacatctcccaaaggaaatccgcggggagatctttcttgtctca

SEQ ID NO: 45552 - DNA, 367 bp, Triticum aestivum
  Clone ID: PAT_TA_45552
cgtccggccaccctcactcctcctagatcagacgcgctctcccctgtctccgtcatctctgttcagcgcgccgatcgatccgatggtgttcacctgcaagcgaccggccgcgttcctcgacggccaagccagccagccgggcgcgatgtgccggaagaggaggcgcgtcatcgggaccacctatgactacgaccaggagtcgtgcctcggcagaggcaagttcggcgtcgtcgtcaaggcgcggtgccgtgccaccggccaactctgtgccatcaagtcccttcacgaccccgccgacccccgtgaggtgctgcgggaggcaccactttcttgaggtgtgctgtggccacccatacaatagtttttt

SEQ ID NO: 45553 - DNA, 364 bp, Triticum aestivum
  Clone ID: PAT_TA_45553
cgtccgagacgtcaggtaagggaggaggagagcgtctctgaatatggtgtcgcttaatcagcaggaacgcctgtccttgagcgttctcatgtgcggcaagggcaaggtctgtctcgaccccaatgaggtcaaccagatcttcttggccatcttccgtgagaacatccgaaagcatgttaaaggattggttcaatatcaggaagcctcagaagatccactctaggtctcgtgcaaggaggtcacatgatgccaagcagaatggccgacactctggatatggtaagcgtagggcttccagggagggtaggctttccaccaagatcctgtggatgcggtggatgctcgttcctgaggctccttctgc

SEQ ID NO: 45554 - DNA, 252 bp, Triticum aestivum
  Clone ID: PAT_TA_45554
cgtccggtctggtctgatcagtcgcgccagaccgagctctagctttagttcgccggagttcgcaccgttcgattcataactcctcgtcgtgggccgccgttcaggtacaagccgtatcccaagcgatgcctgtctaggaggctccggctccgtctccggcggtggtggaggcagtctagccgtccgtcgacgttgacgaggagactacagtggcggtggaggctgtctagccgtccgtagactcggttgatg

SEQ ID NO: 45555 - DNA, 343 bp, Triticum aestivum
  Clone ID: PAT_TA_45555
cgtccgtggacgcgtgggcgcggctggcgtacgtccgttctgtggataagaaggacagcgaggacgcggcgacgatgccgttggaggggatgaagcccggtggcggcgtgtcgatccagcaggtcggtgacccgtgcacggtgccgtctgttagcggcgagcacgctaaggtggagagcggcgagcacggtaaggatgtgagcatcagcaccagcatggtggggtagaatgtcggcatgatctgcctgaccatggtggagttccacattgaagtggtttctgagtggatagggttgttccctttttgtcttcgcatgtttgtctgtaagttttttaagttttg

SEQ ID NO: 45556 - DNA, 422 bp, Triticum aestivum
  Clone ID: PAT_TA_45556
cgtccggcgccactttccccacccaactcgccatggaagcggacgaggctcctcacccgccgccgccgtggaagcagaacaagtcggccgtggccgtcgacgcctcgttgggcccgctcgccttcgccgccgcgcgcctgtcagcccgctcccgcgcgatccctccggcccgcgacttccatttctacaacaacttcccctccttcaagtcccccgtcgccgccgccgccgccagggccgagtcctccctggccgtcctcggcgcctccatgctcctccccaagcagcagcagcagcctttccccacggaggacctcgacgacgcctacgactggctcgtcgcccgcaatgacgacctgctcgagatgtttgccgcctccgcggccgagttcaaggcgctgcgggagaatgaggaggcccag

SEQ ID NO: 45557 - DNA, 341 bp, Triticum aestivum
  Clone ID: PAT_TA_45557
cgtccgctaagccccaatcccaccaccaccgccgctggtgctcggcgcgatggcgcataaggacgccgtcaatggctacggcgccaccacgcgcccgtcgcccactccctcccccatccgcttctccaagttctttcaggccaacatgcggatcctggtgaccggcggagctggcttcatcggctcgcacctcgtcgacaagctcatggagaacgagaagaacgaggtcattgttgctgacaactttttcactgggtcaaatgacaaccctgaagaagtggttcggacacccaatatttgaacttatcccgcacgaggtcaccgaaccactgttcgtggag

SEQ ID NO: 45558 - DNA, 189 bp, Triticum aestivum
  Clone ID: PAT_TA_45558
cgtccgtgtactcgcagccataagaatggaaacgcccagttagccgcgtgcatgattgatctggctgaccacatccggctcaactatgtctaaactccacggcttaaaccccttctaaatgtctcgcagagggtacaaacaccaccgatggaaacatctgtagctgcggtgatatgggtatctcagcta

SEQ ID NO: 45559 - DNA, 415 bp, Triticum aestivum
  Clone ID: PAT_TA_45559
cgtccgcggacgcgtgggcggacagcgacgacggcgccggcaacaaagatttggtccacgacgcgtcgctggcggacacgaagaaagatgacacctttgccagggacggcgatgctgctgcggccgtggaggccgccaaggacgatgacgacgccgccggcgcccttctccctcccctgtcggcgaacggcacgcaggaagagcaaggtgttcttgaggaccaggagctgctcgtgccggatgccctcgctgccgccaattctccaaacaagagcggcaacaatggcggctcccagcctgtggttcaatccgacccggctacgattcctgctcctgtgcagcagactcctcctaccactaccattccagaggctcccaagcatgaggaggccaaggccccttcagcccagcagat

SEQ ID NO: 45560 - DNA, 222 bp, Triticum aestivum
  Clone ID: PAT_TA_45560
cgttcgcggacgcgtggtccattcgactctccggcgccgtcactttgtctttggcgcaagacagaagggtggcggtttccaggcctaaaaggttaggttccgacttcctctttaaggtccacaacccacaacggaagggtccgagacggattaaggcgtctggactttgtccagcccaagggggacttaagggccgcggtacccgaaggattccatgacccg

SEQ ID NO: 45561 - DNA, 172 bp, Triticum aestivum
  Clone ID: PAT_TA_45561
cgtccgtgcctgcagagctatctgatcctctccgtgccccggcggtccgtcgctgtccacgatgtcgagcctccgcaactctcgtcggaagaccgacgtcatcggcgagtgcattgacaagctccacgagaagcgccgcgcggtgcgcgaggaggacatggacacgctcgtc

SEQ ID NO: 45562 - DNA, 435 bp, Triticum aestivum
  Clone ID: PAT_TA_45562
cgtcctcccacgcgtccgcccacgcgtccgctcgtctctctggtcaatccaccactttccccatgagctattactagagcgagaggagtatgcgccgccgccgtcgtagttcccgctcgttggaggcgcatccgttggaggactacaaccttctctccgagattcttctacgccttccgccagatccgtccttccttcctagcgcctccctcgtcttcaagcgctgtcttggccttatctctgacccgtgcttctactgccgctatcttttttcaccatcgtcgcaacccttcttttcttggttttttcgtgcatttcaatttcaaaccttgaatggatccccccaatcgtgttccggatggctacttattcttgtgacttgaccgagaaaatggtggcggcatatttatgcccatgggatcccgtcatggcctt

SEQ ID NO: 45563 - DNA, 144 bp, Triticum aestivum
  unsure (1)..(144): unsure at all n locations
  Clone ID: PAT_TA_45563
cgttcggcgcactggntattcttaaggggatgctagtcgttgcccatgctatgttgcccatgcatgcgacggtatttctgtgatgtaatagcaactaaattgagtctactgagcaccttttataattgaccaattggaaaaatt

SEQ ID NO: 45564 - DNA, 363 bp, Triticum aestivum
  Clone ID: PAT_TA_45564
cgtccgggtacagggggtttggatgggcggatcctctctaatccccttcgatcctcccgaacccacgcgactcagaacccttgtcgaaggactcagggaatctctcgaccgagcgcacgccgccagccacggaggggaggagccccgccgccggatcttcaacgccgccgccacggaggggaagagccccgccgccgccaccgaggggaggagccccgccggcgagaggaggagcccgacgccgccgcccgattctacccgacgccggcgttactcctccagaatactggtgttctccccggtgtgttttgtacggaggggaatttgagggatgtgtggctggagggggatttgaggtttaag

SEQ ID NO: 45565 - DNA, 313 bp, Triticum aestivum
  Clone ID: PAT_TA_45565
tgcgtccgctccacactagcctctccccggtttttccccatatccgacggactcgaggccaagcggaggcggagatggcgctgtggtgtgcactgcttatatcggcggatatctctcccggacgcaaggctgaacttgagtacttgcattctatatcaaagggacagcctactgagtctatcttaagtaccggccttgatcctggtggaatatcactcagtgcctcatggtgcatctactttaagcacaacacatactataacatcacccccacctccagagaagactaactttgctgaccttaaatttgaag

SEQ ID NO: 45566 - DNA, 160 bp, Triticum aestivum
  Clone ID: PAT_TA_45566
cgtcctgccacatcctgggcaagatgcacaagaaggtctggatcgccgtctgggacaatcgtcctcgtggggctgcgcgactaccaggacaacaaggccctcgtcatccttaagcacatgaacgacgaggcccgcctacttaaggtctacggggagttcc

SEQ ID NO: 45567 - DNA, 174 bp, Triticum aestivum
  Clone ID: PAT_TA_45567
cgtccgcggacgcgtggggtcggcacgccgagtcgagtcccgaatccaaatccgccattgcacaggcggaccagtccactcgaaccccacgtaccctctctatcccaaccctagcgcggcggcggcgtcgatggcgtctatggcgtcgatcccatctgacgatgtctccgagaa

SEQ ID NO: 45568 - DNA, 342 bp, Triticum aestivum
  Clone ID: PAT_TA_45568
cgtccgcccctacacatctcattcccccacctcccctcccgtcccgataaggcggactgcgaccgagagaagctcccggctcgcctcctctcccctctcatcgcctgggagaatccgacaagctccatccatccagaggagagggcaggaggcggaggagggacgagcggccgtgcctacctatctatctacgccggcggaatggactcgtgacactggatctcgcgcctggccggcggcaagcggttctactccgcgcagctcggtcacgccgatcgggcggggatgtgacgagctggtcatagacggcgaccgagatcgcctacatggcctcgactttac

SEQ ID NO: 45569 - DNA, 418 bp, Triticum aestivum
  unsure (1)..(418): unsure at all n locations
  Clone ID: PAT_TA_45569
cgtccgnacaagcgtccgatcactcgtgcgcataaacgctgtgctggtgaaccccatatgtctttcaatcatgatgggcatggtgaccttcattttttgctgacttcatatcctgtacaacatgatgtgaatcatcctcatgatgtgaagatgttttcaggtccaaaccaagcattttaagtttcctcggggaatccattcctgacgaatcattttgcaactgctggtcagaagcctgcactcgggggaatacctgttaccacatctcattcagctttttcctctgctggcgttgctgctggaacgtccgaactatgtgtggaaccatttgctcaacttaccatcttctatgctggtactgacaatatcgtgggtgatttttccactgagaaggcacaagctatcatgtcgtttgctg

SEQ ID NO: 45570 - DNA, 356 bp, Triticum aestivum
  Clone ID: PAT_TA_45570
cgtccgtccgtgcgtctctcttttcgtccgatcctgctctttattcattagcctctctccccccacacaggcttagcaatctaggcgcagcgcctccggccatctcgatattgcgttcgaggcgatcaagaggaccaaggccgagaagaagatcgcgtacgaccagaagctctgccagctgctcgaggagtacaccaaggtgctcatcgtcgtctccgacattgtcgactccaagcagctccaggagatccgcaagggtactccgtggcgactcacatcgtgctcatgggcatgaacacccttattcggcgctgtatcatggtgcacctcggagatgaccggctaacagggctttt

SEQ ID NO: 45571 - DNA, 201 bp, Triticum aestivum
  Clone ID: PAT_TA_45571
ccggattcccggtcgaccacgcgtccacaaccgatcgctgatctcagattacctgctgcttctctccttcgttccttggtttgggctggtctgatcggcatggcgacccaaatggacacgttacgtatgttccgccgcgccgcggagatgatgatggtggcgccgcccggagcctccttctacgagcaggacgaggacatt

SEQ ID NO: 45572 - DNA, 262 bp, Triticum aestivum
  unsure (1)..(262): unsure at all n locations
  Clone ID: PAT_TA_45572
cnttcttactcttctagggttctgtcatcagatgattgccaaagaacaacacgacactcacactctgaaggtctctgtgctccagaagcttcggaataactggagggatgagtgaggatatgcctgtagcgcgagttggtattttctaggccttggaataaacaattgcctgttccattttgcggttgtcttacatgtcgatatatattcgccccccttagatgaattcgtggagggggcgagcctgatcaaactggggact

SEQ ID NO: 45573 - DNA, 217 bp, Triticum aestivum
  Clone ID: PAT_TA_45573
cgtccgtccactctatcttcatgagtagcttctattaattttctatcatggcttctcggctagcttcttttcgttgctctcgctctgctcctgaccgtcatcttcagtgagtcccaggcggagcctgccgtagtgtttagctctgacaagtgcctggtttgctccctggaccacgtcagtgctgaagatgccctcaaaggtctccaggctaccatta

SEQ ID NO: 45574 - DNA, 237 bp, Triticum aestivum
  unsure (1)..(237): unsure at all n locations
  Clone ID: PAT_TA_45574
ctttcgctttctttntcctccacctctatcgctcctccttcccccggactccaccttaaccccctgtccgtcgtgttgccgcggagccctaggacggtgccgccgcgctaccggcatggcgcattcgtcgcaggaggcgatcgaaactttcatcagcatcaccggcgccgactaggtcgtcggtgtccacaagctcgtggggcatagcggtgacctatatgaagcggttaaatggca

SEQ ID NO: 45575 - DNA, 162 bp, Triticum aestivum
  Clone ID: PAT_TA_45575
cctcctctcctccactcccccttgttgctcatcatgaaaagcgcggctcggtgccggccctcgtgagtgaggtaggactcgcgcaggagggagcgtctaaccatggtggggtcggtcgaggtctttgtcaatctgctgttttggtcttcgatttgcattatt

SEQ ID NO: 45576 - DNA, 168 bp, Triticum aestivum
  Clone ID: PAT_TA_45576
tcgtccgcgttctcgttggccctcacgcttctccttcgccttgagcagctcagggacgcgcgcaggcatggcgactgagaccgagaccttctccttccaggccaagttcaaccttctccttttgctcatgatcatcacctttttactccaacaaggagatcttcctcc

SEQ ID NO: 45577 - DNA, 180 bp, Triticum aestivum
  unsure (1)..(180): unsure at all n locations
  Clone ID: PAT_TA_45577
tcttcncttaagcaacaaagccagctactgatatgatgaatgtggacggagatgtgccccagactgaagttactaatgcctatgaatgtggatataatcgtggatactactcttagccaagatgttgctgtcaaacatgatgctggtgttaaaatgcctttagctgctgttttgattgtt

SEQ ID NO: 45578 - DNA, 259 bp, Triticum aestivum
  Clone ID: PAT_TA_45578
cgtccgcggacgcgtgggcgtgaacccagccggatccccaaacctccttacggtccgacgccttgtgccgcctggaccgacgggggacccctccgcctttcacgcgtaccaacagcctcgacgtagtcgttccaattccctcgccgaagcatcgcgttccactccttcggcgactaggaacactataccctgatgctcctgatctagagtatgaggggcataaccattcagatgaattaatgaatacacatgagcgtgc

SEQ ID NO: 45579 - DNA, 428 bp, Triticum aestivum
  Clone ID: PAT_TA_45579
cgtccgcccacagttccgtcctcgctttcgaccacgcgtccgaaagaaacatggatctattctgccgggaaaattctcctcccagtggtgtcggccaaccttgtgtcctatatatcattccttcttcgatctgttgtcaaattccaatttcctaggttttctcgatcgatctattgatccgccaatttcaatttgggttcatattgttaggtgctgtcccatttcctattgatgttccccgcttaaaggagcttggtgtccgtggggtcatcacattgaatgaatcatatgagactttggttccaacgacattatattatgctcatggaattgatcatctggtgattcctactagagattactgttttgctccttcattgaatgacattttccgtgctgtggatttcatacatgaaaatgcattgtct

SEQ ID NO: 45580 - DNA, 368 bp, Triticum aestivum
  Clone ID: PAT_TA_45580
cgtccgcgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgatgagatttgctgtttgctgctcagcaaagcaggatacagtggagaaggtttgtgaaattgttaagaagcagcttgctgttcctgaaggcactgaagtttgcggtaccaccaagttttctgaccttggagctgattcactggacacggtcaagattgtgatgggcctttgagaggagttccagatcagcgtggaggagac

SEQ ID NO: 45581 - DNA, 255 bp, Triticum aestivum
  unsure (1)..(255): unsure at all n locations
  Clone ID: PAT_TA_45581
cctccnataacatggacctatccaccttcatcttatctgtcttcctcttcctcctcgtacttgtggtggggaccagcatcagcgggcgtgggctcgcatgagccgttgatgcgggcaacgtttttcgtcttccgggtccggctaatcggtcgcgggccggatgacaagaccaccgtcgttgtgcatagacacgacctgtccttcgctggcttaaccgacggcagcggtcattggcacgcctttcctggccttgtt

SEQ ID NO: 45582 - DNA, 297 bp, Triticum aestivum
  Clone ID: PAT_TA_45582
cgtccgcggacgcgtgggcggacgcgtgggctgcactgcaagaagccaaagcgaaagaaaaagtgagacctcatctctttcagctaagctcgcaatggagctcccatggggtgccctgctgctggcgctgctcaccgtctccgccttctccgccgtcgccacgctcgccgtcaccgttcccccttcggcccctgcccgtgctcctgcccccgtcaccgcccctgccccggcccatgcatttcctcaagctcaggacgctgaaggtctgctgatgaacggcatcttcgagacggcgcc

SEQ ID NO: 45583 - DNA, 438 bp, Triticum aestivum
  Clone ID: PAT_TA_45583
cgtccggttaaatgcttgttttcaggccaggagtggccttggctgggaatatcccctagcaactccatcacacaactgatgagagtgctcatgtgagcaaccaaagggatggacttctgagatagccgaggtcacttttctcacaaggtgaccacactagtttagcaggaatcaaacacaaacacaacccctttcttcaacaggttcattgaaaccttggctcactactaggcaatctttgagtccattgatgtcaccctcccaagagatagcaaggcgaggattaatgtggagcaacattgtctggccagggatattgtgaatatcattgcttgtgaaggcaaggaatgggttgagagacatgaactgttccgcaagtggaagtcgaggttaacgatggccggcttccgtcagtgttccttgagtacttacgtgaat

SEQ ID NO: 45584 - DNA, 266 bp, Triticum aestivum
  unsure (1)..(266): unsure at all n locations
  Clone ID: PAT_TA_45584
tcnttctcttactcgtgttctcgtccacatctcggagcctttcttcacaccattcctccggtccactcggcggcggcgccacactcaccctgcggtccaccgactccgtcgccacaccatcctccggtccaccggcgccgccggcacaccatccgtaggttcaccgtcggggcagcaggttcaccattcctcccatctaccgccgcggcgtgtcttccccttccttgcggtaggacggtcctttcgtctgcattttttctcaccac

SEQ ID NO: 45585 - DNA, 210 bp, Triticum aestivum
  Clone ID: PAT_TA_45585
cgtcctcccactcgtccgggcagcatgcctccattctttgttacttatgaatacagaagagggtggcttatcatagtgtgggaggtgcatggtcatactgctatgcaatctgtgatggaacaaacaacaggggtaaggggtcatgaacatgtcattgtttttccaagggatagctggctcttggtctaatcttctcacaagtgttatttt

SEQ ID NO: 45586 - DNA, 299 bp, Triticum aestivum
  Clone ID: PAT_TA_45586
tgcgtccgcggacgcgtgggcgaggtcaagtcgtctcgtcccgtgctgcgtttctcctcctccccggattcgccgtctgcggttctctccaccgaacaagctcacacatcaagacaataaatagagcctgtctgtttggggccaatcaaaccaaacaacaagttcatgtctgatcttgacgtccaggttccaactgcttttgatccggttgctgagggaaatgctgaggactccggcgctggtgctggatcaaagaactatgtgcatggtgcgttgtccagcagcgcaacggaagaaag

SEQ ID NO: 45587 - DNA, 251 bp, Triticum aestivum
  Clone ID: PAT_TA_45587
cgtccggttttcattgtttggagaacacacaatactcctcccaccttagcagcgcaatggcgaccgccaccatgtccctctgctcgaccttcgccggcaagtcagtgaacaacgtggcttcatcaactctctatggtgaagcccgagacactatgcacaagaccgcttcaaaggccaagccggttttatcatgcttcccatggtacgttgccgtccgtgtgctctaccttggtccgattttcaaagagccc

SEQ ID NO: 45588 - DNA, 357 bp, Triticum aestivum
  unsure (1)..(357): unsure at all n locations
  Clone ID: PAT_TA_45588
tctttcncacagcttaacttccacccactctcaaaccctctcgccggagccctcatcatggagcttgcaagcaagatggacggcagcagggcgatgaaggtggcggcgaaaaagtttggcgggccgaggaagaagtcggtgaccaagtccatcaaggctgggctccagttccccgtcggtcgcatcgggcgctacctcatgaagggccgctactcccagcgcgtctgctccggcgcccccgtctacctcgccgccgtcctcgagttcctcgcagcccaggtgctggagctggccggtaacgcctccaaggacatcatgatgacccgtatcgtgcccaggcacctgttgctgttcatc

SEQ ID NO: 45589 - DNA, 314 bp, Triticum aestivum
  Clone ID: PAT_TA_45589
tcttcctcccactcttccgcttctccgtctcgcccttgtgttggtgtaggagccatttcggaccaggtcaccgacgaccagatcgccgagttcaaggaggccttctttcctcttttacacggacggttacatctgtatcaccaccaatgagcttgaaactgtgatgcgctcgttggggcttaacccctctgaggcatagccgtaggatatgatcaatgaattgtgatgctgttggctttggaacgtttgactgtcctgatttcttcaacctgatggctcgtaattttaaatattctgattccgtggaggatctt

SEQ ID NO: 45590 - DNA, 126 bp, Triticum aestivum
  Clone ID: PAT_TA_45590
cgtccgctcactcgttgtcttagaaacaagcatgcggataccatcgctcgggggttgctgctgaagtctcatgtctggagatactactactgctacaacatttagatggtggccaggtgcaccgct

SEQ ID NO: 45591 - DNA, 142 bp, Triticum aestivum
  Clone ID: PAT_TA_45591
cgttcggctacacatacacggcgcgcgcgacacgctttgtatagacagagagaagatgctcggcgacactgtgctcatacaggagccatgggtcatcttcctgtccacccttgacactctgtactcaacagacgtggcagct

SEQ ID NO: 45592 - DNA, 157 bp, Triticum aestivum
  Clone ID: PAT_TA_45592
gtccgaaatatccatgccttgtaaggaaagcatattattatcctcatgttacaaggggcggcatgccccaaatatttcaacaacccagacatatcatgaaccaaatgaccctatcattccaacagtctggggcagtgatacttggttaagctttctc

SEQ ID NO: 45593 - DNA, 232 bp, Triticum aestivum
  Clone ID: PAT_TA_45593
cgtccgcccacgcgttccgtccacgcgtcgcgactactcgtactcgagctcttacctagcgcacattgatgagcacgcttactggttatcgttgtagccacaaaggtgttcaaaggctaatgctagaacacagtcttccaggcaccgcataccacttttaggtgtgacttgaaggagtttggcagattcaaatggacccttatccaaacccatgaattttttcttcatgaca

SEQ ID NO: 45594 - DNA, 235 bp, Triticum aestivum
  unsure (1)..(235): unsure at all n locations
  Clone ID: PAT_TA_45594
cctcctctaccaccgntccntgacctccatcctgctctctcaacttcgaaccaaggtcgagtgtcgtcagcgaccatgtctcggtcagcggcaagggaggcatatgtgcctgggcaagaggcggcaccaagctgccaccggtaaggtgcgtctcgcgacaacatctcaggggcattaccaatgccgtcgattacggcagcctcgcttcgggagggtgcggcagtgatagcgcatc

SEQ ID NO: 45595 - DNA, 264 bp, Triticum aestivum
  Clone ID: PAT_TA_45595
cgtccggtccgcccctcctcccctcccctcccctccccacggccgcctccaccgcgccacaaatcccggcgacccaccccgcctcggaaaccaccacctccgccgcgcctccgaatcccatccgtgtccgcgccggctccgtctccgtctccgtctccgtctccgtgtccgtgtcgtgggcggtgagccggtgacgacccgtaccctgccccgagtcggagaggggcggccgaggctttttatcctttccgccccatatgggcc

SEQ ID NO: 45596 - DNA, 316 bp, Triticum aestivum
  Clone ID: PAT_TA_45596
cgtccgcccacgcgttcgtccacgcgtccgcccacgcgtccgccggcactgagattccatcctctggcatcaatccaatcctcctgacacgaccatggtgagcgctagggatgtcgacacgacgacggcggcgaacaagcagcagcaggccacctgcctggcccccaaccccggcaaggccacgatcctcgtcctgggccacgcttttccgcagcatctcgtcatgcaagactacgttcgttagggcttcatgaggaacaccatcttgcaaggatcctgagctcatggagaagcttaccaggctatgcaagacgac

SEQ ID NO: 45597 - DNA, 157 bp, Triticum aestivum
  unsure (1)..(157): unsure at all n locations
  Clone ID: PAT_TA_45597
ccgtgcgatgtagtttgtgacccaaacccnaancccctctcccccccgcgagcctaggccgcgggcgcgcaggtaggcgcgggtgggcaatgtctgtcaaggaggacagccggatctttatgggcgggcttttggttcacacccactagcgcaagct

SEQ ID NO: 45598 - DNA, 363 bp, Triticum aestivum
  Clone ID: PAT_TA_45598
cgtccgcccacgcgtccgcccacgcgtccgctaattctcctcaccctctttcaccgtcgatgccagccgccagctctgtgcagaccggccacccgccaccgaccggccttcccctcgcgcacctaccccccctaacattctgcagcgccccgccccaccgcgccccgactcccttcctgacccgccgttgtcctcgacgccagccagcatgggcggcttctttccccaccgccccagccccggatccggcgaggatccaccaggtggtgcctcaccttcatcggcgggatgtctctggaatttacgggagggggttcgcgcgcgcccattcttttacccccccattcttccgcgttgattccg

SEQ ID NO: 45599 - DNA, 315 bp, Triticum aestivum
  Clone ID: PAT_TA_45599
cgtccgcggacgcgtggttgccgctggcctccaccctgtcgataagccatcgtgtcggagctaggattcccgtgcccccgagctgcagcctgacatccacccgtccttgcgcttcaccccttaccccaagaccgaaccgccgtcctcgggccgccccctcgacatacagccgtcgtccttgccaatccccgtttctgctgcagtcggagccccatctcctggctcccgctgttgccgaacctgctgttgtcagggctccatctttgggctctcgctgctgtcggacctgctgaacgggacctgctgatgctgggg

SEQ ID NO: 45600 - DNA, 432 bp, Triticum aestivum
  Clone ID: PAT_TA_45600
cgtccgctcactcgtacacccactcttctgttaaactctagggtttcccaaccaccggggtaagcgttaaccctgaagggggcacgactcttatttataaccaccctatcacccccggcgatgtccattgcggttgctcatggcggcgagaatcctgcgcttaggaagccggtgttcttcaaggtgggccagcttaagtcgtgcaccaacgggcacacccttatcttttaggtcttatatgagccaaccccattcctgggcgcgtgcgcactggtgccccctgcttcttcttcggccgcgcccccctgattgtggagttccttcttgggcgacaaatacttggctctcatcaatttttacttgccccgcaacgaacctaaggtggatttgggtttgccaactcttttggcccttttcattattggtgccctt

SEQ ID NO: 45601 - DNA, 400 bp, Triticum aestivum
  Clone ID: PAT_TA_45601
cgtccgaaggcttcatcaacccgtcggcggggctgcaccaagttggaacgggctgccagcacgggaaccggggggctgtggggttggtgccgcggcacccctccctaaaaccacccgcaccttgcttcggcccatcaccctcatctcccggcttaccaccttggcggatttcgggaggcggcgggcctacccccgcaccacctcgatggcttccgagacccggctcggctggcacctgggcaccccgacagcctccgcgagcgatcttctccggcgggccaccactttgtaggccacgggggaggggccctgccccccgcatcggacatggccggggcgctggaggaacgtatcggggcggggattgagggggcgcacgcgctgctctgacagaaccagc

SEQ ID NO: 45602 - DNA, 394 bp, Triticum aestivum
  Clone ID: PAT_TA_45602
tgtccgcccacgcgtccgcccacgcgtccgccccaccttcttccagcactcacgagtcacagccgaccagcgaagcccccgaccccgatcagcctcagcagcgatggcccccaaggcggagaagaagccggcggcgaagaagcccgcggaggaggagccgacgacggagaaggccgagaaggccccggcggcgaagaagcccaatgccgagaagcggctgccggcgggcaagaccgccttcaaggagggcggcgagaagaggggcctcatgaagggcaagaagagcgtttagacctacaagatatacattttcaagggtcttaagcaggtccaccccgacatcggcttttccttcaagggcatgtgcatcatgaactcctttattaacgacatc

SEQ ID NO: 45603 - DNA, 272 bp, Triticum aestivum
  Clone ID: PAT_TA_45603
cgtccgggccgatggggtgggcgatcgcgctgcacggcggcgccggtgacattccgcgcacgctgccgcccgagcgcagggaggcccgccttgccacactccgtcgatgccttgacctcgtcgtcgtcgtgctatcgggccggccggttctcccttgacgttattgatctcttatttagtgatatggttgatttttctttttataactattttaaagatattatttttattaattttcatattcttatatttatttattttttcttattttt

SEQ ID NO: 45604 - DNA, 272 bp, Triticum aestivum
  unsure (1)..(272): unsure at all n locations
  Clone ID: PAT_TA_45604
cgtgcgctcgcctncgctcctagggtttcccgccgcgcaccacccccaaaaccctcgctccccagctccccggtgatcggaccaagggcgggagttgccgcaacgaataaactcacgctcaaaagctccgacggcgaggacttctaggtggaggtggcggtggccattgcttctcagaccattcaaacacatggtggaggacggctgctcccgacaacattattccggttcccaacatcaccggcaagatcctcttcaaggtcattgagtac

SEQ ID NO: 45605 - DNA, 239 bp, Triticum aestivum
  Clone ID: PAT_TA_45605
cgtccgatgaaatgattactctttcctcgagttcaacaacttgaaaaaggcaacttgggattggggagagcaaatctggtgctggtgtacaatttttactaaaatgaagtcaaaaaggactccctggcttacacgattgaaggaccattgataataaagtactgcacatgctgaaagatgctctaaatgacatttcatttaagaaagacgctatatttgtcccttaggaggaatctcta

SEQ ID NO: 45606 - DNA, 412 bp, Triticum aestivum
  Clone ID: PAT_TA_45606
cgtccgaatggattccctcgcgacgtccacggcccggagtatgggcgctctgctccctcctctggctctgcctcttctgcgccggcctcctcctcggctcccgccccttcttcttccccgcgctgctgccgccgccgtgggagcacttctccaggctgcagcagcagcccgctccacgtcctcatcttcctcctcctcctcatcatcatgctgctgcctaccatgaccacgacgactccacggcaccagcgccggacgccggccccggagatcttggcagcgaggaggagaagcgagaccaggagccggcagcgttagcgcccttctcccttcgtgctgctgctggttaccatgaccccgacgactcaacggcgccagcgccggacgccggctcgggagatgtccgcagcca

SEQ ID NO: 45607 - DNA, 375 bp, Triticum aestivum
  Clone ID: PAT_TA_45607
cgtccggccgccgcggcgaccaaaccctagcccgcccccgccacaccacgacagcccgcgcgccgtactccgccgcggcagtgttctactcccactccgtcctggctcggaagagcccgctgggcacggtgtggatcgccgcgcacctggagcgcaaggccatcaaccggacgcagatcgacggcgtcgacgtccgctcctacgccgagtccataatggaccccgaggtccccatcgcgctccggctgtcggcgcacctcctcctgggcctcgtccgcatctactcgtggaaggtgaaccacctctttcaggactgcaaccgcatgctgagcgccatcaggaccggcggcggctttggccccgcgcgggcggata

SEQ ID NO: 45608 - DNA, 194 bp, Triticum aestivum
  Clone ID: PAT_TA_45608
cgtccgcggacgcgtgggcggacgcgtgggttgccaacttcggcaactgcgcccagcaaactgtgattatcaccgaagcagttattagagatcccgcggtgaatccaaagaaatatttcaaagttctgtcgatgcaaggggagcaagaaatgcaggtggttggtagccgctttgtatgccaggacacagatatt

SEQ ID NO: 45609 - DNA, 378 bp, Triticum aestivum
  Clone ID: PAT_TA_45609
cgtccgcccaagggcaaacaaagcacccacgccgccgcggcgatcccacacccgcagcctccctgccgcagatcgagcggcgcggcgcggcggccggcggccggagggagatgaggaagcgcgagagggagaacccgtgcggggtctgcgggcactaccacaagtgcgaggaaggggagatatgcggggtctgcggccacaggcccgccgcggcggacgcggtggccccggcgagggtcgactccgccttcccctccgaggtgctcaagggcttcctctttctcggcagctacgacaacgcctcccgcttcgagggcctcaagacgctcaacatcacccacatcctcaacactgtggccgggatgccataaactttac

SEQ ID NO: 45610 - DNA, 220 bp, Triticum aestivum
  Clone ID: PAT_TA_45610
cgtccgcggacgcgtgggctcgccgctacgcatcaaccgctcgcgcctcggcggctccttcgtggggcaccacccctcccggtccccggccgcgcaatggcggacctagcgctcggcgcggggccggaggagatttggcggcggcgccccaagaccaagatcgtgtgcacccttgggcccgccttgcgtggcgtggtgaattttctttggatctttgcgc

SEQ ID NO: 45611 - DNA, 291 bp, Triticum aestivum
  Clone ID: PAT_TA_45611
cgtccgcccacgcgtccgcccacgcgttcgcccacgcgtccgcggacgcgtgggtcgcgatgctggaggtggccgctgttgttggtattgatgactttgtatttttcttcgtagttttacgttctcgtgatgtatgggattggcagatcgagggttttattttttgtagggcgttttcattaatttttggtttcccacaagtgggttttgggtttttttccttttgattctgggcttttttttatttcggtttaaaggttttaatttcttttgttttatgggttttctttt

SEQ ID NO: 45612 - DNA, 107 bp, Triticum aestivum
  Clone ID: PAT_TA_45612
cgtccggccacgcgtgcgtcagtagctgcataagtcagtaaccagcttgagaagcagacatggggacaataaaatggagcagaaaatctcccggcgcgcaggtcgtg

SEQ ID NO: 45613 - DNA, 263 bp, Triticum aestivum
  Clone ID: PAT_TA_45613
cgtccgcccacgcgtccggcatacctgatttttgcatctactgcagtggctaaataactgtgttggactcggggaactattttacagttgtgtgctctgatgactactaatctcctctggccttgctatttaagttggaagtaggcattggctgttttggtatgtgcttcgtccactcgtaatgcttgaaaaattattcaagacagcttgggaatggattaaccggctttcgttgcaactattgaagaatatttacttttttt

SEQ ID NO: 45614 - DNA, 355 bp, Triticum aestivum
  Clone ID: PAT_TA_45614
cgtccggaatcaagccacccgcctgcacccctctctgagcgaaacttcgatccgcagcggagagcgatggaggtgttcgagggcgtggacttcgtgcggctgctgagcatgcagcacggcggcgcgtacgtgcacgccgccaaggacgggcgcttcgttcgtcttcaacgcaccggcctgtcctggtcgtacaacgcggtgtgggcagtgcagttgcttatcttcgccttaggcacgctttacgttcttcttcgcggcgcctacggtcggtaccttgggggcccctacgccaggacgcgcgggtttctttggccgtttccttcccccttgcgggttgccgcgcagtgcgactttt

SEQ ID NO: 45615 - DNA, 242 bp, Triticum aestivum
  unsure (1)..(242): unsure at all n locations
  Clone ID: PAT_TA_45615
cgtccgcccacgcgtccgccacgcgtccgcccacgcgttcgcccacgcgtccggcggtgtgctcagcagcaggagggacgcggctggcggntccagcgatgaagaggacaatgagatggagggtaggattgccatgtactctgagaagacgagtgatggccagaggagctcaaaaggagtgtttcaggggatcaataataggggccctgctgccagtttgggggctatgaaagataggttta

SEQ ID NO: 45616 - DNA, 320 bp, Triticum aestivum
  Clone ID: PAT_TA_45616
cgtccgctccccactccgaaatgagttcgctggaggacgccctgggagacagcgccatggcgccgaccatcggctcccgggtctccgccgcccgcatcgccgtcgtcgagctcgaggacgacgacgacgacaccggcgtcttcaaccccgccccccgctcccgcgccttccggggcctcctcgacgcctcctcctcctccccggccttccccaagcgccggctgccgatgtcccccatctgcattgacgacgacacccctccgcccccgccgaagcggcgagagcccggatccgccgcgcccgggaccggaactcccccg

SEQ ID NO: 45617 - DNA, 207 bp, Triticum aestivum
  Clone ID: PAT_TA_45617
cgtccgcctacgcgtgggcgcctccacttccatcgccttcccaagatcgcagatccgctccggtgagaatccggcgccatgtcttgcagcgaggtcgcctgcacccttgccgccctcatactccacgatgacggggatcctcatcacttctgagaagatcgcgacgggggtgaaaggctgcccggaatcaaggttgaaggcctactt

SEQ ID NO: 45618 - DNA, 239 bp, Triticum aestivum
  Clone ID: PAT_TA_45618
cgtccaatcccctgcctaccccagagattgttaggcatttttcttttttcggtggagaaatctcaagaggcgggcaccatgctcgtggaccaggacaagctttccggcgacgagcttatgtcggattcgttccctaacagggagctgtataacggcgagctctgggaagttgatgaccattgagttgttcaaggagccagttgacgagtacattgtagccattccctctgttgagggtg

SEQ ID NO: 45619 - DNA, 412 bp, Triticum aestivum
  Clone ID: PAT_TA_45619
cgtccggtgcaacgtcgacagatcctcgccccgctgcccatcgggttcgccgtgttcctggtgcacctggccaccatccccatcaccggcaccggcatcaacccggcgaggagcctcggcgcggccatcatctacaacagggagcacgcctggtcagaccacgtgagtgaacccaaactgaaacctaacacccctcctttcctttgtctgaacttgaaagcatggcacttgcatgcttggtttctgcagcagtagtaaactgcaggctgcaggcatgtggtagcagtagtattcagtaacttaaagctgatgcagacgcatagctactctctattgcacacctaattaaccgatgggaaattgggaagcttattcatctggtgaactgatgtggcagtaactggcataattg

SEQ ID NO: 45620 - DNA, 229 bp, Triticum aestivum
  Clone ID: PAT_TA_45620
cgtccgaaaaatgcaaccagctggagtaaagccgatacagcgaccacctctaccttggacagcgctggacgggcgcacacgaccgacgcccggcgaacaagactcattatgcctcgtgtgtgcccccatacacagggaggccacgagcgtctccatggccacgcgtgtccgcagcaggtcgtcatgcaagactacgtcgtcgaggggttcatgaggaacaccaactgct

SEQ ID NO: 45621 - DNA, 299 bp, Triticum aestivum
  Clone ID: PAT_TA_45621
ttggttggtctgataacgaagacattgtggcgtacgccaaataggttcatcttagagcgaaatggtggttcaacaatatcctagatacgtaactgacaagcacactgcttatttctcagtactcgatagttaccaaacgagcaacaattgcaacatcctatacagctaaagagctctcatttcctctggcttcaaaacgaaacactcatttgcttggtggtagtagcaagagtacggttgcaaaattcagcagaacacggccagccttagtgggattcgatcggcgccgggggggcgct

SEQ ID NO: 45622 - DNA, 418 bp, Triticum aestivum
  Clone ID: PAT_TA_45622
cgtccgcccacgcgttcaggagaggagaggggagggggatagactataaggggaacggaaaataaagccagggcctctcttgcggagggcaacggcaaggcttccttccttgcgccctcgcaaatcagttcagcggttcggcttctcgggaccattgttggttctccgaaatggaattacacagggatgacttgtcatcaccaccaccactcccgccaaatgcagagccgataaaagctgagtcggctgatgacttgccaccaccaccacccctgccggctatcaaacctgaagaagcatagaagatttcaaagcctaagaaggccctgatcgttcgtcctggttttggcaagaggggaaatcctatacaggttggggcaaaacattacaaagccctcgttgaaaccacagatgaatt

SEQ ID NO: 45623 - DNA, 423 bp, Triticum aestivum
  Clone ID: PAT_TA_45623
cgtccgaaaaacaagctaatgttaatgaaagaggatctgatatcccctctttagggagttccatgcaaacaagttcaacctaagaggcgtcaacagatccttcattgttttcacaccaaagattgaatgttccgtgagactggagactatggaccgatttctttagtgcacagcctgatgaaacagaagtcatgacaaacagactccagcttctgatttgggtcctcgttgatatgattcaatcatggtttataaggggtgctcaattgttgagaactttgttttggcttctgaattagtgcagtctgcaaataaagaggaaaccaatgactgctaaaactggactttcaaaaggcgtttgacacggtgctttgggattgcctctttcagctatgcagcaccggaattttcttacggattgga

SEQ ID NO: 45624 - DNA, 276 bp, Triticum aestivum
  Clone ID: PAT_TA_45624
cgtccgcaggtagagctgcaacagtttgccacatctcccttccctcccttgcatgccgatcgccgccaagggcgctctacttccagcgccggccctcgccggcgccgccgaagccccccgacccgcgccgccggccctgccgcggggcgagcgccttcttcccccggcgtcagcgcagcttggccgtctcaaaccaccaccaccaccatcatcacaagctgggccaggatcttgtgtcggcataccaaatagatggggcctaacttgcgggacgtg

SEQ ID NO: 45625 - DNA, 193 bp, Triticum aestivum
  Clone ID: PAT_TA_45625
cgtccggtttctcttcccccacttcttccacgccggcgacttcaccagaatccaaatcggttaatcgaaacggctcctcctcctcctgcgctcgtcggcggcaaatgcatcgaccccgccaggcccgcgcttccgggcattcgcagaacgcccgcgaccccgcctcgaaccagattccaaacgcgcggggatg

SEQ ID NO: 45626 - DNA, 382 bp, Triticum aestivum
  Clone ID: PAT_TA_45626
cgtgcgcccacgcgttcgcggacgcgtggtggtcaatatggtcgagtttgtgggtacattgagcctctgggatcaaatgctgaagggggatttgaatttgacaacatgattattggacaagcaattcccgtcaactttataccagcgattgaaaagggtttcaaggaagctggcaattcgggtttattaatagggcatcctgtcgagaatattaggattacactgactgttggggcttcacataaagtctattccagggagcatgcgcttaagctagctgctatttatgcttttaaacagggctatactggtggtaaacctgttatttaatagccctggatcgaatgttggaactaaaaattctcaacatagtttcagggca

SEQ ID NO: 45627 - DNA, 196 bp, Triticum aestivum
  Clone ID: PAT_TA_45627
cgtccgcgattgcagttcaaaaaaaatataaaatactagatacaatctctgtgggctgtaggtttgaatgcacaatcttgatctaggcgtaaatttctccaattgaattcataatcacgtaatcagtgatgatttgattcattctctttgcttggtggacagcattccagtacatgtacttgctgggatctgtgca

SEQ ID NO: 45628 - DNA, 196 bp, Triticum aestivum
  Clone ID: PAT_TA_45628
cgtccgctcagactaatggaaagaagtgttttcagtgacaggatggtatttgtccgtgctgttcacgaagctaactggatgaatgagatggatatcagcatatacgattcctggttcgatcctgtggtgtcatcgctcccaggtcttatcccagatggatttatttatctaagagccagcccagatacttgccata

SEQ ID NO: 45629 - DNA, 423 bp, Triticum aestivum
  Clone ID: PAT_TA_45629
cgtccgcggacgcgtgggtcccaatcctcgatctgttctcagaccctcctccgtccgtcgcagctccagatttccttccgcatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccaccggtgttttcaccgacaaggacaaggctgcagctcacatt

SEQ ID NO: 45630 - DNA, 284 bp, Triticum aestivum
  unsure (1)..(284): unsure at all n locations
  Clone ID: PAT_TA_45630
cgtcctcntactcgtgatttcaaccatgctttccatcttcactgcatactcaagtgggtcaattctcaagggtcaacctccttttggcctatgtaccctaagtagatgcatttcaagggctaaggatgactcaaactatgtcagtaccaagagttttcatatcttctcgtttaaaactagaatgaatgtgtaactggaatgtaattgggttgtcttgttagtaccctgtcatactttctggaagtaaggaatgtcgtcattttttaagtgaaaccttgatacct

SEQ ID NO: 45631 - DNA, 419 bp, Triticum aestivum
  Clone ID: PAT_TA_45631
cgtccgcccacgcgtccgcccacgcgtccgcgctgggttgcgccaggtcgtcttcatcctggagacggattcctgcacgggaacgagttcttcactgtcccgacccaaatcttcgatggatttgatccattcttgacctctctcccacgccctaccctttatatattctgcccaactcgtcctagtccggttttcgccaaaatctccgtctcctgtgccctacagagccgccccgatctcgccggagtccgccgcccgaagctcctgtcgccggtctctttcgtcgccgtcaaagggtctctacacatctcctccactctgtcctcttccccttttactcctccacttcccttaccttctaaagcacgtaggggagcaccaggacgaccgcaacgaccttggtccggagctcaactccg

SEQ ID NO: 45632 - DNA, 209 bp, Triticum aestivum
  Clone ID: PAT_TA_45632
cgtccaccgacgcgtgggccctatctcgctctcgcggccgagagatcgaatcggagaacaagaaggagcggagaggcctctgctggcctaggtcccccgcccccgcaccagccatggcgctcgtcgttcgccttgtatcccgctcccgccagttatattctgtccaacctgctttggccaagggaggtctaactcaagtccgctcattt

SEQ ID NO: 45633 - DNA, 248 bp, Triticum aestivum
  Clone ID: PAT_TA_45633
catacccctgcgacaacacatgccgcaacatcatatatgaagatcttccaagctaggtccgtctcgagcctcatgattaggaggtagaacccaaggcggggtttttttttttttttagtttaccatagagacttcacttcaggccggatgatatgtcttttggtatgatgtaattatgaaggtctctttggactaaacttgttaaatgtactttatataaaatgaagaggctatacccccaatttttt

SEQ ID NO: 45634 - DNA, 407 bp, Triticum aestivum
  Clone ID: PAT_TA_45634
cgtccgcccacgcgtccgcggacgcgtgggccgagaccgagaagccgctcttctctccgacagatgtctcgctccacgcatccacgaaggactgctgggtcgtcatccatggcaaggtgtacgatgtgaccaagttcttggaggaccaccccggcggagaggatgtcctgctccatgcatctgcctctggggatgccacggaggcttttgaagatgtgggacacagcacattagccatcagcatgatgagcagctacctgatcggaagcatcgaggactatgtgccctcccgtgcaacgaaggaccccacagctattggcagtgatgggctgccagattccagaacaatgcaaaggaacaaagggctctcccgcttccaacacatttatggacttcgggctcccttt

SEQ ID NO: 45635 - DNA, 402 bp, Triticum aestivum
  Clone ID: PAT_TA_45635
cgtccgcccattcgttcgtctcatcatatcagacatatagttagacattcactaccttgagctagccagccacagccagtccgggcatttatttgtatacacgacagaaatggccagcggttatagccagaaccggtcggccagactgactacaagaagactcacctgggatactcccgtagacgccgaggtggcccccaatactgaaggagtccccgggccagctaaggccgaaggcgaagcttctgccctctgctaggatgaagcaaccaaagaagaggcgccggtcgcccattgagactgaggaggccaaggagaccgatccagcaactgatgtcgagccggatgccgtatctcccaaagagccagaggtgccatccgtggtctagacatataccaatg

SEQ ID NO: 45636 - DNA, 429 bp, Triticum aestivum
  Clone ID: PAT_TA_45636
cgtccgcccacgcgtccgcggacgcgtgggggagggagtacttcacttttgttctaaggagagggactgctatcacttttatgctaactggagtactatatactactccctctgtctcagaatgtaagaccttttctgacactgaacgtcttacattttgagacagagggaaggctaaatttcctgagtaatacatcagatacaatgttggtcatgcaagatgtgccatcctgtttgggtgcgaaataaatgtgaaagctatatagggttttgtctgatcacacgatagaaaggtaaggttatggtgctcaatgaaatactgaccgaaatattttctttggttttatgattatccgagtgatattatctgggatggcacctttctcgtaatgacaggcatgactagagtgtcctacagtcaattcaaac

SEQ ID NO: 45637 - DNA, 429 bp, Triticum aestivum
  Clone ID: PAT_TA_45637
cgtccggtcggtgctggctcatcattttattgctgctgggagccaccatgacgagaaagttgctatgtatgccattgactcgctgaggcagcttggcatgaagtacttggagcgtgcggagctgaacaaattcacatttcagaatgacatactgaagccttttgttatattaatgaggaatagtcgcagcgaaaagatccgtggtctaattgttgactgcattgttcagctgatcaagtcaaaagttggtagcataaagtcaggttggcgttgtgtgttcatgatattcactgcagcagctgatgatgagaacgaatatattgttgaaagtgcttttgaaaacgtcgaacaagttatcttggaacattttgatcaagttgttggtgattgcttcatgtattgtgttaactgtcttattggtttttccaa

SEQ ID NO: 45638 - DNA, 439 bp, Triticum aestivum
  Clone ID: PAT_TA_45638
cgtccgcggacgcgtgggctgtctcgcccgatggagagagagagagcgagagctcgcctcctcccttccagatcgccgccgccacctccctctggcggagctcgccgccgtcccccacgcatacttccccctccaagacagcaaagccgcgccctctcccctcggatccatggcgctgctcagcgccggcgcggccacggtggtgtgggcatgcctcgccatgccgctgccccctacagtcgccgccccctccaccccagcttcaccggcgacctccctcccttcattcctcgagggcgcccgaaaccatagcccctcgcggacggggcgacaaagatggccaaggatccctccttcgcccgtgttccggcaaaaacggggccggatccgtatccaactgcggtggctgctgcgctaacaacaggataccgctcatgga

SEQ ID NO: 45639 - DNA, 464 bp, Triticum aestivum
  Clone ID: PAT_TA_45639
agatgtagactgaacccacttgatgagcagtcctatggaggaagctcaccatggcatgccgtagacaaccaccgcgttcttgctgttggcagggctccacaagttcatggtcatcttactggacttcctctcacacatcttcatatattggtggatcctgttagctccggatgagccgaggctatggtacggtcatcggcgcagacgctgtatcaggtgaggaactactaccggatgcactactggctggtggagtacctgtccaagcaccgtacggtcaccgtcgacatgcccttcacctactacgcctacatggtcgagctgtgcaaccttcagcatgtgctgaagaacaactagaactattaccccaaggtggaggtgtacagctcctacttggtcgtgctggtcttctacggcatcttcaacgccgacagcgagctcttgaggaagcagaggaagacggc

SEQ ID NO: 45640 - DNA, 445 bp, Triticum aestivum
  Clone ID: PAT_TA_45640
cgtccgaaccatacacaaggcgcacggttgcaaaacaagggagttatttagaagcaaggagtaaggaaccacctgaagccatgtgtatcgctgcatggatttggcaggctcaccctcagcaccagctcctgctgctgctcaacagagatgagttccatagcaggtacaggattttatttggtttcattcatcctcgcggtactccgatctgaatctctgaatagtaagcttttgttttcgagtttagctcttctcactcctgaattatatgttcgaagtcatatgtcatgccaacattccaatcctaatatcactgctcactttcttcactaggccacatcgcaaattatcttagagaagcctattcccattgcagaataacaatgatgtatggtcaactgctgttctccatgtattgcaggcctacaaaggcagtaagatggtg

SEQ ID NO: 45641 - DNA, 450 bp, Triticum aestivum
  Clone ID: PAT_TA_45641
cgtccgcccacgcgtccgcccacgcgtccgccttgatatagcttgataagccagcttcgtaaaatggatctgacattcagacatgtcggggaaaattctactccccgacatagtaaatgtacaatggaaattgcaggcaaaagaaggttctcttatcaactctttctaaaaaagaaggttctcttatatagctttaaataagacaaaatatatgatcgtctgatctctagatagaaacctggttatggttagtccgggtgtgtggaaggggagcatgcaaaatacacaattcttgaagttgattatctaatgcctggtttaccaaagatgttgactatcatcaattcccatcttctgttaggcacatgtttgcgtcatggcgccgagtagtctgtttggtttggatctacaactacaactaggccgaataggaattttggtagtggtggt

SEQ ID NO: 45642 - DNA, 371 bp, Triticum aestivum
  Clone ID: PAT_TA_45642
cgtccgcggcaacgcctcaccgcgcgccgcttttcatctcctacctcccatctcctcgacacccgcaattttcttcgccggtcacggctcccctccacctactggtcgcgacctcgcgggaggcatacgatggaaggagggtgcggcgctggcgtccggctcctggagctcgagcgggctgatctgcgcgtcggcgacctcgtgggaggaagaggaaggagattggagggtggcgccagcgggctcgcagacggggatggagagggcgagtgcaggcaagatcgaggctagcgtacaggcggctgaggtttatttgtcttctataccacagatccactctgatattgtgatgagcggattaccactagtgg

SEQ ID NO: 45643 - DNA, 380 bp, Triticum aestivum
  Clone ID: PAT_TA_45643
ggttgctactggcatccttacaagatcagccaattcacataattccagtccaagaacggtcgcagagaggaagagagatccatcgaaacctcctactaggttagagataagagggggaggaagagaaagagagaatacatggcttttttacaggggagaacgccaccgatccagtcccttttttggttaacctccggcacatatttagacaaaatgtgggctagctattggctcttgctactactcgtctgactgactacctgcttgctgcatcctccgccgcctgagttcccagagcggcagactcaaagtcctactctgtgttgtgggagatggcctggccgaacttgaggaatagcttcgcgtccgaggtgctcgac

SEQ ID NO: 45644 - DNA, 345 bp, Triticum aestivum
  Clone ID: PAT_TA_45644
cgtccggatgctacaaaactgcaatcctaactcttaagaatttacagcccgatcttctaaaccaactgcgactcagctagcttcactgagtcctacataattgcaactctgcacatgtatatccatgtcggcaggagaaacagctgtcaatgctgaactattgctacacaagagctcaaatgaagcaccgtttcttcttcagagaacagaatcgaacaacaagtcccacgatcgtatcagcagttcgagcggaggtggtgaagaatttatatgcccacggttgtgagagcagagaactagcagctgtgcatgtaaagtacctgactacctgttccccattggtca

SEQ ID NO: 45645 - DNA, 409 bp, Triticum aestivum
  Clone ID: PAT_TA_45645
cgtccgatttgccaggacgagacgggtagcgtctgcccgtctagtagatcagtacttaagtacacgccctccctctcctctgttctgacagtatggtatcattctgttaggggtgaacataatacaagtctaagcagattgtactaactactgagtactgctgctcattaggacacatgtttgcttagtttaaaaacatgcgtttttgctacagtttatgattttgttttgtttagcatgcttcatatatgatgtatatatattggatctttcggttttaatataaacaaacaaccccattaatacatggatatagcgatgtttgaagtacaagtttgtggcttatggtacttttgcattcgtgcttatccgttgtaatgaaaactatttctttgcatatagtcgtctt

SEQ ID NO: 45646 - DNA, 292 bp, Triticum aestivum
  Clone ID: PAT_TA_45646
cgtccgcggacgcgtgggcgagcctcctgacgccctcggcggtgactggcccatgcgcagccacgaccatgtcgggccaccgcgccctgagccgcggccagctccaccccgcggcgtccagccccttgagcagcccctcgacctccgccgagctggtgaacacgatagcgtcgggcgcggcggcgtccggggccagcagcctctcggcgcagcccgggccggtccagcacgtggtgtacgccggcgcgcgcacggccgcccacccggccgagttgagccgtgcgaggaagtc

SEQ ID NO: 45647 - DNA, 311 bp, Triticum aestivum
  Clone ID: PAT_TA_45647
cgtccgcggacgcgtgggcgcgcataggaggcgaagcatcagcggagccaagccaccgacgccaccatgggtatctcgcgtgactgcatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctcttcgtctggacactggtaacttctcatggggtagtgaggctgtgacccgcaagacccggctcctggatgt

SEQ ID NO: 45648 - DNA, 369 bp, Triticum aestivum
  Clone ID: PAT_TA_45648
cagaaacccccaccgctcgcccgttccgttccgatcccctctcctctcgtcccccgactccgcgccgccggcgagggtttggctcgcgccgtccgcccccacggccgccgccgcccctcctctccccgagccgcgcctgccctcggcgacgggcgggcgagagccgagccccctgccgccgccagatccgtcgtcttcgagctcagggacgtgccccggcgcgcagcccgcggggacgccggagatgagctacagcgggagcggcggaaggaagcgcctccgcacgtcgccgagcgaggcggagggcagccccaggcgtcgtcgtgggtcgccgtctgtctactccccttcgccgtcgtccttaccggt

SEQ ID NO: 45649 - DNA, 387 bp, Triticum aestivum
  Clone ID: PAT_TA_45649
ttttgtcacactgcaagaaccactggattggccatttatgcaaaaggcgtccatcatccaaaaggaacgcgaagccaaaacagacagacagacaagggttccccctgtcctgtcaggagatcagagcaagtttagctagcagaagaagcacgagggctgctgagttttctgaacccatatctatatacatgcaaaagtaggcgtccagttcttctgtcattgtgtccgaagtggcgaaacttcagaagaggtgaactgacaggactcctgctctgatcttgctctagtctgcgtcaacattcgggtgtcgcagcgcattgtaagctggggtcccggacaggaacacgacgatccagaaggtcggtaagaggtcgccgcgaggcatgt

SEQ ID NO: 45650 - DNA, 235 bp, Triticum aestivum
  Clone ID: PAT_TA_45650
cgtccgcggacgcgtgggtcagtctgtttgcctcctcttcctcgcttccttctccgatccagagctaggatttgtagcaaggtcttctctgttaacctccctctctgatccatagttagggctcgtattgagttcttctcgtttgacccccccccctttctcccacccccaccattatgtgtgatttttggcgtcccagctgctcctctgtccttattttagcttatggtcgtga

SEQ ID NO: 45651 - DNA, 409 bp, Triticum aestivum
  Clone ID: PAT_TA_45651
tcgcgtcctccctcgcgttcgcccacgcgtccggcagactcccctaatagacctctccgccatattcacgcgccggggagcggaacgggagatccgaggcgtctagcccatcccgggagaggcggccatgcctgccgatcatagcccggtgagttcgccatgacccccttcttgaattgctcctatcgattattcggcgtcgttcatttgaactgcagttctgttcttgccgaaatttcgagcagttcttgatcttcagaacataaccatggttctctttcgattcaactgcagaatcgcccaatattctccgccataatcagttctcgcggacggcgcattcggttcgtgctggcgctcgaggacgggtactaccccgaggaggtcgacgccgacgactggcgccagt

SEQ ID NO: 45652 - DNA, 428 bp, Triticum aestivum
  Clone ID: PAT_TA_45652
cgtccggttgaaactaaagagttcgatgagcgctgcggcgattcggtggttgacgacatatttgctgtcttcaccggcatggagctagtgttacccggcaatgacaatgatgagggcaaagccaacagcaacagcaagggcgactccaaaggcaatgccaatgggaacagcaacgggattgctggtgtgcgtatgattaagcataaatccagatcttgcaggagtcgcggcaccaacttgatcaagtctgtgctctgatgagagccataatagtctgctctcaggccatgtcctacttggtctgcctgctttaccctctctatctctactcttacagcaatgctatacggacgatgaagacagacgattcatgcacgacggtgaaatccagccgcgcatgcatgtgtacaggagagctaacggccgcc

SEQ ID NO: 45653 - DNA, 446 bp, Triticum aestivum
  Clone ID: PAT_TA_45653
cgtccgtacaggttggatgttccttcctaagttgagaatttcatacctcttccctgaaataacacaacagatcaatatttaggtgaggctattacttacagtttcacaatttgatattttttcctatttatgttatctaatattgcatttgaagaagttaaaagtcaagatgatatctagaatggtgcagacctgacagtaagctaatagtgcaatctcaaaatttcaagcaaagtaacatcactcaaacggaaaacgggtaatataaatagagcttggtcagtgcacccatgtagtccgctaactgcgttagtcatttttttttactaattgcagaaacccacctaatgtggattgttcagatagtccatatcagcagcactacttcattcatcaagagaagctagtatagagccattatgcctccatgaagtttgcacctggca

SEQ ID NO: 45654 - DNA, 447 bp, Triticum aestivum
  Clone ID: PAT_TA_45654
cgtccgcccacgcgtgcggggacgcgtggcgtcggcgcgcacataggaggcgaatcaggagcggagccaagccaccgacgccaccatgggtttcttgcgtgactccatgcacaagcgccggaccaccggtgggaagcagaaggcgtggaggaagaagcgaaagtatgagctcggccgccagccagtcaacactaagctttcgagcaacaagacagtgaggagggtccgtgttcgcggaggtaacgtgaagtggagggctcttcgtctggacactggtaacttctcatggggtagcgaggctgcgacccgcaagacccgtcttctggatgtggtttacaattcgccaaacaatgagcttgggaggactcagaccgttgtcaagaatgccattgtgcaagttgatgctgcccctttcaggagtggtacctgactgattatggagtggaa

SEQ ID NO: 45655 - DNA, 399 bp, Triticum aestivum
  Clone ID: PAT_TA_45655
cgtccgcccacgcgtccgcccacgcgtccgcggacgcgtggggccgtctggggccgcctccacgagttcggcgacatggcgtggctgccgcagcagcgcaaggtcctctaccgcgaggacgaccgcgttgacgtctcgtcgccgggcgacggcctctgggactcgctccttggccgctccattcccacgcggctgctcatcaatggcagagccgccgaggagcggctgcaggagggcagcaccaacgacaccgccctgtgcgcggcggggcggctgcaggcggactcgctggagcggcaggcctacggcttcaagaacgactgccttaacttcaccgggtacccggtgggggggtaccagtatcgtattcaggccgttcggcacagtgcattaactgcc

SEQ ID NO: 45656 - DNA, 431 bp, Triticum aestivum
  Clone ID: PAT_TA_45656
cgtccggagaagaagaagaagaaagaagaaagaagaagagacaaacaaacaaacaaaccaaccgctcgtctctccgggctctcagaaacaaacttccccttccttccgtccgccccccaccccataaaacccaaagccatccatccatcccattccaagtcgagtcgaatttcaagtagaagaagaaagaaccagaacaaggaagaagaagatggtgtctgcggtgcttcggacgatcctggtgacgggcggcgcggggtacatcggcagccacaccgtgctgcagctgctcctccagggcttccgcgtcctcgtcgtcgacagcctcgacaacgcctccgaggaggccatccgccgcgtgcgccaactcgccaacgcgccccagaacagcctcgacttccgcaaggtggaccttcgtgacaaggaggcgc

SEQ ID NO: 45657 - DNA, 119 bp, Triticum aestivum
  unsure (1)..(119): unsure at all n locations
  Clone ID: PAT_TA_45657
cgttctccactcttncgttcacacnttttcacacgtattatatataagggaacagcatatatgggtgaggggactgtcacgggatcggtggatttttacaagttgttttgttcttatta

SEQ ID NO: 45658 - DNA, 432 bp, Triticum aestivum
  Clone ID: PAT_TA_45658
cgtccgcccacgcgtccgcccacgcgtccgcccacgcgtccgtccaatctccctcccgcacgctccgcccggcccccagatcaccgcccacccccgtttcccccaaatccatccacccgccgagcgtcggagcagaaggaggcggaatgggcggcccgctgggcgccatcatcggccgctacccgtcggccgccgccaccgccggccccgggggagacgacgccgaccacccgggcggcgcagggggcctgggcattatccggcacgaccggcgctgccgcgacctggccttcctcgtcctcttcgccgccttctgggtcgccatgatcgtcaactccagcttcgccttcaaccagggcaacccgctcaggctgacatacgagctagactacaaagggaacgtctgtggcgacaggcactgcgaccccggac

SEQ ID NO: 45659 - DNA, 431 bp, Triticum aestivum
  Clone ID: PAT_TA_45659
cgtccgggactgcagtttctctaaagcaaaggcaattaaatgacctcactgaggctttacgtaaaataattttggaaatagttcaggttgaatggctgcatgatttttcatcgcctcatgcacagaaggccaagattttctcacaaaatattcttggtgatgataagttcatgtccgtgcttttaaatctgagcagaaggaacttgttagataagatccagtcttcgatgtcattgataacaagatcaattgagtgtctgcaagcttgtgaaagcacttgtgtttcagctgaaggccaacttgagagagcaatgggatgggcctgcgccggtccaaatacttctggagcaggcaggtcaactgcaaagggttcaggaatcccccccgagtttcatgatcatttatcgaaaaggaggaaattgcttgggggc

SEQ ID NO: 45660 - DNA, 433 bp, Triticum aestivum
  unsure (1)..(433): unsure at all n locations
  Clone ID: PAT_TA_45660
cgtccgtccacgcgtncgtgcattggtgtcatcgggccttgctgttttgggatacaaatacattaatttagatgattgttgggccgaacttaatcgagaccatcagggaaatatggttcccaaggctttaacattttcttcaggaattaaggctctggctcattatgttcatgggaaaggtttgaagttggggatatattcagatgcaggaaatcaaacttgcagtaaacgtatgcctggatcactaggacacgaagaacaagatgcaaaaacatttgcttcttggggagttgactacttgtagtatgataattgtgaaaataatggtatattatccacagaaaggtatccaccaatgagtgaagctttgttaaaaactggaaggccaatcttcttctctatgtgtgaatggcgttggtaagacccatcatct

SEQ ID NO: 45661 - DNA, 373 bp, Triticum aestivum
  Clone ID: PAT_TA_45661
cgtccgcggacgcgtggggttaaatattgagttgggtggtggcgatgtagtcatacagcagaacctcgattcagggtcgtcttctcccacggcttcactggcttccacctcgacgacgttcatgcgccgccggttagtggcagcacttgtgtcatgcgtcacctcgctcatgcggctccggcgcagactccgcagggggaggggagacgatcacgacaacagaaggcgcagttgggtgcttcctacaaggctccaaccgtagccgccgaggaagtcggcgaggaggagttggtggtgcaagcccccgaagcggtgggcgtgaaccaggatacttcagagggcttcgcgctcaaagaccagctggaggtgccct

SEQ ID NO: 45662 - DNA, 343 bp, Triticum aestivum
  unsure (1)..(343): unsure at all n locations
  Clone ID: PAT_TA_45662
cgtccgcggactcgtggacagacacataaacaaacacgttggctttcctatctcacacacaaccgggcgagcganacaccaccagggcagagcaaaaccttcccttcctcttggacttgcgcccgccatccgacgcccggcggagaggacaccctgtcgcccgagccggaggacgacatgatgaccgaaaagaacccgctccctctcgacgaggacgacatcggccttcttaagacctacagtcttggaccatactccacgagcatcaaaacagcccgacaaggagatcaaaggactgtccaagaggatcaatgacctaatgtggataaaggagtctgatact

SEQ ID NO: 45663 - DNA, 429 bp, Triticum aestivum
  Clone ID: PAT_TA_45663
cgtccggattcatgctcgcaatagcattgctatctgcgtgcattgctctgggacgagagagcccagcgcaggcgctcctcgccggcgtggccagaccagggatggggttgaccctagtcgagcaatccggcccagtggatggtgaacgtctgcgtctcccacattgcgtgcagaaaacaggagggatggaattgtcttgctgcgtgatcccagtggtgaatccccatgtgcatcggtggctttagcttagcatgggttctctcctcaccgataggaggttgcaggggattcggtctttgactaaacttgcagctgattaactaaccgatgttctccgttcagttcacgaatataacatgttctaccaacctttttttctgaatcggatgtatacagacatgttttactgtggttgttcaaacatttgag

SEQ ID NO: 45664 - DNA, 146 bp, Triticum aestivum
  Clone ID: PAT_TA_45664
cgtccgaaaaaacttcatttgttcacctccactgcccaccagctcccctcagatttactttgcttgcagccgggtcggtggccgggaaagatcgtgtcttggagcaagcaagaacggagaggggaggagaggaggggagggaggac

SEQ ID NO: 45665 - DNA, 153 bp, Triticum aestivum
  Clone ID: PAT_TA_45665
cgtccggtaacacttgtgcagttgtaagatgtgtagtgtgaatgctaaggatgacgtttctgcgactgatatttatgtaagatgtgcgaaatctctaatccttgcatagtattgtatcagaaattatgatttggcaaagttcagcaatccaca

SEQ ID NO: 45666 - DNA, 100 bp, Triticum aestivum
  Clone ID: PAT_TA_45666
cgtccggggataccgctttgttggatcagacgttatatgcattggcaacttactttacctttaggcttagtaccatgtgacactgggcatgcaaagttaa

SEQ ID NO: 45667 - DNA, 381 bp, Triticum aestivum
  Clone ID: PAT_TA_45667
cgtccgcccacgcgtccgcggacgcgtgggtttttacgctgtataagcctcgagatatcttgttataccacggtttgccgtatcaaagatcctgagttttcagcaaaaaaattacttttgcaaagaacaaccagatgaagcatacgcgattcatcagcaactaacaggctggagcggcgaggtggcccgggacgtcgcgcggttcgccagggctctgcgatccgtgggcatccggaagggccacgtcgtggtggtcgcgctcccgaacctcgccgtctaccccgtggtgtccctcggtgtgatggccgccggggcggtcttctccggcgtgaatccccgcttcctggccgccgagatcaggaaacaggtggaggactccga

SEQ ID NO: 45668 - DNA, 392 bp, Triticum aestivum
  Clone ID: PAT_TA_45668
cgtccgcggacgcgtgggatcccgacacagccgtcgccgtccgaaccccccgttcaacccggcgggccgcccctgatccctcgcgccgccgtctatactggcgctgaccccgcatgcccccggatcccgccctgacatcgcgcgccgccgtcgccgtcccgacaacccacggcgccaccgtcccaagaaaccaccgattcgaatgcaccgtagtccacccgtaccagctagctgccggcgccccatacacccttagcccccggcatcatcttcaccacccagcgcgaacgcttcaccaccaactgtggattttgcggagccgcccatcatacaacacgcccctgacgcatctgccgtccttcgtgaacaccggtgcgcatggatccggcagg

SEQ ID NO: 45669 - DNA, 437 bp, Triticum aestivum
  Clone ID: PAT_TA_45669
cgtccgggatttagcaaagaacctcctagcaggacacctccccgtctgttcagaagaaactaaaaaactgaatagatccattagagctctagtcctgtatgaaaacaacttgtctggtgaattcccttcatttttgaagagctgctcagagttggttctgcttgatcttgcgcacaacaactttgtcggagagttgccggcatggttagcaaacaaattgccaaatttgtcctacctccggttgcggcataataaattctctggctctattccaggtcagctcacccagcttgaacacctacagtatgtggaccttgcagataaccgaatatcaggatctatacctcattcgttggccaacttaaaagcaatgatacaggaggaccaaacaatttggaaccccttagtgtggagttatgaaaggccagcaaaccctg

SEQ ID NO: 45670 - DNA, 437 bp, Triticum aestivum
  Clone ID: PAT_TA_45670
cgtccgccccaagagctctctcccctcgcccgtctctgctgtgctgtgctgtgactctccatagctcgccgccgccgcagatctgctctgccatggagatggaggctgatcttccccgatgtcgccccatccgctggcttcctccgcataccccgcaccacggcgaacacctactgtcggagtccgccctcgttgacacgctggtctacgtcgacggccgcaccagcgcctcaaccagctagtgcatgtgcaccaccgagagcggcgacgtcctctgcctcaccttctgggccgcgcgcccgccgctcctctcctacttcaccgtccacctccccggcctcctccctgccaccccgctcgaccgtctgccccgcgtcctccgcacccacggcgatgtcgccctcctccgcattcccgtcggcccgaaaggcaacgac

SEQ ID NO: 45671 - DNA, 430 bp, Triticum aestivum
  Clone ID: PAT_TA_45671
cgtccgcccacgcgtccgcggacgcgtgggagagtacccatttgatatcgtgcccatccttgctcccattggggatgatgaagatgatatgtcgttcaaggtgatatgcttggaaccatagatggccgagtagccagcctgctagctgcttctggcgcaatgatggcgcagccgcagctggagaagaaggcgcccccgcgggcgaagccgccgctgacggggaaggccgtggccgcgctctgcgtggccagcttcgccgtcggcctgctgctcagcggctgggtgccgctcctgtcggcgccgatcggcaaggtgaacaagacctctgctccctccggctgcgacgacaaccgcgtaagcaaggagttagccggggagaggcatgaccccatgggcatcatgagcgaggtgttcaggacgcaccacgcaa

SEQ ID NO: 45672 - DNA, 214 bp, Triticum aestivum
  Clone ID: PAT_TA_45672
cgtccgcccacgcgtccggttggcttctcctccccacttattcctcggttcccggtccggtcccgttccgttcgttagggtttagtagtatcggtgaagaggaaggaatggcggacgtccagtaccgctgcttcgtcggaggtctcgcctgtgccaccgactaccattctctttaaaacttcttttccaagtacggcgactgtcatttgacttc

SEQ ID NO: 45673 - DNA, 227 bp, Triticum aestivum
  Clone ID: PAT_TA_45673
cgtccgcccacgcgtccgcgcacacagaacgctcaagctagcagcgcgcgcaccgagccggcgactacgacgacgatggcggtgaccacggcccatctgccgcagccgcgcgccctggcggccctcctcgtcctggtgctgctcattacgctgggcggcgcggcggaggcgcaaccgccgttcggcacctgcggggcgcagctgagccagctggccccgtgcgcgcg

SEQ ID NO: 45674 - DNA, 262 bp, Triticum aestivum
  Clone ID: PAT_TA_45674
cgtccgcccacgcgtccgggggagcctggcacgtgccgaccacgtgccccgcgaaatcggcgcacgcacctcaccgtcgcggcgtaaactcgcacagaaacgcatctcgatgtccgcccacgccgtccccggcgccgcgggagacgccggcgcggcccgagccgactatgaggtgcgcgcccttctttccgcctcggcgctccggggcgaccactgttacgctgactccagcagtttttgctatgaggtgtatgccctctaa

SEQ ID NO: 45675 - DNA, 408 bp, Triticum aestivum
  Clone ID: PAT_TA_45675
cgtccgcggacgcgtgggtttttttttttttttttttttttttttttttgcaccaggcagcgctgaagtagcagccagaataagaaagcgaccattacgaaccaatgttcacagaggttctcaagttcagataattcgtcgcctccgcaagaaaacatcttaggcggcgctgtcatggccactgcaggcagcgagcagccggagacgaagcctacgctacgagttgggatccttgctatcatcctcgcactatgcatcggcggtctgatattagggtttcaaaagggggacgcaagcattcaccgtgatcccagattcttcgtcagactgacagaggtgcacggcctcgacccagcacgcaacccggggatccgccccgactttaaccttgagctgcatgtcgacaac

SEQ ID NO: 45676 - DNA, 429 bp, Triticum aestivum
  Clone ID: PAT_TA_45676
cgtccgcggacgcgtgggtgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttggctgctggtagggagaagtttgctgcggtaccatctggtggtggtggtgtggctgtttcacccgctgcttctgctgttggtggtgctgctgcccctgcagctgagtcaaagaaagaagagaaggtcttggataaggaaaagagtgattattacatgggcttcattctggtctactaacatcccggggcatcttgtgtctgtcgtatctatccttggccaggaaactagaatcaatgatggtttagccctttattaagctg

SEQ ID NO: 45677 - DNA, 436 bp, Triticum aestivum
  Clone ID: PAT_TA_45677
cgtccgcggggcgagaagacggcttgatggagcttggagctgttgatcgggaaccagccattggggtacctcaataagggcaccaacggctgcatgggcgagtcgccgcaaagcttgagtccatggagccctgctccagcctcaaggagaggagaaatggttcatcgagccaggcaaggtgcgcggtggtaggctcggtctccagcctcagcgtcttctgtcggcccctttgccatgtggcgccggcggtgctgttcgaagtcggctacaaaactggcatggaagcacgacaggtcgcgtaaagaggaggaaaagaaagctgagtgctcaacttgtttagaggactagcctttcttcttccttgaaagaaacgttgaaagaggagaagatgtgctgaaactagatgtaaagatgcatgaccctttctttgatttcg

SEQ ID NO: 45678 - DNA, 411 bp, Triticum aestivum
  unsure (1)..(411): unsure at all n locations
  Clone ID: PAT_TA_45678
cgtccgcttgtgtctgtaaagatatgcaaatacgtgcttgtatatnagcttgatgttcaagcgcactgcttctgcacagtatcgatcatttctaaattcctgccttgcagatatccgggaatataacaacaaatgagatggcaaatgccatgaggtacagttatctcagaggcccaggtggtcggttcagaaatccatttgatcaccgggtgaggaagaattgttctgacttcttcctgaaggggtacaatgaggatattgagaaggtagaacagacgtcacatcctgacgaggaaatggcaattattcacatgacaagaggtgcaggcttgcaaaatggggagagcgtgccacttcatgctaatggggctgaccatgtttgtgctgactcaccaacccactcaaaattgc

SEQ ID NO: 45679 - DNA, 431 bp, Triticum aestivum
  Clone ID: PAT_TA_45679
cgtccgcccacgcgtccggggacgcgtgggctcgacacaaccaaggcgaaccccaatcttcttgcccccctgccgttaaagaaaaattacttcttccctttgcgttcgttgacctgcaagctccgctctccaatctctatctctctgctcttgcggcaggcagcacggcggccaatggcgcaggacgatccggttgtttctgcgcaatggctgcagcagcacctagggcagcttgatatcaaggtattggatgcttactggtacatgccacaagagagcacggacccatggcaagaataccaggtggcccatattcctggtgcgctgttcttcgacatcgatggaatcgtcaatcgggcgactgatttgccacacatgctgccatcagaagaggcttttgcagcagcagtttccgcacttggtatcaataa

SEQ ID NO: 45680 - DNA, 432 bp, Triticum aestivum
  unsure (1)..(432): unsure at all n locations
  Clone ID: PAT_TA_45680
cgtncggcatcatccatcccatccccaggtcataaacccaagtcggactcgccttcctcctcgccaactactcctatcctctcctccgcgcatcgcaccggggtcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggtgatcttggaaatgtgacagctggagtggatggtgttgctagcatcaatattactgactgccatat

SEQ ID NO: 45681 - DNA, 277 bp, Triticum aestivum
  Clone ID: PAT_TA_45681
cgtccgccccctcatcgcagccgcctatctcccgaccaaaagccctagctagctagacccaccccatccatggcgaccatccccaccaccggctacgcctccctcctccggagctccgccgccctccagagggacgggaggtcaaccaggccgtcgtcggcggccaggccgctgccggggcgacgcgcgcgctcgttgtcggtcgtgcgcgccttcgccaaggacatcgccttcgaccaggcgtcgcgctccgccctccaggccggcgcctagaagc

SEQ ID NO: 45682 - DNA, 301 bp, Triticum aestivum
  Clone ID: PAT_TA_45682
cgtccggcgagagcttaccttctccccccatctctcccccgatgcccaatcgccggcggaagcgcgagcccgacgacggagggggcgccgctgccgcggccggtgctggtggcgccggcgcggatgagagcaagagggatcttgatttgcgcatcaccaacatcctggccgagtaccacgcgccccgccccacacgccgcgcgctcccccttcttgagctcaacggccgggttcttgcggaggaggacgaggagggggaggccgaggttgtctccccgctcacggccccggccccggccct

SEQ ID NO: 45683 - DNA, 431 bp, Triticum aestivum
  Clone ID: PAT_TA_45683
cgtccgtggggatcgagttcttctccgccttcagccaccgccgcatcatcgccggattcgtcgccgtcagctcctctccgaccacccttgcacctccccgagcttgcccccgtcatcactgtgagcatcaccatgttttccccatctccctgctaccacatgtgccccgtagcgaacaaccaccgtagccgtgctccgacctccgcttggcttcgctgccgccgccgtcaccggccacaggtgctcgtgcttcttgcaccttcggacgcggcgcgtcgcgcttgtcttgtaggaccaaacccccgggccaactggccaccggagtgccggtgccgcgcccgccgtcatcgcgtctgaaactctgctcctgtcgcccttggccactccgcccgcgccgtaccctgcgttcggccgagttaccgcgcgtgctc

SEQ ID NO: 45684 - DNA, 422 bp, Triticum aestivum
  unsure (1)..(422): unsure at all n locations
  Clone ID: PAT_TA_45684
cgtccgnnnaannnttttttggactcttgtgaaaccttcatggtctttatgcgccgccgccacttgtccatgggctccttgcactgcgggcccgtcccaagcagctcctttcaccgaatcttcggtcgccacccttcagcgccggatctagatagctggatccagatctgatggcgtgttgtgtccccgcacaagagaagcgctcctgctctcactctacgctccgggaaccccgggcgccccaatctttggatgcacattcacccgggggccctgtcgggcgaccattcgcgaatcaccaccgattaggaacctccatggctgtcgcgcttttacccccgagcctctgtgacgcactgcatgagacgccgatgtgccgccacccaacctgcgcctggcagatcttctcactcaaccaccag

SEQ ID NO: 45685 - DNA, 201 bp, Triticum aestivum
  Clone ID: PAT_TA_45685
cgtccggcatcataaccagtgacggggaatgtggaggaagcatcctacttagacatggtgagggggaggggggttctataactgggggtgggcaacagcaacatgttagtatggtgttctcatgaggcggtaatggtgtcaacgttaatgtcttcctgctattggtaatttgccgcgccctggtttgtcattatctatttt

SEQ ID NO: 45686 - DNA, 330 bp, Triticum aestivum
  Clone ID: PAT_TA_45686
cgtccggccgctttctcccgcacgcctcctactctctccctccctcccgcagccacctggctgcctgccgcgcgcctcctctcctacccccgcctcccgcagccacatcgccgccggcgccacccgcctccccactcgggcgaacccctctcctctttccccggctcgcctctctcccttcccccgtgcaaaccctaggcccgcgcccgccggccgccgacgccgccgctcgcccaggccatcctcccgctgtgaaggaagcggacagagaggaagggcgtcgccgggtgtgcatgtgcctgcgcggattcgtgccacggttgccggagg

SEQ ID NO: 45687 - DNA, 365 bp, Triticum aestivum
  Clone ID: PAT_TA_45687
cgtccggttcgatacgatacagcgtcaagaagtagacagaaagagtgatcgatcgagatgccggagtactgcgtgaccggcggtacggggttcatcgcgtcgcacctgatccgggcgctgctcgccgccgggcacacggtgcgcgccacggtgagggacccgagcgacgaggccaaggtcgggttcctgtgggacctggagggcgccgacgagcggctgcagctgctgcgcgccgacctgctcgtggagggctccttcgacgcggccgtcagcggcgtggacggcgtttttcacgccttctaccccgtcgtcgtcagcttctatgacggtaaggacgctcaggagtagctgtttgactccgatcg

SEQ ID NO: 45688 - DNA, 302 bp, Triticum aestivum
  Clone ID: PAT_TA_45688
ttaccacacgtatcctcgtctgggggggccattctggagcttggaggaagctgaaaaggctatcaaaagccatcttgatggcctgcgctctccaataatgtgcagagatgggctatcgccggcggaggttgcagtgcgacatcgcctttattggcctgatggcacaaggaagaagtcgtccgaaggcaatcccggtcgtaggaatatgaacctattggttcaagctttactggataaatacaatgaagatcaccatcttttgggggatcttgcatatgaacttgataatgttgtgtgctccc

SEQ ID NO: 45689 - DNA, 360 bp, Triticum aestivum
  Clone ID: PAT_TA_45689
cgttccgttaattttaagggtgagtgaactgagcgaacatgttttctgctcacagtagggggtgcaatgaggacactcttcaagagatcttcttaacaccagacatatgggcggtcaagaagaccccttttgagaaattgcaccaggatatgtgggtgtgatccagaattttatgcctgacagggctaacttgcaccttcattcctacgcccatttgtatacatttgcaattaaatatgcaaataaacatgatgcttggttgcccgcgtggagtgaagtattgctttaatctattcgtttaaagctgcctaacctgggcttaataaactggaactaaatgtttttttgtgacacctttta

SEQ ID NO: 45690 - DNA, 399 bp, Triticum aestivum
  Clone ID: PAT_TA_45690
cgtccggaatactggcacgacgatggccccattgttgttgttgcattgaatggtcgggcggacccttgcactgcactttatgccaattcccattaaccacacgtcattcccttccgtttcttccttcaggctcctctcctctcccacttccttcagttacttgaccccttccaccacaccagcaccaccaaccttgtaaccatcgcgcgacggcaggcagcaaagcattctccctccctccctccctcccttcctccctttttcccttccatacacacacacacaccatgctcttgtgctggcagtggcacgacacctatatatgcgtgtattctacaccgccccctcgcccggaagcgtttccgtctcggcgctagcgggcaagcaaatccacagcgc

SEQ ID NO: 45691 - DNA, 304 bp, Triticum aestivum
  Clone ID: PAT_TA_45691
cgtccgcgtacgcgtgggtcctcctaccgagccgctcgcgcgggcggctccggacgcgctaaccctagctagccccgcgagtgcctccctctccgagctcccttggccgtcgacgccggcggcgatggcagcgcgctccgacgggcctcccacgcgcgggcgagtggcgttatgtgggcgacgcggtggtctctccggtgtggaggtgtgcgatgaggtgcgtacagggaggcggagcacggtcgcggtattttggaggaggtgctagtgtgcggtgattatgctgagagcgccctgtggtttg

SEQ ID NO: 45692 - DNA, 394 bp, Triticum aestivum
  Clone ID: PAT_TA_45692
cgtccgatcacgcacacaaagcacacccatctcgttgcaaattgacggttctgcccttgcgccgtgcgaaaccggaagccatcatgaagctggaaatcatgcccaggcagagggccctggaggcggggcagcgggaggaggccatggagatgagcggcctcgagctgtggaagcacgagaagccccccaagatcttccccatgcccccgccgctgccgccgatgctggcggcgccgggggcggggggctacgacgaggccacgctcgtgccgccgctcaacttcgccatggtcgacgacggcatctaccgctccggcttcccggccgccgccaacttccgctttctcaagtccctcaacctccgctccattgtgtacctttgcccggagccgta

SEQ ID NO: 45693 - DNA, 367 bp, Triticum aestivum
  Clone ID: PAT_TA_45693
cgtccgcccacgcgtcccctcccctcctctttccacagcgcggcgccgatggccacggcgcactactacccgccgccgccgccgccgatcgcccacccgcttccaaggccgcacgccgccgacaacgccgtccccgacgacggcggcagcgacagcgagagcgtggcggagtcgtcgtgcccgcaccagcacccgcgccggccgacggccagggacgaggaggaggaggaggacgggtgcagcggcagctgcgtggaggcggacgagtactggggctactactaccagcagcagcagcatccgcaggaagccgacgacgaggaggaggtcagcacggcgagcgtctggtggaagaagaaacgggcag

SEQ ID NO: 45694 - DNA, 397 bp, Triticum aestivum
  Clone ID: PAT_TA_45694
cgtccgatcgctaccaatacacgaccgaccacctagcagtagctagcgtgctgcaactttgtgtgacagtcagatcagatggcctcgccggctcttctccgctacctggttgtgctactcctcctagtaggctgccttgggtggcccgtcccacctcctccgaggatggtcgatggcatcacggccatatacaacttcggggactccatatcggacaccgggaacttcatccgggaaggcgccgtcgggctgatggagcacaccgggaagctcccctacggctccgccatcggcggccccaccggccgatgctccgacggctaccttatgatcgacttcctcgcccaggatcttgggctgccgttgctgagcccgtaccttgtcaaggtcgccgact

SEQ ID NO: 45695 - DNA, 351 bp, Triticum aestivum
  Clone ID: PAT_TA_45695
cgtccgcccacgcgtccgcggacgcgcggtcatcccttcctgcctccacacagccgccggcggcgatgacgcgcagaaaccaggctacaagactccaaaacccaccgatcccccatggcgaacggcgacgaaaccctcgtctctccccccgccgccggcaccgctgaggtcgagaaggctgcgcccaacggaggcgcagagggcgaggaggtcaccgtcggcgtcgctgtgcaccccgtcaagtcctacgccgtctacgccgcgaacgccgtgatcgaggaccttcgcgccatcaagctcgacctggaggagcagctcgccaatgccagccaggagaacaagaccctcgcc

SEQ ID NO: 45696 - DNA, 394 bp, Triticum aestivum
  Clone ID: PAT_TA_45696
cgtccgcggacgcgtgggcggacgcgtgggcagctttttgtctggtcgcacctataggcagtatagaggatctactctcagtaagctcattttttccgcttccattactttttttaccttactttacactgtgtaatctgtttcaatgctatgatgcactatacgtaagttctgcatcattttccttgttgtatctactgagacctattgttggagcattcattttattgggatgctatatctaagttgaaaacgtaataaggtgaggtttagaatttaattaagctgatcaaagtgtgcttactggtcagaatgtgcttattactggtttcctatgttatttttatgactctaaaagtaattatgtcctatgagtcttggaaggtgtgaattc

SEQ ID NO: 45697 - DNA, 330 bp, Triticum aestivum
  Clone ID: PAT_TA_45697
cgtccgcccacgcgtccgcgcgctgctcttcccctcccccgcccccgccagtgtcgcctcgctgtgcccgctcgcggcgacctccaacgcctcctcccacacctacgcccgccccgtatcccaccttcttcgacgatgtcgtcgacaagtatggctgggacaccgacgcccaggtccaggtctagccactcgacgccgagggcgcgctcgttggcgccgtgcaacgctacgagttccacgcccacgcgagggccaccgcggtcgcgctggcgcgggccaaccgacggggccggcgattggggtctgtccgacgcccccacggtggaggag

SEQ ID NO: 45698 - DNA, 372 bp, Triticum aestivum
  Clone ID: PAT_TA_45698
cgtccgcccactcgtacgcgccttctcatccggctgcctttctctgcgccgacgccacgaccgcggctaataacccgccgcatcttctgcctcttactcctcgtcctcccccgataccccgcctcatcttctgccgcttcttacctcgatgcttctagtgctgcccctaggcacacatcacacaatccaacagcatctccatgcgtccagttctactgcctagacctttgctggaacctttacgattactccttaccataaggtttgtaaaaaggaaggaatggaagtctacagtatcaggcttcacatctagcggatccacatcgagtaacgcaccggctcaggcaccggcacgtggtcatccagcagggc

SEQ ID NO: 45699 - DNA, 394 bp, Triticum aestivum
  Clone ID: PAT_TA_45699
cgtccgtctgtgcattgtgtgctcttcagaaccatgttaagaccgcgctacagtcaactggaaaaatagtgacaccatcacaaattgtcaagaacttgcgctgcatttctcgtagcttccgtaattcaaggcaggaggatgctcatgagttaatggttaacttgcttgaatccatgcataaatgctgtttaccttctggagtaccgagcgagtctgcaagtgcttatgagaagagcttagttcacagaatatttggtggccgcctaagaagtcaggtgaaatgcacaaggtgctcgcattgttccaacacatttgatcctttcttggatcttagtcttgatattggcaaggccacaactttggtgagagcacttcaaaattttaccgaggatga

SEQ ID NO: 45700 - DNA, 347 bp, Triticum aestivum
  Clone ID: PAT_TA_45700
cgtccgaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgtttccgctttcactctgtcagggatgaggatgctaagttcaagctctgcaaggtcaggtctgttcagttcgtccagaaggtcattccctacctgaacacctatgatggccgtaccatccgctacccataccctctcatcaaggccaatgacactatcaagctcga

SEQ ID NO: 45701 - DNA, 393 bp, Triticum aestivum
  Clone ID: PAT_TA_45701
cgtccgcccacacttgtcacgaacaggagccctcttcccgtccccgtacgccgcactccgttccccgattggttcgccgccgccgcccccgtccccgtcaacctcctcgattccggccgccgtctctcggcaccacccgagctgcccatggacatcgactccgaaccacccgccgagagcaagcccacccagatggacctcgaggaccaggcggacgccgacgggaagggggaggacgaggagctcgcggactccatcgggagcctatccattgcccccggccgcaccagcttcaagaagaagccggtggtcgttctcgtcatcggcatggccgggacggggaagaccaccttcatgcaccgtctggtgtgccatatgcaggcatcgacaaac

SEQ ID NO: 45702 - DNA, 393 bp, Triticum aestivum
  Clone ID: PAT_TA_45702
cgtccgcggacgcgtgggggaaggggggcggaagaatcccactgccaaccttattaattatgggaatactcacatgttcttcaccttttgttatgtcattgacatcatgagctggtctattggcaataacaagcatattactggaactgatctgttctccagcaaacgaaccagaagagcatacaccaccatgaataatgtggtcattaggtggcatacacgaggaaccaacttcatttggctgcaacactcgtgacactgaaggtttagacaaaaagtctatggcaggaactatttgtaccattccactttctctaggtccactagatgcatgacccaaatcaatgatacactggcaagtgtcttgcaaaagttttaagaaagagaaaatgg

SEQ ID NO: 45703 - DNA, 284 bp, Triticum aestivum
  Clone ID: PAT_TA_45703
cgttcgaaggcgtatttctactctcctttcttcgcgcaaccgagccttccgcccacctgctccctatttcgtcagcggcgcacccaccaacctctctcacccggcggcatgagggtgtgcatcttgatccacatcggccaggccgtcatccaggtcggaaacgcgtgctgggagctgtactgcctcgagcatggcattcagcctgatggccagatccccggtgacatgaccgttgggggaggtgattatgcttttaacaccttctttagcgtgactggggctgg

SEQ ID NO: 45704 - DNA, 322 bp, Triticum aestivum
  Clone ID: PAT_TA_45704
cgtccgagtcggtcctcccgcacctaccctgcgtcagatctgcgccaaccccccgagtcaggacaccgcacccccgaccacttcctaccccgcggcggtgctcccaccatcgacgacccagctgcagtgcctcctccttcctctagctccatcagggccctgccccaccccgcctccttcctccaacatggccggttcgggccggcgccatcccaactgccggcgcactccacggcgatggcgggatccggccggcactggcccccgacgaggccccctttaccggatccggcgcccacttccccctacgaccactaccgga

SEQ ID NO: 45705 - DNA, 255 bp, Triticum aestivum
  Clone ID: PAT_TA_45705
cgtccgcggacgcgtgggcggacgcgtggagctccccccgtcccgtgatggcagcaccggcgcccggcgccggcgccgtcgaggttttcatggacgccaaggcgaaggcgttggtggacgcgaacatcaaggaaggggaggacacggtgcggatgatatgacagtacgcggcgcggacggaccgtgcagatcgacgcgctgtagaaaaaggtgcaggacctttaggcagtgatggatctcgagcttatgctgggt

SEQ ID NO: 45706 - DNA, 390 bp, Triticum aestivum
  Clone ID: PAT_TA_45706
cgtccggcagatgcagatgaagggtgcgccgacaccgcattagctccagcagatgcagcagcagatgcagatgaaggggctgaagctgccgccgcagttcatgggcgccgccgcggccaagatgccgttcccggcgggtgcgccggccaaggaccccaagtccgtcaagttcaacctccccgacgacggctggggcgacgacggcggcagcgagttcgacgacgagttcgacgaatttgacgacgacgaagattacgacgatgagggcttcgaagacgactactacgacgaccccaagatgatgatgaagcatatgggcatgccgccgaacgccggcgggggcgacaagaatggcgccgacattggtgggaagaagggcggtggaggaaa

SEQ ID NO: 45707 - DNA, 430 bp, Triticum aestivum
  Clone ID: PAT_TA_45707
cgtccgcccacgcgtccgtggagtttaactgaaaatcattacttgaagtcgaagcaccggaagttaaacgtcgggactatactgtggagtttaactgaaagtagacagacaacgcctattttactttttactccctccgtcccgcaatataagacgattttacaagctatgttagcttgcaaaaagatcttatattatgggacagagggagtaatagatagaaacaccgaacataaggtagatgcttatgcgcacgcaccctcaaaacactaattgaagaccctagttgtgatacaaatttggacgctgatttggtgaacatgattccacgcacactttttatgaatattaaattcaaaaagaaaaactagatgcaataaaaatgtacttttttgtaacatacgtagtcaaacgatatacctgtgtatga

SEQ ID NO: 45708 - DNA, 373 bp, Triticum aestivum
  Clone ID: PAT_TA_45708
cgtccgccacgcgtccggtgaaccagcactaaacctggagctaattttcaattgttgagaacaaaatgttgcagctagagcatcaagaaccccatggaagctgctaaacctcgagctcacgacgtccacctcaatgccgagcctcctgacgccgtcggccgtgaccggcccatgaacggccacgaccatgtcggtccatcgcgccctgagccggggccagctccagcccgcggcgtccagccccttgagcagcccctcgacctccgccgagctggtgaaaacgatggcgtcgggcgcggtggcgttcggggccaccagccgctcggcgcagcccgtgccgacccagcacgtggtgtacgccgaagcgcgcacg

SEQ ID NO: 45709 - DNA, 316 bp, Triticum aestivum
  Clone ID: PAT_TA_45709
cgttcttggacgcgtgggctgacgcatgtgctttcgcgtgttctcgttccctttctatatttttggggggtagttcttgctatggttgtcgtgtcccgcctccacgatggtgaccgccttcggccagtcccagcctgcggccaccgatcccttcgcatccgcgttcaagcgtatgacggacaccgactccgttatctttcccttctacccacccgtctaggccgtcctggctggagctgactaggaggccgtcgccgtggccatggccgggttcgtggacatggtgaagggctagatggtgtttgatgaggaggat

SEQ ID NO: 45710 - DNA, 408 bp, Triticum aestivum
  Clone ID: PAT_TA_45710
cgttcagatccttgatgtgtgctgagttctatgatcaagtttattgctcgatgtgcactgtggctctgtactgcgcacggtattgtgccattaaaatgtgacgtgcagatatacagaggatttttcggcttggttcaagaaatctacacacatggattttgagcctgaagggttgtccagactgctccagacaatatagggatgggacagacttttatttatctgctgaaaccatcctgaatgcaaaagctgcatgtattggggggaccgaacactacgactttttgcgagatgcttcatattttaccagatgtggttatatgaagacgcaacaactcacggggctagaagcataccgagagtgtactaatgcaagcaggttacgctagcaaaatcttgtgcctcacc

SEQ ID NO: 45711 - DNA, 411 bp, Triticum aestivum
  Clone ID: PAT_TA_45711
cgtccgcccacgcgtccggcggagaaacacaagctttgatccagctcaatggtggtccagtcatgggtcagattcaccaaatctcagagtattggcgatgcggattttgagtttgacatgcagctcctccgcttgtgagaggaattttagtgtttttcagcagattcacaccaagatacgcaacaggctgcttcataataaaatgagagaccttgtttttatcaagctcaactccaaactcaagcaaaagagaaggatcccgatcggggacccgactgtggaccacacatttgtagatgttgtagaagatgaagatactgagtggatcacaggtattgcgcctcatgaacctgatgaagctgcataagctgcaccatgaacatctcatggagcagttggtgcatcaaaaag

SEQ ID NO: 45712 - DNA, 425 bp, Triticum aestivum
  Clone ID: PAT_TA_45712
cgtccgcccacgcgtccggcgtcttcgtactcgcctctctccgcgcatcctagccttcgccgtcctgcttccccattttggcggcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgttccccgtgctgtctttgtagatctcgagcccactgtgattgatgaggtgaggactggtgcttaccgccagctttttcaccctgagcagcttatcagtggcatggaggatgcatccaacaact

SEQ ID NO: 45713 - DNA, 252 bp, Triticum aestivum
  Clone ID: PAT_TA_45713
cggctcgacgcatgcgttcggactctcttgcgaggaactatcctgtacacccatacttaaatctagacgcctccttgggggggggccctatagggggaagtctcgggcagccgactaggatgaggcccctcttctaggagaacctgaactacgacacgcgccactcggggctctagcgcctcttctaccgatacggctggatccaacgcatactcgtgaatgcatggtccgcacttcgcctactgttgagga

SEQ ID NO: 45714 - DNA, 429 bp, Triticum aestivum
  Clone ID: PAT_TA_45714
cgtccgctcacgcatatgcgcactcgtctgatcgcgcgtagtcatgagcgtgctccaaagcgacggtgttaatgatgccagcaccgggaccggtttggaggcgagagaaaagaagcgcgaggtgactgagactgtggagctctagatcgagctcagagactacgacccagagaagggcaaacgttttagcgcctgagtgtagctggcccatatcccccggccaaagatgagggtgtgcatgcttggtgacgcccagcatgttcaccaggctgagaaattggcacttgactacatggatgtcgtaagtctcaagaagatgaacaggatcaagatgcttgttaagaagctagccaagaagtaccatgctttcttggcatcagaggccattatcatgcaaatcccttcgcttcttggccctggtcttaaaaa

SEQ ID NO: 45715 - DNA, 377 bp, Triticum aestivum
  Clone ID: PAT_TA_45715
cgtccggcgtcaggcaaccgcagccgcacccctcccctcccctcccctaccgaccacctcagcgccggagactgcacgcccatcacgccggcgcacgcgctcgctcgctgacgggctcctcctccccgtgcccgtcgccaaatcgacccgccccccagcgcctcacgcttccccgcagcacgagctagaaggaatccactcattcagcagcagcagcagcgggtgagcagagttcaccggggccccaatggcctccgccggaagcttcgggaggctctctcttctcctcgcgctctcgctgggctccgcgctcgcatccacggtccccggcgaggctccgaggagggtctggaatcgagggcgacgccttttggaag

SEQ ID NO: 45716 - DNA, 143 bp, Triticum aestivum
  Clone ID: PAT_TA_45716
cgtccgcggacgcgtgggttcgattcgattcgtccgggaaaatagaaattggtcgatccatcggaccttgcagaacgaagcaaaaatcgagggtttggagaggtgcatcagacgctgcgaagatggacggctccggagggatc

SEQ ID NO: 45717 - DNA, 269 bp, Triticum aestivum
  Clone ID: PAT_TA_45717
accgttcccgaatttcaggtcgagcacgcgtccggttccacgtcgggcgtcgtcgccttccaccgcaagcggaagcttccgtcaccatccctgtgtgacgccaccgtcgacgaggacgactactcctacttaccgttgttcccagtcaccttcttatcctcgtcttactccccgtcgtattcctcctactcccattctgacgaggatgacgtctactcctttaccacctttaccgtcgattgcctctatgccgtacctgtatcctcatc

SEQ ID NO: 45718 - DNA, 419 bp, Triticum aestivum
  Clone ID: PAT_TA_45718
cgtccactctgttcgacctttccatgtatactccacggcacacacagaggaggtgccaagtcacagactggctggatatctacaggtactacaccgatcctacttcagagtcctgactggtgagtgcggcatatcatgtaatcaaggatgccgtctagtatgatcgtctgccgtgttaccaccggttggccatctgcctttatactgatagataccacggcctcgtttgcgctaatcaggcggtgtatactcttagcagttttatcggtcagcactcggtgcgtgcctataaatatggtgggtatgtgggtgagagttgcatgctacccacccgggcacactacatggttggagagcaggcatacgctgctcgggaactatatataggtgggcggatagcaaaagcaaaaatggaaaaa

SEQ ID NO: 45719 - DNA, 430 bp, Triticum aestivum
  Clone ID: PAT_TA_45719
cgtccggtcgtcgcctcctcctcctcctcgccgatccatcccagatccacgccaccgcgcggatccccgatgcgggcgccggcgatgctccggctggccgccgccgggatcgccctcgtcgcgctgctcgccgccgcgccccccgccgccgccttctacctccccggcgtcgcccccaccgacttcgccaagggagatgaactgttggtgaaggtgaacaagctgacatcaataaagactcagctaccctacacgtattactcccttcctttctgcaagccgaataccatagttgacagctctgaaaaccttggcgaggttctccgtggtgatcgaattgagaactccccttacgtggttcaaatgagagagcccaagatgtgccagaatatcttgaaaataactgttactgagaaagaagcaaaggagc

SEQ ID NO: 45720 - DNA, 428 bp, Triticum aestivum
  Clone ID: PAT_TA_45720
cgtccgcccacgcgtccgcggacgcgtgggcgcgtcagcgctacgctgatccgtcagcggagtgggggaggccgtttctggcggcggggaagggggtctttcgtagcaacggcgagccccctaccctaaaccctaggtgcgactcgccccagccaagcgctgtttccggatccccccccttcgccggcgatgaaccggcggccggagctctgcaggaactaccagcgcggcagctgcaagtacggggcgcagtgcaggttcgtgcacgccaactccaaccaacagcagcagcagcaggcgaagcccaaccccttcgggttcggcgccggtagcaggcagtagccgctgctgcagtcgttcggtgtgcagtcccagcagtttcagcagcagcagcagcagcagctgcagatgcccaatcaatttgggtt

SEQ ID NO: 45721 - DNA, 434 bp, Triticum aestivum
  Clone ID: PAT_TA_45721
cgcgtccgcggacgcgtgggttgaagccgcggtggcgctctttcgttccccccttcctcattcggggtgtgtgagctcgaaaacgcgagcgccaaaaatcccccgcgccgccaaagcggcggttggggttccggccttcgcctcccccgcgggcccgggccacggtagccccgccgtcgccttgcagattcccgaggacccccagcctcgccggcgggcgtgtcgtatcggcggactccctggtgttgaacgagttggtccttttgtagagggtgcattacaaggacacagatgcctgtatttaagaggacaccttttctttttactggacccgccaattgacttggatcccaaggagaaggtgatccaagttcgatttactaaggggatatttcgaggataccaggaattcctgaataggttggacctttacc

SEQ ID NO: 45722 - DNA, 279 bp, Triticum aestivum
  Clone ID: PAT_TA_45722
cgtccgttcacacacaactgggttttccaatttcgatctccagcttcttggcatgggccctgacgggaccatggagtgtgccttggaagtccatactcctgctgaagagaacaagaagcgggtcacccacatcttggactctcacaaggcgtcggcaaagataatcacattcacgcttgcggtgctcaactagctcgtatatgtcgacatggtggtatctggctctatgaaagccaatgcatgccaggaacgcaatttctgacaataagacatctgact

SEQ ID NO: 45723 - DNA, 434 bp, Triticum aestivum
  Clone ID: PAT_TA_45723
gcgagcgcacgcgtccgcgcaccttttttcttcctctgcccacaaaaccctatccgtcggcttacagctcgtcgcgggggcagtgagctctgcctccagcgacgaaaccatggcgacccaaatcagcaagaagaagaactttgtgagcgatggcgctttctacgccgagctgaacgagatgctgacccgggagcttgccgaggacagctactcctgcgtggaagtacgcgtgacgccgatgcgcacggagatcatcatcagggccacgcggacgcacaacgtgcttggtgagaagggccgcaggatcagggagctcaccttcgtcgtgcagaagcgctctaacttcccggagaacggcgttgaactttacgccgagaaggtctgtaaccgtgggctctgcgccatcgcccatgccgagtcactccgctacaagc

SEQ ID NO: 45724 - DNA, 369 bp, Triticum aestivum
  Clone ID: PAT_TA_45724
cgtccgatttaacagactatcatatggaggaacagaagcagcacaaaacgtgacaacatttggaggggcgtgcttccgatgaacagcggacgcgctcgcatggtccgcactgatgatacagacctgaagtgcaacgaggaggatgcacgcgctaagcaactagccaccaaagcacgcataggaagtcagaggggacgcagctcctgtgtgaacgaatcccaccgatactggcctggcacggtagcttttccggggatcagcacgcaatagaaaacgacttagcttctgatctggacgctgcctttccagcgcctgatccgcgagatcgcgcaggaatttaagacaggactgcgcttacagtctcacgcc

SEQ ID NO: 45725 - DNA, 383 bp, Triticum aestivum
  Clone ID: PAT_TA_45725
cgtccgataaactccagatccataggagtcggcgcgctgcagctcgtccgccggcggcagccctccccaccgccgcggcctgccttgccccgccttgagtcgcctttcaccgccgggctccccccttgtctgcctccgggcccctccttttctgccgccgtcgtcgaccatctccgccgccgtccccgaccaccggactccctccttgtctgccgccgtcttccccgaccaccggaccacgcaggctgtgcgcctcctctgcctccccgaccacctcgcatatcaactgaatcacagtaggtcgcttgagttaatgtgcaccatatagtgctttgtctctggtaaatttgcttatgagatcagtaaactggtttggatttatg

SEQ ID NO: 45726 - DNA, 313 bp, Triticum aestivum
  Clone ID: PAT_TA_45726
cgtccgaaaaaggggaaaaaaggaacgctcgccgacggcaaggcgatctatctgctgactccacccggtgcagcctcgagaggccagatccaaatcctaaccctagtccccacgcgctctcatggataatttcttcaactctgtgttctacgtcggcgacctcggtgagcacgaggaagaggagggctaggaggaggatgcgttagggcgagcaagcagctttgagggaccggggcggcgattctggtggcgggtggagcattggtgggctgttgaagacactcgccgctgagattgaggggcagatggaatt

SEQ ID NO: 45727 - DNA, 377 bp, Triticum aestivum
  Clone ID: PAT_TA_45727
cgtccgcggacgcgtgggctcgaatccataagtttgtaccaacagctaaccatttatggaatttgatttgcattgaaacattgtttgcaaatatttctacacatgctttctgaaatagcaattttctttgatgttggtgataataaataaaatctttgacgcacaaaaaacattctccatgtttattatctccactattgcatcattgtcctaccacaagtaagtgtcacgattaggctgagtcgtgataatgtggttgggtttacatacaatagttcatattggatggacctcattgaacttttttttaaatacgggatacgttgttaattcttcttatgatcatattttcggggtaatagttattggcggtacat

SEQ ID NO: 45728 - DNA, 177 bp, Triticum aestivum
  Clone ID: PAT_TA_45728
cgtccgcccacgcgtccagacacacgttcgcttggtaatgttggcggtagcccgactagtaagagtcagttaacatagatgcctagctaatgaacactgaccaactgaacctgactaaggattataagagtgaaaagatgtgtgacattaccttgagtggccctaaacataattgca

SEQ ID NO: 45729 - DNA, 403 bp, Triticum aestivum
  Clone ID: PAT_TA_45729
cgtccgcgcttactctatttttattcctggttgtatgctgtggtgctttccacattacttgtgcgagtctggtcgttttaatttaaatcaaatactatttgcttttagggatgattaatgttcttgttgtaaggtgggttcaaagggttttaaaaatcactagaacaatgcccgtgcgttgcaatgggatataaatattctagtacgttagcttgtgatctacctgtcaataataatgcgattgtgtaaataaatgttcatcaaattctgcccgtgaattaccttatattttgattagaagtttcggaaaggaattaaagtggaaatggttctaaaggtaagtaaattaaggggattgattatcatgtacatgggaagttggacgaacgggtgtttggaagaa

SEQ ID NO: 45730 - DNA, 316 bp, Triticum aestivum
  Clone ID: PAT_TA_45730
cgtccggccggaccatctcttttctcttcctctaaccccttcgtaaccggaaccctaacacccaaatccaccactccccggcttcggccccttccatggcaaccggcaaccccgacgcttgcgaggtcgagcggctctaccagctcggggaccgacttttcttaaccaaggacaagtcccagcacgcggcgggctatgaggcgatcatagcggtggtgaaagggccaaacgttaaagcgaaacagctggcggcgcagctcattccccgttacttccggagctttccagccctcggtaccttcgccatggaagcaat

SEQ ID NO: 45731 - DNA, 282 bp, Triticum aestivum
  Clone ID: PAT_TA_45731
cgtccgcctatacggagacccaccaccgtccatcacgcggtcacgcccctgtatataaaccctagggctaatccccccaaccgtgccacccaaattcctctcccaaaacaaacgggataaaccacggcctcgacccgctccgtgtccgctccccccactaccagtccacttcccttcctcctcctccgctccgacccctcaagcgaaagcacctgatggcggcttcccccacccccggcggcggacttgggtccatacttgccggcggcgacaggaactacc

SEQ ID NO: 45732 - DNA, 255 bp, Triticum aestivum
  Clone ID: PAT_TA_45732
cgtccgcctaaccctagcgaatccacatcgagagatcgagagagagaagcatggcgcgcgccaagggcaggaagcgcgcggccggtgacagccaggcggaggcggtggaggctaacggtggccggtcgaagcgcgccaaggcgccctccaagcccaagccggagccggagtacgtccacgagccgaggaatctggaggatctttggctgacggcttttactatagggactgagtgggaaattatggataagatta

SEQ ID NO: 45733 - DNA, 342 bp, Triticum aestivum
  Clone ID: PAT_TA_45733
ccatccgcccacgcgaccttattaattcaagagttatagggaggaacttatgtcaccacaaacagaaactattgcaggtgttggatttcaagctggtgttaaagattataaattgacttactacaccccagagtttgaaactaaagatactgttatcatggcagcatttcgagtaagtactcatcctggggttccgcccgaagaagcaggtgctgaaggagcagacgaatcttctactggtacatggacaactgtttggactgatagacttaccagtcttgatcgagacaaaggactttgcttttacattatagcctgttgcctggggaagacatccaaatg

SEQ ID NO: 45734 - DNA, 218 bp, Triticum aestivum
  unsure (1)..(218): unsure at all n locations
  Clone ID: PAT_TA_45734
ttttctacccattgcattcgtncatggcataccctacccgtatatcgtaatacatggccagttctagtaccatcgacgctgtacgtgtgggagcgcacagtcgctcagacatcatctgtttactgggcagatacatttggtgatggagtggaataggggctgccgcgtagcggagtgcatattcatggaattttgtggtatattgttctgcatcaagt

SEQ ID NO: 45735 - DNA, 193 bp, Triticum aestivum
  unsure (1)..(193): unsure at all n locations
  Clone ID: PAT_TA_45735
cgttcnctcacatgagattcaaatgctccggtttcttttctccgatactaagcccatatgcgggggcactgttggtggtgctcggcgctaatggtgcataaggacgccgtcaatggcaacggcgccaccacgcgcccgacggccagtctcttccccattcgcttctccaagttcttccaggccaacatgctga

SEQ ID NO: 45736 - DNA, 328 bp, Triticum aestivum
  Clone ID: PAT_TA_45736
tccgtgaatacccaccttcgagcctaaatttaccatcttcttatgtgtactgaactcccctactttctcctcattctccgttactctgatggcgttggtttttatttagttcgggcccgtgctagctgacgcccccccatgagcgcgcccgctagagatgcttggggagccccggtgccggtgggtggtggcgatggatctggtgtgattgccgccgtccgatcacgcgttcggagagtgcatgggtgcggtgcgggctccatctgccttgatccggtgtctgggcgcgcctgtggctggttcatcgcctagtctcaatgcttgcact

SEQ ID NO: 45737 - DNA, 147 bp, Triticum aestivum
  Clone ID: PAT_TA_45737
tcgcatccgagtttcgtgaacatctgtaagccttctttgcttaatgttctgctactacaaagatgctgcgcttgtgtagatgtcgattgcctgtgctgttatctctcatctgacgtgtctcacacgtgtctattacattgtagttca

SEQ ID NO: 45738 - DNA, 265 bp, Triticum aestivum
  unsure (1)..(265): unsure at all n locations
  Clone ID: PAT_TA_45738
tcgtccgcttntctgggctttagtcgctccccctcgagcgcctgtccgaggactatggaaggaagtccaagctcgtgttcaccgaggacccatctactcacgtgtcgacctctgtggtcgagccctacaacacgtgcgctgcccacccactccctgctggagcacaccgatgcctccattctgctacgacagccaggctcatctactacagctgcatgcgcttcctggacatcgagaggcccacctacaccaatcttgtaccgcc

SEQ ID NO: 45739 - DNA, 245 bp, Triticum aestivum
  Clone ID: PAT_TA_45739
cttgcttgtactcttggaggctgctgctgccctaccacgccacatctcgtcgcttgggcagtatcgggccgacctccatcggctggggcaccgccatgtttcagacgacgggttcttcgggcgacctgactgggggctcagggttaagggacggcgcgaggacaacaaaagggcgaggagtctagattgggctatcgcaccagttataagtgcggagccacgggggggcgggcacccgctgaatc

SEQ ID NO: 45740 - DNA, 429 bp, Triticum aestivum
  Clone ID: PAT_TA_45740
cgtccgaagatttgcgctcagggaaggagggggtttctcgctggtgccggagtcattgccgaagtcatgagctaataacaataatatgttccagacctttctctttttacttctcaattaattcgagatttgttttgtaaggatttcaatgctgtgaatcaaatgtcaaacgtaggaaaaacaaattaaggatctaaatcctacaatttttaaaataaattttctatgaatcaaaggagtcggtagagtagaagcgtgcagaacactagctactgaaatatgattacggccagaaacatctcttcaacttattagtgcatatccaacgccctcctgtaaaacgtacagaccgacgcgttcggacgcacttggtgggagtataaatcttattgaatcaacatttaattagcttttgattaatgatactat

SEQ ID NO: 45741 - DNA, 366 bp, Triticum aestivum
  Clone ID: PAT_TA_45741
ggcgtccgcggactcttggtcttacaacccgtcgtatctctggcgcccgcctccgttttctgtcggctacttcttccttcgggtttcagccatgggtaaggtgaagactcacatcatcatcgtggtcattggccttgtcgactccggctggtcgaccaccactggccatttgatctacatgcttggaggttttgtctagtgtgtattttagaggtttgcgatggaagccgttgatattaactatccgtcgttcatgtacgcctgtgtgcttgacatggtgtgggcctgtcgtgagagggatatcaccattgctattgccctgttaaagctcgagaccatcctatgttattgtactgcaattgatgc

SEQ ID NO: 45742 - DNA, 321 bp, Triticum aestivum
  Clone ID: PAT_TA_45742
cgtatgctacactctgttctaccacgctgttcgacagttattctccctctctatggcttgcatcaaactgccggcgtccaagcgccacctgatgctcgatcttctaacctatgtaccggcccatggaatcccgatgtggagctccactgcggcccgatctgacgtgggagcggccagatccgtgcgtcttcgcctcgctccgcgcgcctccatggtccagacagtcttctcgagcgccggtgccgagctcagccgccgccgtcccatgccatggttgcctcccttcagaacgacctgcagatggccgttctcccttgcctc

SEQ ID NO: 45743 - DNA, 171 bp, Triticum aestivum
  unsure (1)..(171): unsure at all n locations
  Clone ID: PAT_TA_45743
tcttacgnatgcntctaagagagccatctctcctcaggtgatggccaccatggttgcgccgtgtggcgtcgcgcagccaccttccgctgtcatggggcccaatggagaggcggtgagaaaacagagcgacgcacagggttgaggaggaaacggcggtggtggtggtggcgg

SEQ ID NO: 45744 - DNA, 336 bp, Triticum aestivum
  Clone ID: PAT_TA_45744
ttcttatttactactttccactcggtcttaccctcgcttccactccgcctgctgccgtgccatggcgctccacgccgtcttccctgcggcggtggccttcccaccctgcgccctctcctatgcccgactgccccagcgcccaggttgtggttgactctcaaaccgttcatccctgataagttcgaccacatactttatgaaatttcagttaggagcagtgggtgtatttgttgtgccttcggttcttcaacactcggacaagattagcatttttttggcatgtccatatagaacaaattgtggaagaaatgcatatcgctatagaacacgctacaa

SEQ ID NO: 45745 - DNA, 426 bp, Triticum aestivum
  unsure (1)..(426): unsure at all n locations
  Clone ID: PAT_TA_45745
cgtccgcggacgcgtgggccgatgcctatgtcatcttttacttcggagcagnttgtgagtgaaatatcataaaatagcgtgcctgacaagaaaggcgcacatagcagaagtgtctctgcaccatacttaaagaaaaaacagggtggtggatcatataatgcacaaagcacatcaggttcaggcagttcgcgattcggatgggttctgcagaaaacagttgtacttgtttcaaaatcttccaaccaggccaagttgggggaagagaactgtttctactatgatgagaacctgaagcggtgggtgtagcgaggtgctgcaatccctgctgccgtggagcattctcttgccccaccttctacataatcctcgatccagaacggtgttccagatcacaacatctttgactgggcccctcagcggcggtgg

SEQ ID NO: 45746 - DNA, 200 bp, Triticum aestivum
  Clone ID: PAT_TA_45746
cgtccgcccacgcgttcgcggtcgcgtggttgctcctccttcgcggcctactcagtgccggccgaccccaggcggtaaccttcgcctggacctggacgcggaggctaccgtcacggccctgcacctgcagcgtacccgcgcccgcaccaccaccaccgtaagcactggtcactcgcctgctccggcgttgccgcaccact

SEQ ID NO: 45747 - DNA, 249 bp, Triticum aestivum
  Clone ID: PAT_TA_45747
cgtccgttcacttatcggacggacactggtgattagagccacgagcgagctagtcttcgtgcgggtcatactacacgacacagccttggttgttagggctgttcttgccgggaacccggtgcagtgccatgccggaagcgcctatggccgtgccgtgcacggcgttgtacgctgtgggcggcgtctgctgggaggatgcgaaagggccggagcttgatgtcatcgagcgcgttactcggtgcgcagtgg

SEQ ID NO: 45748 - DNA, 136 bp, Triticum aestivum
  Clone ID: PAT_TA_45748
cgtccgcttgcctttcccatccgctgtggattgctgtctagcgagagagatcggtgatggcgtcggtcgcgtacgagagggagggactgcgtacgccacgatgaagtacctggtgcaggtggcggaggggagggag

SEQ ID NO: 45749 - DNA, 328 bp, Triticum aestivum
  Clone ID: PAT_TA_45749
tcgtccgccacagtctatagtatatagttcgtccacagtgtactgaccaagtagtgctgagaattcagggagtccacacgtcatggctttccctaagcttttccttcagctcgtcacccttcttccaagctgtggtcttctattggcggacttcgacctgatgaccctcatcgtggtgaacaactgcgcgtacccgatttgtccggaattacaggtgagcgccggaaaggaggtcctggaggggggcgggttcttcctcccgtcgctcttccaccgcttctttctagcgcccacccacgcttggtccggccggatatgggcgcgcacc

SEQ ID NO: 45750 - DNA, 297 bp, Triticum aestivum
  Clone ID: PAT_TA_45750
gcctgcggtaccgtccgattcctgtttctccatcatgtcgttactagcttgttttttcgcttgcttcatagagaacagttggatagagaattattagaggcgcaaaggcttggtgcgtcttaaggaccttgtttggccggtagaaagattatataggtgttggtagcttgacgcgccatggtttgggttattatgccggacaacgactgtggggcgggcgcggggttctgggagcgtggggacgtcttttttttctccggggctcggcgcccatgggcgtgacttgtccaggctctt

SEQ ID NO: 45751 - DNA, 129 bp, Triticum aestivum
  Clone ID: PAT_TA_45751
cgttcgcaagctcaaggagcccacgccagcgtttgataggtcaacggtcgaccgacgacgtatgatggcgccgagcaccgtaccgtgcgcactactggccgtgtccctagttctcctggtggacgaagg

SEQ ID NO: 45752 - DNA, 169 bp, Triticum aestivum
  unsure (1)..(169): unsure at all n locations
  Clone ID: PAT_TA_45752
tctttctcgggctcntggtgtttacaccaatgttccgatttgccatctcataaactgtttcggagccagctgcctaacgcgtttggaaaacctttaaccttcataatcagaatgaggctggacctgcttattaaatcaaatgcttttctaaagcctagctttataacca

SEQ ID NO: 45753 - DNA, 326 bp, Triticum aestivum
  Clone ID: PAT_TA_45753
cgtccgcggactcatgggtccggcactgagatttcattctagatcttgcatcatttcaaccctggttacactaccatggtgagcgctagggatgtctacacaacggttagtggcgaacaagcagtagcaggctaattgatctggcccccaaccccggcatggtcacgatcctcgccctgggccacgctatcccgcagcagatagtagatgcaagactacgtagtacgagggcttcatgaggaacaccaactgcaacgaccccgagctcaaggagaagctcgccaggctatgcaagacgacgacggtgaagacgaggaccttggtga

SEQ ID NO: 45754 - DNA, 433 bp, Triticum aestivum
  Clone ID: PAT_TA_45754
cgtccgcccacgcgtccgcgcagaccgagctccaggcgctcacggggtacgccgagccgggcaccatcaccgcgctcatgggcccctccggctccggcaagtccacgctgctcgacgcgctcgccggccgcctcgccgccaacgccttcctctccgggaccatcctgctcaacggccgcaaggcaaacctctccttcggcgccgcagcctatgtgactcaagacgacaacttgatcggcacgctgactgtgagggagacgatctcgtactcggcgcgccttcggctccccgacaacatgcccatggaagagaagcgtgccttggtggagggcaccatcgtggagatggggctccaggactgcgcagacacggtcatcggcaattggcacctgagaggggtcagcggcggcgagaagaggagggtcagcattgc

SEQ ID NO: 45755 - DNA, 441 bp, Triticum aestivum
  Clone ID: PAT_TA_45755
ttattctcggacgcgtggggcggtgtggcggtgcgactccggcgtgtcggacggcaggagggtgggcgccggggtcgacctggagggcgggtactacgacgccggcgacaacgtctagttcggcttccccatggccttcaccaccaccatgctctcctggagcgtcctcgagttcggcgactacatgccgcgcgaggagcgccgacacagctgccgacgccgtgcgcgggggcaccgactacctcctcaagaccctcgcccaccccggcgtcatcttcatgcaggtgagggacccgtggaaggaccacgaatgctgggagaggccgtaggacatggacacggagcgcacggtgtacaacgtcagcgcgtgcggccagggtcggaggtggtcggagagacggcggctgtgctggtcgcggcgttcatggtgttccgtgacgg

SEQ ID NO: 45756 - DNA, 440 bp, Triticum aestivum
  Clone ID: PAT_TA_45756
taaattgtagtccatatatgtgcagtatttagtaaaaagttactgcaattctcagttttagtgaggttgatcctccataggatacttcttggtatcttagatttccgtttgtcttttcagtttcaaacaagcttaatcaatttctcgtatttaaaatttaagtcaattctctgtatacgtgagatggggacgaggaagattggatgttgatctgatggattagaaattgtgtctggaatataacaaaaaatcaagtatggttgtgactagacaatctcaatttcagtatattcagtttgatacgattgcagagacacaccgttgtataaattgggtctttaccaaacttaacatcattgccctaattgtgccacgaatttatctaaaacaaaattttaacctcataagtgaaatcaggcgatttttttatgggatgtaag

SEQ ID NO: 45757 - DNA, 206 bp, Triticum aestivum
  unsure (1)..(206): unsure at all n locations
  Clone ID: PAT_TA_45757
tctttcatgtgacnctttttgtccgtcctttttttttcatttacttccttatttaatgccacgagtgatccgatccgatccggtttaaaactgcaacaaacggtacttttccatttgatctgtggccacactatttacaaacaatacctgaagggtaaatccaaatcatgcggacggagcaaatccctaattcgagttacattacc

SEQ ID NO: 45758 - DNA, 419 bp, Triticum aestivum
  Clone ID: PAT_TA_45758
cgtcctgctactctttcgaatatgagttcatcatatcacacacacccgttcgcacaaatccttggacggaaccaaccgatccatggcgccatgcctagcctccggcgcgaagaccagggcggtgtgcgttctgctgctgtttctactcctgtcggccgatgtgcggtcacagtacgcggatgggcatgcaccaccggctccagaggtggactgggctaccgaagcgtataccgacggccgcggcaacggcacccgcggtgccggcagcgggaacgccctgaggaaggtgcggagcaccatcgactgccagatctgcgagtcgacgtgccgaatcaagtgcctcatcaacaacctctttcagtggggcacttgctaccagcgctgcaaggccgacagctgcaacgactggtgtaggtagc

SEQ ID NO: 45759 - DNA, 204 bp, Triticum aestivum
  unsure (1)..(204): unsure at all n locations
  Clone ID: PAT_TA_45759
cgcgtcaccacgacgntccgctacccgtcgtgcgcgtaatcaacacgaccacaagcttgtaggacgacgacagtgagctcaagcggctccaaccagtagcgacaagaccgggccaggtcggacgagcgacgaccggggaggaggaggcggcggatcgggggacggacgggcgcgagggcggcggcggaaggacagcgggggacg

SEQ ID NO: 45760 - DNA, 454 bp, Triticum aestivum
  Clone ID: PAT_TA_45760
ctgccgtctcctccttcacgtactcgttctatcagtcccctctcattccttcaagtaagagtaagccatggataaggagaagactcacatcaacatcgaggtcattggccacgttgactctggcaagtcgacgaccactggccacctgatctacaagcttggaggcattgacatgcgtgtgatcgagaggttcgtgaaggaagccgctagagagtgaacaagaggtcagtcaagtacgcctgggtgcttgacaagctcaaggctcgagctgtgagtagaggttatcaccatcaatgtattgcctctctgggaagttgtgagacaaaccataggtctagctgcacgagtctatttgatgccccgtgagagacctgtgtacttcatcaagaacatgatcaccggtactatccaggctggctgagctgacctcatcattgtactcaccactggaggt

SEQ ID NO: 45761 - DNA, 304 bp, Triticum aestivum
  Clone ID: PAT_TA_45761
ctgcctccggccagcagccatggcgaggggttccatggccgcggtgctcgccgtcctggccgtgtcgcaactccggtgcgcgccggccgccgtggagctcccgctggtggagcacccggccaagaacgacgggtcgttcaatctgctcagttgttgagactggggccgcaactgatcctacaacctatcaggtgtcttggagcaaatggtgatggtcgaggagaggctgaacatcgacttctgtgtcttcaccgtcgacttcttttacgagaagggcctcacctgcttccatgaccagcagttt

SEQ ID NO: 45762 - DNA, 388 bp, Triticum aestivum
  unsure (1)..(388): unsure at all n locations
  Clone ID: PAT_TA_45762
cagacgcatcnctccttcttccttatcctcccgattcatatcctgcaatgggccgcaccatgctggcggcgtggatgtccaccggcggctaggtgcctaggaagcaactggccaccaaggccgcgcgcaagaccgccccgtccaccggtggcgtgaagaagccccaccgctttcgccccggcaccgttgcgctccgggagatccgctttgtccatatgagcactgagctggtcattcgcaagctctccttccagcgccttgtccgtgagatcgcccacgacttaaagaccgaccttcgtttcagtcctccgtcgtttaagccctgcagaagccggagggcctacctcgacggacttttttaggacaccaacctatgcgcctttcacgt

SEQ ID NO: 45763 - DNA, 328 bp, Triticum aestivum
  Clone ID: PAT_TA_45763
tttttattttcttgtaaccgcaacgtgattttgcatcggaagtaattgctgtacaaactagtgttgttggattagttctgatttaccagctactgtcactgattttgtccgaaatgaacccaagatttttttacacgccgtgtactgactttgggatctcattctgtaagcatgtaagaagaaataaattgcagggcatccacccgatcggcgggataattgatctactcttgcggctgacgtaggttggttgtatagaaggggtgtaaactccagtcgtaggccccgtacttttgcgaatagccttatgagatcctgtttgtacggt

SEQ ID NO: 45764 - DNA, 276 bp, Triticum aestivum
  Clone ID: PAT_TA_45764
ccacgcgtccgaaagggaaccacaacgccgacggaagctcacgttgatgcggaccactgcggacgtacaagcgcactcgggtaagcccaaaggcacactctccttgaggacacatgacgcgtataaagacctctgcactgcaaggggggcgcagacgtcgcatgcttaatttggattttgacttatacgcggccagtcatagcccggcacacggcttcttccggccactggtttttcaaccaagcgccatgaccaattgggtgaatcatcggttcc

SEQ ID NO: 45765 - DNA, 387 bp, Triticum aestivum
  Clone ID: PAT_TA_45765
cgtccgcccacgcgtgcgtggaccctggagcggaacctgaagcagacgcgacgagacactagtcgaattccttctccacttcaatctccatggctaacgacatggctcaagacgaggtttcgcagtcttctgcggcgtctgcgggggtgaacgcccgcgtgcacgacgtcacgccggaattcaccgcccgatacgacgcccatcaccatggccatgcgcatcaccatgaccaccaccatcaccagcagcagcatcagcagcagcatcaccagtaccagcaccagtaccaccaccagggacaggatgagggagaggccgagggggatgccgataacgctcaggataaccctcacctggagctggctcaggagctcgctaagcaggtgg

SEQ ID NO: 45766 - DNA, 450 bp, Triticum aestivum
  Clone ID: PAT_TA_45766
cccgggttcgactctattaacagtactcatctcatcacagtattgcaacattgaaccgtctgaattgactgcattgccctagagcaagatgaacgatacaactgcactctattgaagtctatgctcacagtgaaggcatgaaacgactccgaaaagtaacatgtggataattgaccggcataacaactgtattcatatttaaccgtaaacacggataaacgatgagtgtggcatgactaacggtgtcgcaactgaactgcccaatggattaccatacaggttggttcacactgggcagaaaaacatagcacaggggggactcaaccgacctcaagtgctatacagatgcacctgggttttttctagctctgctagatcatgtcgaccgcactatggcagcgacaaagagcgtgtggatcttgtgtgctacaccatggttctttacaagac

SEQ ID NO: 45767 - DNA, 415 bp, Triticum aestivum
  Clone ID: PAT_TA_45767
cgtccgcggacgcgtgggcgcgccctcccccgtcttctaattccaaacccagctaaaccccgcaccaaacaccgcagcccaaccaacccccaacccgagcgtagcgagggacacagccgcgcgggtggaaggggaggttcccggccatggatttcctacaggggcagagcgtcgagaccatggtggccgtcgccgtcgcggtcgtcgccgtcgccgtgggcggcgcgctcctcctccgccgatccaagaggcccaagggctgcttggatcctgagaacttcaagaagtttaaacttgtggaaaagacacaaataagccataatgttgccaaattccgatttgctcttccaacccctaactctgtgttaggccttccaattggtcaacatatcacttgcaggggttaagaagctac

SEQ ID NO: 45768 - DNA, 430 bp, Triticum aestivum
  Clone ID: PAT_TA_45768
cgtacttccacgcgttcgcccacgcgtttcgcccacgcgtccgttcccccctacacctcctcccccaggggggccttccgttcggaaccccagggctcccccccccggccgccggcgaaaagggccccgaagcgaggcggaaggcgccgggccgcgaagaagaggcggggacaagggggtgaacccgctgttcgagaggaggccgaagcagttcggcatcggcgtgcgctgccgccaagaaggacctccaccgggttcgtcaagtggccccaggggtcgtgccggatcccagcgcccagcgctcgtattcctcaaggcagcggcctcaaggtttcccccggcgctccaccagttcacccgcaccctcgacaagaacctcgccaccaacctgtttaagatgcttttcaagtaccggcccgaggacaaggtg

SEQ ID NO: 45769 - DNA, 339 bp, Triticum aestivum
  Clone ID: PAT_TA_45769
tggccggtagatttgcggccgagtaaagtcttgccagtccttaggccggctcagttccgggggccgatcgtgcgtggctaggaggccgtcgctcaggcgttggtccgggccccgtctacctcgccgcgtctcggtacctcgcaccgaggtgctggagctgccggaacgccgtcaaggacaacaagaagagcgtatcgtgcccagcacttgctgctgtcattcgatcgaccaggagctcgggaggctgttgtccggcgtcaccatcgcccacggtggtgtcatcctcaacatgaaccctggtgctgctttctaagatggccgtcgagaaggctgataagg

SEQ ID NO: 45770 - DNA, 360 bp, Triticum aestivum
  Clone ID: PAT_TA_45770
ccgtacgacccacccttcgtcccgacccgtccccgtcttcgcctcccccccggaaccctaggcaggcaggcagccatggccgcggtcatgctcctccgccgccttccggccgcgcggtccccgctcatggcggcgacgcgcgcgatctccgactccacggcgccgttcaccattgagacctcgatgccctttacggtccacattgttgacccgccctcccgcgacgtctccaccacccccgtcgagcttgttcccttctttcacgacatgttcctcatgctccgcagggagatcgtcgcttaatatttctaaaggcccagggattagctggtggaaagcttcttgtggaggaagacaaac

SEQ ID NO: 45771 - DNA, 419 bp, Triticum aestivum
  Clone ID: PAT_TA_45771
cgtccgcccacgcgtccggacgaactccgcgaccgcctctccctcctcttcctatccccacacgtcacgtcaggcgtgccgtagcgcttcttccttctctccctcccgtcggatccggctataaattacccgccccctcccgtctcctccccacacatccgatccgatccaatccagcccccctccgatctcgccgagaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcaccctt

SEQ ID NO: 45772 - DNA, 282 bp, Triticum aestivum
  Clone ID: PAT_TA_45772
aattgcagtttccacgctagacctacccggacgacaacgcagactttatattttcttctctagcatcccgcctactttaccctttgctggcccaccccactacggtccggagccgaccggaccggactactccccaccccgccgaccggccgatctgttccatcctccccccttgccattcactccggcgtggccggtggccgtgcggcagcagcaactgctacggcagggaggccgcaatagggcttcgtcaccaccggcgtccgtgccaccgacctttga

SEQ ID NO: 45773 - DNA, 209 bp, Triticum aestivum
  Clone ID: PAT_TA_45773
cgttcggcgcgagagagtactgctctgctcaacattcgttccgtgtgctctgctcttgacatgggcatctacccctgctttcacagaagcagagcagagggtgcgtgacagagagatgaagggcgtgaggggcatggccgtggtgatggcgctgttgctggcgctggtcgttatggtgggtacctatttggttgtgttttatcaggttt

SEQ ID NO: 45774 - DNA, 257 bp, Triticum aestivum
  Clone ID: PAT_TA_45774
cgtccggctatattcacgagtttgacaggagaagggactggaggcatacagtaggcagaacgggggaacaaaactcagcttcaattaatcgacatggtgttcgcaaatggaaaggcgttcctgctgctacagttcattggttcaagtccgacactgagctcacaatggacgttgagttgttggacactagggacattaatcccatgaagcttcagaaggccagatttcgttacggattttactcgtttctatctaaa

SEQ ID NO: 45775 - DNA, 265 bp, Triticum aestivum
  Clone ID: PAT_TA_45775
ccgcggggcgtctggtgtccacgctcaccgtccacgcgccgtccaccccctttcctttctttctcttcaagacggggggggcttctggaacctggcatgttcccgaaacacccccgctccacgttatcacctttcacgaagccccaggggcagtctcgtacttccacgccccgccgtgccgttagaccgggttatacaacacattcctcacgaagtcgcccgcagccagaaaggcgagcaaaagttttacttgtccttcctaacc

SEQ ID NO: 45776 - DNA, 314 bp, Triticum aestivum
  Clone ID: PAT_TA_45776
cgtccgcaagcaccagagccttctcaacctcccggtgccggcgcattgactgcatggccgggaccaagcatacggcgagggagtccaccggcggcttggctcctaggaagcatctggcgactaaggccgtccgcaagtccgtcccggccaccggcggcgtgaagaagccccaccgcttccgtcctggcaccgtctcgctccggtagatccgcaagtaccagaagagcatcgagctgttcattcgcaagctgcccttccatcggttggtgagggatatcgcgcaagacttcaagaccgacctttgcttgcagtcc

SEQ ID NO: 45777 - DNA, 413 bp, Triticum aestivum
  Clone ID: PAT_TA_45777
cgtccgcccacgcgtccgcggacgcgtgggaagacggcagcacagacctctgcgtatcgccttgtcctctgcatcctcacatatagcatagagaaaacagtttcttgcgtcctctcttttggtcacaagaaagagatgggttcaggttcaaccaccgtcagactcatggccttcgcctccgctctcgtgctactgacgcactgcattcacgcggcagcggcaccaagctttcagcagaaacaggcggcggccaagacgtggtgcgtggccaagccttcgaccggcgaggcggcgctgagggccaacctggagttcgcctgctccgagagcgactgcagcgcgatccagggcacggggggctgctccgcgcacaacggcggcgtgctgctgtcgcgggcgtcggtggccatgaa

SEQ ID NO: 45778 - DNA, 405 bp, Triticum aestivum
  Clone ID: PAT_TA_45778
cgtccgccatcattatgcatattaaataatgtaggtagtttaggccaaaaattgccactatcggggggttgccttcaagcgtggtgctgaggccttcaggccatactcgacgatgtgaagtgctcaaggctccacaagacgctcttcagcccattcctcaaggcatcatcgtctcgtcgtaatctcagttaccctggtgtcgacgactatgtcctggtctcgttatcatatgtttgtccttggcgaccaggcaccaagcttgggatcattgccttactctaacgacaatgtccgaagcccagtatcatctttttgcccgtggtgaccatgccccaagcttgttatcggtgtcttgcccgcggcgaccatgtgccaagcttgttatccttcctttgccctaggcaa

SEQ ID NO: 45779 - DNA, 417 bp, Triticum aestivum
  Clone ID: PAT_TA_45779
cgtccgcctcaccctccccccaccacccgcgaggatcctccccggcgaagcggagatccctaggcaggccggcaggcaggcggcgccatggacacggagcccttcgacgaggcggccctccccgcctcccccgtcgcctcccctccccgccgcctcaagcgcctcaagaaatccttccaggccgccgccgccgtctcccctcccaaatctccgccgccggcagaggaggaaaccctggccccgcacctcggatctccccctcctcctcctccgaaccactccccgccatcgccgccgtcagcggaggaagccgtggccccgcgcctagggtctcctcttcccaacccctccccgccgccgtcagagcagcaatccgtggccccgcgcctgggggcccctcttcttcctcctcctccg

SEQ ID NO: 45780 - DNA, 357 bp, Triticum aestivum
  Clone ID: PAT_TA_45780
cgtcctaagaagcttagggagaaggagctctaggtgtatgccattaacaaaaaaacccaggaggtgaattaacagagggggcagggggccatccaggtccagtcatggcagtcagccgcgctctacaacgaatctgttgtcagcaccctgaagacccagctcatgaaagtggtgggggaccacgccaaccttaccatggaaggtttgcggcgacagcgtattgagagagcggttctcttccccgtcagaataacatcaacactttccccggaggctttttcaaggcgagcctcctccctggaggtaagagcggggtaaccggcagtgggcttgcatcctgcaagttgtgcggagcga

SEQ ID NO: 45781 - DNA, 411 bp, Triticum aestivum
  Clone ID: PAT_TA_45781
cgtccgcggacgcgtgggccaccagcctggttgtttgctgctaatccagctctaccccacatcggggaccgcggcatggggccggcaatagactcatttcttgccgcgcattgccttccttgccgtacacaagagatcacaacaagcccgctgcctgtctacttctacttgtatccccacgccaacgaaccaaatgctggagacgcacaacgcacagaccgataggaaccggacaactgcttctgactgcatatgcgactgttgtcttcttggtaatgtccaacgagaaggtgacatctgcacgcgatgagggattgggtcgtgaaccccatgctgcgccccgcatggactgtgcggttcacggttatcacgagactcatctcctacaacgggtgcaggcccgtgatgaag

SEQ ID NO: 45782 - DNA, 247 bp, Triticum aestivum
  Clone ID: PAT_TA_45782
cgtccgcggacgcgtgggcgctgttccacctggcgcgtcgcgacttcgacctggagcccgtgctagagcgcctcgcagcgggcctacggctcattctactctttctttccattgatgctagctcggtctattatattttatatcgagactaagtcctgtctaccgttccttcatttagtgttgatccatttttttttattttcttttatgtcaattttttttttttaataattatttctttaaaaat

SEQ ID NO: 45783 - DNA, 397 bp, Triticum aestivum
  Clone ID: PAT_TA_45783
cgtccgcggacgcgtggggggaggatgggatatgttcacattgacgacgtttcatttaggggggttctattttacgagacaggggaggcaagtgtcatatatttttgcagttcagtggttctggataacaatgaattggttggcttactcacgaagcatttcttggtatttccaatttcaaggtggttcagggacccctattgaaagcgggcgtatcagctcaacacattcaagcttcaggggctgggtctcaagttcaaaggagtgcaagagatttttaactacctgcgttgagtctctgaaatcccagggccatttttttgagtgccccttgtgaaaatagagacatcccatacaagctcatagccatacgtgtctcaactatgtttagatcatg

SEQ ID NO: 45784 - DNA, 342 bp, Triticum aestivum
  Clone ID: PAT_TA_45784
cgtccggcttgtattatgtctccttttgagcaacgacagctgttttttcttacataatagtcgagaggcgtgacctagagggagggaattaccttcctctcttcgattctactctttctagggataataacattccaagtcggcaaatatatcacgttcacaatgacaacgcatacaagcgttcttattactttaagactctcctaatacttcctcatgtaactcatcaaataaaacactctatacacctactattctccgaccatgggcatggagaaaaatttctacttgacttttctggaatccctagtggaccgcactcatgtgatatcttgaatacac

SEQ ID NO: 45785 - DNA, 407 bp, Triticum aestivum
  Clone ID: PAT_TA_45785
cgtccgcggacgcgtgggcggacgcgtgggcttccacgtttctgaactcaagcgttgctgggggggatcctatccgggaagtggaccacgaaacgcttgatctccaagataatcttacatatcgggagtgccccattcgtatcctcgatcaagccgagcgtaccacccgacgtcataatatcaagtttctcaaggttcaatggtcgcaccattctgaagatgaagcaactttggaaagggaggatcgtcttcgacttgaataccccgccttcttctcggaggaacccaaatctcgggacgagattcttttgagtgggggtgagttgtcacaccctagctagtcatgcattagagagttgcatcatgtttactctttcatcagaaactttgaatggggatgactgaac

SEQ ID NO: 45786 - DNA, 400 bp, Triticum aestivum
  Clone ID: PAT_TA_45786
cgtccgcccacgcgtccggcccggttctatatgctagactagcggcttcatgagatccaccgacagggacctgccgaagctaagttgctatgacctgccccacgtgcacggattgcagcagccgctgttgtccgtgcatccatcgtcgtctctccaacacagatctcgtcgggagcagcctttccccgacgaaacacagatcaaccaccaagctgcacatgtacgtcctcagccacagattctgcagtcggcccctcactccgggtcttcggggtgttgctcgtttgactcttatcgcgtatttggggcttctggccggcaacaacctggtgcttgtgttagcgtgggtggttctgattttcgggcagcataacaattagtatttttttctagctaagta

SEQ ID NO: 45787 - DNA, 405 bp, Triticum aestivum
  Clone ID: PAT_TA_45787
cgtccgcccacgcgtccgctcccccgcccgccgccgccgtcgcacagccgcaggtagagaagggagggaggaagggaagatgccggcggggcacgggctgcggtcgcggacgcgcgacctgttcgcgcggcccttccgcaagaaggggtacatcccgctcaccacctacctgcgcacctacaagggcggcgagcatgtcgacgtcaaggtgaacggcgccgtccacaagggtatgccgcacaagttctaccacgggcgcaccggtcgggtgtggaacgtcaccaagcgcgccatcggcgttgagatcaacaagcggggtggcaacaggatcattaagaagaggatccatgtgcgtgtggagcacgtgcagtctttcatgggcaacgaggagttgatccagagggg

SEQ ID NO: 45788 - DNA, 414 bp, Triticum aestivum
  unsure (1)..(414): unsure at all n locations
  Clone ID: PAT_TA_45788
cgtccgcggacgcgtgggcgccgcctccgcactgtgccgccgcagccgcagccatgggcgcggacaagttcgtgtcggaggtatggaggaggaagcantcggacgtgatgaggttcgtgcagcgcgtgcgttgctgggagtacaggcagcagccggccatcgtgcgcatcaccaggcccacccgccccgacagggcacgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcaagctgggtggtcttcgtgtgctcaactcctactggg

SEQ ID NO: 45789 - DNA, 363 bp, Triticum aestivum
  Clone ID: PAT_TA_45789
ggggcacgcgttcggttctcgtcatgtctaatcgagggaggggaggctccgcggggaacaagttccggatgggggtggggctgcctgtggcggcgactgttaactgcgccgacaacacgggcgccaagaacctttacatcatctccgtcaagggcatcaagggccggctcaaccgccttccgtccgcctgcgtcggcgacatggtcatggccaccgtcaagaagggcaagcccgacctccggaagaaggtcatgcccgccgtcatcatccgtcaacgcaagccctggcgccgcaaggacggtgttttcatgtactttgaagacaatgctggagtgatcgtgtacctcaagggttagatgaaag

SEQ ID NO: 45790 - DNA, 304 bp, Triticum aestivum
  Clone ID: PAT_TA_45790
cgtccggtgccccccatcacctgcataccaccttgacggtgttgaacattataagcaccatggggggaatcatttcaacggggtaggtgcgtccgtcctttggataatcaagcaacagtaaggaacaagatatcacataatcattgggccctggcatacagttacaagccctacaaacggatgggctaccggcacagtaaacctttaccaaaaggcattccaaaactatttcaagatgcggggaactgatcccgtctgttaggtctatgagaacctcctgactctcacactcgtgccatttctg

SEQ ID NO: 45791 - DNA, 421 bp, Triticum aestivum
  Clone ID: PAT_TA_45791
gcgccacgcgtccggtcgctcacaagacggcagcacagacctctgcctcctcacatatagcatagagaaaacgggttcttgcgtcctctctcaccgtcacaagaaagagatgggttcaggttcaaccaccgtcggactcatggccttggcctccgctctcgtgctactgacgcactgcactcacgcggcagcggcaccaagctttcagcagaaacaggcggcggtggcgaagacgtggtgcgtggccaagccatcgacgggcgaggcggcgctgagggccaacctggagttcgcctgctcccagagcgactgcagcgcgatccagggcacggggggctgctccgcgctgaacggcggcgtgctgctgtcgcgggcgttcgtggccatgaacgcctactaccaggccagggggaggaactcg

SEQ ID NO: 45792 - DNA, 201 bp, Triticum aestivum
  Clone ID: PAT_TA_45792
cgtccgcggactcgtgggcaccgacgtacgtacctaactaagcacctgcaagctctctacacagacgatagctcgatcggggaggcgatgcttttcctgttctcacacctccacgctgcgctcgtgttcctccccaacaacggctgtccggcctgggccggtccaggcattcggctctaattctttgtatcacttttctct

SEQ ID NO: 45793 - DNA, 216 bp, Triticum aestivum
  Clone ID: PAT_TA_45793
cgtcgcaaccctctccttgtgctccctccctctcctatcgctcatcagaggtaagacggggggggcgcctctaccacccacccgcctcgtgtcgtttcccctcctcccacgcacgagggccgtgggcagggcctcccggttgcgggaccggcgacctcccaccggcgctgacggcggtgtaccgcccgctccaaactggctgaccggcacactggc

SEQ ID NO: 45794 - DNA, 258 bp, Triticum aestivum
  Clone ID: PAT_TA_45794
cgtccggcccttcccgccgccgccgccggctctctcgtatcctccgcaacatccgcagtcaaggggcgcattcgcagccgggggaaaggcacttcgttttctgcactgccatgcactaggactccctccatctgggtcaaaacaggctttatcaatgtggactaattaatcaccaaggccgtgaataatgtccatatgccgacgcagatcgacgtgctactgcgagaccagcaaggcatgctcctcgagaagagcgta

SEQ ID NO: 45795 - DNA, 247 bp, Triticum aestivum
  Clone ID: PAT_TA_45795
cgtccgcccactcgttcgtggacgcgtggggggccagagccatatctgagtgttgcatgcactaggtgtgaacctgtgtgcttgggcggcgaccaccaccggagccggaggaagagaggaagggtgaagccatcaggtaacgatggtgttcggctccggtgtgtccgtgcgttgcgtggtggtggatgctcgccaccacatgctggttctccttgcgtcgatcgtggccaaggagctgtttcaacgg

SEQ ID NO: 45796 - DNA, 175 bp, Triticum aestivum
  Clone ID: PAT_TA_45796
cgtccgcccacgcgtccggggcaggatcggaaggatctagaagcttcggttggtgtgttgggggctcccttgccggccccggggacgatggctgtcctcgcgaggtcggccgtcgcggtggccgcgctcacgctgctcgcattggtcgtcgccggcgaggtattcttctaggaga

SEQ ID NO: 45797 - DNA, 262 bp, Triticum aestivum
  Clone ID: PAT_TA_45797
cgtccgctcacgcgtaggttttttttatcaccaacatttctataattgatttaggcaatagcagagtctataacggaatgagggcaatttcctcatatagtatactttgatacaaacaatccatccttcaattaagtttttaatattacaattttttaagtaaacaacgaaagcgttatttttttattcaaacttaaattccttaaccattctcattatcgaatattgacgaacccacccaactatgattattctcttacat

SEQ ID NO: 45798 - DNA, 385 bp, Triticum aestivum
  Clone ID: PAT_TA_45798
cgtccgtctgactaccgttcagtgtgcaaaatgatccgaacatatttcttgcgtccaccttggcgtactggatcgactagcgcggttagccacaagccctttagaagggacctgtactgcggataagactcaagttcccaccttggggggctattcaaggaatatcaactctacaggattgaccactacttgggaaaagagttagcccaaaactagctggtgcttcgtgttgcgaaccgactgttcttaccactctggaaccgcggcaatgttagatgatatacagattgtattcagggaggacttttgaactgacacgcgaggaggatattttgatcaatatagaatcattcgtgacatcattcacaaccatttgatgcaggtt

SEQ ID NO: 45799 - DNA, 301 bp, Triticum aestivum
  unsure (1)..(301): unsure at all n locations
  Clone ID: PAT_TA_45799
cgtgcgcccacgcgttcgttcaacccgccgccgcttctcctccttctgaagaaaaacaganagcttcaagtgggccggagcgagagagatggcggctaaaggcgatgggccggcgatcggcatcgacctcggcacgacgtactcgtgcgttggcgtgtggcagcacgacagggtcgaaatcattgccaatgaccagggcaaccggaccacgccgttgtacgtggcctttaccgactccgagcgccttattggcgacgctgccaagaaccaggtggcgatgaaccccatcaacacccgtctt

SEQ ID NO: 45800 - DNA, 163 bp, Triticum aestivum
  Clone ID: PAT_TA_45800
ccggtccgacccaggcgggcgctctaatcatatcaaccacagactcacagtatgactagctttagctagcctgcatctttgccagggaggcatttttgggggggggggataattatcactttatttcataaccctaggccggctgacggaggaggtcttgggg

SEQ ID NO: 45801 - DNA, 212 bp, Triticum aestivum
  Clone ID: PAT_TA_45801
gactcgacccacccatctcgttttttttttttttttacgagaacaactccaccataccatattaatctagctgtcgaggggacaacttaataatgctgttcaccccttaaaacaaacttttaaccaagagtaaccacacttttaacatactcaaatggtaaaataaacacctaccaacacttggaacaccccttacacaaaaaacctttttt

SEQ ID NO: 45802 - DNA, 369 bp, Triticum aestivum
  Clone ID: PAT_TA_45802
cgtccgcccacgcgtccggcgcggcccaatccccgaccagacgtcgctccctgacccttgcgcctggacgccgaagccctaacacgcagctccggcggctcagctcgcagccctcgcaccttcgttcccagcgcgcgcgtacccccacggacggctcaccggcgaggcgcagctttcttcgaccccccgacgaagcaggcggggagcctgacgccgcaacgcgtggctttggccagatgacgaggaccagcggcgcgaacggcggcgggcagcaggggtcggggaagctcccgcggaagcgcttctaccgggcgcgcgcgcacagcaacccgctcagcaacccggaaccagcaacccgcacagcaaccc

SEQ ID NO: 45803 - DNA, 213 bp, Triticum aestivum
  Clone ID: PAT_TA_45803
cgtccgggaaccattccattccattcgactcggttcccaaatcaaacacaccataggtggatcaatgttggagccacctgttgtgtggggagtttggaaacacatcttttttataccactctcgggttactccctacacacacgagatatgttgaatctttttgaacaccctgctgtacgatgctcttacagatgaaagatattttagggacc

SEQ ID NO: 45804 - DNA, 365 bp, Triticum aestivum
  Clone ID: PAT_TA_45804
cgtccgcccacgcgtccgcggacgcgtgggcgccgccgaaacccaaatccccacccgaccgaccgagcgagggacgcgccgccgctccccgacgacccctccatccacagagtcagcccgcccacggccgcgatggaggaggagatccgcgcggagttcgagggcagcggcttcaccatcggtggcgacagcgcccagatcctctccacgctgctgacctactgcgtcaactacaagatgagccccgcggatctcgtctccaactgggaggtctactacctcaacaggcaactggatgggttaaaggtcgaaagctcatacctggatggttttctgtcacaccttcaaaatgaagtataggaaaa

SEQ ID NO: 45805 - DNA, 280 bp, Triticum aestivum
  unsure (1)..(280): unsure at all n locations
  Clone ID: PAT_TA_45805
cgtgcggccccttccggggccggcttcaggctagggttttcttccggcggccgtgcggcccacccggcgncatgggcccccgcaacggaggaggaaggtctttccgccctgctccacgtgctgttccagtgagaaacccaccagcgccagcccgtgcagattcttcacctgctaccacccagagcagcggtggtggtatcatgagcgggattggggccaccattgctcaaggcatggcttttggtactggaagtgccatggcgcacaaggctgttgatgc

SEQ ID NO: 45806 - DNA, 167 bp, Triticum aestivum
  Clone ID: PAT_TA_45806
cgtccgcggacgcgtgggttgagatataaagtcactagtgctactgcaagaggcaggagagagaggcaccgagctgtgagacgccagatcccctctagcactctgccccatctccttgaatatgatgcagtgcatctccaagcacatttactagcactgcatccagt

SEQ ID NO: 45807 - DNA, 237 bp, Triticum aestivum
  Clone ID: PAT_TA_45807
cgtccgcggagcgccaccgtccgatgaccatgggggcggagcgcgaggccggcgaggaggaggaggcgcggcgcccccttctcccaccctctccgtcgccagcggcggagcaccagcagcagtaccagcacctggggcggagcagctcgtcggcgctgcgcgggggcgggtgctcggaggtcaacaccgccaacgagaagcctcatgagcgacttttaatacttctacttctacgcc

SEQ ID NO: 45808 - DNA, 356 bp, Triticum aestivum
  Clone ID: PAT_TA_45808
cgtccgcggacgcgtgggaaacaggcagtcggtactaggaagagcactcggaacaaagctgatcaggcaggcaacgtgcatcgtcaggacatagggtatgtgtctgcgtcaaccttcttcccgcctgcccccagggcaagatcgtcgatctagttcagacaaatgtacttggaggtggaacggtccaggaaccgatagtccctcagaaagaaaagattcatccaaatccaacgctcaagcacacatgtgtcccactagatatgggggtcccttacactccaagagttaaccatcagtgaaaggggcaaccaagaaggggcctatcgatatttcggacatgacttcgcgccctactt

SEQ ID NO: 45809 - DNA, 433 bp, Triticum aestivum
  Clone ID: PAT_TA_45809
cgtccgcccacgcgtccggattcctccaaggcctcctggttacgcttttgttgagtttgaggatccccgtgaggctgatgatgcaatttatggccgtgatgggtatgactttgacggctacaggctgcgggtggaattagctcatggtggaagagctcaatcttactcgtatgatcgcccaagcagctttagcaatggacgccgtggaggtgtttctaggcgctctgagttccgagttatggttgatggtttaccttcgtcagcgtcatggcaagatctcaaggaccatatgcgacgggctggcgatgtctgtttttctgaagtataccgcgagggcggagccaccgttggagttgtagattatacaaactacgatgacatggaatattgcgattacgaagctcgatgatacagagttcaaaaatgcattttt

SEQ ID NO: 45810 - DNA, 259 bp, Triticum aestivum
  Clone ID: PAT_TA_45810
cgtccgcggacgcgtgggcaaagagacaagcaagcagatccactgcaacagtggctgctgcgggggactcggcactgtatttactactactggtaggaagatttgaatcgagtccaggtccaacgctgacaggagcctgcccgagagagaagccggccacggcaagacacgacaccaacccccctgcccctctctcgcctcggctcctcctctcgcctttcaaaccactccactccgccgcagcccttcatttttcccg

SEQ ID NO: 45811 - DNA, 441 bp, Triticum aestivum
  Clone ID: PAT_TA_45811
cgtccgcccacgcgtccgcccacgtgtccgggggctccctgtcgctcggagcgtcttgccaagtacaaccaggcaagtagctctcctgtttattcttgttctgctgaagcaatcttctggtattatgttggccaacaggaccttacaatcaaacaaaagaaatttatttgacccccatgctttattctattgttcagtgccttgtgttcattttgcattcgatgcgtctcatttgtgtctgatcttgataagcattcattattttttgcgaaaacaaactaagagctatttttccccaaatggaacagcttctgaggatcgaggaggatctgggcgatgcccctttgtacaccggccttaagttttcggcaccggtggagcccctactaaacggggattctgcatgaggttttgtgaagaaaatgggagtgtttatacctt

SEQ ID NO: 45812 - DNA, 362 bp, Triticum aestivum
  Clone ID: PAT_TA_45812
cgtccgcggacgcgtggggttttttgtgaagacagaggatgagaaagaaacagtatccaggaccggggactggactaacattgtggggaggggtccgtgccacctatttctattttgaagcagttcttttaggaacagaagattacacatgaaggaatggtatccatgactatgtacgatactaacattagtaattatgggcccatgctagggatttatattccgaagtaatttcttcaggaacagatgatcacacaatatcttttgataaatcttttttgcctagctctgatttctattatcagaaatagattggctgtacttacaagaaacatctgttaataggcggtattcggtattgg

SEQ ID NO: 45813 - DNA, 387 bp, Triticum aestivum
  Clone ID: PAT_TA_45813
cgtccgcccacgcgtccgcccacgcgtccgcttcgctccccctctccccccccgtcgccggagcgccaagaagccaagaacccgctccccgtctccgccgcgcagatcccacctcctctcctccgcggcggtccagctcaagcgacccatggagctgttccagcacggccagcacgtgcggctgcggagccgcgcgctgggcacgtacctgcacgccgacgatgacgggcagggcgcctccctccaccaccgccgggcgtcgatgaacgcggcgtgggcggtgcacgtgcaccatcccccccgcgcgcaggtgccgtacctgctcctccacagcgcccgctacgggctgtacctcgccgccacggacgggccggcgccggtgggcct

SEQ ID NO: 45814 - DNA, 289 bp, Triticum aestivum
  Clone ID: PAT_TA_45814
cgtccgcctccatgtccacccccatccattccgccaccatccttcaccgctggccgcagtgacgccgtccctgtgcctacattcatggcgagtgcccctccccacgcccgcgtcacagccttcgctgcactccaaccaccaccacccctggcacagtgcagccccttctcgggctagccctccttgccctggtgctgctggccttaccggggccggggctctgtcggcaccgggcgcggggcgcgccacgaccgagaccctcgacgtctcggctgcatttccgcgcccg

SEQ ID NO: 45815 - DNA, 153 bp, Triticum aestivum
  Clone ID: PAT_TA_45815
cgtcccgcacgcgtccgcggaacatctactggcagtacggcgatgccgggaagtcgtacatgcggtgggcgggcgggatggccgtcgcgctcgacaccggcgtgccctgtgtcatgtgccagcaggccgacgcgccggtcacccctggatcaa

SEQ ID NO: 45816 - DNA, 257 bp, Triticum aestivum
  Clone ID: PAT_TA_45816
cgtccgggagcccaacaccggtgttacgttcgatgatgttgccggtgttgacgaagcaaagcaagacttcatggaagtggttgagttcctgaagaagccagagaggttcaccgccgttggtgcccgcattcccaagggtgtgctgcttgttggtcctcctggaactggtaagactttgcttgccaaggcgatcgcaggagaggctggcgtgccattcttctcgatatcgggttctgaattcgtggagatgtttgttg

SEQ ID NO: 45817 - DNA, 261 bp, Triticum aestivum
  Clone ID: PAT_TA_45817
cgtccgcggacgcgtgggccggtccacagccggagccgccgccacaccatcctccggtccaccggcggcgccgccacaccaccctccggtccaccggcaccggcgccacaccattcttcggtccaccggcggcggcgccacaccatccgcaggtccaccgccgtggcagcagctacaccatcctcccatctaccgtcgcggctgcctccccttcctgcggaaggccggccttccgcctgcatctttctcaccacttgcata

SEQ ID NO: 45818 - DNA, 403 bp, Triticum aestivum
  unsure (1)..(403): unsure at all n locations
  Clone ID: PAT_TA_45818
cgtactcgatccaccattcccgaatcgacccacgcatccacccctacgcgagctacatgcttacggatcaacaattgcatcatgtgcgacttcaactgcggagcgggtanctggactgggagccgacccaagggttgacaccctcctgcccggacggtaaatgcggagatctgttcctcgagaacacgttgacggccgccaccttggcctgcgagagcacgacgtgctcctacgccggctacaccaacggcacctggttcaccattctcgacaacctaaccaccaactccgtgtgcaacgctggtgggatatcgtcggccgcgcagtcggcccactactgtgagaacagattggggtctccagctcggtggtacggagctggtcgtggggctccatgtggctc

SEQ ID NO: 45819 - DNA, 331 bp, Triticum aestivum
  Clone ID: PAT_TA_45819
cgtccggccatcacaagctcaacgagcgcacgctagcgtttgagagaacaaaaacagtccaccgaggtgcggtggcgccgagcacctttcctctctcgctccttgccgtgtccctctttctcctggtggtcggcgggctcgggccggcggcggaggcacatcccgccggggagggcggtccgcatctgaacccgctggtggcgtgccccgcgtacctggggcccggcgcggcccgcccccttccctactttttctttcgcgcttagcttccttttggtgggactgggctggccggttcccttgggcattattgaaaaggctttccctttcc

SEQ ID NO: 45820 - DNA, 284 bp, Triticum aestivum
  Clone ID: PAT_TA_45820
cgtgcccccactcgtttccccacactttcgaccacgcttacggccaaacgtccttgtacccaaggcggaagggcgtcactctgtatatggtaaaccaaactcttccacttttgatttgctccccaccaaacatcctgtagatgcagaggatccttatactgaggcgcctttttcgcaattacctggaggccaagaaaatcaacaagtacatggaccatttctatttcctgaaggtcactggtaacatgttcaaaaacattagggtccttatggtaacattccac

SEQ ID NO: 45821 - DNA, 410 bp, Triticum aestivum
  Clone ID: PAT_TA_45821
cgtgcgccaaaccaaatgagaaatcgaaccctatcctctcctccccgcagccgcccaaaaccctagcgccgggagtttctctgcagctgctctccccctaccaaccggattcatccggcaatccatccatccatgatgggggaggccaatgagaacgacgtgtacgaggaggagcttctccactacgaggaggacgacgacaaggccctcgacgccttctacaccgccaacgccaagcccgccggcgacgccgaccaggccaagatgggctaccgttggcatacacagcttcgggattccgcgacttcctcctcaagcccgagcctgctccgggccatccaagactgcggattcaagcccccctccgaaggtatactttctgatgacatttcccggttgggggaaaaatg

SEQ ID NO: 45822 - DNA, 249 bp, Triticum aestivum
  Clone ID: PAT_TA_45822
tgggacccaactcttcgcggactctttggctctccatccgtctcggcgccgcaatacatatggcctggggcgccgggtccttgcggaaggcatcgaccctactgtaccactacccgtgcccggacggtgcattcgccgatctcgtcgtccacctctacttttccgccgagcgccttcccgtccgattcttccccaacaccgactattaccccatcaagagcgatggtcttacgattgacgaaattgaaa

SEQ ID NO: 45823 - DNA, 354 bp, Triticum aestivum
  Clone ID: PAT_TA_45823
cctttcgtggacccatgggctggaattgggtctcaaggaagatgacaaggccaccaggggaatgggggaagccagagacatgcatataacaaacacggccactattgacttgcttggtcaacatatcatgcaggctatgaagctgctaaaacttcacatccttgttcgcgaatgcctgccagccaccattattagaggaattactggctgtggcgtggaacggacagggaaggggaacatattccgatccgttatcaacctcggggagagggaacgcatctacaggttcgaagggaacttcggaaccatatttattcgactaggggggccaagagaacaccagtctactggagc

SEQ ID NO: 45824 - DNA, 416 bp, Triticum aestivum
  Clone ID: PAT_TA_45824
cgtccgcccacgcgtccggcggctcggctccacacagaacagagcagtccccgactccagatccggcgccgccgggattcagccccaccgccgccaccgtcgtcgggaatcgcctcgtcgccgccgggattcgctttagcgccgccactgggaatcgcctcgccgccgccgggagttgcctccgcgccgccaccgggaatcgcatcgccgccgctgggagttgcctccacgccgctgctgggagtcacccaaacttgcgtcggcaagaggtagcattatctgtttgctacaatctgaagaagtggagggctaggaaaccaaagcttcttaactggttgtacaagactagagtcaactggattgctgctggcagagtggtatagtagaacattaaaaaggcataagcttcctccccc

SEQ ID NO: 45825 - DNA, 436 bp, Triticum aestivum
  Clone ID: PAT_TA_45825
cgtccgcggacgcgtgggctctaacttatgaaatatactgttcaactgacctgaaggatgcaagggaggatggtctatgcactgtacgctgtggaattgctgctcaagaaccgcagcctcctggtgaagaatgtgtatctcaggcgagtagcaatgctgcaaccagtgaaaagcatgaacaagaggccaaaagtgttacaagtagtagcgatgaagatagctgggttgaagtcaaaattcctgagtctcctcttggaaattacacgccagaatctcaagcagaaaggaatgcgataggaatctgccagaaaaatactctggctcactacgaagcaactgccgagataactgatgcaaacccatgtgtatctcttactgtgcggcttctttcacttcagtcaaagacatcagggcatattgaaaagatctacatatt

SEQ ID NO: 45826 - DNA, 148 bp, Triticum aestivum
  Clone ID: PAT_TA_45826
tcccagttccaaccaagacgtacgggcttaatctctctttgacccgccgccactttttcctaccccggaggaggaaaaaaccccccggggtaaaaagcctaagcctcccttgaccccaaaagatggcggcaaagggcaacggcccggc

SEQ ID NO: 45827 - DNA, 324 bp, Triticum aestivum
  Clone ID: PAT_TA_45827
cacgcctgcctccactcgtccgctgacgcgtggttccgtgtgcttctggtacgacccaataccttacggggcggtggagctggggcacacgaactattctcctcctgcaacgtaatgtgacggaccaccggaccgacgacgactatgtcgtttgtcccagttacgaggcgccttgccgtgccagccggctccaacgtggtgcttgtcaatatcctatacttctcctgacactcttacatgattacacgtatgtgatggctcaaatagtgaaattcttaccaaaactaggaacattgccaggagggaactactacttgtctaaca

SEQ ID NO: 45828 - DNA, 175 bp, Triticum aestivum
  Clone ID: PAT_TA_45828
cgtccgtgcatttccgtgtattatctaaagcattgcgtatgtctggggggagatcatatgcacgggggtacagtgatcaggaatttaaaaagccaacaccaaatgactttagggtttgttgatttattcgacaatgattttattgaaaaaaaagcgcgcttggggtgtctttttc

SEQ ID NO: 45829 - DNA, 415 bp, Triticum aestivum
  Clone ID: PAT_TA_45829
cgtccggaaaaccagtgagaatcaatggttcactcgactatgccccagcattgtttgcacaaaagagcagagggagctcgcagcagaagctgtaaggcatggaaccgtcttgttgaagaacgataacagttttttgcctctaaagagaagtgaagttagtcatattgctataattggagcggcagcaaacgatgcatacataatgggtggagattacacaggtgttccctgtgatcctatcaccttccttaaaggcatgcaagcctttgttccgcaaacaaccgttgctggcgggtgcaaaaatgtatcatgtgactcaacggatggatttggtgaagccattgaagttgctaaaagagctgatattgttgttgtgaatgctgggttgaacctgactcaagagaccgaagatctt

SEQ ID NO: 45830 - DNA, 437 bp, Triticum aestivum
  Clone ID: PAT_TA_45830
cgtccgcccacgcgtccgcccacgcgtacgctctgcccaatccaccgggtgtcccttaacgcgcggtctcggggctcctaccgcgtctttgaccccgacgacccgccgtagccggcgctctttcgtttcccttttgccttacctctctgtccagtccgctggcgacttccttgttgacctacgtggtggttcacgaggtcaatgaggagcgcacgccgacgtatccattcatttggcaggcttgtcctgtggcgtgccctgctggtggaggctgtctccgacaaggagaggtcgatgtgccatgagcatggcgatctccgggtccatatccgtttccaccagatccggcgatagatacgggcatggcgagctccaggatggaccgctgattacagggcagagaacgacgcccgaaggtacttaagggcctgtagagg

SEQ ID NO: 45831 - DNA, 368 bp, Triticum aestivum
  Clone ID: PAT_TA_45831
cgtccgcgaacacaacagctactagtagcgatcaagccaagctaagcttagccaggacaaggacatggctgcgcttggcgtcctcctcgtgatggtagcagccatggtagcagcggcagcggcagcagcaacgccgagcgctcctcgccccttctttgtgttcggcgactccctggtggacagcggcaacaacaactacctggccaccacggcgcgcgccgactcgccgccctacggcctcgactacccgacccaccgcgccaccggccggttcttcaacggcctcaacgtccccgacatcatcagcgagcacctcggggccgagcccgtgctgccctacctcagcccccacctcgacgggcacaagc

SEQ ID NO: 45832 - DNA, 433 bp, Triticum aestivum
  Clone ID: PAT_TA_45832
cgtccggttttattaaattgaaaagtgacctgttggttacagggtgatttgttgaatacgaaagctgaaccattttgtgtttgatcactggttcacgaagttacttctgccataacacttgatacaattaatggatgcacccatcttccatttcttttgggttaagatctcagactgtgcctatgcccgaaatgctgttttttaggctattgtctccagtatgagaatctctaattgatacaaaagctttcagtatcagttctattttaattactatatgttgcaatgcattgcagagtgggatccctggggtgttcctgatgactacgaatgcgaggtgattgaagatgacacacctattcccaagcatgttccgcagcaccggcccgttgcactacctgaggagttcttcaagacattagatgccatcaaa

SEQ ID NO: 45833 - DNA, 395 bp, Triticum aestivum
  Clone ID: PAT_TA_45833
cgtccgggtgcgctagggacaaaaatgccgcgagccccaaatccccgacgccgatgccatatcccgtgatctatgtcgccgccgccgctccggcgaccgccccgccgcgtcacccgtgtcgtccgccgcccgtctccccttgcccccgaccggagatgggctacccgaggcgccgcgcccacccgcgccgcggcgccctgctgccggcgatggcggcgctcctcctgctcttcctcgccgtctcgctcctctccatcgccatctccgcgccgccgctcgcggaccgccaccccggcatctccccgccgatcccctccgacaaccctccgacaaaggtcgatgggactatacgagagaatcttgtgggggtttcgggaagctcggcttagcaaact

SEQ ID NO: 45834 - DNA, 422 bp, Triticum aestivum
  Clone ID: PAT_TA_45834
cgtccgcccacgcgtccgcccacgcgtccgcccacgcgtccgcgcgttggctcgcgccgctatatgtagcgggtcccactcgcaacggccgagccgttccatccccgcctcctcccccttccacaagtttgggaaatccccccaaaacccaacccaattccaccaatcggccgctgcttcggccgccccacctcggcgtggagatggctaaccgacgcggcggtggcggcggtggaggccgcgacggagggagagattccggagataagaggggcggcggaggcggcaggaaccggggccgcggcggcggccgagcggctccccccgccggcgggagaggcccccgcgatgaggttgacgagacccgcggaggcggctcgactcccgtcggagaccagaaccgggggggaggcgcctctcgc

SEQ ID NO: 45835 - DNA, 436 bp, Triticum aestivum
  Clone ID: PAT_TA_45835
cgtccgcgctcgagccctccgccgccgccgcgccttcagctcttttcttccttcaccgattcaagtaacgtgtcgttcattcccttgcgcttctgtacttccgtccgtcgatatgatcttcttactgcatagtgttgttcgtatgctgcactccattagatgttgaagaaatgggattttagttgggccatgtgctaggaagtcacattttttgcttgcgtgtccggggttgttcttgttgctgacagctttgtaggtgcaccttgtcacgatgctctggtttcagtaaaacatctcggtatagttgcaagttagctagtcggtttcgtagatccaaaaatgaatgaatgcgatgctaagatttcactgccatagaaatatgtatgtcctacgtggttcttactggaatgtagataactttctttgtcctcgtaaa

SEQ ID NO: 45836 - DNA, 437 bp, Triticum aestivum
  Clone ID: PAT_TA_45836
cgtccgcccacgcgtccgcccacgcgtccggtttcttctcaacatatgactattatgaatcctgcgtatgagaacctcattaagaatggtgtcaatgtttgtcatataaatacatgtttgtaaagtacagctgatacatcagattgtcttttgatcttccattaataatcatgttgatatatcatcttctcttttttctcgcttgatagttaccatgtaactcttgaattggttacagctaatttcttgagaaataaaaataaattttcatcacatgtttctatattttttatttatttctaataaggagaatgtgcacgtgacgctatctgtcttttgttttctcattggagctaccatgtctttagggtgtattataaatgtgtcacagtaatatcttatgattataatacatgactattatgagtccacataaa

SEQ ID NO: 45837 - DNA, 359 bp, Triticum aestivum
  unsure (1)..(359): unsure at all n locations
  Clone ID: PAT_TA_45837
acattaattcttttttttatccaacanggtatttagcaggtttttaaataggaatttttcccccccaacaaaaaaaattattattggacggaaggggttaatgggaaacaaggggtgctcaaggggaaaaataaccctatggggggcaacttgggcttggttattaaaaaaaaaaaagggttggtggtggaaaaccatattaaaaaaaaaatgggacaaagtttccactatggttggaaaaaaaaggtatgtgattttttttaagggttattcaacccgggaaacaggtatttacaaaggggggggggactttaattttttcaatttttaggggacactcaaggagggatttcccccag

SEQ ID NO: 45838 - DNA, 427 bp, Triticum aestivum
  Clone ID: PAT_TA_45838
cgtccgaaaattggttaaattttatgaggcttgacttcagtcaaatcttatatgcgaactaaaaaggaacggagggagtactttgtattattgccagttctattgattaaacatagatctccgagtttattcatgaaccctttggattctttaaatggccaactatgcagcgtaaaaaaaaaggccaactatggaaaccacaaaccaaaattttggtcctttttcttgtaatacaataatatgatgttgtaaggataaaccatctaccgagatttaaaaaataataatccagaacaactgtttttgcaatttgcaagaatggcatagagtagtcactacaaagtataaatatgtttaggatagtcacctccaaacaaaaaatcccagtcactcatttgtgattcaaacgatgaagctgaattatatc

SEQ ID NO: 45839 - DNA, 311 bp, Triticum aestivum
  Clone ID: PAT_TA_45839
gccccggtccgcggatcccgcgtcgacccacgcttccggagaattattggtgtcccataaggaggaccggcggtggttgcggtggcactgctcctgcgtcatcgcatggcagccgtcggggaggacggcggccgcgatggacgatcatgacgactatccacctgcccgcagcctgccagcggcggacgacgatccgtccacacgaagcatgccggcgccgtcagacgagcaggacgacaatccgcctctgcgaagcatgccgcctgcgccgccgtctgacgagcaggaggataatccatcctgggctgggc

SEQ ID NO: 45840 - DNA, 365 bp, Triticum aestivum
  Clone ID: PAT_TA_45840
ggtcgacccacgcgtccggagaattattggtgtttgggaggaaggccgagtcacagaacacgcttttcatggaggaggcgtcctcggacgagagaatcctgcaagcgaacatccaactaaaactgctccagcctgatcaggtacagattggagcccaacacgctgctctactaggactgcaaagtgttgtttcacaccggccacctcatgaacctctacttcgccgccaacggccgggactcctggaactgctactttggcgactcgtgcatcatcgtcaagtccgaccccagggaggtggccagccactagcctggctaccttgagagatcgacgccattattttttgcagctctgacagacag

SEQ ID NO: 45841 - DNA, 435 bp, Triticum aestivum
  Clone ID: PAT_TA_45841
cgtccgcggacgcgtgggcaggaagcaccgtcaggctggccgaggcacagaagacgtggtgcatggcgaagccgtcgtcggacgagaaggtcctgcaggcgaacatcaactacgcgtgctccaacgtgagctgcgccgtgatccagccgggcgggccctgctacaaccccaacaacctgctgtcgcacacctccgtcgccatgaacctctacttcgccgccaacggccggcactcctggaactgctacttcgccgactcgggcatcatcgtcaagtccgaccccagtgagtggccagccactagcctgcctacctgcagagatcgacgccattattctttgcagctctgacagacagcggtcgttttgcaggttacggttcgtgcacctactactgatcttgctcgccgaggtcgggcgatgcaaatgggtcgca

SEQ ID NO: 45842 - DNA, 385 bp, Triticum aestivum
  Clone ID: PAT_TA_45842
cgtccgcggacgcgtgggccctcctcttctccccatggccggagcaccaagaaaccaagaacccaccgtgggcacctctccttccccaccgcgtgcctctgctctcctgcgtcaccggctaccgacggagcagttccaggacggccaccacgtgcggctgcggagccgcgagcgcggcacgtacctgcacgccgacgacgacgggcttggcgtctccctccgccggcgccgcgcatcgatgaacgcggcttgggcggtgcacatctacgagggagatggcgatgccctgtacgtgctccttcacagcgccgcctacggccgctacctggcgccacggacgcgccggcgccgtgaggccacagcgggcgccgcgtcgagcagtgcg

SEQ ID NO: 45843 - DNA, 404 bp, Triticum aestivum
  Clone ID: PAT_TA_45843
cgtccggcaaattacccgcatcaacctcttgtcgatccatggatatctccacagtttgcatccgtccctccaccataatcggcccacgcgccgccgactccacctccctgcgccccggctatcccgattgggtcttactcaacaagacggcgcgcatctccgaccaacggaacgcgaccactgccttgtgccgcacgagggagggccaagccgtcgcggtgtccttctggctcgtcgacccgcccgccgtctcctacttctccgtccactgccctggtctggaagacgacgatttctccgacaccccgcccttccttctttgcgccgagggagccttcgtcgtcttctgcgtcacccttgatgactccgttcaccacttcgtctactccggtcgaggaatcccc

SEQ ID NO: 45844 - DNA, 436 bp, Triticum aestivum
  Clone ID: PAT_TA_45844
cgtccgcccgcggtcgctgcccctgctccatccgacctccatcctctccctccatcctgtcccgggtcgccgcccctcttctcccgctcaccttggccacctcctctcctccgccgtgtcatcggccccctccctcctctcagttccgtgccagccgtcgcccaaaccctagccccattccccttgatccccacagttactgcatccacaaccacccgctcagcgaggccgaagaccgggcaacggacgcctgacggggtggaggagaggccagcgatagggaaaagcagcatcttcatggatgagatcctgacggctgaagatggtgcgcatgggaagagcttggaagatgtcaagtggtggcgccgctggggatgaggggagcagcactcgcagcaggcggtgatgctagggaagcgggggccatggggccttc

SEQ ID NO: 45845 - DNA, 299 bp, Triticum aestivum
  Clone ID: PAT_TA_45845
cgtccgagctcccacaccttccgtcaagcgatcgatcgtccgctccgcctcctgtggagacgaggtcctcctagctcgatcgaggcccgccattgccatggacgccgcacggatcgcgtcccttctgctcctcctcggggtcgtttggtcacgcgcacagcccggcgccgaggcggccggcacgacgggctttacgctgcgcaacaactgcacctttacgatctggccgggcacattgtccggcaacagcgccgccgtcgtctgtggcggaggttttaagctcgcgccgggcgccaacg

SEQ ID NO: 45846 - DNA, 436 bp, Triticum aestivum
  Clone ID: PAT_TA_45846
cgtccgcggactcgtgggcggacgcgtgggctacttgtctagcagtgaagcgatcccagcctgcccgaccgcgactcctctccggctctcccccatgtcgtcgccgccgccgccgccgcctcccgccgttcctcccaccagcgccgccgcggcctatgcgtctctcgcggacattgcgagcaccgtcgagggcctcgcctgcttcaacgacgtgctcgtcgagttcctcgacgagtggcgcgagttccacctcgacgccaactccatcggcggcgccctgcccccgctcgccgacgacgatgccgaccccgaccccaagcccagccccgtgggacagctcgggcccctccttgggcagtggaaccccgtgcttcccgccggcggcgtattcccccttcgccgaccgcggtagcgggcgaaatccaaccctagatta

SEQ ID NO: 45847 - DNA, 442 bp, Triticum aestivum
  Clone ID: PAT_TA_45847
gcgtccggcgtcttcttactcgcctctctccgcgcaccgagccttccgcccacctcctccccatggcgccagcggcgcacggacgaaccacccccacccggcgcatgagggagtgcatctcgatcaatcggcaggccggcatcaagtcgggaacgcgtgctgggagctgtactgcctcgagcatggcattcagcctgatggccagatgcccggtgacaagaccggtgggggaggtgatgatgctttcaacaccttcttcaacgagactggggctgggaagcacgtcccccgtgctggctttgtagatctcgagcccactgggattgatgaggtgaggactgggcgcttacacggcaggttctttccacacctgaggcagggttatcaatgggcaagggaggatgcttggcaacaaacttctggccggggtcattacaccatt

SEQ ID NO: 45848 - DNA, 198 bp, Triticum aestivum
  Clone ID: PAT_TA_45848
cgttcgctttctcctgtgctgactcttggtctgtcataggtatcggcgaacagggtcttatgtcggtggcggtaagctgggacgaggtcctctccgctggcaaccgcaccggcccggcggtggtgtccggtggaaccggggcagcattcctacctgtgcgcgctggcttactcggtctgtacaaccggggggtctaaa

SEQ ID NO: 45849 - DNA, 202 bp, Triticum aestivum
  unsure (1)..(202): unsure at all n locations
  Clone ID: PAT_TA_45849
nctttggacccactcgtccttaatcacccaatccccattcatgtcttatcccttttgcttctccacatatatatactaggggaaggcacttattgcaagggatcccctacactttaacttgaaatatcttttgcttgctttggtttactaatggtttcattgatctaacatgtaatagtctctacttcaaatgtatattgcc

SEQ ID NO: 45850 - DNA, 466 bp, Triticum aestivum
  Clone ID: PAT_TA_45850
ttacgcctgccgtaccggtccgcattccgggtggcggacgcgtccgcccacgcgtccgcaaccccgtattggcccatcaagggataagccttcgcctgacgagggtgataaaaatcatcgagagtcagaaaaatattctggcaatgtccagagaacctcacaggctccacaaagagtgccaacagcaagaccaggaagggttgttggtccagttctgccttacgaaaatggtggcatgaaggatacatatgacccacgaagagtggcagcaatgaactccggttatcctccccaacaacaaatcccgcaaatatacggttattatcagacaccggcaaagtcagcttgctccgagccatcgcaggccgaagtgtatacgctgcaccagcaggcctatgcttgcgcaaacagttcaactgtgcctgatgttgctctggacatgagagcacctcccttccatcagtca

SEQ ID NO: 45851 - DNA, 393 bp, Triticum aestivum
  Clone ID: PAT_TA_45851
cgtccgcctgccgttgcctcgccaaggcccgccgccgccgttgcctcgcccaggccagccgccggggtgtctacatcccactaggctggagcgccgccgtggtctgcatccccctcggcaccggtgcgcagcaaggtctgcatccccttgggcaccggcgtgctcgagctcagcgacggaaacagtgctcccccccctcccgcgaccatccactgacactggagcttgccgaccgcgggccggcgcaccttctcaacgtcgggagcaccgtccgcatccccatctccgagacaggatctggctgccgagctcattcccgcggatggcctcctctttccccggtcggatatgtcgccggtgagcccgtttgcgacgggatgcacccggggggag

SEQ ID NO: 45852 - DNA, 435 bp, Triticum aestivum
  Clone ID: PAT_TA_45852
ggtaccggtccgaattgcgggggggggcacgcgtccgctcacattcctcctacctgcttcattcttggatccactccatcgcccctcctggggcgggggctttcgtgggggggtgggcgggatcacccatctcacagcagtcatattcattcagctccggccgccgccctgccttcaaccaccatgggtgcaaccactcattcacgcaagcaggagcccccctggttcacctgggctcctccactctctaaatcaagggcgaccccgaggaccccatggtcctgggcggctgcatgccttctcaatctaccaccaaatgggcttccatgttgggcctgcaaatagccatggatactttctttctccatagtctgcgatctcggcttctgcgagggaaaaagttcaccatgggggaacgaggcagggcaacatact

SEQ ID NO: 45853 - DNA, 157 bp, Triticum aestivum
  Clone ID: PAT_TA_45853
cgtgcaaaatcaatcgcataaccatgaagcttacttgttcttcccattcacttatatggacctttcagatgggctaaatccatccaacaaaacaaagactacctttcaaccctaaccatgcttcatttctatcatcgggttctacggaggatgtacc

SEQ ID NO: 45854 - DNA, 438 bp, Triticum aestivum
  unsure (1)..(438): unsure at all n locations
  Clone ID: PAT_TA_45854
gtttccgcctgcagtacccctccttaattcccntgggcgggggcgggcgcctagaccaaccacctccaccaccactcaagaaccgaataactcgggagcgcctacagggggcagggtcatctccctagggggcttggctccaccggggcatcctacaactcccacgggcggcaccttaagcggcgggctcacgttcatggattcgccacagaatcctacggcgggccccactgccaacggtggattcatgttctcggcttctccggagcagcctctcacgccagcgagctcttctgccggcggcggcctctggtccttggctaccgagccgtccctgtcacccagggaataccacggcgggcgcgccgtggcgtccttcccttcccctaatcacgcgctcacgggctacaccgatagcgggggcttggctttcttccc

SEQ ID NO: 45855 - DNA, 279 bp, Triticum aestivum
  unsure (1)..(279): unsure at all n locations
  Clone ID: PAT_TA_45855
acccttccttaattcccntttctacccactcgtcctctaccccttttccttctctttctcttacccacccccacactctttttcacacttctaaccaaggagctattttttcaacagcgaagtttttacaccccatcctctccattcatctctacttcttctctcaaaacacttttattcctcttctgtctaacctcctcttcctcatctactctaacaaaaactttttccactcccttaccatcccattccccttaactttattaatccaattatacc

SEQ ID NO: 45856 - DNA, 406 bp, Triticum aestivum
  Clone ID: PAT_TA_45856
attcccggggggcgcacgcgtccgaatcctcctctgccccccgatccccaagagcatcacctgcaagcaatggacgtgtctggcggcggatctggcgccaagggcaataatggcgcggccgggctcaaggccggcggccccaggaagaagtcggtgacgcggtccgtcaagggcgggctccagttccccgtcggccggatcgggcgctacctcaagaagggccggtacgcccagggcgtgggcaccggcgcccccgtctacctcgccggcgtgctcgagtacctcgccgccgagctggtggagctcggcggaaacgccgccaaggacaacaagaagaggcggattatcccgcgccacctggtggtcggcgtcaggaacgacgaggagctcggaaaggtggtggcgg

SEQ ID NO: 45857 - DNA, 294 bp, Triticum aestivum
  Clone ID: PAT_TA_45857
cgtccggtcatagcaaaacagtgtcatcgtgaaccagcacttacagctagtctcgaaagcgcatgcacagctcgtatggatgcacctcatcaccatgataacactgacttatgggctgatgtacgccaccattgaattcaccactacacacgcactgatgttctaccgtaaggagatctaccaccaggtatctgcttcacgacaggaggagcctcgcatccacacataggtgatgcaggagtccgacgacgtaccacacgtgatggctctactcactagacagcactgtagatg

SEQ ID NO: 45858 - DNA, 399 bp, Triticum aestivum
  Clone ID: PAT_TA_45858
ttcgacgccagcgggcggcttactttttcacctgtagagataattcatcaactggctgcggtcatgggtatttcgggggaaggatatttaggccaagcgaaatactatcccttaaaggaatttcctgcaagtacgttcctacttaggctaaattcactgatatacttacaaggaaggggctacggtatacacatgcaattcacacacatgggcaggtccggcatagagacactacatacatggcttgtgcaaagatggttgaatgatcaaaatagtacactccataggctcagagatcatgccattcaaactacacatttgctgccactggaagtgggacacataattcttttccgtcttgcactaacttgagccttgcagatcgtgacaaccacaata

SEQ ID NO: 45859 - DNA, 255 bp, Triticum aestivum
  Clone ID: PAT_TA_45859
gccactcttccttgtactcttgtacgtgaggcaccaccgctctgtagcaatggagagggcaacgcgggtggggagcctgcacacctgggcgggcgacctgctcacgtggtctgtctactggtcgcctacacctcctccacctcgccttccatcccttcccgccccaacctaaagcctgctggggggatcaccccggccattttctgttctcctattgagcgagcactatgccgatgatctcagcaacattgaaag

SEQ ID NO: 45860 - DNA, 438 bp, Triticum aestivum
  Clone ID: PAT_TA_45860
gggacgcgtccgtccatctccaaaccgcatcaacccacctccctccccgtctaccccgcatcaactcccgtgggcgggaccaagcaggctgggggcatgtccaccggcggcaaggcgccgcggaagcagctcctcaccaaggcggggcgcaagtcgggcccggccaccggcggcgtcaagaatccccaccgtttccggcccggcaccgtcgcgctccgtgagatccgcaagtaccaaaagagcacggagctgctcatccggaagctccccttccagcgccttgtacgggagatcgcccaggacttcaagaccgacctccggttgcaggcctccgccgtatccgcgctccaggaggccggcgaggcgtacctcgtcgggctcttctaggacaccaacctgtgctgcatacacgccaagcgcgtgaccatcatgcccaag

SEQ ID NO: 45861 - DNA, 380 bp, Triticum aestivum
  Clone ID: PAT_TA_45861
cggccgacaaaatacacacaactgagagggcaacttggtatagtttttactatttaagtctacaggggtagggtatatatagggaggggggtccctcgtaaagggatatcatcggattttccgacatacgccaatcaggcagactggttttcctccaactgttgatctgtgctggatttcactcctcataatggaagctctacatatgcaagggacggctcgtaactgacaaggataccaataaacctaaaggatatgcattcataaaggcttttccttcctcggatattaaaaaatgctaacaaccatcctgttgggagaaaaggggacaataagagggtcctagttgttggggaacggggtaaaactggccctaattg

SEQ ID NO: 45862 - DNA, 336 bp, Triticum aestivum
  unsure (1)..(336): unsure at all n locations
  Clone ID: PAT_TA_45862
agtaccgatccttaattcgcggggggagccacnctttcnttattatttacaatttaacaatgagttcctccatttatgtagtgctccacacaggggagaggcctaagaggggagatatgtctattatctctaaaaaaaattaataaattataaaaaataaatttattattaaatatataaaataaaaataatatggcctttctatttatatgatctaaatttacttacccatacattcaactttatatactttttttatggttacctaaatctaatttaattttccttagttttacaacttcttcaatattaaaaccctttcgttaccaaacttaa

SEQ ID NO: 45863 - DNA, 439 bp, Triticum aestivum
  unsure (1)..(439): unsure at all n locations
  Clone ID: PAT_TA_45863
gggggcgcgcgtccgcggactcgtgggccaagaactggagttgagctgcatcgatcgatctccgtgccacttctgtcctctggcttgccaggcatggcatccggctcngcgtttcgcggggcggtgctcgcagccggcctggtggtccctttcctcggcccggcggccgtggaggcgcagctcgggcaggtgagggagtactgggggagccaggtcgccctcggcaggcaggcgtgcgccatcctcccggccaccagcccggagcaccggcaccaggacgacgagggtgatgacgacgactactaggactaggactaggacgaggatgaggactactattaagacgacaaggggggctgctgctgtggaagctacaaggggggtggcggccgtggaagcggatgaggaggggggggcccgggatgctatagtaggggtg

SEQ ID NO: 45864 - DNA, 405 bp, Triticum aestivum
  unsure (1)..(405): unsure at all n locations
  Clone ID: PAT_TA_45864
cggggagcggcacgcgttctatgactcattntattttaaaagaatttcgagttctctacatccagatncanatgcggggggctgtgcctgaggcgggcatcctctttaacatcgatagcgagactgccgctcacattatcctgagccaggccattacggacgaggcggttgggtccacccgcaccatggagcgcgtcatgggtacgaacaacatcatcgagaacaactaccgcctgcgcatgaagaatattccggagcgcatcaagagacacttgattttggaacaacaactagcttgtttttaagttcctatggaggaccatattaaattgattaaagatttccagaggaaggagactggatacattagacttaaaagggatagaatttggggggatgactttt

SEQ ID NO: 45865 - DNA, 363 bp, Triticum aestivum
  unsure (1)..(363): unsure at all n locations
  Clone ID: PAT_TA_45865
ggaggggcgcgtgcgccgtctcatagctctccctctctctgtcactcacatggcggtcgccaccgcntcccgcgggatcgccnccctggtgggtgggggcggagtctcagtcactgctcatccacatcctgcggcgggagggccacccgctacacctcctccggcggggggagccacccctcctccggcggtagggccggccaaggcgcctcctttgccggccgggccggccaagttccccgcgatcctcgcgttcggcgactcggtgggcgacacgggcaacaacaaccacctccggacgttcattcgctccaacttcccgccctacggcaaggactttcccgggcacaagcacaccggccg

SEQ ID NO: 45866 - DNA, 279 bp, Triticum aestivum
  unsure (1)..(279): unsure at all n locations
  Clone ID: PAT_TA_45866
tcntcctatagactattgctgtcatgtgcgagcgcctctttatcggcacccttctttccgggcggggtgcttctggaccggggggcgtcaccactcttacccttcacaacctgttcccgtaccccgtgtggcctgtggtgacccccaacaggggcttcccctccatctgcgacaacaacatccgcctttagggcaacggccacgggctcgtttcctttaccttccctccaatctttttgttccggaagctgttggcgcgcacccgcttcgcttcccctc

SEQ ID NO: 45867 - DNA, 419 bp, Triticum aestivum
  Clone ID: PAT_TA_45867
cgtcctcccactcgtccgcggactcgtgggtgcaagtgtatttcttgtgtactaatatggggggggcggaacagggggtgggatggaaaaggaatgccatatgttttggctaaatactatcctctggagctttgttatgcaaacaggtgttttcctcttggattatggagcaaacaacagtttggaatggttagttccactgaatggtcaaacaaacctattgtgccttacatggttaccagaaaatgcaaaggggatatctttgctcgtgtccgagatacattggccaaggcgagccaactgtgcggagaagatgatagaactaaagctctgtgcctaaaccatgagcaaaataacccaggcctccttcagcatagatcttaagcggcggattaggggttcacctgcgttcattctca

SEQ ID NO: 45868 - DNA, 249 bp, Triticum aestivum
  unsure (1)..(249): unsure at all n locations
  Clone ID: PAT_TA_45868
cgtccggccagtgcttctagccctccgctagtagcactcggcgtgctcctcctcctcctcttgtggggtaggtcngccattgcgcatggcggtggagcagatccggtacgccgccgccagcgctacatggtggtgcagaccagccacctgatggagccaaaatccatttgctccggcctcaagggtacgtacgtacataggtagacgagaggatgaaactgtgttgcgagaaccatacccgggatgcat

SEQ ID NO: 45869 - DNA, 265 bp, Triticum aestivum
  unsure (1)..(265): unsure at all n locations
  Clone ID: PAT_TA_45869
gccactcgtccgccccaatctagccgagctcctctcgattcccaatccccgcacggcttctcctcgggcccgtgctcctcctgggggcgggctttacatttattcaagatggaacacaatgaggcgggttgccaacancccgtaggcccaatcctatgggtgaataactggggcttcttttgcagcgccgctaccatgaacatttgctccaagtgccacaatgggatggtcatgaaggaggagcatgccaatctggctggctcct

SEQ ID NO: 45870 - DNA, 261 bp, Triticum aestivum
  unsure (1)..(261): unsure at all n locations
  Clone ID: PAT_TA_45870
tcgtcctcccactcgtcctttaacttccaagtgcattggatcttatgttaagagcaanaagggccggagaccatatatggtgggtatgggaaaatttcaatttcacacaatacaaatgctttcaaatattcctggtacaatgttcattacaaatccactgtaatccttccttattagcacttcttttgtgagagttatttcatcaccagttgattctttaccacaaaataattttttgacatacttcatcttaaatctttc

SEQ ID NO: 45871 - DNA, 405 bp, Triticum aestivum
  Clone ID: PAT_TA_45871
cgtccgccttcctccaccctactcctacccctcccccacccgccatggcccatcaccacctcctcgggtggggctcatgctgggggggcccctcttctcctccacctcggccaccggcgaccaggctcacctttccgcggtgatcggcgacacgggccttgccttctgcaaggacgtgcttatctgcgaggcggtgcggtcgctcaccccactccgcctccccggggcgggaaaagcctttcgcgtgcccttcctcggcggcatccgcaccggcgtctccaacatcacgctcttccacctcgacgtgggggatgactctgttgttcgcctctgcgactcggccctcttcgtcgtcacctccggcattaccgccaacattagcattgcctggagctacttctacta

SEQ ID NO: 45872 - DNA, 341 bp, Triticum aestivum
  unsure (1)..(341): unsure at all n locations
  Clone ID: PAT_TA_45872
cgtccgcgtactcntggtctgactctttggtcccatccaagtacatctcgcacccacgaccagggcggggcgcgcacggcagaggcgatgggcgtcgtctcggcggtggcggacgcggtggtcgtcctcttctccctcaccatcacggtggcggtcccgctcatttacgcgcagaccgtcctcccgcccgacctctacccggcgccgctgcgggacctcaagcggtggtacgccgccgagttcgacgactacctcatgggccacccggcggccttccttcacgggcttttctgcctcgagctcgcctttctctggccggtcttcggtggcaccattttacg

SEQ ID NO: 45873 - DNA, 352 bp, Triticum aestivum
  Clone ID: PAT_TA_45873
cgtccgctctcccgtcccccactccttacgcctctgcgccctccctcgcttgctccgccatcctggggggggggtgtcgggagggcgggcttctcccactccatgatgaatcccgggggcgcgggcgccggtccgggcactggcaccgtctaggtccgcgtctagcgcccgcatcgcccgcccgtgcaccccaactcggcacgcctcaaggcgcgcccctactaccgccgatggacgccctggctcgtaccggccgactccatagcctggggcgccggctttctcgtcaccatgggcgttaacgactggcccaaccgcaacgccggcaactgcaccgggggcttttttcggg

SEQ ID NO: 45874 - DNA, 122 bp, Triticum aestivum
  Clone ID: PAT_TA_45874
atacaacatctacttcttcatagtactaaaacatctacaccctgacatctgcatcttctacaaggccatgtacttcatgaacttcttcatcaacgacatctttgattaactcaatacattat

SEQ ID NO: 45875 - DNA, 171 bp, Triticum aestivum
  Clone ID: PAT_TA_45875
cgtccgaatttcccgtctatctaagtgttgttcatactacatctccaatcccctcatttactcctgggcgaggggcacccttggggggtgggagcccgtcctctattacattatcaatgcctgtatgggaaagaacctctttttcatcacttatgttgagaagcatttctc

SEQ ID NO: 45876 - DNA, 238 bp, Triticum aestivum
  Clone ID: PAT_TA_45876
cgttcgcgtacgcgtgggaaaaaaaaaaaaaatttttaataaaaaaaaaaaaaaaaaaaaggggaaggggcctaccgttttaagaggctcctagctcaccctttcatattatccaaattatcctactctttcatgctcaactatattctttttattgtgccacctattttcatttcactgactttcaatatccacccttttaccttctaaaacctcttcagtaaccaaacttatttcc

SEQ ID NO: 45877 - DNA, 455 bp, Triticum aestivum
  Clone ID: PAT_TA_45877
gccgtaccgaatctcccgtttcgacccacgcgtccgcccatgcgtccgcgtcacgtctcttctcccgaaacgcaccgcctccgtcttccccctctgatcgtcttccccccgtgcgtccgattccccttcccaaccagacgagccgcagtccaccgcaagtcacctcctcctcccgcgaaaccctcgcccccccgccgccgccgcctcctcacgcaacccgcccttcgtcgcgccggcgcgccggcgcccgccggtgcccatcaggtcatttcctgtggcatggcaaggattccaattggcattggctttccttttcatgaatgatgtccttcccttcgaaggacacaaattcacaaacgttatttaagtggccttggagaagagaatcaccattatcagcacaactgctcattgacattccacctgaaattgagttgtcggactaccgaagattg

SEQ ID NO: 45878 - DNA, 366 bp, Triticum aestivum
  Clone ID: PAT_TA_45878
cgtccgcgccgcgcgtggccgcgcctcgccgccacctacggcctctcgtgcgccgccgggggcgggtgcctcgccaccttggtggccctcctcggcaccgtctgctccacactgatgtccatgctctacccgccggacattgtcgttctgcgccggcctcctcacgggccttgcgttctccatcgtgtacgcgcacaccatcatagtgtgcagcctcggcggagtcattgccgttcttgaggacgcggccggggtcaatgcgctgcttcggttggtgcatctgatgcgcgggcatacccaggggtgggcgggtggactttctttgtgatcccaccattggtctggccttccactgtggggctgttt

SEQ ID NO: 45879 - DNA, 416 bp, Triticum aestivum
  Clone ID: PAT_TA_45879
ggggggcacgcgtccgccaccgcacacctctccctctcgctcgtctctccctctccccccaccactaaacgtgggggggcgccacctacggcggtcgattcctgcttggaccggcggccctcgccggcgcgcagcacagatccgagctcccttggcggcggtcttcccttccctccggccagatccgcctctcgcgtccccgagagctcacccacgacccctccccattggtagggtttcgagggtggcatcccctccaactctggcatgtcgctggcgactctgctccggcctctccgacgggcaccggaagggccacgggcaggtccccctcgtggtcggctctcctgcacccggtggctgcggggcggacgcacgcggcgggtaaactccggggagacgacaggtccattcac

SEQ ID NO: 45880 - DNA, 226 bp, Triticum aestivum
  Clone ID: PAT_TA_45880
cgtccgcaaacacatagccttccacgtcagaattattacccacctagcaatctcagaaatagctcgggtgcctcatacgcggggcgcccgctcgacgtgctcgctaatttccgtcctaacttgcgtacgcgctgaaccaaagaaaaatcatcctatctgtcatggcggtaactggacttctggcgtcctggagacaaagcagttataacttattaccacacgacct

SEQ ID NO: 45881 - DNA, 269 bp, Triticum aestivum
  Clone ID: PAT_TA_45881
tttttattttttctttcttttcttttttttttttacatagaaaaaatgggggcggtttctatattggggcgggacaacctcacgccgggaccattctaatcctccattgataccctctatgacacctctgccctacatattccaactacccttaaagagctataggcccccttacaaacttataaaacacttgcaccgtacttctgaacctacatttgtgtacagccattttcaaggtttactttggtaaccattcattacatagttac

SEQ ID NO: 45882 - DNA, 168 bp, Triticum aestivum
  Clone ID: PAT_TA_45882
tcttccgcccatatctgtctctttaccctttcctccttcgcccacccacgccatcatctggggtggtgtccatatccgggggtgggggtctgcttcatcatcctctactcggctatcgattctctccttaacactgataatcagtgccgcctctcctttgatgtggcc

SEQ ID NO: 45883 - DNA, 133 bp, Triticum aestivum
  Clone ID: PAT_TA_45883
gcgcacgcgtccgggcaggccaagccgaacactggatccgccagcatacccccggagcagacctacgtccagggcggcgtgattgccaagacgatcctggtgctgctcccaaggaagacgccaaacctggcct

SEQ ID NO: 45884 - DNA, 423 bp, Triticum aestivum
  Clone ID: PAT_TA_45884
gcacgcgtccgcaattccgttgctgcccgtcctgtttcccctgccccctcctcccgcaccaaatctgtcgggcgaagacgacgtctggcgcacattggtgcagacccagaattgaactttagcttggaagagttcaccgctccctggccctgctcaatgacggcagcggcgccgtctctgctaggatccggccatggaagtcagtgcgcttaacagagttcttacatacagcggccatctctgaagatgttcctctcctctacttgttcagttacccaagggctgacagtgactactctcaacggctgagatctcaccaaccgctttgattaagtcgctctagttaaactagtcattacctttactgctattatggttattggttgctaaaatcaaaccctggccattatactctacagcgta

SEQ ID NO: 45885 - DNA, 392 bp, Triticum aestivum
  unsure (1)..(392): unsure at all n locations
  Clone ID: PAT_TA_45885
cgtcctcggacccttctgcccactctttaggcccgacatattttaccggcctcctcgtcttcgggggcaattattccgggggggccgccgccccctcggatcctcgcctactacgagagcagcaccacacccgccccccctcgcgcgcctccccccgaaaccctagaccccggaggaacccgcaggcccgcagccgccgccccgatgcggcgggacttcgaggagatctccgacgacgagtggtcgaaccacaccttcaagcccttccgggccctcaagcgcccccaccggagcccccagccgcccgcgcgggctncccctnccatcgattcgtttcgctacgaccccaaggcgtcctccgccgtcggcaccagcaacggccgccgccgtcg

SEQ ID NO: 45886 - DNA, 331 bp, Triticum aestivum
  Clone ID: PAT_TA_45886
gcgccacgcgtccgctcaaatcccccaccggcgaagcatacaaaccctagactcctacccccaccaggtgggagggcccgcacgaagcggacggcgcgcatgtccaccggcggcaaggctcctcggaagcagctggccaccaaggcggcgcgcaagtcggccccggccaccggcggcgtgaagaatccccaccgtttccgcccggggaccgtcgcgctccgggagatccgcaagtaccataagagcacggagctggtcatccgcaagctccccttccagcgcctcgtccgcgagatcgcgcatgacttcaagaccgacctgagggttcaga

SEQ ID NO: 45887 - DNA, 408 bp, Triticum aestivum
  Clone ID: PAT_TA_45887
cgtccgcctattgcctgtcaggctcaggcttcccgattaagagatacctttctcctgccggggcggaacttgcttcattccgttcctgttgcccgtcgccgtctgcaaaatgccatccgcgcgctagccaccaaagtggttagtcgccaaaccccaaagcgattcctccgagtgctcctaccgtgccgtgcctgcacgtacgtaaccacgcctgactgggcatgaaggacctggtgtcgtgcttcagcgagcacgccgtcaggatctccgacgtcgcctgctccggctccgccggcgtcaatgcggctgcggcgggggcagggtgaccggccgacggctggggcagggcggcggggatcagcgcggacaccaccgtgtaccgctcgcgcctttcggcgttcgggaagg

SEQ ID NO: 45888 - DNA, 220 bp, Triticum aestivum
  Clone ID: PAT_TA_45888
ggggcgcacgcgtccgcgccctccttccacagacccatgactaagcctacctagctaggttgcaccacgtgggagtgggcattatatgtgcgcggggcggccctccgtgccatcccggtctccatcgccatggcgacgacggggagggggaggccttctcctctccttgcggcgtggctggctctcggctttgcgtggcattgggcgcttcaccatgctt

SEQ ID NO: 45889 - DNA, 127 bp, Triticum aestivum
  Clone ID: PAT_TA_45889
cgtcctcccaatcttacgtctcacttctctattcactggtctatcaactaccattttgggggcaaggtcatctgtactggcgactctaataatcatacttctattcatgtctatgtacaacccctat

SEQ ID NO: 45890 - DNA, 303 bp, Triticum aestivum
  Clone ID: PAT_TA_45890
cgtccgctccagcaagttttcagatgccctgaagaagaaacttggatttttgggcaaggggggagggagtggtcggcaaaggtttcaggataaaattgctagtgaagtcattaagtttttgactgggcaccattggacaaggctgtgcatcatccgacccagactctcttctctgaactttttggtgccttctacctctactgcaatgattttcctttatgacaggctaatgatgaattctggacagcaactggaactgaaattctgggtgggttaattttctactcttctataggccgtttc

SEQ ID NO: 45891 - DNA, 411 bp, Triticum aestivum
  Clone ID: PAT_TA_45891
cgtccgcccacgcgtccgcccacgcgtccgcggacgcgtgggtgctgctgcattgcttcctgtggccaaggcaaggattgctctcgagaggagaaaatttctagaaaatgcaaatattgctgttcaaaggcaagcaacctggtccaatttagcacatgaaatgactgctgaattccgaagtctatgtgctgaagaggcatgtctgcagcaggagttagagaagctacaagttatgagaaacaaagccaagctagagggggagccgtgggacgaacgcatctcaagctcgtctggacagaattcacatttggtatctaaggcaacacgtttgtgggaatcgatattggctcgcatgaccagcatgaggttttagcttccggtccaattgaagatcttatagctcatcgtgag

SEQ ID NO: 45892 - DNA, 410 bp, Triticum aestivum
  Clone ID: PAT_TA_45892
gggacgccacgcgtccggcaagcccttgcagagaagccatagagctgcccgagatcggctacagcaccagggggcggaagccacacaacagggtggagagctataaacggcgccccactccgtcgctcccgatcatcgacctcgcgcttctggccggagaggagcgacccgtggacatggacctactgaatgacacatgcaagaactggacatacttccaggtcctgtaccaccacatctcgaccgacctattagacgaggtgctaaaaattaccaaggagcactacaacatgacgctcgagcaactgttcctttagtgcgagagcaccacgctgaaagactgccgcaggccggacgacatcctggaccgggagagcacactattcgggcgccaccttatggagcccaac

SEQ ID NO: 45893 - DNA, 420 bp, Triticum aestivum
  Clone ID: PAT_TA_45893
tgcgtccgcccacgcgtccgcggacgcgtgggttttttgcgaacaaattttttttttatatactactgtacggcacttgcttattgctgctacaatatctctggtaaaattattttctcagttttttataaactggagaaggggttgccgtgtctatcctgagtcctgacaaatggcaaacctctcacatactattgatattgcatactgacggtggttcaggtcttcaggatgtcgtaaaatgtggatggccgatttcttctcttcaggcagagctcctctactgccgaagccaccctcaataagctagcctcgccccacggacggcctatcagttgcaggccgataggaaggccttgcttgtcatgaccaacaggaacagaaatggcaggcaagccaagaaggttcccggcaaaaatg

SEQ ID NO: 45894 - DNA, 419 bp, Triticum aestivum
  Clone ID: PAT_TA_45894
cgtccgcggacgcgtgggcgaaaccctcgttcgttgccaacgccgtcagagggagacgcctccggcggggccgcgtctccgggggagggcggtttgaatcccctccgccgacgtacgggatcgccgccgctgagatccgggagatgccgacgccgccgttctaggagagacgtcgccgccgtccgaggggagacgtcgctgccacacctccttttctcacgccccatctcctcagccgggaggcccctgcctccatctcctcctgcgaggcaacagctggccgcgagtggatggtgctctcgggagcgggggacacgagtgcggtgcagtcaacggccaggtgcgatgcgagcagcagtcggcggcggacggggccaacgctcaacgacggttttgtgcaaaaggctgagaaagttggg

SEQ ID NO: 45895 - DNA, 420 bp, Triticum aestivum
  Clone ID: PAT_TA_45895
cgtccgatatggccgaaaaatctgctgcgacagatcgaagcgaaggacatttcatcctcctactgaagatgcagacttttgtgaagaccatgcctgcgcaagaccatgatactggcagcggtgcccttagacactagctacaacgtcagggttcagaaccatggacagggaaggcatccactccagaccagcaaggtgtgatgttcgatgccaagcaaggttagggatggccgcaccctggctgactacaacattcagaaggagtccaccctccaccttgtgctaaggcttcggggtggcatgcaaatcttcgtgaagaccctcaccggcaagaccatcacccttgaggtcgagtcatctgacaccattgacaacgtcaaggcgaagattcaggacaaggagggcatccccccggaccag

SEQ ID NO: 45896 - DNA, 414 bp, Triticum aestivum
  Clone ID: PAT_TA_45896
cgttcaccgactcgtgacgcgccgacgcagtgcgcggaggcgacctcccaccgccgccaagagggagatcttcgtgaggagcggtgacgggcaagaccatcacgctggaggtggagtcctctgacaccatcgacaacgtcaaggccaagatccaggacatggagggcatcccggcggaccagcagcgcctcatcttcgccggtaagcagctcgaggacggccgcacccttgccgactacaacatccagaaggagtccaccctccacctggtgctccgtctccggggcggcgccaagaagcgcaagaagaagacctacaccaagcccaagaagcaaaagcacaagcacaagaaggtgaagctcgccgtccttcaattctacaagggcgacgacgccaccgggaaggtcaccaggc

SEQ ID NO: 45897 - DNA, 286 bp, Triticum aestivum
  unsure (1)..(286): unsure at all n locations
  Clone ID: PAT_TA_45897
tcgtccgttgcttctcattcctaatacagtgacattacagtcaattccatttcttnacgagatggggaccatcgagagaggtgggcgatttttcacaccttcgtgctaataaccttattatttcacacgcccttgatagcaatgggcactattcttctaattgctctaatcataccgaacgtgacaatgcttattacattcagccacgtcatcatggctttttctttataaaagacctctaattttacaatggatgaatcatgcgaaaagctctgtcacctaattt

SEQ ID NO: 45898 - DNA, 326 bp, Triticum aestivum
  unsure (1)..(326): unsure at all n locations
  Clone ID: PAT_TA_45898
cgtccggttccaccaagagaggaaaggggatcgggaatcanttatgctccgccncctggcgtggggggatctccttgctggggcgcgtcgtcgtcaccgtcgctgtcgtgggcctcgaatgaggaccgagcggtgcttgagcagaggcgcccaaataagcagcccccctttgggagccgcagcccccaatcgaagcagcagcagcttcatttcagactaaccggtggcagcttgggcgatggcgaagactaggtcgcggcgacaggctgccaaattgatggggaagccatcccattccaccatgggggaagacaattcagattata

SEQ ID NO: 45899 - DNA, 219 bp, Triticum aestivum
  Clone ID: PAT_TA_45899
gcgcgcatcgcgtccgcccactcgtccgcggacgcgtgggtctggcaagtgaggagacgcggaggtgagcaggcggggggggcatcaacaggctggggactccgaggcgccgtccaattctccggcgggccgaggtctccactgcggaggaggaggaagggctcaggggaagggcctttcggtgccctgtccgccggaggaaaatgtgttggggtggtt

SEQ ID NO: 45900 - DNA, 415 bp, Triticum aestivum
  Clone ID: PAT_TA_45900
cgtccgcccacgcgtccggaaaagcgaaaaacagacacagcgctccggccgccggccgcaacgcctggcgagtcctcctcgacggcggcggcagccatctcatcgtcccccctctccccgcgtcaaatccagccctcccaccatcccacccccccttcccctagcagccgccgcatagagcacagatccggctcccctcccctcccctcccctgctacggcaatttggatctagactagactccctcgtcccctcctccccacccacagcacggtcgggcggcagatactcgcgatggatggatacgcaatcatctcctctgatcaggaacaaccagtaatcggtgcagattggagttcaggggcactgtcagatgaattggagatacatgcaaactcggcagacctttcactgc

SEQ ID NO: 45901 - DNA, 428 bp, Triticum aestivum
  Clone ID: PAT_TA_45901
ttccgtaattcccttgtcgacggacgcgtccgtttcatccctggagacagaggcagcttttcttgctttcaatacttggctgtctttgacggaggccctccaatgaggggagcgcctgccttcctgcatagcgatgatggctcttagcaagaggcacccgcagtcggagaataacgccccccgggcgaggcccatgtcggcaaaggccgtcttctttctctgcgccaccagcttcttggtggggctgctgttcaccggcctgatgacggtgctgactcctccttcttcttgcagctcacggctgctccaggatcgcccttttctccgactactactgtgagctcaggcttaatcttgaataatatgcgctacccggtcgatgtcatcaaccatgttaactaacccaccatggcattctttctattgac

SEQ ID NO: 45902 - DNA, 276 bp, Triticum aestivum
  Clone ID: PAT_TA_45902
cgtccgcccgccgcctccttcaccatctcatcgctcgtaagcatacctcgcaccatctccagggtggagatcttcgtggggacgctgacttacaagaccatctactctggaggtggattactcggacaccatcgacaactgtaatgccaatatccaggacaaggttggcatccctcctgaccagcatcgcctcatcttctccgttaagcagctctatgaccgtctcaccctctcctactactatattcatatggtgttcaccctccaccttgttct

SEQ ID NO: 45903 - DNA, 437 bp, Triticum aestivum
  Clone ID: PAT_TA_45903
acttaatggccggggcgacgcacgcgtggccggacaccttggcggacccgtgggcggacgcgtgggcggagatcctgcacgagggggggggatctgagactcagggggcacagagatggttagggctgatatcttctccttactcagtcgtatctccaagaacgtgacggagctgaaagccgagcagaagctgaggattatcgactatagcagtggccagggccatattcacatgggaaacatgtgcagggagggggcaaatttgcttgaaatatggggaaggggcagaacacctagattcccgggaaaagcaagtcttggggaacactcgggggggaggggttcatattatggctggtaacaaggggggggtcagaaccaaagagcggggggtgggctactatgaattggattggaagcaatcttcaacggggtgg

SEQ ID NO: 45904 - DNA, 419 bp, Triticum aestivum
  Clone ID: PAT_TA_45904
ccttgctcggttcctcctcctgtccccctctcccatggcccaatcctgggccttcttcctcctcgtcgtcctctgcttgtgctgtgtgtccgacctcatctgcggcagcaatggggagcgagtcttcctctacccgcagtcccagaaggtctcgtccatcgtcagccagaggtaccggaccgcctaccacttccagccccccaagaactggatcaacgatccaaacgggccaatgtactacaatggcatataccatgagttctaccagtacaaccccaatggctccgtctggggtaacatagtttggggccactcagtttctacagacctcatcaactggattccacttgaaaccgcaatagcgcgggacaccccgagcgacataaacggttgctggaccggctcatccacaattcttc

SEQ ID NO: 45905 - DNA, 383 bp, Triticum aestivum
  Clone ID: PAT_TA_45905
ggccacgcgtccgcccgcgcgaggacgatcctcgccgtgctcatggacaagaaaatccttcccccgacggcggaggtgtcctacaagcgaaccagggacgggcctccggccaagcagggcacggtcactgtgcaagggaccatacggtgcgcgtgcggctgcggcggcaaggccttcaccgtggcggagttcgcggcgcacgcgggagggtgcggcgcctagcggccgtctgcgagcgtgtacctcaacgacggcaggtcgctgtcgcagtgcctggtgcagctgatgcgcgcccacggcggcaacatgctggccacaggctcgccgttttcgcgcgcgagggtgaaacgcatattcccggccgagctgggggacgggtactg

SEQ ID NO: 45906 - DNA, 207 bp, Triticum aestivum
  Clone ID: PAT_TA_45906
ccgtacttaattgctcgacgccacgcatccgttccgttcaaccttggcttcccggtgtgcccggaggcagggtagcgtttccctcagcgtggggctttaagccgtccacgccgccgcctttatcttcgtatctctcaatattaaccgccaccctttgtttatgctatcccacctttcaacaattaaacactttcttatctgtttctt

SEQ ID NO: 45907 - DNA, 381 bp, Triticum aestivum
  Clone ID: PAT_TA_45907
cgtcctcccactcgtcctcataatggcatgcaaacaagttgaagctcaccccaccaggtaaggtggcggaaaataccgggcgtgtgtgtgacgttttggcaatcggtggagaactgcatgagagcttcacaacccattcttgttgctttgaggattgttgatggtgatgacagtccagcattgcctgaaatttgggcagccatggatgttgcgaagacacacatataggatgcattgtcacaaaggccaggcctacaaagtcaagtgctagcaattgttgacaagagggtgggatcaccatatggagcaaatgctacatggtgctgcaatggttttgaaccctagcaaggtttttcaaatgaaggagactaacataagact

SEQ ID NO: 45908 - DNA, 243 bp, Triticum aestivum
  Clone ID: PAT_TA_45908
cgtctcttccttacttgactgttgctcatgtgcatatcactacaagtaagagttaatcccacggggtggggccttacgggggggggcgtttacatgtttaatgcccacccagcatcactttaacaaacctttctagtatgctaatgcgtcttatttgcatcacaaagggatgccatgaatctgctttacaacatttatggttggctagcctggccattctcgccaatggacataatactttag

SEQ ID NO: 45909 - DNA, 411 bp, Triticum aestivum
  Clone ID: PAT_TA_45909
cgtccggtcgcctttcgattcgaacctccccgaattcctcatcagtcgacaggaggcggggggggggcgccttggggcgggcgaagcataccgccctcaagtccaccggcggcatggcgccccgcatgcatctcgccaccaaggcggcgaggaagtctgcgcctacgaccggcggagtgaagaagccccaccgttacaggcccgggaccgtggcgctccgggagatccgcatgtaccagaagagcacggagctgctgatccgcaagctgccttttcagcgccttggccgcgagatcgcgcaggactttaagacggacctcaggttccagagccactcctggcttggccctcaggatgctgccgtagcgtacctggtgggtctgtttgaggacaccaacctgtgcgccattc

SEQ ID NO: 45910 - DNA, 243 bp, Triticum aestivum
  Clone ID: PAT_TA_45910
cacgcgttcgttttcgcttaagcggacgcgtgggggactgatggaaataattagcgctgcgggtgaaaggaaaaaagctaaacatgctgggatgtttgatattgcgaagacagcaaatagacctatgatacatatcggtggctgagggatgctctatgtcttttttttggccttgatgaaaaaaaagaattaggagttatctttgtaacctggtctttatctttgggtggtttataacatgaa

SEQ ID NO: 45911 - DNA, 415 bp, Triticum aestivum
  Clone ID: PAT_TA_45911
cgtccggtcggcttctcccgtcagcggatccacacgcgggttaacaacaaccaaatccggtgggcggacggggaacttgaggacggaggatggcggtggagttccccatcaccttgcgggagctctacaggaacgccatcacgaactgaatttcagattttggcattaggagttgctaataactcgaagggaacaaggaatttgttggctttcttcaatacatccaaccaatagatttatatatcaaccatggctgagcacgcaagagcagtttttgcaacaaagctctcactacggaaattcatggcgacggcgcagcgtgtaactctagatcaaaggcagcttgcccgtagcatgggcctggatcatctgcttgacctaaaatgtgatactttgccgcgcggtgtcgttcatt

SEQ ID NO: 45912 - DNA, 410 bp, Triticum aestivum
  Clone ID: PAT_TA_45912
cgtccgcggacgcgtgggcttcggcgagagagagctagggcacgggcggccggccacgatggtgctcgcggagctgggcggtagcatctcccgcgcgctggcgcggatgagcagcgcgacggtggtcgacgagaacgtgctccgggagtgcctcaacgagatcgcgcgcgcgctcatgcaggccgacgtccgcttcaagatggtctgcgacctgcaggccaacatcaagaagtccgtcaacctcgaggccctcgccgccggcaccaacaagcgccgcgtcatagagaccgccgtcgggaaaggagctctgcaagatgctggatcccgggaagcccgcctttgtccccaagaagggcaagcccaacgtcgtcatgttcgtcggactgcatggctctggaaaaaccactacg

SEQ ID NO: 45913 - DNA, 428 bp, Triticum aestivum
  Clone ID: PAT_TA_45913
gggaggcgacgcgtccgggcttctacgttatgggaagggtcccttccagctatgacccctacaacttctaggtacggatgtgcagtaaccctggtaatggcaggacgatgaaaggctggaattggctcaagctaccaacaccacctggctatgctgacaattgcattggcaattcccatgcgctgcttgaaattgaaggtgactcaattcttggtggctcctccggagaagaaaggcttggcacctactgggttaacacagccagtcgcaagtggtttaagggtggctcctggacactggcattcctcagtcgtgctgggcatggaccagagctggacaacctcttatttggcattggcagggatgcacccaaccacttttgtgcaatgggtatctcccggcttctctcgaagaggtgtgcaccttta

SEQ ID NO: 45914 - DNA, 399 bp, Triticum aestivum
  Clone ID: PAT_TA_45914
cgtccgtgcatgtaagtccaccatagtactacaacgtacagtgccatggaggccatgccgctgctgctgggcctcaccctgctcggcggcccggcgtactgcctgcagtcaccgcggcagtcctaccacctcgaactcgtccgctgtggactccgtggacaccggaagcctcaacatcaccgaccacgagctcctacggctcgccatccagcgcagccgtgagcggctggccagcatcacgccccgcctgtacccgacccgcaaccgcaaggtggtggcggtcgacgcccccgtgcttgaggccgggggcgagtacctggtgaatctcgggctgagcacgccgcattgctggttaacggcggacatcgacacgggcaggggcctcatctggacgcattt

SEQ ID NO: 45915 - DNA, 259 bp, Triticum aestivum
  Clone ID: PAT_TA_45915
cgtccgtccaatctccttcccctttccccatactcttttttctacacacatcgttgcttgggggggcgtagctagctcggcgggtggctcgctcgctcgcggtggcgcacgcaattgcggagtcggaggaggtggatcggccatacggagatggggcggtagaagattgagataaagcggatcgtgaacgctaccaacaggctatgtgacctactccaagcgctgttcggtgatcttgaataaggcgcggtaacttacc

SEQ ID NO: 45916 - DNA, 425 bp, Triticum aestivum
  Clone ID: PAT_TA_45916
cgtccgcagacacctcagacatctcaaggaggtcacggtcgactctggagtgcctgaccaaacaagacaagactgggagcacgcaacaaagaaccacccgaataggccgagactcgtgttgcacaaaagtggtgttcgaatggaaagcgagggaccgggtaatgaagaagcttctgctgtgagggagaagcggaaaatatgtgtactccaaccgagtttggatgacggactggattctagtctcaagaagatgaaactttcatcagagtcttcttcgcgtcttcaagtgatcgtccattccacttcctcatctggtcactgaggcagatggcagtgctacttcagtgaagcaaactgctacggtgatgattcagcttgtacacacaaatcagagacagaatagatgatgagctgctgttgtattg

SEQ ID NO: 45917 - DNA, 357 bp, Triticum aestivum
  Clone ID: PAT_TA_45917
cgtccgcccacgcgtccgtctggcttcaccaaggtgaagagcctcccgaccggcaaagctagcggctggactttgccttggcgtgtgtgtgtagagttcctacgtgtgtgtgtgtgtgtgttgagagaagaagagacgaaccccatgagagttgtgccaggcagctcaaggtagaaaaagaagagtggcgctgcgagaggcggcgccaacgattggcatcagagccttgtcgatccgtggcggtgatggcgatagctgtggctatggtggccggcgtggcggtggcggaggctacggcggcggcgttatggcggactccatgcgagatggaggccggtggcgcgacaaggaggtgtt

SEQ ID NO: 45918 - DNA, 425 bp, Triticum aestivum
  Clone ID: PAT_TA_45918
cgtccgcccacgcgtccgcgctctccaagtcgcggggcctcccctctccgagcgctaccacacagaggcggcccagctccgggagaagttccaggcgatggccatcagccgtgccgagccgatgttcccgggccgccctgggttcggctccaaggggcaggtgtgcgtggtgagggccaaccacttcttcgtcggcctcgtggacaagggcctgcaccagtacgacgtggccatgtcgccggagccgaccatgacgggcgttttccgagctgtcatgtccactcttgtgaaggagcaccaggacaccactcttggcggtcgcctcccagcttacgacggccgcatgagcctgtacaccgcgggcgagctgccctttacaaccaaggagttcgaggtcaccttacctgacaaaaattcaggtccac

SEQ ID NO: 45919 - DNA, 421 bp, Triticum aestivum
  Clone ID: PAT_TA_45919
cgtccgcgcaatttcccacaccaaggccagaagatcgcggcagaggagtgaccactcgttcgatcggctcatgcatgcatgcgtggatggaccaccgctcaaggtcgtcagtgacctccagattgaatcaccccaagaggatcaagatgaactctggtagtacatgtggaaccgtgtctgaacttctcagcggcttcgcacacacgtacctgaaccagtgtgcggcggccaacgcatcgcagcagaaggtagccacacagaccaaagctttgctcttaccacatacagcctcgatcgagaatcaacttcccgaaggcgatgccacgtcgccacgccacgcgtgatgcaacttattcgccggctgataggactcttcctacctgatggtttgcttggagagggacaggctcggccgatctct

SEQ ID NO: 45920 - DNA, 431 bp, Triticum aestivum
  Clone ID: PAT_TA_45920
cgtccgtcccttcctccccgccgccgccgccgccgccgccgtcccacccgtagccgccgtcgcgcgagaagatgctcgacatcaacctcttccgcaaggagaagggcggcgaccctgagcttgtccgcgagtcgcagcgcagacgctccgccgacgccaagcccgaaacattagaagaaaacgttgcgctcgtcgacgaggtcatcgtcctcgacgaggcgtggcgccagaggcagtttgagcttgacaagatccggcaggagctcaacaagaccagcaaggagatcggcaagctcaaggccaaaaagcaggatgcgacggagctgatacagagcacagaggagatcaagaggaggctggccgccaaggagaaggatgtggaggaggccaagaccaccctcgatgccaagctcgtcaccattggcaacctc

SEQ ID NO: 45921 - DNA, 272 bp, Triticum aestivum
  Clone ID: PAT_TA_45921
cgtccgcggacgcgtgggcgcaaatcacacacacacacgaacgcattttcattcatttctcaagccagcagcagcgcgcgcaccgagccggcgacgacgatgatggcggtgaccacggcccagctgacgcaaccgcgcgccctggcggccctactggtactggtgctgatcacgctgggcggagcggccgaggcacagacgccgatgggcaccttgagggcgcatatgacccagttgtcccctctcgattcctccatggccacggtgatgcc

SEQ ID NO: 45922 - DNA, 181 bp, Triticum aestivum
  Clone ID: PAT_TA_45922
cgtccgatccgatccagttcaatttcgggttcatcgctttcataccacctggccgatcctttgtgggcgggggcagttaacaaggcttgtgattctttttttctttctatccatcgatgttcttttgcctactatggatgccatccctttttagattgttgtttctctctctgcggttttt

SEQ ID NO: 45923 - DNA, 184 bp, Triticum aestivum
  Clone ID: PAT_TA_45923
cgtccgcgaatctctgttaattaagtactccgatgaacacattgaaaaacgacataaaatagcacaagaggcacattaatgagcgtacggtcacgtcctacagtactagtaccagcatgtgatcgaccagcttaccgatggcgagggccgacgagccggccttgccggcgcgctcgagagggga

SEQ ID NO: 45924 - DNA, 427 bp, Triticum aestivum
  Clone ID: PAT_TA_45924
cgtccgcggacgcgtgggcggacgcgtgggcacgaccaaccgctcccgtcgcccgatccatcgatccgtcagctccatcatcatctgattgccgccgccgcttgccgcccatcggtccagctcacactgaccgctacgtctcactctctcctccctctcctagctaattgcctagctacgggcagagctagctagctggtgatcaccacgcgcgcccgcccgcagctcgttttaagccggccgggtcggacacggcatgcgctgctctgcccgcacggcaaacgatggctccagcttccgcctcgctcctccccgccgccggcgccaagcgccccttcgccgccgactccgcccctgacgttgctgagcaagagcagccactcgcgcaggaggaagcggtgaccaagaagaacggccagagcgagca

SEQ ID NO: 45925 - DNA, 425 bp, Triticum aestivum
  Clone ID: PAT_TA_45925
cgtccgcccacgcgtccgcggacgcgtgggcggcggtggggggagcagcaccgtgcaggcgccgctgcagttcatgtcaacaagggtgaactaccccagcagcggcggcgcgatgggcggcatgccggacaccagcatcggcatgcttgctgggctcaatgcttacgaccgcggcgtcggaggtacggaagaagagcagcagcaggagcaagaccagcaacaggaaatggagcagcagcgcgacggcagcggcggtggcaacgaaggcgaagaggacggcgacgacgacagcggcggagaagaggaaggccatggcaacaacagctcacagtaagcaagctcgcatgatgaaaaactctgaatccaacatgatcatatcggaatcgtgctagtggggtgggctaggatcgaatcctggtgtcttt

SEQ ID NO: 45926 - DNA, 424 bp, Triticum aestivum
  Clone ID: PAT_TA_45926
cgtccgcggacgcgtgggcggacgcgtgggtcagtccccagtcgaccaggagcaccacgccacacacacacaccaccggacacggagagatggcgacaggagttggggaggccaggggggagacggtgctggtcaccggcgccagcggcttcatcggctcctggaccgtgcgcctactcctcgcccgcggatacgccgtccacgccgccgtcctcaaccccgatgacaaggccgagacggagcacctcctggcgctcgccggcggcgacgaggcccgcgtccgcttcttcccgtgcgacctcctcgacggcgccgccatgctcgtcgccgcgcgcggctgctccggcgtcttccacctcgactcgccctgcaccgttgaccgtgttctcgacccccagaaggagctggtggtgccggccgtgga

SEQ ID NO: 45927 - DNA, 355 bp, Triticum aestivum
  unsure (1)..(355): unsure at all n locations
  Clone ID: PAT_TA_45927
cgtccggtcaaagctagccagcaagaaccaagaagaagcagagcagctcagaaccgagcgcagagcgaagcggagccaaacgaaagaagggacctaacctaacctagccaagccagccggcgatcgaccgagagatggcgcggtggtgtcagctggcggcggtgctgctcgccgtgtcgatggcggcgtcgacgtcggtggcgcaggacgcgctgcagaccaagtgccagggggacctgcagaagctgtcggactgcatggactacgcgacggngcacgaggacacgccgtcggccaagtgctgcgaggacacggtggacacgcagaaggcgcggcccgagtgcctctgctccat

SEQ ID NO: 45928 - DNA, 360 bp, Triticum aestivum
  Clone ID: PAT_TA_45928
cgtccgcccacgcgtccggttgagcagggcacacatgactctttgatggacctgaacagtctctatgttagagagatgcactcccattttgccaagggccttccacagcatcgactaggctaggctaatgtaatgaatgttgggtttgataggtgtaaattatgttagggcatgacacaagatctcctgtcggtctgtgtccagccacgtagcttcatgggtggagtagctggcgatgttcctaatgcgcagaagggttgcttggtcttgacaaaatttttgactggagattgacaagactaactgtgttgaatctgcagggaacttttattctggaaatagctagcaaggttggtggga

SEQ ID NO: 45929 - DNA, 423 bp, Triticum aestivum
  Clone ID: PAT_TA_45929
cgtccgggtaaccattattgcacaaaggattgccatgtgttagagattccatcggatcaacgtaaggctgataccatattatctctcagtagaaagaacactcttgctgagccttgcgaaagatgcaatcttccttgtcaaagggccagggatcctccttgttcacacccttgcccttcacggtgtcatctaagcgactgtctaccttgcaaagcccttgttaaaagatcatgtcattgtggtgctatgacacatgctttcgagtgtgtgtactataacaacttaaatgccaagcaacagctgaaagtaaggtcctgcggtggcccgtgtcataggaaactaccaaattgcccccatctgtgctcagaaatatgtcaccctggtcaatgcccgtcagtggatcagtgcatgaaaaaggttaat

SEQ ID NO: 45930 - DNA, 380 bp, Triticum aestivum
  Clone ID: PAT_TA_45930
cgtccgcccacgcgtccgcccggctacccggcgcagctcgccggcgcgttccgggacaacgtcaggaccctcctcgggctcaggctgctgcacggcgtcgcgtacggcgacacatggttcgggcggtggggcttcaggtacggccgcccgagctacggcgtcgcgctgcagtcgtaccagcagtcccttcacgcgctccagtccataccgctctgcgtgctcgagccgcacctttcctgcttcagccaggagctccccatggtggtcaccaagtaccaggccatcagcgggcacaagctgctcaaccttggcgacctcctccgctttatgctcgagcttcggacccgtctgtcggacaccttcggtacggggatggacta

SEQ ID NO: 45931 - DNA, 350 bp, Triticum aestivum
  Clone ID: PAT_TA_45931
cgtccgcggacgcgtgggcgcaggcctatacgtacggaggttgacacgcttcagaaaattacgaagttccacatggtatcacaaatgcggctctcggcggagggagtcttctagcagctggccatttttagtttttcaaatccatcttcgaccctgtaatgatggatgggcagtggatgcccttttgttttttggttttcgtttctggaaaccttcagggacactttttttcttggtaaaatggtacaatcttatgtggggtatctggaaaaaaaatgagctatttcgttaagcccatttaaccaacaccaatcattttgggaaattatttttttatggtaatatgaaaa

SEQ ID NO: 45932 - DNA, 191 bp, Triticum aestivum
  Clone ID: PAT_TA_45932
cgtccgcggacgcgtgggcgcatgcctatacgtacggaggctgacacgctccagaaaaggacgaagttccacatgggatcacacaatgcgcttcttagtagagggagtcttctagcagctggccatttttagtttttcaaatccatcttcgacccttaaaggatggatgggcaaaggatgccctttagttc

SEQ ID NO: 45933 - DNA, 250 bp, Triticum aestivum
  Clone ID: PAT_TA_45933
cgtccgcggacgcgtgggcacccctcccaggctcccaccctcatcgaagcagcctcttctcgttaacatcaaggaggaaagttacaacagcctcgtcggagaagccaagaactcatcttctcttttcctccttcctcaggtgagatgatggtggatgagaagggaaggtgtgggaggtgcaagtagtggcaggagcactactactgggagcacaaggagggtgggagtctgtatcagcttttttataagc

SEQ ID NO: 45934 - DNA, 361 bp, Triticum aestivum
  Clone ID: PAT_TA_45934
cgtccggcagcacgcttgggtggtgggccatcactgccgggcatagtggacggccgtcggtctcttccgtggtgagccgtgaatcagaatccgtctccccgtctgatccgtggaccaggaaattcgattttcgtgtagtggtgacaggaacgaattgaaggcaggaccgagtcttctcggctacggcgtcggtcatttggaagctggagactccggtacaggggcaactagcgccgccggcaagccgccatggattttctgatgcagccaatcagcagatccagtctgcttgaggaggtaggggatagcttggtgccggctcctgtggctgtctatctggaagtggcaccgaatgctgagc

SEQ ID NO: 45935 - DNA, 248 bp, Triticum aestivum
  unsure (1)..(248): unsure at all n locations
  Clone ID: PAT_TA_45935
cgtcccgtctntgacaaccaccagaacattaagggctacgcgcacatcccctgtacgtggggaggggggaagcaagagctcatctttagaaccagaggccggtcaatgtcctcgccgatttcgtgtaaccggtcccatcttagccctagcaggcctacaggcgtacccctacaaggtggcgcttccgaaagacagttcaagcctttgatcctacatctaggctttgggctctgcagataactcttttt

SEQ ID NO: 45936 - DNA, 189 bp, Triticum aestivum
  Clone ID: PAT_TA_45936
cgcatcgccccactcgtccgttcaacttgtactgctagatagtaataatcctcgaggctttatctcgaactgggggtgggccgagccttggggtatacctcacatcgcgacggaggtagatctcctcttctattcccctaacatctattatgttggcctgagcatgaataactgctgctacctgccgta

SEQ ID NO: 45937 - DNA, 368 bp, Triticum aestivum
  Clone ID: PAT_TA_45937
cgtccgcggacgcgtgggcggacgcgtgggatttttcttaagaaaaatcgtgccatctcgcagtcacaattatggaacaaggaatatagtacaaaatggtatgactgatctgttctattgaactgcaatcgaatatgcactagaataaaatataaaatactagatacattctctgtgggctgcaggtttgaatacacaatcttgatctaggcataaatttctccaattgaatgcataatcacgtgattagggatgagttggttcattctctatgtttggaggacagcatcccagtacatgtacttgctgggatctgtgcatgtttatcggtctttgcatttatggccaactttaataacctctgtttc

SEQ ID NO: 45938 - DNA, 158 bp, Triticum aestivum
  Clone ID: PAT_TA_45938
gcccgatccccattcgccccacgcgcccggatttttttctaggttttctatacacacactaataaaaaaacttgactttgtaactgacttggtgtgataatgaaacgacaccacactttctatactaaatggagcgagcaacacttttcacattggag

SEQ ID NO: 45939 - DNA, 170 bp, Triticum aestivum
  Clone ID: PAT_TA_45939
cgttccgcacacacgtcacacacgtaacgtctcaagtctatgcagcgcgctgcaccgagatcggtcgactgcgaccgacgatggaggtgaccacggctcccgctgccgcagccgcgcgccctggcggccctcctcgtcctggtgcttttcatcacgctgggcggagcgat

SEQ ID NO: 45940 - DNA, 216 bp, Triticum aestivum
  Clone ID: PAT_TA_45940
ccacgccccacttgtcccgcaggaagcctaatatcctaatagagagtgtgtgcgcccagaaaaatacgggcgtattcattgctgcatggctggcgcgccaggcccccaggaggcttgttagcgagctgcacaagctgcgaccagggccatgggcattgagctaggtgacggtgctggctcttgctttgcttgaactggatcaatgtaggaggtatt

SEQ ID NO: 45941 - DNA, 392 bp, Triticum aestivum
  Clone ID: PAT_TA_45941
cgtccgcggacgcgtgggcggacgcgtggggagaaaccaccaccaaacccaggaactcgctgcgcgagagaaacagaggaggcggcgccgagcgagcgatcccctccttctcccccgtcgcgtgatcatggccatggccgcctccagatcgctctgggcctcccgcgccgcctcctacctcaagatctccgccttccccagggccttctccaccgtgctgaaggatctgaagtatgctgaaacccatgaatgggtcaaggttgatggtgattccgcaatcgttgggattacagaccatgcccaggaccatttgggtgatgttgtgtatgtggagctgccagaagttgtcgcctttgtctcccaaggtacccactttggtgctgttgtaagtg

SEQ ID NO: 45942 - DNA, 148 bp, Triticum aestivum
  Clone ID: PAT_TA_45942
actccaggggcgacgagctcactactcggcagccgcccttgtttgtttttgtttagagcacgtgcacgtttagggggggggcaattacgttcactggaccgggctttaccctcttagccgacagtggatttacccacagatgtctatc

SEQ ID NO: 45943 - DNA, 423 bp, Triticum aestivum
  Clone ID: PAT_TA_45943
cgtccggcgatcgaccatggcaatcgcactggcagccttcctgctgctgccgctcttctccctcggcgctctcttcgtcctcgccgcgtggagggtcgtcgacaagaaggcggcggcgcagcggcagagcgcgccggggctgctgcggccgtacccgctgctcggccacctgccgcagttcctggcgaaccggcaccgcatactggactggctcaccgaggtgctcgcgcgccagcccacctgcacgctcgtgttccgccggccgggcggcatccggggcgtcatcaccgccaacccggcgaatctggagcacattatgcgcgccagcttcgacaactaccccaagggcccgcgcttcgcgtcgctgctccacgactttctcggacggggcattttcaacgcccaccgcgaggcgtggcgcgc

SEQ ID NO: 45944 - DNA, 416 bp, Triticum aestivum
  Clone ID: PAT_TA_45944
cgtccgtgcaaatatcagtgagattgacagacgaattcatggaacttgcaaaggagaatacaagcaataatctagagacctgtggaattcttggtgcttcatttgtaagtgcagttgggagaagaattagataccaatagggatggaacttattatgtgacaacattgatcattccaaagcaagaaggaactgctcactcatgtcaagcttctaacgaggaggagatacacgccgtattatcagagcagtcactttaccctgcagggtggatacatgtagatatctgaacatttccatacttcatcgaattcagttctctgttggtttataatattgtaaatgaaataaatacacatggctagcctacctcatatggcctaagaacataggtatgatgagacaaaactgtatcatt

SEQ ID NO: 45945 - DNA, 419 bp, Triticum aestivum
  Clone ID: PAT_TA_45945
cgtccgcggacgcgtgggttgctctccatgatcttacatcaagggatgatgaagatccccttattccaaatccccttgctcttaatagtgagaatatacaggataatgggatttatttattggaaaatggcgaggatggttttattcatgtcggaaatgcggtgaaccctgccaccctcgagcaaatatttggtttctcatctttggctggtgcaccaaatctgttggtattggagcaatttgataatgtattgtccagaaaagtaaatgaagttgtgaatgaaataaggcgacagaggtgctcctacctaaggtactatctgtgatttctcaactatgcaattactcgctactttactcaactgcttaacatgttcaaactgttttgcagactgagactatgccaaaagggcgaccca

SEQ ID NO: 45946 - DNA, 284 bp, Triticum aestivum
  Clone ID: PAT_TA_45946
ttcccgattcgacccacgcgtacgtccacccgtttcgaccacgcgttcgaccacgcgttcgcccacgcgttcgtggacgcgtgggcgaaaaagaaaaaagaaaaacatattttattttggaacaccaaaatgtggtccgcaaactttgagaaaaaaggggggctccaactgaactgagctcaatttatgatatcctcgtatccggatgtcgcacacccaattttgatatggtctgtacatagggctgttaatggggaaaccaaatgcacgcggaagaacatggt

SEQ ID NO: 45947 - DNA, 281 bp, Triticum aestivum
  Clone ID: PAT_TA_45947
cgtccgcgagagcgccaagaaggcgcggctgtacctgtccgtcggccactccgtcaagcaagagctcgtcgcgcacgacgcggcggccggaggaggcgccgtcgtcgcggtggcgccggagcacagcccgagggcggtgcttgccgtgaagatcgacatgtgcgtgcttcactgtccgctctgcagccttcccttcaagccctccgtttttcagtgcatgggcggccacctggtctgttgtgggtgctcggtccagtagcccttcgttcagtgcggggcgt

SEQ ID NO: 45948 - DNA, 229 bp, Triticum aestivum
  Clone ID: PAT_TA_45948
cgtacgctgttactctcaaggagtagcaccatgggcaatacagtgttggctattgggactcagccataggggcggcggcgcattagtctgcggagtacataatgggctggttacttgtcggacaatgctatcgatctggtggacgaggcgttcgccaacgtgtgggtgctaaatgtacagcctgtcgcaggtgtacgattacctggagaggaagcgaattcagctgtag

SEQ ID NO: 45949 - DNA, 421 bp, Triticum aestivum
  Clone ID: PAT_TA_45949
cgttcgccggctccggcggctccttcggtcgccgatctctcgctgcgcttgcttcatagtcgcattgacggtgctccttgtcgtcctctcacttcgccagatcgcccgcgtcgacctgccccgtccggacctgccccaccaggtgccgaatgagcagctgtggggttctaatggctacggctatcatgcttgtgtcacaccaatccacagatatattgctccaatagagtcggaccgctatatgactgttagaagaaatggaggactcaaccaaatgcgtacgggaatctgtgatatgattgcagtagcccgcttggtgaatgcaacacttgttattcctcaattagacaagcgatctttttggcaagataccagtacatttaaagacatttttaatgagcctggttttattaaagctctg

SEQ ID NO: 45950 - DNA, 224 bp, Triticum aestivum
  Clone ID: PAT_TA_45950
cgttcgctcgatgccggcggcgccgctcacccttgttgtaatactcctcgccgaaatcgtcgagtggggccatggccgtctgttctactacgacgttctcacggggcaggggagcgcgtacgatgccaccgtgcttcgtctcccgtcgaacgagcggccgatcggggaggctggggagggcggttgctgatattacctatggttatttgttctgtactgatacg

SEQ ID NO: 45951 - DNA, 394 bp, Triticum aestivum
  Clone ID: PAT_TA_45951
cgtccgcggacgcgtggggttctgattaccgcgttattgcaccatgacgttcagaactactatagctgtttgttcgaataaaataaggtccttttctactcatgtgctatagttttttattaccatagttgtattttggctttttaatacttttatatattattcattttttttattattttaattttaaatatttaatatcatattatatttcttttatttttttctttttttttctttattaattttttataattttatttttattttgtgttatttatatttattattatttatatattaatataattttatttttttttttattattttttttttattatttctattcattaatttatttatataatttattttttttcttttttctttt

SEQ ID NO: 45952 - DNA, 419 bp, Triticum aestivum
  Clone ID: PAT_TA_45952
cgtccgcccacgcgttcgcggacgcgtgggtccctccacacaggagaggagaggagaggagcacaggagagccagggagctcgctcgctcgctcgctcggccccggcggacggagaaaccccaccccaccacagcagctcgccggccgccgccggaccttccttcgctttccgccggtccgctcgaattcccgggccctcgccgccgcccgcgccggaggagaaggaggaggaagcgggaggagcgtcggtgttttcgcttggcttgctccgtcggtacggtttgaggccgcgggttttgctttgcttgctcgggttgctcggggtatgagagacgaatacaacagctagaggaaagcccagattaagctcctttatcaaggatagaatgggtggctgctgctgttgtgcattaagagc

SEQ ID NO: 45953 - DNA, 139 bp, Triticum aestivum
  Clone ID: PAT_TA_45953
cgtccgttttttcttaagcaagaacatactaacgtcgcaacggctaggttgaggagaggacgatggcagcgccttatcatgcgttaactacctagatgattctgtttacagatacatgccttagccacactcttacaag

SEQ ID NO: 45954 - DNA, 354 bp, Triticum aestivum
  Clone ID: PAT_TA_45954
cgctcactagtccgtgggcggcctttttttttgtttcttggtccacaaaatcctgcagggacgggctatgaaccttctacgacttgatcatctgtccgaccccaaaagaaaaagtcagtactagggtaagctcgaacattgactttgttgaagcgagccccaaaccagaaccgtccgaatagagttggcatttcgacggaaagcacactgtttcggtattgggtttcaaccaaaaaattttcatagcatgggtgatacaacacggtataaataaaccactggggggtgaaagtgcaacgcttgttggtgtcttaattgatcctgtgaaagacaaggttcacaatggaaataata

SEQ ID NO: 45955 - DNA, 203 bp, Triticum aestivum
  Clone ID: PAT_TA_45955
cgttcggtggctccgtgtgcatcgcctccttgactcattgatcaaccgaaaaagaaaggagatggcttcttgaccgtcttgctggggtgggttgacgcccacacagatcttaagctcagggggcgacttccgtctaattttatcggggcttggggcaggtccagggagggggatggacttcaattagccgtcgcagccgccgg

SEQ ID NO: 45956 - DNA, 405 bp, Triticum aestivum
  Clone ID: PAT_TA_45956
cgtccgcaaagatccaagaaccgtcgatcgagcgcccaccatgccgtccactgaccaagcccaccgcagccttcccatgatcatccctgccgaggcaggcgccgcgccgcgctacgccggtcgcaagaggcctcacgagctcaccctcgccgtgtacgaccccgccgccgcggagcaacgggccaacgcggccggcctctccctctccggcgctcttgtcccgttcttggcgccgcccgtcgacgccgcgcccatcagggtcgtgccgctcttcggcgtcgctccccgagccgagccggcgtggatacgcccccacttcgacctgcggctcgacctggcggtgcactttatcgacgagaagggcctgaccgtcacctgacctttacccgcagtagaaccggtttc

SEQ ID NO: 45957 - DNA, 419 bp, Triticum aestivum
  Clone ID: PAT_TA_45957
cgtccgctcaaatcccccaccggcgaagcattcaaaccctagactccttcctccaccagcttcgatggcccgtacgaagcatactgtgcgcaagtccaccggcggcaaggcgccgtggaagcagctggccaccaaggcggtgcgcaagtcggccccggccaccggtggcgtgaagaagccccaccgttttcgcccggggaccgttgcgctccggtagatccgcaagtaccagaagagcacggagctgcttattcgcaagcttccctttcagcgcctcgtccgcgagatcgcgcaggactttaagaccgatctgtggtttcagagcttcgccgtctccggcctgcatgaggcccgcgaggcgtacctggtcgggctgtttgaggacaccaacctgtgctctattcacgctaagcgcgtta

SEQ ID NO: 45958 - DNA, 228 bp, Triticum aestivum
  Clone ID: PAT_TA_45958
cgtccgtaaaaccctattagcctattccaccccgcgccattccacccccgccgcagacgcaaccgcagcaggagccgtagcccgatggaagttgacagaggcccgaccggtgccgcggtaggaggatcctcctctggcgcgaaggcggaggacgccgccggcggccgtgaaaaaccgcggcatcgagccccgatgccaaacgagatgagcggggggaggccacaatac

SEQ ID NO: 45959 - DNA, 422 bp, Triticum aestivum
  Clone ID: PAT_TA_45959
cgttcacttacccgtggccggcctctttttttgttgttgtaacatctcaacaacattctataggggtccacacggctagttcgcatcttcctcgctgaaattacatgattgggatggcgctactcattgtaatacgaaggccgacttatcgaaaggtgagaagagcgctgaactaaaatggaaaacctaatgaaacggtcaaacatattccagactcaataattgtgcttccttcgcaccacatggtaccaatgtgaacgttattgacctcacttacataacaatttacgggtttataacttttgacttgatcttcttgtgcgggaaaacaacaccaccattgctgtgaataacatcacatacattgacatcttctccaaggatgggcatattattcaatttagcccaatgcccaacagttg

SEQ ID NO: 45960 - DNA, 422 bp, Triticum aestivum
  Clone ID: PAT_TA_45960
cgttcggcagtctgtagacacatcatcgccaccgttcctccgctccgccggccgtccaggcccacgccatgccttctccccacgcggcatcgcctccatcggcccttcacgccccacttgccttgtaggaggtccctccatcttttcacttgctcgggcgagatgccgccgcccaaccaccggatatcacccgagggcctcttcggcgcccctgacccgacgtccttccagtgcttcctcacacctctcccttttcggtgcccacaagccgacctcctggcgcttcccactccattccacaatgacaataattctgactgcggctggtgcccgcatcgccggttcggcgcacttcgatggccaacaaccgttgtgggcgttccctgatcccttttagcaatagcagccatgggcgcccaatt

SEQ ID NO: 45961 - DNA, 207 bp, Triticum aestivum
  Clone ID: PAT_TA_45961
cgtcctaccacgcgtccgagactgattgcatcgctccatctattgtcgaccggaactgctggcggtgccatgataggtctagcccctggcacactgcctttgctacattgcccaccgaattgattccattcaccttcatcactctccctcctttcctgagacctgaccgaacagagctaagtagcagtgctgaagaggtgtcctttt

SEQ ID NO: 45962 - DNA, 338 bp, Triticum aestivum
  Clone ID: PAT_TA_45962
cgtccgttcaacttactgataaccaaatacttacctatgtctagtctcggcttataacatgtgcggtatatttttttgcgtatccctcaacatcaaggaggcttctcatgatgttagttcgcttgcgggcaagtggggatcagaacttgtccctgccttcatttcttatgattcgtgaagtggcttcactcttacctgactgtttggatttctgtttaacttaaaacatattatgcattcctttccagttccaagattgttgacaaccgaaatatagaaaattttgatttctttctgaactgtctggtggaactttattctctggatatttataatgc

SEQ ID NO: 45963 - DNA, 215 bp, Triticum aestivum
  Clone ID: PAT_TA_45963
cgtccgaccgatactatatcaatcgaatcgatggcgatctaagtagctaactgttgatcttgctggtttgcttatctgcaatttcatggcccacaatatccatggcatcatggtgtgaagaaaacatctaattaatcaagaacgctttgctatctatgccacccataagcatgagagccgatctagataggtgctgttttctacttggttacttg

SEQ ID NO: 45964 - DNA, 417 bp, Triticum aestivum
  Clone ID: PAT_TA_45964
cgtccgctagaatatatgggtcaattaggctaacgatgatcagcggcagcgatggcggcagagtaattagcagatggatactgagaacttgcagaagctggaggaaataaggattcgtgctttgcagatagcaagaactgagttttttagcacaacagtgaagaagataacgacgtcagtcctttatgtgcctgggctaatgctttgccaaatccgactttcgaaaagcttgatcgagttctcgtgagcgtggagtgggaacagaagttccctcttgttacggatcaagctctatcgcggcgcgtatccgatcacacgcccctagttgtggacttaggggagcccaaccacatgggaaacaagaacaacttttatttcgagatggcctggttcgaacgcgaaagggtcttggacctg

SEQ ID NO: 45965 - DNA, 287 bp, Triticum aestivum
  Clone ID: PAT_TA_45965
cgtccgcgcaggcctacatgaacgggtgggtgaacggcaacggcggaggaggaggcggcaacggcggggcgtgcgcggtgtgcaagcaccatcggcgcaagtgcgagcccaactgcgagctggccgactacttgccggccaacatgatgaacgacttccgcgcgctgtaccttgtttttggggtggccaacctcaccaagctcatcaaggccaacgccacctaggcggcgcggcggcgcgccgccaatacgctgacgtgggatgcgcgtcggcgcgagtgcgacccc

SEQ ID NO: 45966 - DNA, 426 bp, Triticum aestivum
  Clone ID: PAT_TA_45966
cgtccgcggacgcgtgggccgagacgtgggcctcctcctcaatcgcgtcctcgccggacctccttgctccgcgccaagtctgccagccatgccccatttcgccttggcctcaaccgaggaggacgagcagggctgttgcctgctcgatccgcccacacgcgtgccccgcgcgttgaccgtgaccagctccatgcccgagagagcatgctcctcctctcgatgcctagcgtcgcccaagtctcctatgttgctgtcgctggacaccgagtacctaaattaacgcattccgtttcgtctatgtcaaggccgagagggcgccaagataccaagtaccacgacgtggacgactctcaagttcaactacatcgactacgaacggtattgaccctgaacatctacagcgagcggcggtgatggccctggaca

SEQ ID NO: 45967 - DNA, 443 bp, Triticum aestivum
  Clone ID: PAT_TA_45967
cgtccgcggacgcgtgggcggacgcgtgggtggcaattagatggccaaaagcgctggataggtaacagcacgtttgcagatgtgcttgtaattttggctaggaatgcagacacaaagcaactaaacggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctagcaatgtcacgtattatggtggcttggcagccaattggcatatcgatgggcgtctacgacatgtgccatcggtatttgaaagaaaggaagcagtttggaagctccctggcagccttttaactcaaccaagaaaagcttgttcggatgct

SEQ ID NO: 45968 - DNA, 326 bp, Triticum aestivum
  Clone ID: PAT_TA_45968
cgtccgcccacgcgtccgcggacgcgtgggttactccagtggcagctacggtcactcctactgaggttactccagtggcagcgaagcagactgatggggaggagaacagaaaatggttcaatagtgaggaacctggcaaaacgcctcaagagccaagtgcagcagagcaagcacaaccgggcaatgaagttggagataccagtgctgcagagcagaccgcacagagcaattcgccggcactaactgttcaagatcttgttaaccggattaaaactaatcctggagatcccaacatacttgaaacacaagaaccccttgaggattta

SEQ ID NO: 45969 - DNA, 277 bp, Triticum aestivum
  Clone ID: PAT_TA_45969
gcgtccgcccacgcgtacgaggacgcgtgggcggacgcatggacggacacgtggacgcgtacttgcgatcgactgttacctgaattggcatagcaagaaacttaaagcaaccctagagttaacaaatttcttgatgaccacccgggtggagaggatgttctacctacatgcatcatgactatggggatgcactggacgattctgaagttgtggaccacagcatactcagtcattattttgatttgaagctacatgattggaataatcgattactttg

SEQ ID NO: 45970 - DNA, 404 bp, Triticum aestivum
  Clone ID: PAT_TA_45970
cgtccgcccacgcgtccggccgccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgccttatcggcgatgccggcaaaaaccaggtcggcatggaccccatcaacaccggcttcgatgcgaaacggcttatcggcagaagggttgctgatgcttctggccaaaaggatattaaaaaggggccggaccaaggtatttct

SEQ ID NO: 45971 - DNA, 423 bp, Triticum aestivum
  unsure (1)..(423): unsure at all n locations
  Clone ID: PAT_TA_45971
cgtccgcccacgcgtacgcggacgcgtgggttccaaatgcagaagacaatcaaatggtcatcaattctgtttgctttacttcggtacaggaatagcctcactacaagatagctgcagatttcccaaaggtgaacaagttcactaaggtttggaatattttcaagctgatgaagatttggaagacctacaatggcctgcgtcttgtttggtgaacctagacatttgctctgctcattttggtggtggcttggctgggtggcacacatctagaagcatatgtacatcttttggggcaccactttaagttgggtgggggggaaacatatatatgtacttctttcggggcacaaccttttccnaaaaaaaaaacgattttaaaagcttctccgaaaactgattaaaaaagaaaaaaaaaaagggggg

SEQ ID NO: 45972 - DNA, 358 bp, Triticum aestivum
  Clone ID: PAT_TA_45972
cgtccggccaccaccagtagcaaccatggccgtcctcagagcatccccgctcccaccccagcctcttccctcttcctcctcctcctccaccccccagtctcagcgttcccccagaggcagcatcacctccgcagcgctctcaagaacaggcccgcaccctcctcttctcaagaccggctgccgcggcggcgccaagaagatccttcttgcaggaggagggcgactcccctgcttgcccacaaagcaagaggtcggcgcggtaggcggtgcggaggaggaacgatacctcgcgagggaggccgggtggggagtgcggcggatggggcggatcggcgaggagatgaagcgggtggcgctc

SEQ ID NO: 45973 - DNA, 267 bp, Triticum aestivum
  Clone ID: PAT_TA_45973
cgtccgcccacgcgtgcgcccacgcgtgcgcccacgcgtacgggggcgcgtggccaaggaaacaactcttgttcctgcacttaatgacaccctagacgtgctacgtgctgagcaagaggagtggccatgctaaagcgtggagcccaaacagtgtaatgggatcgcattgaggatttgggacgaaaccatccggccgcagctgagggggggtgaaacaacgaggaactgtgagccaatctactaaaggctacgggtatggagggccct

SEQ ID NO: 45974 - DNA, 399 bp, Triticum aestivum
  Clone ID: PAT_TA_45974
cgtccgaccacgcgttcgatcgccggttgacgacgccatggcaaacgacgacgacgaccggcggccgatgaagcggaccaacagcgacgggtactcggggctctgcttcagccccgggagcccgttggggtctgacctcaacgactgcagccaccagagcctgccgtccgtcatgccgtacgacgcctaggagtacccacacgtgtaccgcccggtggcgcgggccggcggtgtggacgtgctcccgacggtcacgcatcagctgcctgagccgtcccctccgtctccgccgacgaccgctacttctgcggcgacgtcgctgtcgctgtctctgtccctggctggcttggatgcgcccgagccaagcccgggggcgcaggcgcagcccatgtccatggc

SEQ ID NO: 45975 - DNA, 206 bp, Triticum aestivum
  Clone ID: PAT_TA_45975
cgtccgcttacgcgtaagacaaaagctgatgatcaactcaaacataaacccttgcgacagggaggaggatcattttcgggggcaggagaaatgtaccgctaggggagcggtcgcctaagaccagcgatgacgacgcgtgcggatccgcgagctcaaggacgagtacgccttgttcgagctaaaggacaccgacgcgtgcatgggca

SEQ ID NO: 45976 - DNA, 436 bp, Triticum aestivum
  Clone ID: PAT_TA_45976
cgtccgcggacgcgtgggcgaggcgcgcgtcatgggcgagatctccctgctccccgccaacgtgcgcgtcgccgccggccgccgccccgtcgccatggccgtcggcgccgtcgaccgatcctacaagcacgccgacgtccgcaagcaggttctcgtcgtcgtcacctccggctgggccgtcatgtgcttcgaccacaacctcaagaagctctgggagacgagcctcggggacgacttcccccacgccgcgcaccaccgcgaggtcgccgtatccgtcaccaactacacgctcaagcacggcgacgccggtctcgttatcgtcggagggaggatggagatgcaacaccattccgcagatctcttcgatgactttatgaccgtcgaacacggcagggaagagcaccgcaaaagtgccagcgagaaacatgctttggag

SEQ ID NO: 45977 - DNA, 234 bp, Triticum aestivum
  Clone ID: PAT_TA_45977
cgtccggttcctcctaacccaacttgttattattgacgttgacctcgtttttttggataaggagagggattcatgggagttaaaggatattgctgagaagattgaagcggttgttaagaaaaaagatgaagggaccgtgtggtttaagatggccaagtatgccagggcttttaagagatatgggacggctttgaatttcatagagtacgaaagttctttaattgagaagaaaaa

SEQ ID NO: 45978 - DNA, 386 bp, Triticum aestivum
  Clone ID: PAT_TA_45978
cgtccggaccggccgactttctggactggcgttctgtcatattcttgagagctgcacctccagcttgcacatccggcctcactaccactagccgccggcggacatggtggccggcgctggagtgggatggaggtccggatcctatgtctacgagtgtgtgagtgtcttactctggcaaataaagtggagctgaatcttggatcttgtctaggcggatggtcaactctgaatagcgaccacgctagtgtccaaaaggcgcaggcaaggatgatccctggcacaagatcctttggcgggtttcctcccggatccatgaggaagcttaggcccggtcgaatgccaccacacatctgaccccttttcgtgctgtaataaatgccaatatg

SEQ ID NO: 45979 - DNA, 412 bp, Triticum aestivum
  Clone ID: PAT_TA_45979
cgtccgcccacgcgtccggccttgtgccgcttgtcgtcgtcaaccagtaaacgaagcgatctagccttacgacccaggccatggctgacttggacttgtctacgcctctgttgtcagcgatggatttggccgaggagtccaacgtgtccgcggctttcccgctgctggtgcttgagccgccgccagattcagatcgttcgtcgtacaaggtcttcagcttgccggaccagaagcttgaagatgtcactccgttcgtgtcgagcaacaaagcattcttggagacgccgcaaggctgggtattggtcctgagctcctccgattcctcgtcagaagacgcagggacccatctcctgaaccctaaagacggatcaagaatcgagcttccgactctcaaagacgacgaggtcccatg

SEQ ID NO: 45980 - DNA, 430 bp, Triticum aestivum
  Clone ID: PAT_TA_45980
cgtccgcccacgcgtccgcccacgcgtccgcccacgcgtccggagaaaaacatgtagccaaggtggtcaccaaggaagtgcttggggcaaagctattgtgtcttcttccttggtgtatggcgtgtgtgtgttgagtcttctcacactgtgtgtgtagagagaagagagagacctcaaaagagttgtgcgaggcagctcggggtagaagaggaagcggcgctgcgaggaggcggcgccaacatttggtattcagagccttgtcgatccgagtcggttgtggcgcgacggacttcatgcgagatggaggccgacggcgcaagaaggaggatggtggctatgcggtgccgctatgtgaagatggcggtgcgaagctgccacaagaagagtcggcgtgatgccgacgacggtggtgtgatgccatcgtcatcat

SEQ ID NO: 45981 - DNA, 415 bp, Triticum aestivum
  Clone ID: PAT_TA_45981
cgtccgggaagttgagaagggaaaacaattgcaccgagcaacgaaggctccctccttttacagcgcctgtctcttctctccttctatgacccaatccccaactcgacccccgtttctttccattctcggcaacgcaccccaccaccaccagaccagagtaggcacagtagacagcagcgacagtataaaatactctcctcaccctcctcctagcgagcgagcaagcgcggcaacaggcaacaaaagcagaggagaagccagatccgaagccgtcgccgccaccgcctccgtcgagcccggacaagaacagcaatcccgccaatggacatggagctcgacgccgctcgccacgggttcgccaagatgggctttgggtgcaagcactacaaggagcggtgcaagatccgggcgccct

SEQ ID NO: 45982 - DNA, 444 bp, Triticum aestivum
  Clone ID: PAT_TA_45982
cgtccgcccacgcgtccgaacggaccaaaaacggacaagggtaagatcttgaaagtttcttgggaaggtggtgcagattactacactgcagcaaagctggatgagatctttaagcaattcggcactgttgaagacattgtgatcaagactaggaaatcaaagagcaagggttcagcaattattgtcatggcttccaaagaggcggcacaaactgcactgaagaaccattctgtgtgcaatgttttccctgtcccattgattgttgcttctgttcaagaatcgggagggccaccggcaaggtcaactcaaacacctgaaccgaggacaagtaacattgatggaactgggttcagcgatttggaagcatcggtattccgaaaacttcaagaggcccagaaaaggaagaaatctggataactgatgctcctcgaggcatgaggtacc

SEQ ID NO: 45983 - DNA, 421 bp, Triticum aestivum
  Clone ID: PAT_TA_45983
cgtccgcccaacccaaccttgctgctgcctgcccccgcactcttctcaccacctcttctccccatctcccacatatacacacgattttgcatcctccacacctcaaaactaactgctgcctcacaccctgctaccctccaccaaagccatgaggggcttcccgctggccatcctactgctggcgctgctgctcgccgccggggaactgcattgcgcagcaacagcaccagcgccaccagcaaaggcaaccgctccgcggtctgcaccatgctcctcgtgttcggggactcgacggtggaccctgggaacaacaaccgcctgcggacgacagccaaggccaacttcccgccctacggcgtcaacttctacggccgcaggcccaccggccgcttcaccaacggcaggctggccaccgacatgc

SEQ ID NO: 45984 - DNA, 391 bp, Triticum aestivum
  Clone ID: PAT_TA_45984
cgtccgcttctcctccccttccggttcgggttctggttcggttcgggtccgagagtagctagcctagtctagggtttccgtagttcggagaggagagaaagggagagatccatggcggagacggagtaccgctgcttagtgggcgggctagcatggggcagggggtaacagatgctgcaataaaggttgaggcctactggccagatctcttacgccaagatcatgaacaacacgagcgacggacaacgtcacgcgtttcgtctgatctggtggaggtggtgctccagctgatgctgctgctgccccggatgatggtggtgctgctgccgctgaagagaataaagaagagaaaaaggaggaggcccaggaagaaagcgatgatgacatgggc

SEQ ID NO: 45985 - DNA, 324 bp, Triticum aestivum
  Clone ID: PAT_TA_45985
cgtccgcctgcctctcttctcttccggtccagcgtcccctgtccttgggggatcgatccgagcttcggttgggtgggttcgccgattcatgcgtgtgaggcaatggcggtctcctcgccttcttctgcaccggagaagaagaggaagtggctcctcagcaacaggaagccggtcagttcttgccacgccaatggatcgtctgtgcaacaactgtttgctttttcttctgtaccggacaatgccaagaacatttggtcctttgactacacaagcagggtcgtttggtcgtgccgtccaaattccaaatcacaagacagctttttt

SEQ ID NO: 45986 - DNA, 353 bp, Triticum aestivum
  Clone ID: PAT_TA_45986
cgtccgcacacgcacacagaacgctcaagctagcagcgcgcgcaccgagccggcgactacgacgacgatggcggtgaccacggcccagctgccgcagcctccccgccaagtgcggcctcccgcgcgtctactgccagtgatcgctcgctgcctggctccatgcaagaagaggaggaactgaagaagacgacgatgaataagagatcgatggtcggagcaaccatcttgagtagtagtagcagtgcctagtagctgtcctgtccgtctagatcgatcccctgtgatcattacagctctcggtctgtggcctctgtgaagtcaattataccatagtattgaaccaatttgacccg

SEQ ID NO: 45987 - DNA, 429 bp, Triticum aestivum
  Clone ID: PAT_TA_45987
cgtccgcggacgcgtgggcggacgcgtgggtcaccacaagggaagagaatatagcgaagcactgctccaaggatgaaagaaatatataccctcttcaccatctgggccctgatgacgcatgtaccctcttcaccaaaaaggtatttaaggagaccgtaagtttggatgagcgatatccagagttggttgaaccagcaaaactgatattgaagaagtgcagagggcttccccttggactagtcatcataggtggcttcttagcaaaccaaccaaaaactgcttttgaatggaaaaaaatgaatgagcatatcaatgctggattggaagtgaatccaaaacttgggaccataaaagcaattcttatgaaaagctatgatgggttaccctattaccttaaggcttggttcttggatctggccatcttttctg

SEQ ID NO: 45988 - DNA, 222 bp, Triticum aestivum
  Clone ID: PAT_TA_45988
cgtccgaggacgcgtggggacaaacccgatagctacaaaattaacagtggtgcacgtcgtagatgggagggtcaatagcaggactcaatacatgcaggacgagtgtttgatgtcagcgtgcgagaccgtgaatgatggacacagttacacagtgtgcgaaaaaggctgtgacactgaccgtgacggactactatctgactaacctgatacgtgaggtgatgt

SEQ ID NO: 45989 - DNA, 206 bp, Triticum aestivum
  Clone ID: PAT_TA_45989
cgtccgtctaagcgtccggcgtcggctcgcagtacatcgccgacaccccctcgctcagacgctagctagcatccggcagattcgctagctagatacgaactcaagcctagtggctaggatggaggtgcgagcggtgccttattcctcgccgcgcggatctggttgtgcatatccacggggccgacctcctcgacgacctaaggccc

SEQ ID NO: 45990 - DNA, 357 bp, Triticum aestivum
  Clone ID: PAT_TA_45990
cgtccgcccacgcgtccgcccacgcgtccgatgcatttgttctcttccattgtagcctgccctgtagcctacctcccccctcccccaacctcatccccattgcttgctagctagccagccagctacctgatctcgtggcggcaatggcgaggaactgcagagctcccgccgcgtcgtcgttcatggcgccgctgctgctcgtggcggcggcggcggtggtggcgttcttgggcggcggcgcggaggccatgaagtccggcagcaacatcacgggggtcggctccgtctactgggacgcctgctccaacaacaacttcttcaaacacagcttcttccttaaaggggcttgggtgctga

SEQ ID NO: 45991 - DNA, 187 bp, Triticum aestivum
  Clone ID: PAT_TA_45991
cgtccgcctgatacacccgtaagcattgagcattctttggtggagcgggggaacactcagatgagcgagcgttactctcttgcccggccatggagggcggggctcacgggaacaacgaatcggacttaacagagtgctgcttcatgtgctggcggaaccgatacgtactccgactaagattatccgc

SEQ ID NO: 45992 - DNA, 401 bp, Triticum aestivum
  Clone ID: PAT_TA_45992
cgtccgtgttaatcgatccactgcttctgcttcagaatctacttcaatacagttggacccatcaggtagatggccgggtcggattagctgctatgtacggctctgggtgctgggcttcatccaaaggaccatttggcacaccattcgtaattgggtgttgtgcaaccggagctggcgaacacttaattagaggatttgcttcccgtgaatgttgtatctcagcatcactgtcacagtctggccctgcttcctcctgcaccaaagttttgcgctcggtggtgcagagcagcagcgagatgtctcacgacaccggcgctgggctcttgctagttcagtctgaccttacaaagagaggggaatcgcctctactcgaagccgtcgagctcgttggcgcctactca

SEQ ID NO: 45993 - DNA, 429 bp, Triticum aestivum
  Clone ID: PAT_TA_45993
cgtccgatttttgttgctacattttaagttcctgctgctgttgtagcatgtactcgttccacagcactgtaatcttaatatattttttaggggaagaagctgcacccttggttacctacaatgatactgaaaagctatttgtgtatttctactttcacatgttaatggaaaatcccattgcacatattgatcacatgtttgcatccaaatatgcaaggcgatcatcctttgtgtcaaagtagcaattggtgttgtaatctacttctaatacttttgacttctataagagtaacacaaattcctgagcttgtccattagatcatgatttataactacataccctcgttggagattttcatctgtgtccatttcaatttcttttagcatccgtaagttttgccccatgccactatacaagccccacaacta

SEQ ID NO: 45994 - DNA, 220 bp, Triticum aestivum
  Clone ID: PAT_TA_45994
cgtccgcgagcgaatggttacagctaacatgggtagagtgggcttaactggccgctcacggtttgtcgcctgttggctcatcatagggcttttggagtgtgaatatagagagatagggacaggcacatacctaggacagtaaacagatgccgctcacctttggatactggctggtgcaaaagagaggctccatctagagagagctgatttatcggatgaa

SEQ ID NO: 45995 - DNA, 431 bp, Triticum aestivum
  Clone ID: PAT_TA_45995
cgtccggtcctctcctcaccctctcccctaccctcccctccccttccggcgaaaccaacaaacaaacacgaacgaagcgagggtcggggacggcgacgcacaccggattcaaggccggcgacgatcatcgacgacaagcgcgcgagggtcggggacggggacgcacaccggattcaaggccggcgacgaacatagacgaccagccgaggtttggggacgcacaccggttcggcaggaggccggcgacgagtatcggcgaccagcgcaagttccgctgattttcttctgcagccacaccggcgatcagcgcgggtggtcagctgaaagagtgtgggactaaggtcatacaacagtggaaatcaaacgatgcaccagcatcaagaatcgttgatttttcagaagccttagcattttatgatgctgcatcggca

SEQ ID NO: 45996 - DNA, 380 bp, Triticum aestivum
  Clone ID: PAT_TA_45996
cgtccgttcatgcgtgcgtgaacgcgtggtctgacgctatccttgcggggctaaaagtcgtgagctgcgcatgcatgtcagataccgactattacaaccgaaaatgatcgaagggcatgtactgatcgacgtacatctactgcggctggaccagggaagagaacaccatccaaaggccatgcctgcagatatgttacataagaataaagactaagacgcctgaacacacacaggggggataatggactctgttcaagacaccttctgactgtatcaaaaagtgctcagcatatttcatcatgaataactaccaacttacgtactcaggaatgaccaacatactgactctttgcaccgggcaatggtcagtagtaacattt

SEQ ID NO: 45997 - DNA, 287 bp, Triticum aestivum
  Clone ID: PAT_TA_45997
cgtccgcccacgcgttcgcggacgcgtgggccgtccccaaaccgaaaccctcctttccgggactggctttcgtgcatcctacgcccaccttcgtcgccgtcgacgtcgctgccgccatggccgatccgcggctctacccgtggggatccgacccttactgtgacgaatccaccatcgacggcttcggccggtggttatactacccggaccaggaccttaacatccctacctgtctacaagaacctatacgaccttctcaatgttcttgaagttccttttccaggagg

SEQ ID NO: 45998 - DNA, 442 bp, Triticum aestivum
  Clone ID: PAT_TA_45998
cgctcctaaaccacatttggcttctatctggctactctctggatggtaccaattattcaactgaagcaagaaacagatcgcaagaaatttatctgctggagcttgcaaacaagattgacaattgatgagtgtaagcccaaaatgaaataaatgtagtggctggagatccacagatctgacagttaatcatgcgaactgaggttataaaggcggacaccattgatgcagctgctgaacgaattcttgatgaactcaaaaacactagaagcagagagaatgccatctactttgatggctgggatggcctgggggcatctgccgtcctgcgagccgtggcccagcggctggcaccaaaggaacaaacaaggcccccaggactggagtttgagcaagtcatccacattgactcctcaaagtgggagagcagaaaagcggtgcatag

SEQ ID NO: 45999 - DNA, 165 bp, Triticum aestivum
  Clone ID: PAT_TA_45999
cgtctcggcggatctgtgctgattgacattctattttcatttgctgagtcagatttaatggtatgtgaataagcacagatactcctacaccttctatataactataacatcttatttctaatcattactctttaaaatatcttagatttatttaacttaatcctt

SEQ ID NO: 46000 - DNA, 140 bp, Triticum aestivum
  Clone ID: PAT_TA_46000
cgtccgcacaaacattccaaactacagagcgcactccacatagacacagagctacacagagagagagagagagagcgaaacagtcgccggcgcattccaccaccgtagtcaacatcaaagcgagagtcatgtcgagagcc

SEQ ID NO: 46001 - DNA, 531 bp, Triticum aestivum
  Clone ID: PAT_TA_46001
cggacgcctgggcggacgcatgggctgcacttggcccctgaaaaaaagaaaggactgtgtcaaccacgaccgccgacttcatgagcggttggagctcaagtctgaagagtatgacctttgagaccctcttgcccaaggatgaggctggcctttatcgcacctttgagtctatggaagggacggcttgtgttctaccagctggccgagtgccaggacctgaaggagcccaaccgaccttttacttatgatacgccttctacacagagtgaggtacacgcagacgacaacgacgacgactcaagacgaccgctgtatcgactgcgaacccgtataaggcggtaggccagccccttgcctgcctctggctcaataaagagggttttcctgctgtatgtacccggagataggactgtgggccgatgaagcaccttgcgtgttacccgtcggggaacaacgacactgtcacactcactcaagctcatcctagccgtttgtggtctacccgccgctgcacgagacatccagccgtgt

SEQ ID NO: 46002 - DNA, 156 bp, Triticum aestivum
  Clone ID: PAT_TA_46002
cccgtcgagcaaaagaaggctcttccaactccataaagtggaaagtgggtcgccataaatcccaaggctaccgtgccaggatcgaacagcgtaaagccttcgagcctggataactagcacggcatttctgtcctcagctaacaacgagttacacgt

SEQ ID NO: 46003 - DNA, 556 bp, Triticum aestivum
  Clone ID: PAT_TA_46003
gcgacctggggttcaaaaccttcctcctcaccggccgcccgggcccaccaggccgtcaccgtcgacacctcagagacagggcttccacgactgggacaagctcatactcagggcagcagctgaccgggagaaaacggcgacggcctacaagtcggagaagaggaaggagatggaggcggaggggtacaagatcctgggcaactccggcgaccagtggagcgacctgctgggctactccatgagcgcccgctccttcaagctccccaacccgatgtactacgtcccctgacacaacagagcagacatgattggtgggcatagtgtgagaaatgcagtgcttatttatctgttgcgttcgtcatgccggcccgattgactgaaccctgtactgactgactgagtgtgcaaaacaagactgagaatggaattgagaaggaagaatttataccgtgcaaattattcgctgacttcatgtagcatacttgcattggacttgtgagcttgattgtgtaatggatgagatgctaaatgctgttgctctgaaatgaaatgttga

SEQ ID NO: 46004 - DNA, 248 bp, Triticum aestivum
  Clone ID: PAT_TA_46004
gccgagggagacgctaaggaggagctgtactctctggtcacagttgctgaattccccagcaagtcttaaaggtttgggtaccaaggttgtggacgatgaggactaaaccccctctctgtcgtaatccatcagccaaaacttaatacatatctgttgagagcatattgggacagtttgctttatctctattgaatctactgttcatgcatgtcccatgacttcttgctacaagattcctgaccttcgat

SEQ ID NO: 46005 - DNA, 205 bp, Triticum aestivum
  unsure (1)..(205): unsure at all n locations
  Clone ID: PAT_TA_46005
caaaagtanactccaaaacgcggagatatgtcaatgccggcgatgaaaagggcccgttggcggcccagaagggaacactgggacattaatgctctcaatccgcccaaaaagatgtgagcatgcagattgggggcactgaattgctaatgcgaaggggccagtggggttatgaacggaatttcgtttagctatgtggacatggcga

SEQ ID NO: 46006 - DNA, 491 bp, Triticum aestivum
  unsure (1)..(491): unsure at all n locations
  Clone ID: PAT_TA_46006
ttcacatttcanatccantggttggccatcaagaagaaaatccancaaacatgcaagaaataacagtgccataaataagccaaaagtccagaacgttggagacgattcaagaggaaatggagttaacagaagttgtgaatccaccttgcagcacgttagttctagagtgggcacaccagagactgcctcttcctgcgcattggattctaagttcaatctgctgcagtgatgacgctgacgtttcaagagctggtcttatctttttattgggtctggaagctgtttcagctgctccatctcttgatgttcctttggtttggaaaatgcatgcactttctgcctctgtccgcactaacatggacttgcttcaagaagatagaagcaaggatgtttttgaggcttagcaagaattgtatggaaagcatctgggcatattatgccagaaatattatagatctaactctgtttataatgatgaggttgtaagatct

SEQ ID NO: 46007 - DNA, 275 bp, Triticum aestivum
  unsure (1)..(275): unsure at all n locations
  Clone ID: PAT_TA_46007
ctcctacctacctcctcctacctcggctctgcgcgcacaacaggaacaggancagtantagcactggcgactgtggaactatgccatgccacggcccctgactccagtgccggggtacacaacgtgtagtaggacgcggtaggtgactctgctgactgctgtggcttggattgtgtggatatgcatgaccatatggcgcgtgtgcctgtgacccggtttgtcgctaataccgaccgttgtttgtgtagtcccggcgcaacgaaaaccaaactcat

SEQ ID NO: 46008 - DNA, 551 bp, Triticum aestivum
  unsure (1)..(551): unsure at all n locations
  Clone ID: PAT_TA_46008
gnttcggccncgaccacaaacctggtccaaaattgagcaacaaagtgtctgtgcagacaaggacggacgctctcgctgaacgtcaccgtccgctacgtccgcccgctggcccacgaaactgtgagactgcctccaatccctctcgacgcgatagttgtcgtgctcgccagccccgccgctcgcgtcgtcgcaaccccgccgccgctcacccgctttgctcccgtgccgccgctgcccgcgccagctgtcgctggaggccggcctcgcggcgcaccacgttgccggcgtccacgccgggacagggcaggctggcggtgaggagggacggagcaggccaacggcgaggcgggtcggcctgtgggggccggtccggcggtgaggagggacggagcaggccaacggcgaggcgggtcggcctgtgggggccggtccggcggggctggagcgacctcggggtggactgcacgcgcaggcggcactgcggaggacgggcgcggcgtgggcactgttcgcgcgggcgagctgcaacttgacggaggcgtttataggaa

SEQ ID NO: 46009 - DNA, 521 bp, Triticum aestivum
  Clone ID: PAT_TA_46009
cacaggctgagcacgagggacaggctcctcatgctgttctaggacgggctctaccagtacttaaccaaccaggagcggtggcgcaggtggagatgttcatcgcgacgacacccggagggcgaacccggccagcacctcttcaaggaggtcctgttccgagcatcgtaacataagcaggcaatgagactttcatgagctgatcgagatccccaggcgaccgccggcggtaccactacgacttgtcggaccatcgtcatctctctggaagggcaggatctggagatcttgcgtgtaaatacacaataataaacatactactagtaggctacatagaggaaacgtatatacagaggagagagatagatagaggtgttattgcgtcgaattgcaggccctgagcagattgttcgtgtcgtgtcgtgcgcgcggctactgccagtcctaactccatccagtcgagttttttccccagctgcgactgtacaatttcaaataaaccctgtggaggaatcagggttttg

SEQ ID NO: 46010 - DNA, 560 bp, Triticum aestivum
  unsure (1)..(560): unsure at all n locations
  Clone ID: PAT_TA_46010
ctccagtcacgccattgctatacaccagtcacgatgctgtcaagtcttgngaaacccgcggcaggctgctgcgcaggtcatgaacttcgcactcatcctgtccacggcctttatgatgtggaagggtctctccgttatcagcgattcaccgtcaccgatcgtcgtcgttctctctggctcaatggagcctgcctttcaacgaggcgatcttctcttcctatggaaccgaaacctgatggccgagaccgatgtgggcgaagtggtggtttataacgtcaaggacaaggacattcccattgtgcaccgagttgtacgcaagtttggaaagggcgacaaggcacagcttctcacaaagggcgacaacaacctctctgacgatacggagctctacgctaagaaccaggactatttggtgcgcaaggacattattggcagtgttgtcggttacatcccctttgtcggctacgtgacaatagtcttgtcagagtacccttggttgaagacggtgatgctgggtatcatgggtcttttggtccgtctgcagcgataatagaacgttt

SEQ ID NO: 46011 - DNA, 448 bp, Triticum aestivum
  Clone ID: PAT_TA_46011
gttcctcgcgcccccaccccccctacccccgccgccctgctcctcgcgcgcgatgcaagccctcctcgcctcgcctgcgctcaggccctccccctccccctcccccgccgcccgctcccctccgccgtcgcgcgggcgcgtcgccctcgccgacttccccgcccgcgcccgcgcgctccgctgcggccccagggacaccatggaggcgctcgagcgcgacgagatgctgaacgccgagcagctcgagcagtggcagatcgggatctccgagcagcggcatcgcctgcctgccagggcgatacgggtccgtcggcacgggcgctcccgccgcctccttggcagaatatctggccgagatggccccccttcgcttcgttctttagcggggcctctgggacggggtatatgacatgggcctaggtcttgctcgttgtcctctgtatgaggt

SEQ ID NO: 46012 - DNA, 379 bp, Triticum aestivum
  Clone ID: PAT_TA_46012
gccgggccttcccactcacgtaatctaccggattgcgatgagttcccccaacacaaatccgacctgaagacttgaaaaagactggcacaagcaaaggcaaagcggaaggagaagaaagtggacacgaaaatgaacagtaatataggatgtcggctaagaatggcttggctggtagtcacaccgacggagaatggtcgcaggaatattcgatggtcgtggccttaaactgatgtttccaatggacaggatccgggtatcattcatgtataaatagtaaccctccacgcataggctgtctcatcttttctccatgaactgaacgataacgcctttgctatttttgataatgaattccaagcgcctattttctccttcttag

SEQ ID NO: 46013 - DNA, 577 bp, Triticum aestivum
  unsure (1)..(577): unsure at all n locations
  Clone ID: PAT_TA_46013
ggnaaacgccaaattctcagcgctatcgctcccgatctgcaaaagtcaatcgctaccgctacacctctcccctgcgatgccttgaagaattcgtcgaggcgctgtctttcgcacactacctccgccaccaaaccatcattactcccacacaggcccaagccgctatgccagcggatatgtccctaacgccgcatgattacatgtacggtattttcgatctcttggcgaactaatgcgctttgcgactgtcacgacagcccagacgggcgagttggccggcaacggagaacgaaacatcatgggcgatattcaagagcttggatgcgagtttgagattttgcctgatgtgcctaccaaggactggaggggtaagatgggtgcgatgagacagagtgtcaagaaggttgagaagctgggctatggacttgtggtgagagggagtgagaggcccaagggctgggtgccggacatgaaggatgatgcgcctgagcctacttcaccgtgatgatggaaattacgacttgatgtgatggaaacggtggggagggatgcttgttgtgggagacatcatttttgc

SEQ ID NO: 46014 - DNA, 560 bp, Triticum aestivum
  unsure (1)..(560): unsure at all n locations
  Clone ID: PAT_TA_46014
cggncgcgtgggcgagtactcaaaatcctggtcactccccagctgttgtcacagggnaagcccattgatcttggtggatcattaggtagggatgctgccactgggcggggtgtaatgtacgctactgaggctctcctggccgaatatgggaagtctatttctggatcgacctttgttattcagggattcggtaatgttggttcatgggctgcacaactcatccatgagaaaggtggtaaggtaattgcacttggagatgtatcaggcacaatcagaaacaaagcagggatagacgtacctgctctgatgaagcacagaaatgagggtggtcagttgaaagactttcatggcgctgaagtcatggatgcctcagagttgctagtgcatgaatgcgatgtcctcctcccatgtgccttaggcggagttcttaacagggaaaatgcccctgatgttaaggccaaatttataatcgaagctgctaatcatccaaccgatccagaagctgacgagattcttaccaagaagggagtggtcgtgttgcctgatatctatgctaatgc

SEQ ID NO: 46015 - DNA, 578 bp, Triticum aestivum
  unsure (1)..(578): unsure at all n locations
  Clone ID: PAT_TA_46015
ggctcggccaacatagacganactgggcaactgcagcagcttcagtcttccaaaatggatattcggtgatctgcacagcaacggcatggtttccattgaagaggatggaactcatgacggcataaagacgatccggattcagaaagcctgcgagttcaccaccagctctgtgctttgtgtctgcattatcacatggaacatgaacggcaaggacctaagaaagctggtgagctccaccaggaagttcgacttgctggttgttgggctgcaagaagtcccgaaatgcggcgtcgagcaggttctgcaagaagccatggctgatacacacatcctgttatgtcagaaagccatgcagtctattcagatgtttctttttggggcaaagagttcggaatcgtacatcaaagaaatgaaggtggacaaacacgcagtcggaggctgcggaggcgtaattgggagaaagaaaggagctgtggccatgtatgtaaacttcagtgggatccggatggtgtttgtgtcctgccatcttgcagctcatgaacacanaggtggagaagaggaactctgaatgccggcat

SEQ ID NO: 46016 - DNA, 305 bp, Triticum aestivum
  unsure (1)..(305): unsure at all n locations
  Clone ID: PAT_TA_46016
ccgccacaaantgccgtgcgcgtgacacagccgcccccgaccaacccctggggngaagaaaagccggtggtgccgtccggcagacaccactgccacggttcactgtcagccgcggtgctcctgggcacattctccggtggtgcttaggagtctgcaccggttactgtacccatatgagcttatggttggtggttgtgactgttagaggatctcatgcttggctatatataggaatcctggggctttgcccttttgtcgaaactcgaataatgaaaagttgaaattgcattctgaatttgcgcaag

SEQ ID NO: 46017 - DNA, 540 bp, Triticum aestivum
  Clone ID: PAT_TA_46017
cgtaaacaagcgctgctagagcggaacagtttggccccgttaaccttttcgaaaggcgaggtcgcccatggcgatgctcccgttcttggcgaacgagtgctgcagccagtacgggtattgcggcactaccgacgcctactgcggacaagggtgtcagtctggcccgtgctcggggagcggcggcggcggcgggagcggcgtctccgtggagagcgtcgtcaccgaggcgttcttcaacgggatcaagtcccgggccggcaacgggtgcgccggcaagagcttttacacgcgcccgtcgttcctgagcgccgcccgggccaaccccaacttcgggaaaggccgcacgaccgacgacggcaagagggagatagccgccttcttcgcccacgtcacgcacgagaccggacacatgtgctacatcgaggagatcggcggggcgaggcagaactactgcgacaggaagtacacgcagtggccgtgcgcctcggggaaggggtactacgggcgcgggccgctgcagctgacgttggactacaacta

SEQ ID NO: 46018 - DNA, 236 bp, Triticum aestivum
  unsure (1)..(236): unsure at all n locations
  Clone ID: PAT_TA_46018
cggacgcgtgggngaagnactcgacaaccatccatcaagtaccgtacggacgtagtagcgtggcactcctctccttgaagaagaagaagaagaagaagaagaagaagaagaagaagaaaagaagttaataattgcactagttatgatcagtagcagtacctttggtggcttgtaccagtactaatttgtactacggggtggtggcccttgcgatgaaattgaagatttgcaaggcc

SEQ ID NO: 46019 - DNA, 552 bp, Triticum aestivum
  unsure (1)..(552): unsure at all n locations
  Clone ID: PAT_TA_46019
ccaaataccgcacgagctcaanacggttccgatgatgacatcgcaagcagtgagcgcgagcagcacatcgtctttaacgatgaccgatctactgaccctacccactccatgctttccaaggatcatttctcaaacattctcaatgagattgctggtcgaaatgctgcctctatggttcaatgggtcgttccccagctcatggatgccatcgatgacgacggtaccgacgtggatagactcctcgatgatattgtcgacggtgttctgcaccatcccgctcagcgcgacctgggaagccgcaaggctcaggaaggtcgtaaccgcttcttcaagggtattgaggagtggtggcaggagatgggcgatggtcagcgtgaggaataccgtggcaagctgacccgagatggtgtccaaaacggagagaaccacaaggagggtgttcaagacaccggtcacggccacggctgtgctggcaagcttaagatgcgcaagctgtacggcggtggccccgaaactcttgaggataagattgctggcgctgcagctgatgcc

SEQ ID NO: 46020 - DNA, 577 bp, Triticum aestivum
  unsure (1)..(577): unsure at all n locations
  Clone ID: PAT_TA_46020
gcttacggtgcaaaananaaggagcaagagttgtaatagcaaaccgcactttcgcacgtgctcaagaacttggtaacttaatcggtgggcctgctttgactctcacggagttagaaaactaccatccggaggaagggatgattcttgcaaacacaacagcaataggaatgcatccaaatgtcaatgaaactcctctatccaagcaagcgcttaaatcttatgctgttgtcttcgatgcggtctacacaccgaaagagactagacttcttaaggaagctgcagaatgtggggccacagttgttagtggtttggagatgttcataaggcaagcaatgggtcaatttgagcatttcacgggcatgccaggtaaaaaaaattatgcttatatttttgtgtgcttgcccatgagttcgtgtgtggtagtaagtcttacatcgtttctcctatggctcgtcatacagctccagatagcttgatgcgtgatattgttctgagaaagacatgataaggtttgttcaaaatgcatcctccccttccataggactgtcaggaaaacaacttangtgccactntcttt

SEQ ID NO: 46021 - DNA, 580 bp, Triticum aestivum
  unsure (1)..(580): unsure at all n locations
  Clone ID: PAT_TA_46021
ggccccgncggccacggctccgccccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccatccaagacaatcccctatgtatggaccgttttcactgctggttacatagagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccttgaagcagctcttaccaaaccttgagcttcctatgtgctttttctggaaaataaaggcaaagtggatgccattctttgttgtatgtttctcaagtatcatggccttcatcgtgcct

SEQ ID NO: 46022 - DNA, 571 bp, Triticum aestivum
  Clone ID: PAT_TA_46022
ctccgccatgccgcctcccacgccggctgcctagcttcccccgcaggccgacccctggcggccttcctccgatatgtcgcctccccatcgacgagtgccaacggcctacgccgcggctcaggcgcctcccaccacgcccctcctctccaatcacaggttccatcccgcgatccaaagttcccctcgtctccgggtctggacggagccgccgccatcggcgcgagctgtggaggagaaagcaatcgaacatgaaaagtttttgtagcggccggcttgtgcgccgtctcggcttcggggtaaagcagtctgaagtttatgaaccaggtggtgatgattgcagaattccagtcattgagtgtgtctacgagtggattcaggtcctggaaatattgggagtgatcttagtgccagaaaataacagccttaggagtgtagggtggaccagtggagcaggttgtaaacactaagccccttccagtgaaactgttagctttgtggccagaaagttttttcttctgatgagacacctggcgatgtatcgaaatctgtcctgcataataaaggagcgctg

SEQ ID NO: 46023 - DNA, 597 bp, Triticum aestivum
  Clone ID: PAT_TA_46023
gtcgacccagcgtccggctttggcggaggcgccggcggcaaggccgattctgtactcttactggcgcagctcctgctcccaccgcgtccgcatcgcgctcaacctcaaggtatcgattatgagtacaaggcggtgaacctcctcagggcgagcagtctgatcccgagttcatgaagcttaaccctatgaagttcgtccctgccttggtcgacggcgacgcagtaattggtgactcttacgcagtagcattgtatttggaggacaagtacccccagcgtcctcttttgcctcaagaccttaaaaagaaggccctgaatatccaggtagcaagcattgtatgttctggtattcaacctcttcacaatctcaccttggtgagatttatcgagcaaaaggttggaacaggggagagcatcccgtgggtccaacaacagattgatagaggtttcacaggttgtcttcacagacatgtcccttctttcttggttattactgctatatttgcagcattacttccatccagaaagtttgctttggaaatactgctcaccaagtaattcagtgatcttgcatgttttgagaaactcacattatttc

SEQ ID NO: 46024 - DNA, 267 bp, Triticum aestivum
  unsure (1)..(267): unsure at all n locations
  Clone ID: PAT_TA_46024
cccgggtcgnacccacgacgtctcgcctttcctctcttgcccatacatatctactctctgccatcgatctaacctacacacacagganaaagagagagaagcagcagtagcacatgtaacctagctagcctgcagctctccgcgctaacgcttcttattcttggctgacgactggtgaaccttgccgtagttcgaacggttaggggggcagcgaggcggtggtttcagaggataataaggaggaatggtatgtgtttcacagatcac

SEQ ID NO: 46025 - DNA, 518 bp, Triticum aestivum
  Clone ID: PAT_TA_46025
ggaacaacctggttgcatccgccggaccgccgccgaccgtgcgctgtagtcgcggatcttctgcggggagccgcgtaagagaggagaagagaggaggaccgagggtggacgggccgtggctgtgcgccggaggcgccaccgccatcgcgcgtggaggcgcatccgtgtcgaggccgaaggccatggctgattggaccgccgccaccatttgaacaagtgcgcagttccacgtccaatgcaatctagagattgtccggagtgcgacgcgagctattgtcaggagtgtgactttctgaaccagaaccaaggatattcagacgaagagtaaggtaccgttagggtcgcgagtctgcactcagcatcgccagtgggctatgatgggactcatcgttattttctgctactttccactatttgattgaataaagctagccaagtgctatgcagattgttttattttataaacactagatcatacgttgtaataaatggtgcacatgctattgtggtattcatct

SEQ ID NO: 46026 - DNA, 592 bp, Triticum aestivum
  Clone ID: PAT_TA_46026
cgacgactgcccctctcctccatcctccgatggcaaccggcacctggtcaccccgctcgtggtcaccgcgttcgtcctcgtcttcctgtctctcgtgtccctgtccatctactgcttcatccgtcgcaggaggcgccagcgccggcagcagtcccttctcgccgccggggctgccaaccccgccgcccaaggcgacggccccgcccccgagatggctggcgccgcgaccgcgaccgacgtcgaagggggcgcagctccggatccagaggatgaggaggtcgtgcaccacgcgtggcacatccgcaccgtggggctcgacgaggcggcgatcgagtccatcgcgctcacgcggtaccgcgtcggcgcggggacgctgggcggcgccgccgactgctccgtctgcctcggcgagttcctggacggcgagctcctccggctgctccccaagtgcggccacgcgttccacgtcccctgcatcggcacctggctccgcgcccacgtcaactgcccgctctgccgcgccgacgtcgtcgtcttggactcggcggccaccgggcgttcggagccacctgccgacgctcagcagtttctg

SEQ ID NO: 46027 - DNA, 586 bp, Triticum aestivum
  Clone ID: PAT_TA_46027
cccgctcgcgcgtgcggggcagtgcccatggcgagcccgccgtcgccgcgcctgctctgcgccctcctcggcgaccgcctcggcgcgctctccgccaggccgctcctccgcaccgccgccccaggcagagggaacgcgagggtgacgtgccaggccacgagaacgctctccagcctggtggacgccctcttcaacaggagaagtcgggatgactcactggaaaataaccctagacgcctacgacctgggaaagtgtctcctcgtctaaccgtccccagtcatatacagcggcctccttatgtcaattcccgtcaaagacctcagatgaatgatggacctgaaatacatgatgaaaaagggattgaatgcatgagagcttctggaaagcttgccgcacaagttttgaagtttgctggaacacttgtaaatccaggcatcacaactgatgagatagataaagcggtgcaccaaatgataatagataacggtgcatacccgtcacctcttggttattgtggatttccgaagagtgtttgcacttcagtgaatgaatgcatctgtcacggaataccagattctcgtccac

SEQ ID NO: 46028 - DNA, 581 bp, Triticum aestivum
  unsure (1)..(581): unsure at all n locations
  Clone ID: PAT_TA_46028
ctcaatggagaacaaacttatctaacacaaatcaaccatgnaataaattcctcatccttgccctcattgttgttgcggcgaccaccacggccgccgaacccttcaatgcattgcatggtgcttcggagccgcaacgaccatcatctccggagcagcaaccaactccgcagccacaagaacatccagttccacatcaaaagttgaacccatgcagggatgcgctcctacagcagtgtagcccagttggtgttatgccgttggtccagccacaggtggtgcaacaaaccagctgcttggtaatgtgggagcagtgctgtcagcaactgaaagcgatccccaagcaatcaagatgtgaggccatccacaacgtgctgcacgccattatcttgcaacaacaacaattggtacaaggtacttccacccaacctcagcagcaacaacaacaaggtcaacaacaacaaggtcagggttttagccagccacaacaacaacaactggatcagggttggattgcggcgatagggacatgggtgattcagaccattcccgcaatgtgcgacgtgcatgttccaccatactgc

SEQ ID NO: 46029 - DNA, 401 bp, Triticum aestivum
  unsure (1)..(401): unsure at all n locations
  Clone ID: PAT_TA_46029
gtgtctattagtggacctgtttagtgctggaagcgagacatcagcgacgacgctcatctgggccatgtcggagttgatgaggaacccaaccaccatggcaaaagcgcaagccgaagtacgtaacaacctacaagggaagccaagcgtaactgaggacgacctggccgacctcaagtacatgaggctggtcatcaaggagacgctcaggctgcatccatcggtgcccctcctgctgccgcgcgagcccatcgaggcgtgcaaggtcctcggctacgatgtgccgacgggcaccactgngtntgngaacacgtgggcgatctgccgggaccccaagcactgggatgcccctgaggagnnncggncggagcggnncgagggcggnaaagnggactnnaagggaa

SEQ ID NO: 46030 - DNA, 477 bp, Triticum aestivum
  Clone ID: PAT_TA_46030
aattccttgacgacagctcatcaagaaactgttggacagaaccgtcggtttcacaataaactatgagagagaggatccatacgatacgagagaactgtcggagttcccagacgtgaggctatggtttgtgaggctcgatgcctcctgcccctggtttccggtggtgcttgactggagagccggtgagctcgccaggtacgctgcaatgctggtccctcaccagatgagcatgcgtcatggtgtagtcttcaacccggaggcgctggagctgtttgggatgaagaaagtgttcctcgtctactcgtggctgaagcagcagaaccatgccaagcccaggttgaagacgggcgacatggccaagatgctcggtttcggcatcggagatgagttgtttgatttgatcgagaagtatcctgttgatgaactctagatcctcatgctgaaacagttggtgaagaatagatatcattaccctgc

SEQ ID NO: 46031 - DNA, 591 bp, Triticum aestivum
  Clone ID: PAT_TA_46031
ggcaggccggcgagcgagcgcgcgagcgatcacaatcacaatcacatcacgccgtcttccacggtgcgcggcgggagcatgcaacggcagcgcttcgggtctgacgaaggtccgggaagaaaccccgccgaggagaggaggctcaagagacccgcgaccgagtcggaggagaccggcgacgacgacgaactgcccccgggaaccaggaggaagatgaaggacacgcagcagaagacgaggccgagcggcagcaccgcagccggcgcaggcgcggcgtcgtcggcgtcctccgtccgcgccgtgctgcaggacttcctggagcagcagcagcgcctggacgcgcagcggcaggaggcggcggcgcggcacgcgcaggagcggctggccttcgagcagcagtggcggcaggagatgcagagactggagcgggagcggctgatgctggagcaggcgtggcgggagcgcgaagagcaaaggaggatgagggaggaggccagggccgagcggagggacgcgctcctcaccaacctgctcaacaaactcttgcgcgatgacttttagggagtgacacgtggctccacgacgcgtgcc

SEQ ID NO: 46032 - DNA, 561 bp, Triticum aestivum
  unsure (1)..(561): unsure at all n locations
  Clone ID: PAT_TA_46032
gcctgnggcgagctaagcgttcacgggggacacagctcaaactaccagctaggattagctaaagcttcattcgcatattacttccgcttccgcttccgctagacacacagctcgtcggcgacatggacgccatggagagaggcgagcgcacgccgctcctgcccgagagtcatggcccaaaggttcaagaggacgacagcctgcagctgcaggtgccgctcctgaagcacaagaagcgcggcggcagcaaggcaccagcagtaattctattgttcgaatgcctggagagcacggcgttcaatggcatctccaccaacctggtggtgtacctcgagaccgtcctccacggcaccaacctcgccagcgcctccaacgtcgccacctggttcggcaccagctacctcacccccgttttcggtgccatcatcgccgactccttctggggcaactacaacaccatcctcgtctccctcgtcgtctaccttcttggcatgatgctcgtcaccttctccgccttcgtgcccaccaccacggcggcgctgtgcgcggcaggtgcctcga

SEQ ID NO: 46033 - DNA, 540 bp, Triticum aestivum
  Clone ID: PAT_TA_46033
tccgttccttgttgtctactcctccctgaagctagttcgagctagttagggttagatcccaacaattggtatacagagcctcgtttgttcctgtgctcgtggccatggcgatcgtcccgcacagcgcagggggtagcacggtgtcgatgccgatgccgatgctcacaccggacaactacacggtgtgggcgatcaaggccgaagccatcctcgacgcccagaacctctgggaagcggtgtcaccagcgagcggtgcggcggtcgacacggggaagaacaagacggcgagggcggtgctgttcggtgcgctctccgaagacttgttgatgcaggtatcgacgaagaagacggcggctgaggtgtgggccagcttgaagacgaggttcatcggtgccgatcgggtccaggccgcgcggctctccaccctccgtggcgagtttgacaacctgcgcatggaggagggggaggcgctggacacgtacgccggcaagataggcggcatggcagcaaggtatgctggcctcggctcgacgctcggcg

SEQ ID NO: 46034 - DNA, 411 bp, Triticum aestivum
  Clone ID: PAT_TA_46034
tcgcatcgccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatgaccattggtattgctctgtggaaattcgagaccaccaagtgctcctgcactgatattttatgctgctggacaccggtatctcgtggagaacatgatcaccagctacctgcca

SEQ ID NO: 46035 - DNA, 391 bp, Triticum aestivum
  Clone ID: PAT_TA_46035
aaggagctcatcttccacagggatttcccttacgtggagcacttcagagaacattgggcgggtacagcatcgacaggttcgagaaggtgaagcccaagatgatccaggcggtggacgacatgctcgggtacgacatcccggagctgctcaagaacttcaggaacccttacgagtgagcagacatcatgatggaaagaccggcttcggtctcaggcgtagatggtggtagccagtctagtagggtattttattgctatattgtacccattgctgtgtaactgtatgcataagagccagaagcaattgctcaattgttggctggagaacggccttgttgtaatggcatggaaagaattcggaatatggtatggtggggtggtcgcgttgatcc

SEQ ID NO: 46036 - DNA, 568 bp, Triticum aestivum
  unsure (1)..(568): unsure at all n locations
  Clone ID: PAT_TA_46036
catctacttggngatagcctcagcacgcaatgggttcacaaatcgcagagcatgaagaattaacgtgctcgtcacgggctttggtcccttcagggagcaataccccatcaacccttcgtgggagatcgccagcagtttgccgtcacacctgccaccattgcgcgccaaagaccctaactcgaggcatgcggctattcttctaccaaacgtgcgcatctcggtgcacccagagcctatccgagtgaactaccaagtcgtgagaggcctagtaccgtcgttctacgatgcaacacggccattcgacgttgttatccacatcggcatggcgggtccgcgaccattctactccatcgagaggagaggttaccgtgacgggtacaaacaccccgacgttgatggggaatntgttgactcggaggaagaccgccaaaaggatgactggccatggcgaggactaccagaggagatagaaaccgagctggatctcgaccaggntctttctctatggcaagggcacagttcagagtatgatgacgtccgcatattcgaagacgccaggcacctactt

SEQ ID NO: 46037 - DNA, 506 bp, Triticum aestivum
  Clone ID: PAT_TA_46037
cgccgccggcggcgaggctcggacatgtctccgtggacaaggacagaatcagggggctctagctgaaggggaagaacgggcggatgttctgggacagctaagggaccttacgggggcgttcgacctcctacgtgttgtctagggcaccgtaggtgcactcaattggctgtccaagatacaagtggtgcacagctaaatcgctagggtgctcaaagtgatttggcttgaaacaacatgcggctttgagggaggggtacaataacaagcgaggtcccgatcgacctgcgttccaagaagacccgcaccattcaaaggcgaatgacacaccacctgctatgtttcattacaggagggagaagaagcgctacagtccttgcgaatgatgaagtatgctatgaactactacgctatgatgacattttttaccgttcgttttttgctaagaaggtgcgatgaattcctatgaagttgtaagacaccggtgttatctaaggactatgaattag

SEQ ID NO: 46038 - DNA, 526 bp, Triticum aestivum
  Clone ID: PAT_TA_46038
gcacggcagcaccaaacagtatattacggcaagttggagcaactcctcaatacatatatccaggcacaccggatgaaaaggctaccaaacaaaacagaaaactccacaatgtgctcaaagcccacccacctggaaaatctcttccatttgttcacagctactcaaagacacactcggcagttttcaatgagaaaacaatttattcgagacgcaaagccgaccttcagattcccttctccagcatcgcgcggacccgggtggggaggccgtacagcctgatgaaaccttccgcgtcagcctggtcgtagatctccccgttctcgaacgacgagatgtcctccctgtacaggctgtaggggctcttccgggacgcgaccgtcaccgaccccttgtacagcttcagggtcaccgagccggtcgtcgtcgcggtgatggtctccatgaaggcgtccatggacagccggagcgggtcgaaccagcgccccgcgtagacgagctccgcgtacttgagggccagcatgtcctt

SEQ ID NO: 46039 - DNA, 263 bp, Triticum aestivum
  unsure (1)..(263): unsure at all n locations
  Clone ID: PAT_TA_46039
gcgggnagcgagnacaatcacaaccccagccgcctcatgccaccgttcgccagcagtagttgattcgcctgcccttttaattagatcgtgttaggtcgtttgcggtgatgcaaacagatgcttactgtgaaattgttggttaatatactgttgatcgaccattatcgatgtatgcaattctgaggtactgtgaggttgatgcctcctgttctctgaatcctcatgtgattttcgttcactgaatcctcttgtgattcctgttc

SEQ ID NO: 46040 - DNA, 591 bp, Triticum aestivum
  unsure (1)..(591): unsure at all n locations
  Clone ID: PAT_TA_46040
cgtttgtngattagntatcatcaaattgcgaccgtcgattgtgtttgcgaccattgcctcccagtgcttacttgtcgctgcgcgtgagaataatgacgcacagcattgggaagcaagtgccattgatgcgcacataaatgcgaaacatccgcaccaggatccatggcaaaaggtccgctggtagaacgatggcgacaatggatgcgacgacaagatacgagcgcaacagacgacaaggaaacgtcgacagaagcaaagtctgagacgagagagacgacaacagaagacaaggctacaactactgaggacaaacaaacaactacagaagataaaccgacaacaacagaagataaaccaacaacaacagacgagcctgtgtcaacgaccgaagagtccactacagaagcgacgtcgactgagcaatcttcttcatcatcaataatctcatccacagagacatcaagcgacccaacatccacatccacatccacatccgcatccacatccacaagaagtaccctcacgtctctagcgcagggagcatcatgctacagtacaaccgtctcaaccagcgtcgtctgccacatcaca

SEQ ID NO: 46041 - DNA, 565 bp, Triticum aestivum
  unsure (1)..(565): unsure at all n locations
  Clone ID: PAT_TA_46041
ttccaggntcttcaggtcagttgctcctatctggacgagctttgtcagggtcatgtggttgctgctgctacctctttgtcggggtcaagggtcaataaaactcagatccccaaaccggaaccctggctcctctctctgctcggcaccgcctacaccagcggcttcgacagtcaatcctcagcgcctgtcgcaacaaagctcgggaaggagtgtgattgtactgtgctagcagagtaaaatactggaacgctctgactgctcctggacttccaaggtgatgctgggagattcgttctgccactttgcctatactccgcctgatcaccgttcatccagagaaaaggagaggaaggggatggatgagcaaggaccagaaggaccagaagaagaagggcaagggagatggggcgatgtgcatgtccatggaggggaaaattctaatttctttaccagcggtgtttgaaaaaaatggcatanttccgtgggnctggatgatagaaggacatttttgnttgaagcactcaagaaggagtaatanctattgtgatgccaacacatgctgaat

SEQ ID NO: 46042 - DNA, 486 bp, Triticum aestivum
  Clone ID: PAT_TA_46042
cgccggcggcgctcccctcgccgccgcagcagccgcagccatggtggcgcatgcacaggtcgcgggcaagggcatcctcctcgagccgagctgacggacaacaggactccgccgagctgggtcgagaccggcgttgcccatgttgacgagtaactcacccacgccgcgaagaagggcctcatgccggctcagcatcggcgatcctactccgtgaccaccacggcctccccctggccaagagcgataccgttagcaagagccctcgcagcctcaaggcccaggggctgccgccagaaataccggaggacctctactgcctgatcaagactgcggccgcgataaggaagcacctcgagaggaacaggaaggactaggactctacattgcgactcatccttgtcgggcagcaggatccaccgcctggctcgtgactacgggcgcaccaacgaagctagcctccacctggatgtacgagcctaccaccgg

SEQ ID NO: 46043 - DNA, 487 bp, Triticum aestivum
  Clone ID: PAT_TA_46043
cgccaatttactgcggggatcgcgtgagcgaaaaaggaaaagagggctcagactggcaattactggttctgaaaagaaaggaaatcgacttctttcacgatggcgtaagattaagaaagatggtggcagtttcaaacgacagggggaggatgttgaacaactgcaccagtacctactacctacctacattacagcaccaacaagctctcaactttacccacctacctcacctaccttctcttctcaaggatgaatcctagtgacggttgaccctggaggttagccacagtcaccgcggaccacagatcatccgaaccagatcagacatggtcagcattgactcggtgtcatggcctgggcgcgaagagccgaggctggctgagccctgtacacgaccaaaggcatactgcacccttaataattccagtcgctctgcagctaaactggtcgggtcttggcagtgtcatggcattttgagaaagtgagg

SEQ ID NO: 46044 - DNA, 612 bp, Triticum aestivum
  Clone ID: PAT_TA_46044
gagaattgaattacatcttatttcattatcacgtctgattcggtattcaacccaattcaatttcatactctccaatatcgatgtccaaacgtagcattaaggatgtcatgatacaacgagttaacaacgtctagattcaaacgatattttcaaagaactcgttttcttttaaaaattgtgacaaggcaatgtgactgagatggaagagcggcattgcaggattggaaaggcaggctgccgttctgcatcagatctagggtgtggtctcccctgcctcactggttgtgatggcttctactacggcatcagaaagttctctacggtgagcagtgtagcagtgatttgctccctcgatgacacgcagcttgtggtttggtataagccttgcaaactcatacgcatcttccacgggtatgatctcgtcagctgaaccgtgaattgtaaagaacctgcactctttgctgatggaaaggctcgttgcgtgcaaatcatggctcagccgttccatcaagctctccttggttactctgtacaaaacatttcctgatttgtctttggcatcgatgtagccttccttgtttattctatccataaactctttgcctaagcgct

SEQ ID NO: 46045 - DNA, 382 bp, Triticum aestivum
  unsure (1)..(382): unsure at all n locations
  Clone ID: PAT_TA_46045
cttcgcctgatcggcgccacaccgtgtacgttcgccgcgtccgcaccaccacgagcgcgagcgcgagaccgatggccgtcgccccgtcgccgcggcgaggaggccgggctcgacgcgggcgcggggcgggctggtggcccgcgccgtagttgcagccaagggtgaggttgcgagctccgatacgggcggtcatgaggttttgatgtttgaggcccttcgtgaagccatgatagaggagatgactttggatccaacagtgtgcatgattggtgaagatgtcggtgactatggaggttcatacaaggtatccaaaggcttgtctgagatgtttggagacctncgtgtccttgatacccctatcgctgagaattcttttaccggt

SEQ ID NO: 46046 - DNA, 589 bp, Triticum aestivum
  unsure (1)..(589): unsure at all n locations
  Clone ID: PAT_TA_46046
atcttcccccagnagacaaggttagnccggaacgcctggtgcgtcggtggattgcagagggctactcaagggagttgcgtggcaagtccgcggaggaaatagcggagagctatttcatggagctcataagcaggagcatgatcctaccatctcaagaatccattcatagtagaagaggaattgactcctgccaagtccatgatctcattcgtgaaattggtatctcaaaatcagcagaggataatcttgttttcacattggaggaaggctgtggattaaacaaccggggaacaatacgccatcttgccataagtagtagctggaagggagatcagtgtgacttcaagagcatagtggacatgtcttgtataagatcattaacggtgtttgggaagtggaggccatttttcatgtctgagaagatgaggttgctgcgagtgctggacctagaggggacatcaggtcttgttgatcatcatcttacgggcattgggaagcttcttcatctaaggtacctttctttaagaggatgtgatgatatttatcacttgccagactcattgggtaacctgaggcagctgcaaacact

SEQ ID NO: 46047 - DNA, 436 bp, Triticum aestivum
  Clone ID: PAT_TA_46047
aagaaaaggcgggcacaagagcagcagtgatgaagttggcggtcgtcctcctggccatgagccagctcgtccacatggcgaccccagcggcggatccgacgactgagtcgtctctactggtcacgagcgtttccggcacttccgaggggaagtcgatcctaaacccagccacatcagggaagagaaggtgttgctctatgcgcccaagcccagcatccctgtccctccaccccctccccacctcgtcctaccgtgcaagggaagagcgtgttgacctcacggccgggaacgatcaaagtcaagtgcagctggagctccaagtgaccaaaacaaaaacaacaaaagtccctagcttcctctgtattgcattcaatgttgactgccgtactcggtcgttatgatcgactgatggaataaaataagcgcgaccttgttt

SEQ ID NO: 46048 - DNA, 451 bp, Triticum aestivum
  Clone ID: PAT_TA_46048
gtggggatttcgtaggtgtgaggatgtttgctgggtgaaaaccaacagaaaaagcatcatcaggtctgcgacatgattctcgtacattgttgcagcattcaaaggagcattgtttgatgggtataaaaggaacggtacgccgtagcactgatggtcatgtcatccatgcgaatattgacactgatataataatagctgaagaacccactgatggtatctatctcgtagctgccattgttaattctcattattattattcgttttatgatatctgtcttctaaactgtgctgaggccacttttcctttcctatcttgttcctgtatgaaattaaattcactgttttgtctttgttgttgtcatggtatgaaatttatggtttggcccatgaaagtggagtatgatttttaaagaaattgacttgttgatacaagcatattgcatctggctta

SEQ ID NO: 46049 - DNA, 574 bp, Triticum aestivum
  unsure (1)..(574): unsure at all n locations
  Clone ID: PAT_TA_46049
gcaagctgacgcggcggtgctngaagagggcatcgacgcgacggggcggttcgacgtgctgtccaaggcggacggcgtgccgttggtggccatccggctcaaggacagcaccaacttcagcgtgttcgacatctcggagaacctgaggcggttcgggtggatcgtgccggcctacaccatgccggccgacgcggagcacgtcgccgtgctccgcatcgtcatccgggaggacttcaaccggagcctcgcgcagcggctcctcgccgacatcaacaagatcgtgcgcgagctggacgcgcacgccgtccacgccatcaagctgtccaacgccgccgccgccgagggcgcctcgcagagcaccgtggacgccgtcaccgaggccttcaagggcctggccgggaacaagaaggccggagtctgctgatggccggggtggtccttgctgagacgcctggctggcgccttgtttctttcatcacgtctgtctatgttgtatcttgcattgtgtaattattgtggaggggtgcatatgtgaactgtcaagacctgcctcctccttattttgtacgtacgc

SEQ ID NO: 46050 - DNA, 604 bp, Triticum aestivum
  unsure (1)..(604): unsure at all n locations
  Clone ID: PAT_TA_46050
ggagnaggaggaggaggaggacgagggcgagggggatgggcaacacgagcatgggcagcacggcggcaacggggagtccgtcccgatggacgccgaggccgtggcacaggctgctgctgcagctgcggccggcgcaccgttggacccgcacggggcgatggtctctgcgattgtgccgcccgccacgggtaaccagctcaccctttcatttcagggcgaggtctacgtgttcgactctgtttcccctgataagtctttgattgctgtcgcaggtgcaagctgtgcttttgctgctagggggaagggagctgaacccaggcatgggtgccggagcatcatcatctactccatacagtaagaggttgaattttccacaccgggtggcatcgttgatgaggtttagggagaagcggaaagagcggaactttgataagaagatccggtatacagttcgcaaggaagttgcactaaggatgcagcgtaatagaggccaatttacatcttcaaaaccaaaacctgatgacggaacttctgaactggcaactgcagatggctccccaaacttgggatcagtggaaggtcgacctccgtctgctgcttcttg

SEQ ID NO: 46051 - DNA, 573 bp, Triticum aestivum
  Clone ID: PAT_TA_46051
cccggtcgcccagcgtccgcacacttgcaggccgcgaccctgccagagcagagacacgtcggtgcatccatccgtccatggcggccaccgtcggcaaggagagggaggaggcggtggtccacccgaacgcgaggcaggggggcaagctcctctccaggctgctcaccagggacagctcggccgccgcgccgtccttccgggtctactacggcgtggcctccgccggcgcggtgccgttcctgtgggagtcgcagccgggcacgcccaagaacgccgtctccgacgccgcgatgccgccgctcacgccgccgccgtcctactacgccgctggaggcaccgccgccgcgaagaagcacgcggcgcgcaaggccgccgccgggggcaagaggttcaggccgtcccgcatcctgggctccatcctcatggcgacgcggaggcggggccggacggcgccctcgtcggtatcgcccacctcatccttctcctccggggtcgtcctcgtcctcctcgacgtcgtccttccgccgcgcgggcggcagcagcagcaggctgcactcgtcgtcgtcgtcgtcg

SEQ ID NO: 46052 - DNA, 560 bp, Triticum aestivum
  unsure (1)..(560): unsure at all n locations
  Clone ID: PAT_TA_46052
ggcgaccggcacatgcatcgacagccgggagncgggctcctcacctcctgcaagtgggaccctcgcctgggggccaccttcatctacaacacggccatcagcgtccctctccgcaacgccgcggcgttcgtcgccgacgtgaagcgcctccgggacctcaacccgcgcacgttctgcagcctggacgcgaggggcggcctgctcgcgcgctacatcagggcgtcgtccgcctacctcggcaagccggaggacgcggtggacttcgacatcacgtactaccggagctacaccgccggtgcaccgcgagcgcacgcggacgtcatagacgagctcgagcagatggcgctgcacaagtatggaggcttcccgcactggggcaagaaccgcaacttcgccttcgacggcgccgtgggcaggtacccgaaggccggcgagttcctggaggtgaagggcaggtacgaccccgacgggctcttctccagcgagtggagcgaccaggtcctcggcatcaacgggacgagcccgagcgtcgacaagnaaggctgcgccatggaagggct

SEQ ID NO: 46053 - DNA, 555 bp, Triticum aestivum
  unsure (1)..(555): unsure at all n locations
  Clone ID: PAT_TA_46053
gggnaagctgagtcctgggttggtccaaagggcaatactatcgagagctgccttgccctaactgtaggggtagaggatacactccttgcaaaaaatgcgggatagatagatccagcttggattgccctatgtgcaatggcaaggtgacccttcccaacctcttgtaaatcgttctgaaagtaaatacatgcacttttgaggaatttatcagtctattgttgtgcatacctaggggattaggatgtgtatgcaatgtggtggagaatgtgtgatatggcaagaatctattgatgaacaaccatgggaggaagttcgatctaggtgacgtttgttctgcatctcttccatgtagtcaacagttacctgtttttttgtcacactgcttgtcgaaagatctcctgttgacaaatctctttaatggtttgattaaatggttgttacgacttaaattgactattgcccatcaccatcatcaattgtaagtacatatacacatttcccattgttttaaaagaagtaatgatagatgataatggcgttttgacatagtgatga

SEQ ID NO: 46054 - DNA, 599 bp, Triticum aestivum
  Clone ID: PAT_TA_46054
aagaatcctccccccccacgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatca

SEQ ID NO: 46055 - DNA, 585 bp, Triticum aestivum
  unsure (1)..(585): unsure at all n locations
  Clone ID: PAT_TA_46055
tcccctcccccacccgnaccccgntcccccncactcaaatgcaaacgtaaaactccgcaccagggggnnaaaggaaaggnagaaaacctaccgccccgaccgccggccgtgggcggcggggtcggcggcgaccgggcggcggggggctgcggggtgtgcgccatctgcctcgacaggatcccgctccaggagacggcgctcgtcaagggctgcgaccacgcctactgcgtcacttgcattctgaggtgggcatcctacaagcagacaccagtttgcccccaatgcaagcacccgtttgagttcctcagtgtgcatcgctctcttgatagctgccttcatgactacatgttcgatgagagcgtctgtcttcttctgagagccacttggtttaagcctctggctgtagaggctcacgaggaggctcaggaggaagaagacatttaccgcagttaccaatatgactatggcgatgaggatgacctttatgaggaatacataagcaggtcaccgagcattcgaattggtaacaggaggtggggtgacaatgggtacgtcagaggggggcggagggaggccaggccagta

SEQ ID NO: 46056 - DNA, 572 bp, Triticum aestivum
  Clone ID: PAT_TA_46056
ctaccaaccaacaacatgccttctttcactaccttcgtcgctgccatcgctggatgctccgccattgtcaatggcgctgctatccctaccgagagcactggtctccagactaccactctccatcgccgagcggtcactaaggagcatcaactgagcaagcgcgagcccgtcactgtggctatcctgactgcggctggtaccgcagcagtcactgccatcgtcaacgaggctgtccaggccgccgtcggtttcatcggcgacatctccaactttgatgccggtcgtgaggcattcactgtccagaccaccgaggccatgatggccaacaaccccgaccctgaacgtttccaagctgctgcttgctacaacaaggccttctccgtcgctgaccccgccaacatcgatggccagtcctctgtcaagttcagcctcggcattctcaacaccgactacgagtgcatgtacattgctgcccccaaccagttcttcaccgagggtgacggtggcttgatcaacctttccttcacccacaccgaccgatgcactttcgattccgagactgctgatctcac

SEQ ID NO: 46057 - DNA, 527 bp, Triticum aestivum
  unsure (1)..(527): unsure at all n locations
  Clone ID: PAT_TA_46057
ccgccccgccccggnatagcggcagtagaaaaccgcccgcccgccattcccatccctccctcaattctcatctccctctcccctgccgcggccagccgcccagccgcggcgccccgcccccaaaaccctagccccgcccgccgataccccgccaccgcgctctgcccggcctcgcgccactcccgcccgcctccgcaatcaatccccccacccacccacccacccaccacgccgcggcagtccccgcggcgcgctcctccatggacgggtccaagggcccgagcgacggggacgcggcggaggacgcgggggacggtaacaaggacaggacgcccggcgggcaggaagcaggcgccggcgcctccgatgccgttctcgccgccgggtcgttcaggatcaccgccagcgacggcagggcgccctgggcggcgccgggggccaagcccaaggtggtctaccacgatcccagcatcccgcgcccgcaggacgtgtacctcatcagggtcaacaactgcaactcgcccttc

SEQ ID NO: 46058 - DNA, 586 bp, Triticum aestivum
  unsure (1)..(586): unsure at all n locations
  Clone ID: PAT_TA_46058
tccggtgcttcattctgnaggnacatctggtgaccccaagttagtaagggagtgnncctgcaaaattgnancatttntnctnccgtnccggnaccaaccctttcccaaactgnaaacattagnaaacaggnagaagnagatnatggnaggaaaacaaatcttgatgttaggcacaaaaccaatgctacaatcctacctgacaanaatcaagctcaaccaccttccctgctgcgtactgttgacagcagcagagatgatctgcacaactctgcttcagttcatgatggttcatgtggagctcacggagacattcacaccaggcaggggagcgtgtttatgaccgccaatgctgtcagaacagattatctctccctggaggaagaacgcagaaaatctccaagaaatagtcagcagatgcggtccaacgggccttcctccgaacctgaggctgcccaaactacggaggggacgcaagttgctccgggcacctccatggtaagaaaatgggttctctgttgacgatggagaaaaggcgttcggaaggccggatggaaacaagttttcttgactgccgcctctgcttccg

SEQ ID NO: 46059 - DNA, 601 bp, Triticum aestivum
  unsure (1)..(601): unsure at all n locations
  Clone ID: PAT_TA_46059
ccaccggntagnacatcaatccagtccactttctcagacaaanacagactagctaacacgtcgacaaggtgaacgtagacgtagacgtcggccgtcgtcgcagcctcgcaggggaagagaagagagatgggctcgtgcgtctcgcgatcgacggcgtcggtggaggggtccgggcgggcggtggccacggcgaaggtggtcggcccggacggctctttggcgcagttcgcggcgcccgtcatggcgggcgaggcgctgggggacgccgcccgcgcgtcgagcttcctgtgcagcgccgacgagctccgcttcgacgcgcccgcccgtgcgctggcggccgaggaggcgctgcagcccgggtggctctacttcgcgctgcccatgtccatgctccgccggccgctctccgggcaggagatggccgccctcgccgtcaaggccagctccgcgctcgccgtcgccagcggtaaggggcggaaggcggctcgggtggcgccgttagtcctcgctgacgatgagggcaccggaacagaggacggtggatggagtcgccacgcgtatggaaaaagcgatgcgctcaaaaccgtgcacggcggcggtg

SEQ ID NO: 46060 - DNA, 570 bp, Triticum aestivum
  unsure (1)..(570): unsure at all n locations
  Clone ID: PAT_TA_46060
cagnaaacccagnatatcatcactctccaaacctgtccccaacatgtctccccctgctgccatctcccctacttcccgctctgttgagcttgctacctctactaccaagctcccagtccatgcggtcaagaacatcaacaccaagaccgttgaggaaatgcttggcaactgggatgacttcaagttcgcccccatcagggagagccaggtctcccgcgccatgactcgtcgctacttccaggacctggacaactacgccgagtccgacattgtcatcatcggcgctggatcctgcggtctgagtgccgcttacatcctgggcaagaagcgacccgatctcaagatcgccatcatcgaggcttctgtgtctcctggtggcggtgcttggctcggcggacagctcttctccgccatgatcatgcgcaagcccgctgatgctttcctccgtgaggttggtgttccctacgaggacgagggcaactatgtggttgtcaagcacgctgccctctttacctctaccatcatgtccaaggtccttcagatgcccaacatcaagctcttcaacgccac

SEQ ID NO: 46061 - DNA, 609 bp, Triticum aestivum
  Clone ID: PAT_TA_46061
ctggtgtcagccgcgtcactgtaaagaaagcaagaattactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatcttgaatccagagacgtctggcccgggacaggaggacaatgatgaggaggtcgacgaaactggtgttgaggccaaggacattgagctggtgatgacccaggcatctgtttcaaggcccaaggctgtcaaggccctcaaggcttctaatggggacattgtcactgccatcatggatctgacaacctagggtgatatttctgtccgtgccacttttgttttggagtgctattgcaacttgagtgttatatgtggacctatgcttcgatgatgttacatgattgcttcttgggtcaaggtcattcaaacaaggtttcatctttgctggcttgaaacctggcagtagtttatagcccagaatgtttgtctgtggttctggtgtttcagtaatgtcacagttatcaatggctcttaagtttctgca

SEQ ID NO: 46062 - DNA, 584 bp, Triticum aestivum
  unsure (1)..(584): unsure at all n locations
  Clone ID: PAT_TA_46062
cttcgtcaacccgaactggcaacaagttccagattgttggtatggcctaccaacctggaggtagtgccggttacgaccctgccacgggnaaaggaccctttgagcaacaaggataagtgtatgcgagatgctgctctcatgcagattcttggtatcaacgccatccgcgtctacaaccttgaccccaatgtcaaccacgatgagtgtgccagtatcttcaatgctgctggcatgtatatgatgattgacgtcaactctcctttgccccacgagtccctgcactccttggcaccatgggaaagctatcacgccgactacctcaaccgcacctttgccattgttgaggctttcggaaactaccccaacactctgctcttcttcgccgcaaacgaggtcatcaacgacgagaagacggctgaagatgcccctcagtacattcgtgctctgacccgcgacctcaagaactacgtcaagaacaacttgaagcgcaagattcctatcgggtattctgccgctgacgttcgggaggttctgtgggacacctggaactatttgcagtgctctgaccctgaaacgagggtgac

SEQ ID NO: 46063 - DNA, 556 bp, Triticum aestivum
  Clone ID: PAT_TA_46063
accacgtagccgtagcgacagagagagatccaagtgccttccgccacctagcaccaacatcacatacacgaacatggcgcgctgggccattgccatccacggcggcgcgggcgtggaccccaacctgccggagcaccgccaggaggaggccaagcgggtgctggcccggtgcctgcaggtcggcgtggacctgctccgggctggcgccacggcgctggacgtcgtggaggccgtggtgcgcgagctggagacggacccctgcttcaactccggccggggctccgcgctcacccgcgccggcaccgtcgagatggaagccagcatcatggacggcaacggccgccgctgcggcgccgtctcgggcgtctctacagttagaaacccggtctccctcgcccggcgcgtcatggacaagtccccccactcctacctcgccttcgacggcgccgaggatttcgcccgcgagcagggcccttgaggttgtggacaatagctacttcatcacggaggagaacatcggcatgctcaagctcgccaaggaagccaacagtatcct

SEQ ID NO: 46064 - DNA, 590 bp, Triticum aestivum
  unsure (1)..(590): unsure at all n locations
  Clone ID: PAT_TA_46064
tccgatcaaaagctgagctctctcatcaccaagcggtggatcattgcgacgatgctcaagcttttctcctcgcccgaatgggttgaaatgattttagtcattagcaaggtatgcgatttcacacacctcgactcgctctcgacctttcatgatgaagcggcactgggctccgaaatataccccatgagcacgaaaagccattttgcggcaggcctagaaaacctcgcccactgactcgtcacgctctaccttcattttgctggatgtcgtcgagccactgaggctaacctacctcgagtgccagtgtactatcacttcaatctgtgtttgcagccatgcgtgcatttctaaattgtagatcaaacgtgagtagccaactgttcccagcatttgcaccgtatcatctctatgatgatccaaaatgaaaacgacaagcatatgtccgagctcacgctacgacgataactcatttatcgactgatcgagatgcttcacgtcacgtcaatgcagtctttacaacgacagcggctgacatttcgaaagcatactcagctatactcatcacttctcgactcacattntatatcatg

SEQ ID NO: 46065 - DNA, 566 bp, Triticum aestivum
  unsure (1)..(566): unsure at all n locations
  Clone ID: PAT_TA_46065
ccgnccccgtcttctgctcctccgcttcctgcggcgccggccgccggccggcctcctccaaatccgtacgccaagcgggctctccctccctttcgaccttctcccctgccgcagacactgcccccgtgatcccgtgcctacagataatttgactctgaaaggtgacggctctggcctcggagtgatctgacacctaaaggatacaggcgcccttactaccctgcttcaagtaaagggacaacaaagcgatttgttgtcccgttgttttgagctggaaaacccccggtatggctgatgccagttcgaggactgacacatcgatagttgtggacactgacgataagaatcaaaggattgttgtacacatttgctccagtgcctaaagaaacaacacacttcttaaattagatatcaacttgcaaaagtgaacaggactactgctgctgcactatcagtttcgtcagatggaaaacggacaaaatggagctatcgtgccttctaattcatctgaaccgtctgacaggtccgacaggcctatggaccaaaaggtattgcggaggcttgcc

SEQ ID NO: 46066 - DNA, 587 bp, Triticum aestivum
  unsure (1)..(587): unsure at all n locations
  Clone ID: PAT_TA_46066
gtacgatgacctcccanataggggaaaatgttggagtggacgcgcatcatgtaggtgaaacgggagagtttgtggtcatagcaactgtgttcttcttacagttttccttctctgaattgcatctttggtacatctatatttattatttaatagcatggagagaaagttgtcatcggtattttcatcagttatgcaattgattctgtacagaggaaatgtatgcactcttttctcattcttttacaatatatcctccttttgatgtcttatcgaaccaacccatgcctcagcaatgacacacttgaggagtctgaactccgaaggaaggtgacgacgagttgaacccatggaattatgagacacctgatgatgtgtcaaaacctgtcctgcaaaataaaggagcgttgaggatgatggctttcatgttcgcttggatgatgctggttccgtggtggcctttgatatgtcagaccatgtgcagctccatagatgacaacaagcttggcctgtcttttcatcgagttttgttgagcaactgaaatttttgtgcttgccggcgtgtctttttagcatcactttttggtcat

SEQ ID NO: 46067 - DNA, 600 bp, Triticum aestivum
  Clone ID: PAT_TA_46067
cagcagaaagaaacgttcataagttaaattgaaaaacctttgagaagttcaaaaaacccgcagtaggaactgccctgtacatgcatccatgtctgtcagaaatgtcagaagttgatgctacagatagggcttccagattgacagatgtcactgttgatagtctggtccagtctatcatcgtggccgacggtgtgaaggccagattttgtcggctagggcgcggtggcactggggatagtatcgctggccccgtttggcgtcgcaagtgaaggggaggaaggactggaggctcttcttcaacacgctgttctggaacctcgactagtgggatcggccgttcccccgggcgctgacggtggcggttgttctgatcgctgtcaattacctgctgctgcttatggccgccaccggcgccacggatgcaccaccgggtacctgggtcattggctacttggccgatgccgcaggcatcatcgggggcccatggctaagtatcggaaggggggcggcgcgacgatctcctccatcggcatgtttaaagcccagatgagcagtggctcattccagctcctcgggatggcggaactcagtcccctcccg

SEQ ID NO: 46068 - DNA, 566 bp, Triticum aestivum
  unsure (1)..(566): unsure at all n locations
  Clone ID: PAT_TA_46068
cccagtacggcaggggcagggcagggcacgctccgttatccaatccggcgtcctgcacgcacaccatgtaggccacaagatctcagatagcttatgtcattggtggtggcataagctaccagtaccagctgcatgcctgtgctcttcttcgcttggagtgtgccctcggccatggcccgtgggcgcgtacgcagcaacccagggcatggatccggcgttggctagctacctctggcctgcatcaagctgcagctggctaggctgcttggtttcttgaggaagctcggggtgaaactgccatggctggccggcaggggcggcctcgtccacggcggcggcggcgacttctcacctctactaaggtagggcaacttctatcctttggcaattgtgacttctcgatcggtagttgggcgtgatgatctctctcctccgagtagagcaccggtnggagatcatagcacggntgcacgtgtgtgcgtatcctctgtatcgtcgtgtaactactagctagctataccaagttgatatgaagctagtgtggttgtattgtgtgatcctgcttg

SEQ ID NO: 46069 - DNA, 576 bp, Triticum aestivum
  unsure (1)..(576): unsure at all n locations
  Clone ID: PAT_TA_46069
cggccgcgtgggcggncgcgtgggtttcaacccaaaatatccttatctttggcgcaacagtaccatcggccggtacatcaccaagcgatagcaaagctcagcccgcgttcgaccaagtcaccatctttacttctgaggacaccgttgtcagaaaacagactttattgaagagctcaagtcaaagaagtcaagatcatcacaggagatataaacaatgaggaagacgtcaagaaacatacaaggtatcgacactgtcgttagtgccgtgggcagnaaacgtcatcgagacgcaaatcaacctcttcaagatcgcggcagaatccgactctgtgaaaggttcttcccttctgagtacggtaccgatgtggagtatggccctcagagcgccgacgaaaagccacatcagctgaagctcaaggtacgaaagtacatccgagagaagcgaatggcctcaaatatacttttgtggttacgggaccatacattgacatgtactttactctcacacccggggtccctgaagcagggggttttgatcatattggaaaaaaggctgtctttggttgataatggaca

SEQ ID NO: 46070 - DNA, 494 bp, Triticum aestivum
  Clone ID: PAT_TA_46070
ctcactgaccctcgccttcgccccaaaacccttgttcccctttccttctccagcggcggcggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaaacctttgttcctttgtactttccaagatgctgtttcttacgtcagtgcttaggaggtgaaaggactgttagtgtgaccatgcgtttctactatgtaatcttcagggctatattaaccaacaagtctatgcattctccagtttcaaacttattatgctccaagcgttgaac

SEQ ID NO: 46071 - DNA, 436 bp, Triticum aestivum
  Clone ID: PAT_TA_46071
gtgcggcgagccaggcgcttacgcctgtgacgacccgtcaaaccactggaactgggacggcgtccacctcacggaggcagcctacggccacatcgccaagggatggctctacgggcccttcgccgacccgcccatcctagaggcatgacaacgttagaacttagaagtgatcacaaaatatctcatgcatcgggacatatgcatctcaattatcgattagaacttttagaaaataaatcataaaataagggtgtaggcacagcagatattttgggtgtgtttggtactttggtagcatgtatggacctggccgcccagttgttctcctctcatacatgctgagtgcagacatatgcttagtccatgcatttgctgttgttcggcaccgatgtatgcgctgagacattctgaattgagactttgtttggtagcctgc

SEQ ID NO: 46072 - DNA, 582 bp, Triticum aestivum
  unsure (1)..(582): unsure at all n locations
  Clone ID: PAT_TA_46072
atcgccngagccggggcggcgcacgaggccatcgagctggagctgtcctcctggccctcgtccccgagcggcaagagcaggcgcgtcacggagcttgtcatggcgctgctggcccggctgtgcgcgtgcgcggaggggcgggcggctgtggtggcgcaccccgcggggatcgcactggtggcaaagcgtgcgctgcgcgtgtccgcggtgaccgacacgtccgctgtgcgggtgctggcggcggtctgcggcagggcggcgtcgccggaggtggtgcgggagatggcccgcgtgggcgcagtagggaagctctgctgcgtgctgcaggcggactgcgaccgagacgtgaaggaggcggcgagggccgtgctgagggtgcactccggcgtgtggtgcgggtcgccctgcgtcagcgcctacctgctctctaggtacctctagttagctgccatgtcacacttgcactggtgcatggtggaactggaacatgctcgttgcgacatcctgttggttaattggatttgttggttccttgatcaattcttgctggtttgtaagagaaactgaagttgaaatcccaaa

SEQ ID NO: 46073 - DNA, 583 bp, Triticum aestivum
  Clone ID: PAT_TA_46073
ggatcacatttatcggcaccgctgggcgagttcctcttccacctcctggctctgttccccaatccccccttcttcttgctgaaaccctagctactccaatttgtatcctggatggatctggtgttccggagttgagaatcgagtgatagttacctaggaccgtatcatccgcccatcttccggttctcgtggcagcggcggcggcggcggcgacttaccggccagcgccgacgacgcatggctcccaagaagaagcgcaagagtgcgccgccggagacggtgagcaccaccgtccacgacctccccgacaatctcctccagcacgtgctctccttcctcccagcgcaggagtccgttcggacttgcgtgctcgcccggcgctggcgccacctttggaagtccaccacaggcctgcgtatcctagaccttgtccttgacgatgatgaggatatctcattccaagacctccggaagttcgtcgaacatctgctgatgctgcgcgagcgcaccgacctagaaagtgttgagatgaaattccactgttactacgaaggcgaatcctatgtgagcctatggacccgtt

SEQ ID NO: 46074 - DNA, 608 bp, Triticum aestivum
  Clone ID: PAT_TA_46074
atccattatgcgaaagctgtgaagatgatgggcaatcgtgttaatgcagttaaccttgacttctctgagatacttccagaagaagtggaagcagagctgaaggaggcagctgtaatttccatgggaacagaagtcaatgatcttgacctctcaaacattagggaactgtgtgatcaagtcctggctctttctgagtacagagcccagctctatgactatctaaaaagtagaatgaataccattgctcccaacttgactgcacttgttggtgaacttgttggcgctcgccttatttcccatggtggtagtttgatgaatctggcgaagcagcctggcagcacgattcagattctgggggcagagaaggccttattcagagctctgaagacaaagcatgctacaccaaagtatggtctcatctatcatgcatcattaattggacaggcggctcccaagcacaagggaaagatctctcgttcgcttgctgctaagagtgcacttgccataagatatgacgcccttgctgacggtgacgataactccatgggtcttgaaagcaggatcaagcttgaaacacggctccgagttcttgagggtaaagaacttgg

SEQ ID NO: 46075 - DNA, 577 bp, Triticum aestivum
  Clone ID: PAT_TA_46075
ccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttg

SEQ ID NO: 46076 - DNA, 238 bp, Triticum aestivum
  Clone ID: PAT_TA_46076
aataaattactcctgataaacatggtccctgcatggtgagcaaaaggaaggtgcatatatatgcgcgtacgcatacgtacgtgcgcgttgcacagtgaccttgtagaagaacacatgcatccggccctctgtgttccgtatgtcccgtatcaatatataccccccgctttatctgttagtaccgtggaataaattcactctggaatgtaatatatatagcctggttctactcggtgca

SEQ ID NO: 46077 - DNA, 590 bp, Triticum aestivum
  Clone ID: PAT_TA_46077
agcacccatacgcgccatggagacatggcaaatcttcttcggcgttatcctcttcgccctcccgctgaccctcctccttttacgcaccggtaagaccggcggcggcgcccggcggcccatcccgcctggcccgccgtcctttccggtgctgggcagtatggtgtggctcacgaactcgcccgcagacggggaactcctcctccggcgtctgtttgcgcggtatggtcccatcgtgtcgctgcgcgtgggctcccggctctccatcttcgtcgccgaccgccgcctcgcgcacgcggcactcgtcgagcgcggtgccgctctggccgaccgcccgaccctcgcgtccgtcaggatcatgggcgagaatgacaacaccatcacgcgcgccagctacgggcccgtgtggcgcctcctccgccgcaacctcgtctccgagacgctgcacccgtcccgcgtccgactcttcgcgcccgcgcgctcctgggtacgccgcgtgctcgtcgacaagctgcgggacgagtcgtcctccggcggggcggccgttgtggagacgttccagtacgccatgttctgcctcctcgtgctcatgt

SEQ ID NO: 46078 - DNA, 147 bp, Triticum aestivum
  unsure (1)..(147): unsure at all n locations
  Clone ID: PAT_TA_46078
ngaagatgatatcatgcagaataatgatgaagccacgtttcttggatttcatataatgagcgtgtatttgtagaccaattttatttgatgtacctggacctccatgttttagctataagtattaacagaaccaatgtttacttattt

SEQ ID NO: 46079 - DNA, 547 bp, Triticum aestivum
  Clone ID: PAT_TA_46079
cacaaacaagaaacaactacagagcagacacgtaaagtgagcaagaaaatcgtgagctaagtcactcgcgccacgtaccgagccagcagtccgcttgggttttgttgccatggcagcaagcgcggcgccgctcccgctcgacggccgcgtcgcgctcgtcacgggcggctcgcgcggcatcggccgggaggtgtcctcccacctggccgccctcggcgcgcgcgtcctgatcaactacgcgtcggactcggccagcgcctccgcgctcgccgcggagctcaactcgcgcggcctcggcggcctccgcgccgcggcggcccaggccgacgtgtccgacccggccgccgtgcgcgcgctcttcgaccgcgccgaggaggccttcggctccccgccgcacatcgtggtcgcctgcgccggcctgctcaaccccaagtaccccgcgctagccgacaccaccgtggaggacttcgacgccatgttcgcggtgaacgtgcgcgggacgttcctggtgtgccgcgaggctgccaatcgcgtgccggccggcggc

SEQ ID NO: 46080 - DNA, 598 bp, Triticum aestivum
  unsure (1)..(598): unsure at all n locations
  Clone ID: PAT_TA_46080
gnaaggagcaggcanaccgaggttataggtgggatgaaacagacatgctaggagtaacaaaatgtattgaaatggcaatgagttgtgtggaggacgaacgagacaagagaccttttataacagagattattgataagctcaaggaactagattctaagatcgaggagatgttaaagaatgatccgaagccacttatacgccagctgagaaacagtgtcaatgattcagaagcggttaaacagaatataagcccgaatgcttcggaaaagaatattctggttgatccatcccgggaactctgcttaccattcgagccaaagaaggagatacggtgctgcctgcagctcatgaacacggtggcgtccagccacattgcttttaacataaagactgatgtaaacaagtatcgcgcacagccaaacaaagggattttagccccatgctccaagtgctacattaccctaaccttgagagcacaggaggagccgccgctgaatatgcagtgtggtgacgtgttgattgtgcagagcaaaagcgttagcaagcacttcacatctgacaaaatcactcaggacttcctcgcgcacgccagcgccgt

SEQ ID NO: 46081 - DNA, 270 bp, Triticum aestivum
  Clone ID: PAT_TA_46081
cccacatcgtgcgcaggtattctgtgttctagactgtcaatttgatgtccctgtggtgggtgctctggttcattccggcgtgcccttggaggtgtatctgtggctgaaacgacgacgacgacgacggctgtggccagggctctgtccctcagcctacgaattaccgtagcagctggatttgaccaggttttgaaccttatcaagatccttgaggcggagtctgacaaacaaatatcgcattgattatctaattgatcatgattatgatca

SEQ ID NO: 46082 - DNA, 583 bp, Triticum aestivum
  Clone ID: PAT_TA_46082
cgccgatatagaagcagccctacgtgagcttgtaggcctcaagtggcgtcacgctgggcaagcttgcgtcacagtaaatcgcttccttgtccaatcagccgtgtacgacaaattccttcaacgcttcgcggaagaaacagcaaagtatgtcgtcggccacggcgcttctgagggaaccactctcgggccagtaacaaagcccgagagcctggatagagctgagcgactcatcaaagatgccgtttcaaaaggtgcccggatcgttacgggcggtaatcgtctttctcccaaggatggcgaagggggatacttttttgaaccaaccatcctggcggacatgactcacgacactcttatttcttgcgaagagtgttttgcgcccattgctgcgttttataagtttgagactgaggaggaggccgttcgggtggctaatgatacgccgatgggcttggccagctatgcttttaccaaggatgccgatagaatttggagactctttgagaatcttgaagctggcatgattgcgcttaatactggtaattcctccgcggctgagtcaccctttggagggatcaaaatg

SEQ ID NO: 46083 - DNA, 581 bp, Triticum aestivum
  Clone ID: PAT_TA_46083
aaactaatatggaccttaggcagcggccaacagcgttctcgggggcttgaagcgcagggtgagagcaggatcgggctcgaactgctggggctcctctacaaatcatcgaccacagactctggcgggtattgcatggtgaggctcacgcccaccgataccgctgagccgtcgtgtggtgggcggcggtcagcctaatttttctctggtccatggagcaagagcacctcacctgccagattgaggagatacctttggcgacactctgccgcacagcctgcacacggtcatcaccccactacatcaccatacttgattgacgagcacggtcccgccttcttaggcctgcagcgaggcctacactcccgtcgggactacactgaatggcacctgaacctccggctgcctgcgtcttcgttcccacctatgctacaacaacaacccatgagcgtgggcggggcaactcacgagaggaacactactactgccctgcttccgagctctggtggcgccagaccaagacggtacaacgatgctacctgatctaggtggttcgcacactatgaggagcgcctcacctactg

SEQ ID NO: 46084 - DNA, 606 bp, Triticum aestivum
  Clone ID: PAT_TA_46084
agactctagcagttgtgtgattgaaaagtttcctccaggcttcagtgatgtcctcagcttagagaagatcaattcaaagagttttagttatagcaaggaccactctggcaaactctgcctaaaatggtgccgtctgctacgaagtcctgaggcagtgaagataatggaaaaccagatggaaatgttacctcattggaatttccaacatttgcaggtaaaggactacggaggtgaatcttgccctagctggctccagcccaacctcatgccaaggttacgttctcttgaatttacgcactgtttcaacttgaagagcataccattctttctccagttagatgggtcacttggcaatacatcacggtcagacaacattaatcgtcttgaagagttggtcataacaggatgtggtcaaatcagttggcaaggctcggtggtcttacctacttctcttagaaagctagaccttcagagcccgggccatcccatggatcacttcgtgagctgcttccttgacctcatctccctcacttatttgaaactacatcactgccactcgttgacagctattcccttgcatgtgtggagaagcaatcttccatccct

SEQ ID NO: 46085 - DNA, 536 bp, Triticum aestivum
  Clone ID: PAT_TA_46085
aggcagcttggaggcggaaaactcatcttggtatctcactgtgcttctgctggtacgaagataggcgctggtgctgacatgctgcccagcaccaccgcgctagcactggcgcaagatgcatgaatgactattgagggaacgactgaaccaagatataccatgggcattatgttaagaatgctcactgaacatgggaggcccccaacaaaggtcttctggtcatgcgcacctctgccatgaccctgacacattgcaataatggattactaggatgatttacacacacgactatgaagtgtggaatcataaattatacctgtggaaacgtgccaacatgacatgatatactatccagacccatagaacgcgcatcactgaatacaaacaccataccgttttattcacataccgcatgctccttgatacacacgcaagataccagtacaataaaactgaaaccggctgacgatccatgacgatacaagctcacttacatatgcatgcgacccgaatgctctggtataggtcacctaaat

SEQ ID NO: 46086 - DNA, 590 bp, Triticum aestivum
  unsure (1)..(590): unsure at all n locations
  Clone ID: PAT_TA_46086
gntactcgaccaccggccgccgccgtgccgtgccctagcgtcgccgccgtcgcctcgatcgcacgccccgccggctcgggacacgcccgcctctcacgcgtcgccgccatcgccgtccccactcttactcgtcgggacaccgcagtctctggccgcctcttctgcgcgaatcgcttgtccgcgggcgggatggacaagctggtgcagttcgggaggaaggcatggttcgtggtgcgggtcatgtccggctacgaggagaggaggatccggtcctacaggctgcagctgcagcagcgcctccagcaggctcaggctaagaagaaggagattgagaaacaaccagagcaagttattctgtcagaggttcgtcaagtggttcagcagatgcaagctctcaatcagcacctcgaagaagctgaaactgccatagacgagtatttcaaaccgatcgacaagaatgctcagatcttaacagacatgcaaatggagaaagaagagaagcaaatgaaggagatgctccaagtaatgcgaggccaaatagaaatgcaaagagaaatcgaggcgaggaaagccgnagccagtgccgtgga

SEQ ID NO: 46087 - DNA, 600 bp, Triticum aestivum
  Clone ID: PAT_TA_46087
gcctgtatgacattcttgatatatagaagtgcctaactggactggaagattcagctaggccttcctgatggggtcatctccttcatccgttgcatcacagcagagggatattgatcattgtcccttgccctcgtatggtttttgtagtcggggtaactggtaaggctgcttatggctgaaatggaaagaaaaaccaatcctgcattggaagactgcaccaattgtatcattgccatgccaaggatactgcatcaccatgtctagacatttccaagaaacacaactcagtctggtggctatggtccgcaacatcacaaccctcagggtcatggcccagcttctcagtgggggccacggtctcaacctcagcagtatggatatccaccaagagggcctcctcagaacgcgccatactctcaacccccttatggtggttacccacagcagccaccaccaagaggtggcatgggctgggaccagaggcagggccctccgcctcaccagggtggtggttatgactactacaaacagggatctcaaccttatgaaagccagccaccaaactacccccctggaccaggtaacttcaacagctatggc

SEQ ID NO: 46088 - DNA, 598 bp, Triticum aestivum
  Clone ID: PAT_TA_46088
cggacgcgtggggttgcaaaatcaagcgaaaagtttttccagactggatttatgaccactttgcgcaagatgatggactacaagcatgcgaagtcacaggagaaactgaggaaatcgcaagaaagatgaacttaattggcctgtggtgcgtacaaatactgcctgcatatcgccctaccataaccaaagttctagaaatgttcgagagaagctcagatgacatggacatgccaccgaagcaaaacttctctggattgcttgaaagttcagctcacaatatggatgtacaaagttcaagttctaacagatctgaggagatcagccttgtgaattcaaaaatcctacaacaatcaccaactctttgagcagataagccttgtgaatcaaagaacctacattcatttccaacactgtgagatggtggccctgtactagagtacattcagaaattgaacaagcgcagcgaaattcggcattgtgtactgcagtatattcagaaaataaacaattgcaacaaaaatctgcattgtagtagaacatattccaggtatgcatgacctatagtcaatagcatccacatgccagcgtcctaagttac

SEQ ID NO: 46089 - DNA, 221 bp, Triticum aestivum
  unsure (1)..(221): unsure at all n locations
  Clone ID: PAT_TA_46089
gccaccagaaggtgatagaggaagcgccggcgccgggcatggatgccgacacccgcgcggcggtgtgtcaggcggcggtcaatgcggcgaaggcggtcgactatgtcggcgccggcacgatcgaaaaaaggaaatagtattcaattaggtatatangaaaaaaaagagtgtgaatctcgtcaaccggtactcaagattacaggggcgcacggtttatttac

SEQ ID NO: 46090 - DNA, 593 bp, Triticum aestivum
  Clone ID: PAT_TA_46090
caactgaccagtcggatccttcttctatagaaattggaaacataaatccctattatagcggaggttatattccacttctgagacaatctcattaatgcataaatagtaataggttatttaatggtgggaatcataattcaaagatggcggtaaagcataagactgcggaagcgaaataacactaatctagttggccaaagcaagggaagttcatctctttcttattttgcctacgtcgcatattgaaaggcattctatcgatccgccattaagcttcaatcgatcgcctactttcattcctaatctatctctaatgctttgcttgcagcgagaaaacagatgcgtaacggcttccgagtaacaaagagctggttttgcctacctcttgaaggctcgaaaggcgtgtaaagtgacaaataggctagattgtcctattaaaacagaccttgtgccaaatagaaggtggtcccttgatccatccctgcggacgagatacatcagttgagattcagcaaaacgaaatcagctgcatgtatagacgccaaagaaggagatcaaaagaatctttcgaatcgatatatattatataatct

SEQ ID NO: 46091 - DNA, 585 bp, Triticum aestivum
  Clone ID: PAT_TA_46091
agacttggtaccaagttagtcgatggacatggtcaccgcccccctccttctcctcctgcttcttgcgcctctcgccactgcgcaatggccagattgcggcaagaagggcaacttcacacaaaatagcacctaccaagccaacctcaggctcctctcttccaccctccccaagaaagccgtgtccaacaccaacctcttcgccacagccactgtgggcgatgttccggacatcgttcacgcccttacgctctgccgcggtgacaccaacgcctccgcctgccagagctgcgtggcaaccgcctttgaggacgcccagcagctctgcccgtacaataaggaagccgccgtgtaccacgatctctgcatgctcaagttctccaacaagaattttctcgccaccaccaccgcactgatcctcatgagcgaccggaacttcacgacaaactccgacatcacccaacgattattgttcacgcttatcaacagcacggctcagtcggccgcgaatagctcgaggaggttcactacctcgcgcttagatgttgggtcctccccgacgctgttctgtcttatgcagtgcacgcc

SEQ ID NO: 46092 - DNA, 324 bp, Triticum aestivum
  Clone ID: PAT_TA_46092
gcgtccccgccgcccctggtcgacccggcggaggagtccccgccggtggcggtgggtggggacggggaggagaagggcaaggacggcaattcacactagcgcgggcagcagaggggtcccgtctacgattgcttgattttgagttaggcagcggggaattcaccttccccgaacctctagttcgttggacagagcacttcgccgatttcgcttgtgtttaccacttcttttcttctgctccattccactgctcccttgtacatcagtgaatcctgtagccttgtactgatacgattagcgaataaagactgatttttttggttg

SEQ ID NO: 46093 - DNA, 599 bp, Triticum aestivum
  unsure (1)..(599): unsure at all n locations
  Clone ID: PAT_TA_46093
ctcagcttgctccacctcgacggcaaccgtctcacggggcagctgccaccggagatcggccggctcccgctcgtcatgctgaacgtctcgaggaacaacctctcgggcccgattccgtcggagatcggcgacattctgtgcatcgagaggatggacctgtccttcaacaacctctccggcgagctcccggcgagcctgttcaagctcaccgagctatcaatgttcaacgtgtcgtacaacccactcctctccggcaatgtctccaccaccggccagttcggcaccttcgacgagcagtctttcctcggcaacccgctcatttcgttgcatcagggtggagctgccggtaagcagcaaccaccaccggaagctgccgacgctcctgcagttcggacgcgcagcataccgagaaccatcgggatctggctgcttttctccctcgtcatcgccttcatcgccgctgctggacatggccggcgacgcgggctgtgcatactgcatgagctcaggacacagcgacggcgagcaaacaagttctctgacataggtgttgaaggtttacaaaaccaatttatttttttgngtacaaaaatgctgtt

SEQ ID NO: 46094 - DNA, 561 bp, Triticum aestivum
  Clone ID: PAT_TA_46094
cttgtctttgggtcgtgccaacgagcgcattgctggtatccaagactcgtacgttgacagcgccaatgcgacttggctggacaacctcgagaggagcctggcaatgatgcgagagtaccagaacgctcgcaagaagctcgagaaccgacgcctcgcctacgatgccagcacaaacaagctgcaaaaggcccgccgtgacgatttccgtgtcgaagaagaggttcgcatgaacaaggccaagtttgaggagaccagcgaggatgttcttcgtcgcatgcaagacatcaaggaaacagaggtggacaacatttcctctctgacccagttccttgaagctgagctcgactaccatgagcgttgcgctgaggagctgcgacgtgtgcgccagagctgggccggcggtgcatcttcacctaccagtgctcccaagatcggccgcagtcgatccaacaccgctcgttcttggcaagagcctcggcaccaggccgtctacgaagaacccgagcctgaacaagaatctgcccgcattccccatcgttctcctgccagccgtcttgcacc

SEQ ID NO: 46095 - DNA, 608 bp, Triticum aestivum
  unsure (1)..(608): unsure at all n locations
  Clone ID: PAT_TA_46095
caggtatctaatggtcctggtaaagccctcccanagtggaaaacaagcatgcaccaagtttcagaggatttgcactgatgggaaccacagcattgtcttgtgcaaacctgtcactggccgaactcaccagatacgggtgcatctaaaacaccttggttacccaatagctaatgatgagctctatgtttcgggggatttttgtccgcgttcatcaaagggaacgagtatccatagggaaacctcactagcgtgctcattgccatcatcagaacctgacaacagtgctgaagccgatttgaaatttggtattgatccaatgtgcacgaattgtccaaatcttgctcctgtcggttatgatggcgacgaggagggactatggctgcactgtgtgcgatatactggtcccgattggtgctacgaatgcccatatcctgagtgggcatcccttgacaatgtttcagggaagaaaatgaagcctgatgtaccaccagaaaattaagtcgagaaagcaaacggcatcttgatggtagcccgccaactagcgtggctgaaattttggatgcttatgatcactttgatgcccatggtactattgtcttgtcacttat

SEQ ID NO: 46096 - DNA, 595 bp, Triticum aestivum
  unsure (1)..(595): unsure at all n locations
  Clone ID: PAT_TA_46096
caggtagagctttcacttgnaagccgcaagcttagctcaaaggaacgccactcttggaataggtgactcttctgcagtgtctgcaacgagagcaagggctttggctgaggacgcatttttccatccgtccattatgtcaatcagttatgcttccgtggagcactacttcgccatttacatgccattctttgcgccagtgtgcttgcatgtgctgctggcggcgatcaaagagctgaaacgctacaaggtggagcgggccaagtactcggcgttcctcgcctcccagtcccaggcgacgacctcctgaagtctttgatccatccatcggtgacaggctgcaaagcatcgctggctttcttcacgcctggtatcgtcatcgatcatcccacggagtttgacagatgacggaaggtatggtagatagtggcatcctaggcaggcgagtaggagggggtctagtctacctgcgcgcgtgtaaacctgtaacttattacagtatgtggtagatcttgcttatagtccggggccgaggacccacattttgttcgtagaagaatacttgccctctcacatgaagaaatccgngtcaatttcc

SEQ ID NO: 46097 - DNA, 589 bp, Triticum aestivum
  Clone ID: PAT_TA_46097
cggacgcgtgggcttgcaccgagctttcgatggctgtgttggtgtcttccatacctcatcactcgtggatccaggaggcatctccggctacacgaaacacatggcgactctggaagccaaggcggcagagcaggtggtggaagcgtgcgtgaggacggagtcggtgaggaagtgcgtcttcacctcgtcgctgctggcctgcgtgtggaggcagagctaccctcaccgccaccggttccccgccaccgtcgacgagagctgctggagcgacgaggccttctgccgggacaagaagctgtggtttgcgcttggcaagacgatggcggagaaggcggcgtggagggcggcgcggggccgggacctgaagctcgtgacggtctgcccggcgctggtgaccgggccgggtttccgccggcgcaactccaccccctccatcgcctacctcaaaggggcgcacaccatgctggcggagggcctgctggcgacggcggacgtggagcgggtggcggaggcgcacgtgcgcgtgtacgaggcgatgggcggcgccaccgccgccggcgggcggtacatctgctacgaccacgtggtg

SEQ ID NO: 46098 - DNA, 305 bp, Triticum aestivum
  unsure (1)..(305): unsure at all n locations
  Clone ID: PAT_TA_46098
cggncgcgtgggcgagnattagcagacatgtaaatggcgacagcgatcccgtcccgcgatgttaatgtaatgttccacgccacgccacgccacgagccgacgagcacgacgcgaagcccaggctcgctgccgcagcatcagttatcaaaccagagaagcacggcctgggcttagcgcgcggtaccattagcctagctagcagctggtagttacgtagcttagcgcaccgagaattagcagacatgtaaatggcgacagcgatcccgtcccgcgatgttaatgtaatgttccacgatccatccgac

SEQ ID NO: 46099 - DNA, 131 bp, Triticum aestivum
  Clone ID: PAT_TA_46099
gcctgcaattattcgtgcaccctgctattacaggcttggggaatgaacagtcacaggatacgccgtgtcgccattggcaggggcgtgcgctccatgattgcctgaccagaaacattgttttctgatatgtg

SEQ ID NO: 46100 - DNA, 441 bp, Triticum aestivum
  Clone ID: PAT_TA_46100
gggctagaggcactagccgtacctcctttagagccgactgcctgactctacaccaggcctctgaccaccttaggtctgtggtttgcattaactagggtacaaagtgaccgagccattgctgctttttctggcggacacaccctgacgaaatcccacacagagagatccgtcttagagggagcctgcaccgccaaccctttgagatttgacaactcttaattaactgcgctccttactggggaagaagaacgccttcttcatctgccgaccgacaagacccttctgactgacccggcctttcacccactagtggacaaatatgccggagatgaggatgctatccattgctgactactctgacgcacacctcaagctctacgaattgggatatggcgaggctactaagggctcctgatgattcaagcttggcgcctgtaggtt

SEQ ID NO: 46101 - DNA, 569 bp, Triticum aestivum
  Clone ID: PAT_TA_46101
cgttgatagactcgtggaccttctggtaccgacccccgatttcaaaggcacacggctacatcgagtacgagaaacactacatgaaatcgctactgtgcgaacagcggaggagttctgggagatgtatgcttacctaaagcgcccctccgtacttcccgttgtctcggactttcatctgttcaagaagggtgtccgcccaatatgggaggatgatatcaacaagaagggcgggaaatgggtggtgcgaatgaagaagggcgtgtccgaccgatactgggaagacctcctgctcaacctcattggcgaccaattcggcgaggctggtgaggatgtctgcggcgctgtgttgagtgtgcgcaatggcgaggacattctcagtatctggacacgaaccgatggtggtcgagtcattaaaattcgcgagaccatgaagcatgtcctcaacttcccacccaacactcgtgttgaattcaagagccacgactccagtattcagcaacggacagccatagaagagtcacgccgcgaaaaggctggtcaactccatcaccacgacaagcgtcacgctg

SEQ ID NO: 46102 - DNA, 605 bp, Triticum aestivum
  Clone ID: PAT_TA_46102
acccgaacggcatcagcaacgagtatgcactcctggggatggacatggagggcaaagtgcggaagactatccctatgccatacggtcgaagatttggtgcgattggatcgtcgcaggggtgcttactctatggtgtagcttccgtcgatgataacaataaaacactagattctgagacagaactctggtgcctcaaggattgtgacagtgaagaattcgttctgaagcacactgccagcatcgatgagcttatcagcatgactggggagaagtacagggtggctgggattcatccagattgcgacaccatttacctggtttcacgtggaggtgataccatggtaccgtatgatatgcaacatcagaaagttggctgtatccttaatctcgagaagaatacacaacgatttctaccttatgttcctctgttctcggagtcattagcagatggagatgggcagtagttttttaccttcaaaccacccttgtgcaagaattggctattttgtcggctgaagtacttgtttgtgtacctctgaatctgccggtatcatgccgctgaattttgctggtgctcacactcctgcttggttgatttccagttc

SEQ ID NO: 46103 - DNA, 585 bp, Triticum aestivum
  unsure (1)..(585): unsure at all n locations
  Clone ID: PAT_TA_46103
gnaggaaatgagaagaagaaggatgaggagcgtngaggcccaggagagattattggaagaagaagctatggcacgngaaagccaaggaagaggaagctgctgctctggaatttgagaaatggaaggggccttttcagttgatgctgaagggacaactgaaagtgagacgcaagatggtgggcagggtttgctccacaattttgtggaatacatcaagaagcagaagtgtgttccactagaagatcttgctggagagtttggaatgcgaacccaggactgcataaaccgaattattacgcttgaaggcatggacagattatctggcgtgatggatgaccgtgggaagttcatatacatatcaatcgaggagatgcaggctgttgcagactacatcaggaagcatgggagggtgagcatatcacacctggccaacaactcaaatgaattcatagatctagagccaaagcccctgtatgacgagaaggaggagagccatcaagatgaaagcgccccggcaggtgtagttgcagagccctgatgagtactcatggtcgagcttattgcccctgcaaaaaaacatatatc

SEQ ID NO: 46104 - DNA, 317 bp, Triticum aestivum
  unsure (1)..(317): unsure at all n locations
  Clone ID: PAT_TA_46104
tccgctccggacctgnacctccgtcgagcgatctagnatagnanagccaacaacaggccggtgggattgtctaaattgattagggttgtgaacttgtggtggtgttcgatctccaatgatgtgtccggctcgtgcttggacgaagacatcaatctacttattcttgttttcttattattagggagtgcgtttcgaagaagaagaagaagaagaagaagaagaagaagaagaagaagaagaagttgtaccaccggccggttgctctcttaatcccagtgttgggtaactctgttggctgctcaaaaaaaaaaaanaaa

SEQ ID NO: 46105 - DNA, 530 bp, Triticum aestivum
  Clone ID: PAT_TA_46105
ggaggagggtcgggagcgagcgggatcgtgctctacgggctcgccgagataccgggcctcctggacgacgtgcccgcggtgtggtcggaggctcgccgcgtcgtcctgccggccaactctcacaaggaatgggtctacttcctgaacagagggagtcagatcgaggtcaactatagcgtcgagcctggaactggaccaaccaatccactccgcgtcaccattgctcaagcagcaggtaaggtaggcttcacgcagtggtcagaggagccatcggtacacggaaccggagcagttaagcagagcatcaattcttccgaggactactacatcaccgtcggcaacctgcgcgaccaagacacgacggcgatgctggatttcaggatcagcgccgtgctctacaacacgagcggagcagagtacgcgtgctcgccgtcgccgggcggttccggctgcacgtaccggctgccgatcctgggagagaacgtgggccgtcctgtcgtccggcctgaaacagggcgtgaaggtggagc

SEQ ID NO: 46106 - DNA, 430 bp, Triticum aestivum
  Clone ID: PAT_TA_46106
gcttgctgcctgcccaatactcctttcctacgggcattgtatagcaccggggagctcacctgagacacatcacaatggtgaagctgtgggtgtgcttaccggcagggagggtgtcaagggcaccatcttcttcacccaggaaggaagatggcccgaacaccgagacggagagcgtcactggactcaaggaaggcttcacggattccacgtgcacgctcttggtgacaccaccaaggctgcatgttaactggcaccacactgtcaaccctgcaggtcatgtgcatgggaacaccaggaggatgaaatacgtcatgctggtgatcttggaaaatgtgtacaggctgggagcgggatggttgttgcataacatcaatgttactgactgccatataccccttactggaccaaatcaattgttggccgcgctgtt

SEQ ID NO: 46107 - DNA, 466 bp, Triticum aestivum
  Clone ID: PAT_TA_46107
cccactacaccaatatggagcttagcacagcacactgcacactggccaccacagaccttaataataagcacccccgactgtgtactgaggggcctgatgcacgagggcactcattctatacggacaataacggcttataccttaaagctggaatctccagactggcagaaggtggtgcgccagcagcactactcatcattgaccatccaatcccttcttatctggactcagaacaatgcatcaccctaccgtccgctcgcaggtatgggctcagatggcaagagcgctcactgcactgaacgcaaacacattgttccacacaaccacctaggatatgaccccgggactaatacgggtgacttaggagaccaacatagagcacaacgtcatgcatgtatacgactgacacgacattgccagctactagatcggcctgtagtcgcctgagggcattatcgagtactac

SEQ ID NO: 46108 - DNA, 575 bp, Triticum aestivum
  unsure (1)..(575): unsure at all n locations
  Clone ID: PAT_TA_46108
ctgggnaacccgactcagccccgcaagccccaanaaaggagagaaccanaaccccgcgtggcgctccggcgcaagtctctcggctcccgtctcctcgtctccgcggcggtgccggaagggaactcgtcaaaaacaagaaatcaaagtctcaaggaatgctgaaagatgtgcttgcatagaagagatctcttctgtgagaccaagaacatcaccactctgcgtgggcccatttggtcacctcttgatgtgagcaaccaccttgcctgcatcaacgccacgccattcagactccgctatgacgaatccaccagagtgctggatcatgacttcggggaggctggctgaagtgtcgtagcatatttaagtggtagccacaagaatattagtggccgtgacttatactcttgaaggcatggagaacagtgggaagatcgtaatgggtaggtatgaggtgggngagattgttagnggaaaggagcatttggcaaggtgcactacgccaagaaccttgagtcaaaccgaggcgtcgccataaagatgttggacaaggagaaggtgctgaaggtcgggctcgc

SEQ ID NO: 46109 - DNA, 565 bp, Triticum aestivum
  Clone ID: PAT_TA_46109
cgaggtcgccatcgacgccgcgtccccacaaccgcagcggcggtagaggacgacgacgtggaagacgagagctcgatgagcatggacgaggcgtacgcgctcgtcctagcggggcggcagcgggcgccgccgacggaggaggaggcggcggggtccgaggtggacgccaaggcggaggagttcatccaggggttcaaggaggacctcaggcagcagcgcctcaaatccatcttcaactacacccagatgctcaagcgccgcgttgccgccggccggccggctgccgctccgtgatcggctcacgtgatcgttgaaagttcacagtaatccagctgcgagctactcaggattgagtcgttgtcctggacgtcgccgtctttgattcacatgttcattgattcatttgctttatttacagagaattgagctgtcctttttgagttgcttgctctcgtgtacataggcatttcggttgttggtttgtgcagattgcttctagcgggtttccttttattggcttgctttgcatgcagtgttctttgttgtaagtgcattcattcatttg

SEQ ID NO: 46110 - DNA, 611 bp, Triticum aestivum
  Clone ID: PAT_TA_46110
cggtccggattccggtgcccaccgtcgccttctctaagaccacaccgtacgcagcctactccagatggcagccttagccgctgcgacgtcagttgtttcacagggaggagggcccgatgatgaagacaaccctccgccgccctgacggaggaggctcccgcggaggagacgctcggtggccgccgacgaggccccgaagacagacgaggttcccgcgcccacggaagccaaagtcgatgcgtctgcccccatcaaagttgaggcgaccaatgaggaggcgcccgtcgccactaagacggacgaggccaaagagaccgaaccatcagctgtggccgagcccgaggcctaagcgcccaaagagccatatgcgccagccgtggtcgagacagagaccatagaggccgttgcaaaggccgagccggccgtggtcgaggatgtgaaggatgaggacacacctgctgccgagccagaacaccggccgtcgccgaggaagcaccggctgcagcggaggaggcccccgccgccgtggcagaagagccggccgccgcggtggccagcgtcagcgtgtgaggcgcgcacagagacaaacgaagggctggctgggtcaacgt

SEQ ID NO: 46111 - DNA, 529 bp, Triticum aestivum
  unsure (1)..(529): unsure at all n locations
  Clone ID: PAT_TA_46111
ccccgcgtccgacagcttcagnagaggtatcatctcgagaactctccatgccctcctggcatagtccactgctgcttcccctggtgcgcgaactgtcaggagcatcgtgaaaggaaaggccgcctcgcagaaagcagtgctgttccaatgaccattgtcaacccgccgccgccgctgcaagagatgagcatggtcgagaacaacgctcccacatccgagaatgaagcgtcgaaggccgagcatgatgatgtggaggtgatacctctctaggaaagatagcatgagaactgaaactgacatggaatctgctagccaatttagagactaccatatattgttaataaatcactgtcatctggcaggtaccgtatgaaacattgttctgatccagattttagtttatgaccattactacctatgatagaatgttgaccgtgggcatgtaatatatgtgtggagaccattactacctatgatagagtgctgcccgtgggcatataatatatatgtgtggagaccattactacct

SEQ ID NO: 46112 - DNA, 586 bp, Triticum aestivum
  unsure (1)..(586): unsure at all n locations
  Clone ID: PAT_TA_46112
cactggccagccagtagccactacgaccactgaaaagagcagtgaggcacggatcacggatgccaggcatggcatccagcaagggtcttcttgtgttcgctctcctgcttgcagctgctgctatcctcgtcgcctcgactgatgaacacactgaggccaagaaggaagagaatggagcgggcgtagagaacttcttccactttggcggaggccaccacgggcacggaggcggcgggggaggctatggcggaggcggaggaggttacggcggaggcggaggctacggaggaggcggaggctacccaggcggcggcggaggctacggcggcggtggcggctaccctggccacggtgggaaaggcggtggaggttacggcggcggtggcggctaccctggccacggtgggaaaggcggtggaggttacggcggcggcggcggcggctacccaggcggcggaggaggctacggcggcggtggcggctaccctggacacggtggaaaaggcggcggaggctacggcggcggcggatgtcactggggctgctgcggccacgggctgntccatcaccatggctgccgctgctg

SEQ ID NO: 46113 - DNA, 495 bp, Triticum aestivum
  unsure (1)..(495): unsure at all n locations
  Clone ID: PAT_TA_46113
ccgggtncgnnacccacgcgtccgctgggacaacagcaccgtgtacatgtgaccctccaaaacgacctcaagtgagcgtcgagggggagaaaccggccaccgggggcgcagcggcggcctgngaaaaagcagtgtcatgggctgggnaagcaagcagtcgagcgagagcacgaangggacgagtaccatttgaccgccaggacggcgaccaccagagcaggacgatgctgctcaacggcgtcccgctggagctgggagacggcggcggcgtgccggccctgaacccggtgcccgccgccgtggattcgcccgtgcacctggccccgacgtcgatcgcctttgtggtcctgccgaggttcgaggccaaagcctgttcttgagggaagaaggttttttgttcattttgtggtgtggagatataatcgtataaaagaggaaaacgagcagaagtatatcaatgcaaacattcaaagagcttgccaaggctttatttat

SEQ ID NO: 46114 - DNA, 583 bp, Triticum aestivum
  unsure (1)..(583): unsure at all n locations
  Clone ID: PAT_TA_46114
agccatgccaagccaactcaaanaatcatacttagcaacaaanagtagctataggccaaagcccttgccgacccggcacgaaaagctagcacgtgggaatgggtccttcggcaccgggcgagagagcacacgccgtgtgcctgccggcgccctttcaggggcacatcatccccatgctcgacctggccaagatgctccacgcccgcggcttccatgtcaccttcgtcaacaccgagtacaaccacgcccgcctcgtccgcgcgcggggcgaggccgcggtggccggcgtcctgggtttccgcttcgacaccattccggacggcctgccgccgtccgacgatgacgtcacgcaggacgtcgtgtcgctctgcaagtccctcacggagacctgcctcgggcccttccgccgcctcctcgcggagctcaacgacaccgccacgcccatgggccacccgcccgtgacctgcatcgtctccgacaacgtgatggacttctccatggaagcggccagggagctaggcctcccctatgtccagctgtacacctccagcgccatcagctatgtcggtgtccgccactaccg

SEQ ID NO: 46115 - DNA, 522 bp, Triticum aestivum
  unsure (1)..(522): unsure at all n locations
  Clone ID: PAT_TA_46115
cggtccggattcccggtcgcccacctccgtctttgatagtgttgttcacattcacgtatcactccttactcaacatggcatccgtcgcttaaaacatcgttgctacaggcgcatcctctggnattggcctggnagctatcaagcagctcctcgaccanagccaaccatacaaagtcatcctcggtgcgcgcaacatacaaanagcgcaaaagtcatacgatgagcttaactatgaccgctctgctagcggcgtcactattcttccgctcgaattgaacgacctcaaggtgtcaagtcgttcgctgaccagacccttgnanaaacttgngccaaggnaaagattgattacttgttgctcaatgcagggttaggcggtgtcagcgccgatgagccgggacctaacggatcaaagtggtgtgagccgtatgtcgtgaaccatctctcgcagtattatcttgtgcatctcttgagggagaagctggtcgagtccaagtctagaattggctttgtatcttctggtgc

SEQ ID NO: 46116 - DNA, 367 bp, Triticum aestivum
  Clone ID: PAT_TA_46116
cacacgcacacgagtacagacacgtaatacgcagcagaggaggcagactcatgatcatcctaccgattgccgcgacagcgagagtgaccatattggactacacgtctcctggagctacatagtcggggctgacggcaagaaaactagaggagtcgagcgcgtccttacaagagcacgctatactgccggaaaggactatatgcgctacgaaagaacaccatactgtcgaagctcaacctcaggaagatcgcaaactccatctctaacatctggggcaatggtacacacccggaaacaagaacagaaacttactggctgagcatgtgcacttccggacaacatactggactgtggaggtattactatc

SEQ ID NO: 46117 - DNA, 522 bp, Triticum aestivum
  Clone ID: PAT_TA_46117
ccaacagtgctgtgccctaactgtataaggcggcttctttggaagatatcggacactggggtcattatgaagaaaacatgtttacctttcgagggtctataaacaaaatttggtctgaagcccatgaactgccctggacactgcaagatctttgcccattcaaacgtcacatacaatgacctaccctggaggatggctgatttccgcactcttcacctaaacgagttctttggtgctctgtaaggtctgacccgagtccgtcctttccagcatgacgatgctcacattttttgtactgtggaccagatcccagaggaaattgagtatgctttcaactttttgagcaccgtttactgaattttcggcttctcattcaaactcaagctcttcacccgacccgaaaaggacgttggtgatattgccacctgagatgcggccgagaaaaaacttgaagagggcctcgagttctttgctgaggaagaccggagctaattgggagttcaaccccggagaaggggcttt

SEQ ID NO: 46118 - DNA, 594 bp, Triticum aestivum
  unsure (1)..(594): unsure at all n locations
  Clone ID: PAT_TA_46118
gngttggacggcctgccgatttgccgcggtgatggatgatgccgcggtgcacgttctcgtgttcccttggccacggcagggacacatcaaccccatgctccatttcgccaccgccctcgtcgacgccggcgtccaagttaccttcctccacaccgagcgcaacctccgtcgtcttgctcaggcgcctccgccgggcctccgcttgctgtccatccccgacggccaacccgacggtcaccctcccggcttcttggagctcctggagtccatgtccacgaccggcagcgcggcgtaccgggccctgctctctgctgccgatgcgccggtgacatgcgttgtcgccgacagcaccattccgttcgccttcgacatcgccgaggagctcggcatcccatcgctcgccttcgtcacgcacagcgcgtgcagttacctggcgatcctatctatgcccaagctcgtcgagctcggcgagaccgccttccctgcagacgacctggtgcgtggcgttccggggatggagggcttcctccggcgacgagatctcccacgtggactctgctgcgctgaaagagcggcgaagaccccttggtgctc

SEQ ID NO: 46119 - DNA, 566 bp, Triticum aestivum
  unsure (1)..(566): unsure at all n locations
  Clone ID: PAT_TA_46119
ctgcttcggcctacgnacgcagcggtacttggttcagaacaagnctaggtcccattttaacgcggntcttcaactggcctatgactatcacctatactttcaacctccccgtttgcatccctaaggcgagtacctcttgcgaatccagagcatgggtatccacaacccttacccagcgggtctccctcagttctacatcagctgtgctcagatcaaccttatggcggtggcagcactgttcctggttcccaagtcaagattcccggtgccttcaaggagacagatccaggatatacggccaacatctattccaacttcaacagctacaccattccaggcccttcagtgttctcttgtaacggtgctggtggaggtgacaatagtggtacaccccctgttaccaccctccagactaccacacagccgtctgctcaacccactcaacctggacagtgtgcttctctctgggcccaatgtggtggacagggctggacaggtcctaagtgctgtgctactgggaacttgcaaagcgacgaatgacttttatgctcaatgtgttcagtaac

SEQ ID NO: 46120 - DNA, 119 bp, Triticum aestivum
  Clone ID: PAT_TA_46120
atccattgaaaatggctggctcctcggttcggcacctggttaccaagccccgcaagttgtcactgctggcactgtatgctagcttactgcacatgaaccacaccaagcactgatacgca

SEQ ID NO: 46121 - DNA, 320 bp, Triticum aestivum
  Clone ID: PAT_TA_46121
cgcaagcattggcacgagccggcgatgctacaaccgtcaacgtgggagctacaagcaacgctggcgagtggaagctgtgaccatggcattgatttgctgggtacggggggacgagtgtggtggcggagttgcaacggtggttggtggtgggagagggaccgtgccccctgcttcattcacagggccgtcaggagctgcaatggcaacctcgggtcacgaggggacctcgcgcgcgacgacggcgacttggtgcagcgcgcctgcacgagtcaaactacgcgacctcgcgcgcgacgacagcaacttggtgcagcgcgcct

SEQ ID NO: 46122 - DNA, 500 bp, Triticum aestivum
  Clone ID: PAT_TA_46122
tccgctctcacggagtcgttgcgtttggaaacatcactgtcgaacactgtcgcaccaggttcatgtactttgccggaccagtgggagggcagctctgcgggggattgccgacctgtcgcagggcggggagaccggtggggccgagggcggtactggagcggcggtcgtgggtacggcgggccgccgtggcggatttctaggcggtctggggcgatgcctccaaggagatggacgatgcttggcgcactctatcgagcttcccggagggctctttgtgagctttaagggtggaaaaacaagccgcaatttccaaggactgtcgcaatacaggagtggatactttgttttatgcagcgtaagcaaacgtggtgataccttggggggcccaaactgctacagcctgggcaataaggttcgcatgttaggtgactgctgccaatgttgctcaggctgctgcacctgctagcttgggggtggctgctgggcctgctgtactcgaa

SEQ ID NO: 46123 - DNA, 569 bp, Triticum aestivum
  Clone ID: PAT_TA_46123
catcagcccaccaaaggctcaggggatgaatcatatgctacatacatgacctgataaggtggagtcctcgcatggtgagctccttctgcctacgcgttcaaagtggcctcgagtaaactggacggaattactagcacacaaggggtaagagagcaatgtccctatcgacttaaatatgtctgccacaccaaggctacatgaagcgtgctcaagcctctaacaaaacagctggtccgttttatactctttgcttattctggactacctgaacgactcacccccccttgtctggatggacctgatcctgcacaagaccttacgtgcaccactctttcgcttgtgagcacgatatgtgaacggtaagttgtttccttggggcatatgaaacctcaatacagcaaaacaggaagagagagcctgtaacgtggaggagaccctatccgggcttcaacacttggaaggagtccttgcagagtgctccaaagcgaggcacaggcggtagcaccgatcttcggtggtgacaccattgggttcctcgacatcgcgctcaggtgctatcttccctggtt

SEQ ID NO: 46124 - DNA, 569 bp, Triticum aestivum
  unsure (1)..(569): unsure at all n locations
  Clone ID: PAT_TA_46124
ccccgcgtccgctgncaactatttgttcctgatccgttcacgcattgtgctcatactgatcccattttccaagatcgatggtttcgccgcggtcgtcggggagaaattcatcaatggtaggggaaaagcaggtaggctgaggcgggcaaccacaccaagcggccgacccaggaggcagccctgcagctccgcctcgtgccactccccatctctatgtttgtgccagacccagcgcaaggtagaggcaggagaggaggccgggaagagaagctgcaaggtaggaggcttttgatctgaaggcaagagttggacgatctgctcacaaagacacacctctattctgaatttctacttgaaaagattgatcagtagctgaagtggaagaagaagatgaacctgtagaagagctgaaaaaagacgtggtagaaagaaagaagcgaagcctaaacagtataatgatcaattgttttggagacacgggagaagacttggggcgacgtagcaatgtgtggggcgggcggagcatcgggaaaggccacagcaacacccgcgctttaatcaattacgat

SEQ ID NO: 46125 - DNA, 581 bp, Triticum aestivum
  unsure (1)..(581): unsure at all n locations
  Clone ID: PAT_TA_46125
ggnaagctcccagcgccagctcttcacggcacggtgaccaaatgaggcgcacccaacattccaaatcccctcgtcgaaccgcccaaatccgccgccgcccgggagccgaggccgctgcactccggcgctccaaccccagcggagcaagttggcgccgccgccgggggtgtcctggaccgggcgcgggaactttgcgccgctgcacggtggcgtcgggcgtacgtcgcatgcctcgcgggaccgaggaagatcccgggcgcgccggcggggagcagcggatctatggggagtggggcctgttgtttcttccccgtacgtgttgggccgcacgtctcccccgcgacgtcgtgcgtcgcacgacgagacgacggaccggtgcgtgcccgtgggtgtagcctccatgttccgaaaataaagaaagatcaactcggttgccgacggaccttgctggttgcccccatccactgctgatccacgcctccgcaacggtacgatgcgctgtacggtcagtggttcgggtgaacaagcgcgtccgcccgttcgctgggtctgccggtgcgtgcgcaagttcgtcgtcgctt

SEQ ID NO: 46126 - DNA, 495 bp, Triticum aestivum
  unsure (1)..(495): unsure at all n locations
  Clone ID: PAT_TA_46126
ccagtgcagccgccggtgcggcagcaccaccgtcccttacccttttggcttctcccccggctgccccatcccgctgtcctgcgacgccagcatatccacgccgatcctcggtcgcagcggcacgaccatccactccttcaactccaccaccttgaccattgtcgtctccctcccgccatcgtgcactcgcagcgtccccgacgccaagaaggcgctctccggcgccaactacggggtttcgtcccacaccggtctgttcctccgcggcggctgccgcgagatcaacgcgtcgggcgccgaatgcagcgtgcccgcgagcgtcatgtncaggcttctccgcacagagcagtgtgtcggcaacgacacctccgtgacgtgctttgcctcttctccgatgaacagcacggcggnggcggggcccgcgcccgcnccggcaccggccttgaagttcgcttatcccaacgagttnttgcgctgggagaaagtggaggcctt

SEQ ID NO: 46127 - DNA, 572 bp, Triticum aestivum
  Clone ID: PAT_TA_46127
caggttgtagaccgaaatacgagatggcagctggcgcgcttcctctgggcgcgttcgtcgtgctgctctgcgtgggcgtcgtgcgcgcggcggacgcggacatcgtcgcggctggccgtccgctctccggcgaccagaagctggtctctcccggcggcaagttcgccttgggactcttccacccagacggagcagccgacggcagctggtacgtcgggatctggtaccacaagatctcggtgcacacgccggtctgggtggccaaccgcgagacgcctgtctccaacacgtcgcggctcgccatcgcgccagacggcaacctcgcactgtttgacggcgccggctcgatcgtctggtccacgaacgccagcaccagcggcgtcgccaatgccagtgacacggtcgccgttctcctcgactccggaaacctcgtgctcgcgccggcgtccaacgcctccgcggtgctgtggcagagcttcgaccacatcacggacacgtggcttccaggcgggaagctcaggcgcgacaagcgcaccggcgccatccaggctatggccctctggagggcgcgc

SEQ ID NO: 46128 - DNA, 563 bp, Triticum aestivum
  unsure (1)..(563): unsure at all n locations
  Clone ID: PAT_TA_46128
agcgtccgtaaaatttcgtgtggagttaccttggctcgacacacaaannaacctcctgccgaagtagagtaaccagcacgcaacccgtcggnaatgatagacctcgagccagtgtaacttcggcaggaggttctttgtgtgtcgagggattgtccgttggttatcgttaccccatcttccggttacatgtactgctcgcgtaattgggagatattatcagctgaattcagaggagtacattgtattgtgaaagatcgggccaaatcagtagcacgacgaggttgtgctttcatcagttggtattcggaccaaagattgttcacgggtggacttatactactttactcatataccctggagcgatacaaggcatatcaccaaaggcgtgatcatgctcaggaagcaattgatgtgaaggtactcaatgaccaagacaaagcaggcatggacattcaacatgctgaatttttggcatcgacagtttctgcggatgcatatgctgagaaagatagattgacgccgaggagggtttcgtttcaaggggggagaggatgatatggcaa

SEQ ID NO: 46129 - DNA, 595 bp, Triticum aestivum
  unsure (1)..(595): unsure at all n locations
  Clone ID: PAT_TA_46129
gntccgcgcggtccggtcaaacgcctccgncaacgtctactgcaccctgcttgcgcacagcgccctccatggcgccatggcaggatacagtggcttcaccgtcgcgcccgtgaacggcagacacgcttacatccctttctatagaatcaccgagaagcagaacaaggtcgtgatcactgacaggatgtgggcgagggtgctgtgctcgacgaaccagccctgcttcctgagccacgaggatgtcgagaacatgaagcacgacgacgatgagcgccaccacctgcacaacacgcagctcctcgacggctcaccggcgaagtgctcacccaactgcaatggatccgctggagcagagtgagaggcacaaagctatttggatggatatattgagcatgtgtaattatagctattcttttttaaccttctcttgtgagtttttagcttgccttgtagtagagacttctccggagaattactgtataactatatataataagggttccacgatggcaatctttggtggtagaagctcgattttgtagattagaaaagctaagttttgggttcgagctcttcgcaacagaagctcttttgc

SEQ ID NO: 46130 - DNA, 602 bp, Triticum aestivum
  unsure (1)..(602): unsure at all n locations
  Clone ID: PAT_TA_46130
gctttactgtaaactgcacatatgcaattgtgaagggcattcagttttttcttcagaagcaaagatagtaagcttctcttattcccaggaaagctctctactttatttcgactgtagagtagaggggcaaagacaatttatgagcagaatggtagtgaagagaggagctgcacagtggcttctcgtcgtgacaactattttcttaacctttttttacctctactgttttgcaatagttgacttgatgttttgctttggctgctttgctatgtacaatgggtggttgtagctgctgcttgtagcattgtatggttgatgtgttttgtctttgatgcaatccaaattttggcagcaattgttttgaagacacgggagaagacttggggcgacgtagtagtgtgtggggcgggcggagcgtcgggaaaggccacagcaacacccgcgcttcaatcaattacgatggcctctgatcgaaccatactaagcaagtgtaaaggaattgacaaagtgcaaaattgttcaaagaaatatgacttggggcgacgtagcantgtgtggggcgggcggagcgccgggaaaggccacaacaacacctatgtcaa

SEQ ID NO: 46131 - DNA, 606 bp, Triticum aestivum
  Clone ID: PAT_TA_46131
gcgagttcttcggactcaagcgctacaaccagttcagcgatatcaattcggatcccgagattgcaaacatcctcgagaagctgtacactgaccctgacatggttgagctctatcctggtctcatggtcgaggacatcaagccccagcgcaacccaggatccggtatcatgccgacctactcagtcggtcgagctgttctctctgatgcaatcacgcttgtgcgctcagacagattcaacacgattgattacaccgtatccaacctcacttcttggggttacaacgaggtccagcaggactacaagaccctcggtggttcaatgctgtacaagctcatccagcgcggtgtccccaactggttcccctacaactctgtcgctgtcatgcagcccatgtacaccaagagtgccaatgagaagatcgccaaggagattggcacctttgaccagtttacaacagatgatcccaagccaccagccaaggtcgctgtgacgatgtccaacgagaccatcaagaaggtcctcagcaacaccaagcagtatgtcgtgccctggctcaaaccattgaacgacctgttccctggtaagaaagaatatggatggttca

SEQ ID NO: 46132 - DNA, 595 bp, Triticum aestivum
  Clone ID: PAT_TA_46132
caaacaaaaaactggccttgacttgctcctccgggcgggcgattctgctccggcgccgccaggtgcttcgcttcgcttctcgccttgctccgatacttcgcctgcccgcctcccccgtccgtcgccgtcgtccctctgcggctccaccagggttcgctgctcggctccaagcaagctagacgccattcctgggctccgccgctcgattcctccaccaagaccaggccagagagccgctgcaatcattcttcacatgcttctgggaggcctttgctcattgactataataatctcactaagatttgttagtcttcccgaggatccagtttgggtcgatccgatgctgggcgatcctgttcgtgtcctggttccttgtctttggagtgtgggcctcgagaacccgcacgagccgccgcgcttcatgatgacatcgagtgtgccctctgtcagctgttgcgaggatttgggaccgtgtcgcaagagtagcgtccacgacggtgttaggtactgttacccctgtctatattggccgcgagctatgccatggacgtactattttttttttagctggagtatgtgagatgtacatgtttgg

SEQ ID NO: 46133 - DNA, 486 bp, Triticum aestivum
  unsure (1)..(486): unsure at all n locations
  Clone ID: PAT_TA_46133
aaacccggacttgtcaacctcattgagnacgaactgctctcaagccaagtcgacgaggccctcgctgtctacgacgagtacgtcaaaactcanacctccgaagtggtgaggccaagaaggagaggagaccaaggcctaagccgtctccgacttgtcatcatttccttttttctattatggttatctgactgggcaaccccctcaatggaatgacgaatgcctctacaaggcaatttatggaacgatcagcaacgaaacatgctttacgaccttgtgttacccaatatgagggggcgcattatgtacagatagacttggttgctatttcttctcaggaagggagattcaaaagtttggggactttaaggtggctggctctcgtcgcgaaccttcgcttgctcacagcaacggcgttggcgctttcgagagaacccaccagacggcgttgacggttttctgacactctggctgttggcctataccccc

SEQ ID NO: 46134 - DNA, 315 bp, Triticum aestivum
  Clone ID: PAT_TA_46134
gacgggccgtccttccggcgtcctgcgggaagtgcctcctgcatacgaacacggcgaccggggcgcagatcacggtgaggataggagaccagtgtaacaacacgtgggctggacactggacttcgacacggtgttcatgaagacgacaccgacggggcacggcgtgacctaaggccacctaaccgtcatgtaccaattatttgactgttgcgacaactaactgattaattaactggtgctcaggcgctatggaaaataataagctgcaaataaaagtactactaatgtgctacttgcattgatgcacttgataat

SEQ ID NO: 46135 - DNA, 545 bp, Triticum aestivum
  Clone ID: PAT_TA_46135
atcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactc

SEQ ID NO: 46136 - DNA, 221 bp, Triticum aestivum
  unsure (1)..(221): unsure at all n locations
  Clone ID: PAT_TA_46136
cggccgcgtgggggaggattaaaacagnattaatttaccctgcacgtgaacatctcccggcctgttctgctccagttctgtgccgtcctctcctgtgttaatttattactacgtacaagggtaaaaagaacgtaaaagtgtagcagaagcagatgatctagtgttagctgtgccgccgttaattatgcgatgttccgtttaatcttactcattctttttcg

SEQ ID NO: 46137 - DNA, 546 bp, Triticum aestivum
  unsure (1)..(546): unsure at all n locations
  Clone ID: PAT_TA_46137
catccgcagcggctttattacctaccganaanaananagaaaaaaggttcgagtgcgttcgagagtgaggagtgagaagagatggctccggtgaagctgtacggcgcgaccctgtcgtggaacgtcaccaggtgcgtggcggcgctggaggaagccggcgtcgagtacgagctcgtccccatcaacttcggcaccggcgagcacaagggccccgaccacctcgccaggaacccctttggccaggtgccagctttgcaggatggtgacttgtacgtcttcggtatgatgttctcttgagatgttctctcttttctacccctcataaacagaactataaagggtcatgatgcttttacattactgttgttgtggttgtttgttttgctgttaatgttgtttccttgtagtataacaaagctagcatttccacttgggcttaaatggtacctgagcctttactagaaacanaggaattggttcatttggattaatgataaacctttgaacgtgttcttcacacatcagtatgtgatgacatgagtaaaa

SEQ ID NO: 46138 - DNA, 576 bp, Triticum aestivum
  Clone ID: PAT_TA_46138
gcgctgtacagaagcgcacctcttctttggctcaattatccccttccttccttccttccttgtgcttcttcattcagctggcactgcgagtgagcgcgggattggaggagaaggagatggagctggtgtcctcctcccgctccaccctatcctcttgcagccgactggttgctccctccaggtccagttccacgacggcatccgcagccgctaggcgccacgggaagaggctattatgtgtcttgggtggagacaggaatggtaagctcaagatcgggaagcgggcggctcttgctctgctcctggctacgcccacgctctcactgcccttctccgcccacgccaagaccaagaccataaatccttatgacgaaagacgcttgcttcagcagaacaagaagatccaggaagccaaccgtgcacctgatgatttcccaaacttcatcagagaaggttttcaggtcaaagtagtgacacccgacaactacataactcgggactccggattaatatatgaggacgtcaaagttggtacaggcgattgcccaaaggatggtcagcaggttatatttcact

SEQ ID NO: 46139 - DNA, 365 bp, Triticum aestivum
  Clone ID: PAT_TA_46139
gatcaagataaaccaactttcaaaagcacgcatcacgctaccgatcttgctttagtccttgatgagcatgatcttccaggaccctgtgtcccccttaatactccctgcctactctggcgcccttaccaaggtgacttaacccggtgcaccgatgtggctattacttcggatctgattcgtctccggttcccagacccgctctactgtcgtcgcgattggcacttactggtcttgctaccgccgtggtcattgatatagttgtctaaatttttgactatgagacttgattaccatatcagcatatgagggattgctcatgactcacaacactggaaagttaagatagtatctggctgatgcgcttg

SEQ ID NO: 46140 - DNA, 466 bp, Triticum aestivum
  unsure (1)..(466): unsure at all n locations
  Clone ID: PAT_TA_46140
ccccgcgtccgcggncgcgtgggcggacgcgtgggtgcgcgagaacttctctgacgggaccgtcatgacgattgcgcatcgaatcacctgggtcctcgacagcgacatggttctgctcctcgacaacggtgtggccgtggagcgtgacacgccggccaagctgctggagaacaagtcgtctctgttctcaaagcttgtggcagagtacacgatgagagcgacgcacacgtagcgaacgggtggatcctccagccgttcttccacgccgttgaggcttcttgagtgagtctggccgtcgatgatgccgaaaaattactggtaggtgtgatgtgaagtgctctcggatcggatctaccacggtgttggtgctactgatacgcgcacggtaactttacatgtttctgaagaaaaggctgaaaaggtggttaagagtcngttaaagtttagtgtttgaagaaagttgttc

SEQ ID NO: 46141 - DNA, 493 bp, Triticum aestivum
  Clone ID: PAT_TA_46141
cggagccaagtctgccgtcagggcccggtgagaagggggttcacccccgcttgctgccggagttaggagagcgctgcagaaggggccacgcccgagcacctaattaatagcgcaagccgagcgccgggcccccaataacgacaccgtagcatgtctatgccttccacacgggaggacacaatcaaaatgaagtgccgtgtcctacaggagaatgtaggttttgcacatcgatatggaaagcgtggtcactcaaaaagtcactttggtgacattgacatttttgatggcaaacaatcttgtggatatggttccttaatacaaaaaaggcgaccgcccccatggagaccggctaacatatcagctgattgaaataactgaagatggatatgtgagacttataactagataaggcaacacggaagatgacctgaagctctgcaaagaagatgttctgcttggccagatcaagactggatttgatgatggcaaggac

SEQ ID NO: 46142 - DNA, 580 bp, Triticum aestivum
  Clone ID: PAT_TA_46142
acttgctctcctaggattattacctacccttctgaagaaggtctaccacctatgttcaattatctatatgttaactatggcagtgtcttcactgtaagttgctttggagtgatcaaggtaacactcttgatcgggccagaggcgacgactcatttcttccaaggtttggagtcagagattagccatggtaatctgcttgagttcacagtacccatgtttggcaaggcagttggttatggtagagataccgccacccgaatggaacaaatgcgcttccacagtgaagcactgagggcatccaggttaaggagccatgtttctccaatgcttcaagaagtggaggatttctttgcaaagtggggagaggaaggcgtagttgatctaaagcttgagttcgagcagctacttatgttgatatcaggccgatgtttgcttggaaaagagtccgggagaatatgtttgatgaagtctacacactttttcgcgagatcgaaaagggtgtgaccttgatcagcttcttgttcccatatctcccaactccagcaaaccggcagcgtgatagggcacgtataaggctaac

SEQ ID NO: 46143 - DNA, 521 bp, Triticum aestivum
  unsure (1)..(521): unsure at all n locations
  Clone ID: PAT_TA_46143
gngattgatagtagcagctagctataagcaacagcaacaatgnngctgacccacgatcccccggttcgaggtctcccgttttaccttatgatccgagatcacctcctcctacaaggtctcctcgatcacctccaccaattcctccaagtctccccgatctcctcctcccccaccacgaagaccctccaatcttgtccaccacggctcttcctccgaccaacgtctcggccacctcatcgcctacggcactctcccacccgaccgttccgctgagctactagacatccaacatgtcgaaccctcaccagaaccccccgaaccatccaagccgacaagcccgagctcccgcgcacttccccccgatttgttgcgtggtcttttgatgctcctcatggccatggaccacatgggtctcgccctcaacagntggtcccacggcaccggccgaaagaccgagatggacggcctacccatcaaggaatggaacacagacttcgcatactttatccggacgcttacac

SEQ ID NO: 46144 - DNA, 573 bp, Triticum aestivum
  unsure (1)..(573): unsure at all n locations
  Clone ID: PAT_TA_46144
gntgtgtatgtgttacaatccaaaagctgctcggtcagcttctgaagagggaagttcagagttcaagcaaacaaagtgctgtgctacaggatttgtgcagagctgcgcgatgggaggaagctggggagatgatatctaagatggccagaaaggattgtcccccaaatgaagtcacatcaatatactaatcaattccttgtgccaaaaaggcttatcgatcgtgcaatcttggtggttgagcaaatgccaaagtatggaagtacacctgatattttcacatacaatgcccttatcaatggcttttctgaacaaggccgtctgtatgatgccgacaagttattaagcactatgccgtgcaagccagataccgtttcctataattctacattgaagttcatgtagagctgagcgatggaaggaagcagaggaggttgtggctgagatgcttagaaagaagtgccctctaaaggaagtaacattcaattatgctaatcaattgtttataccaaacagggtaacctgaatcaacctttgaaatctcttgagaaaattccaataatataaagttatgct

SEQ ID NO: 46145 - DNA, 325 bp, Triticum aestivum
  unsure (1)..(325): unsure at all n locations
  Clone ID: PAT_TA_46145
gtttcagcatacgcttttagcgatgaagaaagagcccacgggnaacaatatctttgtattgaaacattgttgtattctctgtctggaacatgtcgtttgggctcctggtggaaaataaagttgtactagctattgtagttcatattgtatgtccatgtgttggtgcaggcctgccatttagagaacgtgaaacatttgcaagtcgccacttctgaatgcataaccttcattcgcctcctgacacagatgggttcgtctacaagtggattttgtgcaagttttatgaaaatggtgctaatatctacaatatgtataatatatacgt

SEQ ID NO: 46146 - DNA, 378 bp, Triticum aestivum
  unsure (1)..(378): unsure at all n locations
  Clone ID: PAT_TA_46146
ctggtaccgcctgtcgagtaccggtnccggnnnatatcccgggtcgnacccacgncgtccgnaatgccggnaatcagcaatatttagtagtttggatttgaagtgtacttgcttagaatggcattacggttgaagttgcattcttctagcgatgctcgattgggtcttcgggcaagagctcctcgatctcctcgtcggggaccttcaagactcaaaggaggctggacgaatgcaacttcaaccgtaatgccggaatcagcaatatttagtagtttggatttgaaagtgtacttgcttagaatggcgtccatgtgctaggcactgcctgtgtttagaggctcggttctattggaccgtccagcagacaaaaaagaagag

SEQ ID NO: 46147 - DNA, 520 bp, Triticum aestivum
  unsure (1)..(520): unsure at all n locations
  Clone ID: PAT_TA_46147
ccgtgccaaaaggaatctacacttcatatgtgtntccgcttggcgtgtcagaaaaaaggggagcacatttttgtcaaaacactgatggcaaaaacatgctttgagttgaggagaagaatcttacaggtgaagcaaagattttgatgaaaccggcatccccccaggcagacagcgtctcatctttgctggngaagcagctgtgagatggccgcaccttggctgactacaatgtgcacaacgaatgtaccattcatcttgtggtgttccacggcctcacgtgtcaaagaatgggatgcacatgcacatcattatcaggggactgactgacaagatcatgactgctgtggctgagggagaagatccatatacagtgtgaaggtaaaggtttccgctgaaaccggcgttcccccagacagacagactctcatctttgctgggaatgtgctggaggatggccgcaccttggctgactacgacgtgcaacatgcatctacccttcatgttgtgttgcgcggcgtca

SEQ ID NO: 46148 - DNA, 296 bp, Triticum aestivum
  Clone ID: PAT_TA_46148
acacacggcaacgagagagaagcacatgtccgacatgtacaactagatagcctgcaattatacggactaacgtcttctggtaacgaggctgcccactggtgaacctggacgaacgccgaacgggtacgggagtaatcaggcggcgtctacagaggataatcaagacgaatgtcgtggtacgaccagatcaccccggcagaacaagtctgctacgtacactgcaacttgtgcgaacagcgaactcacggaaagtgcacctgtgaacatcatgctcaacattgtgacagtcctgagtg

SEQ ID NO: 46149 - DNA, 236 bp, Triticum aestivum
  unsure (1)..(236): unsure at all n locations
  Clone ID: PAT_TA_46149
gttttgtggaagtcggccacagnatggaggagaggatatcggttgctgttaaccccaagagtgggatcgccaggcgctctggaataatgtcgttcttacaccaacctcatgtcttcccgctgtctctgttggtcttttactcaatattttggatgctctttcatatggtatgtttctcaaaatcatggctctacagagtaactaacaattgaaggaatgattcttttccctcttgg

SEQ ID NO: 46150 - DNA, 402 bp, Triticum aestivum
  Clone ID: PAT_TA_46150
gcgcaacacgaagatggcgacgatgtccctcgccgcggcctcacccctcaccgcctccactccccggggcctcgccgtgcccgcgccccgcgcgccgccattcctcgtcccccgcgcatttggcgcgccggcgacgcggttcgcgggactggcggcggcgccgcggccgtcggggaggggtgacgcggcggtggtgaggatggcgaagagggagcaggagctggaggagattcgggccatggagacggagaatctggagcaggaggtggtggacctcaagggggagctcttcctgctgcgccttaagcgcttcgcgcgccaggagttcaagtccagcgagttcggccgcatgcccaagaaggttggtcggctggtgactgggagaagaaaaaggaaattgga

SEQ ID NO: 46151 - DNA, 444 bp, Triticum aestivum
  Clone ID: PAT_TA_46151
gagttccccaggagcgggtcgacgaggcccaccgtgccggcgtcaaggtcttgcatcaggttggtaaccttgaggaggcagcaaaagctaaggaagctggtgtagatggaatcatcgttcaaggccgtgaagcaggggggcatgtgattggtcaagagggtctgctaccgttgctgccgagagtagtggatctagtttcagatagtactgtttcggttatcgccgctggtggaatcgtagatggccgtggctatgctgctgcattggcacttggtgctcatggtgtttgcttaggaactagggggctgtttggttggtgcccaggttcgccctgccaatcatgggctgaccaaaaaattggcgaccaaatcgcgcgccctggtttcgccaacaatttggcgtggaatcagaaggagggagtgcgggcgagctgggcatgccaaa

SEQ ID NO: 46152 - DNA, 425 bp, Triticum aestivum
  Clone ID: PAT_TA_46152
agcaaacgagttgcgacatggctgcgtccgtatggttgttcttctcgctggcgtcgctcggtgccctccatgtttccgccctcagcgtccgcctcctcgccagcctcgcgccctgcctgcgcgggcccaaggatctccggcgcaggtacggcgcgtgggccgtcgtcaccggcccgacgtcaggcatcggacgctctatgtccctggagctcgcgcggcgtggcctgaaccttgtcctcgtcggccgtgaccccgccaagctccgggatgtctccgagaccatctccagggctcacgccgtgcagaccaagaccgtgctgttcgatttctccctcgtctccaccgcgcaaggggacgaggcgatgcggcggctccgggaggcggtggcggggctggacgtagggttgctggtgaacaacgccggg

SEQ ID NO: 46153 - DNA, 485 bp, Triticum aestivum
  Clone ID: PAT_TA_46153
aaaaggccccagcaacccaagcgcgtcgaccccatctactttcagagattttattagtcgagatggcacaggcgatcgaggctcagagggagggcgcagaggtgtaccacggcgcggcgctgtgcgcggagaaggcggtggagctgctggccgagaccaacatgccgctgggcctgctgccgctggcggacatccaggaggtgggctacaaccgcgccaccggcttcgtgtggctgcgccagaagaaggcgctcacgcacaccttcaagcagatcgggcggcaggtctcgtacgccaccgaggtgacggccttcgtcgaggaccgcaagatgaagcgcatgaccggggtcaagagcaaggagctcctcatctggatcaccctctgcgacatgtacatcgagaaggacgatccctccaagatcaccttcaagacgcccaccgggctggggaggaccttccccgtcttcgtcttcggagaagcagga

SEQ ID NO: 46154 - DNA, 505 bp, Triticum aestivum
  unsure (1)..(505): unsure at all n locations
  Clone ID: PAT_TA_46154
caaataccgaccttcaaaaccaaccaactctatgcccgngaatttctagaacattaccgtggctatctgcaggcagacactgcataagaatgttatagaagagtgggcatctctcctgtcagatactatcagtgagtgccttgattcatggtataccaagcagactgttgtgcctaaaaacatcgacgaatcattgagacctaataaagaatatgcgtactacagaaagagaaagttaaggaacagctgtgaagcagtgtcatccaaaaaagcagtgagaactccaacggatgagcagctttccaagcctctacgtgagcttgttgagcgcaaggttcatcttaaaaatgtccaggaaccaaggaaggccgggaagtcgaaaaagtcctccaagagtcggaccaaaactcttgataatgttggagacactttgaatatcgaacaaggcttgaagcggctttgcaatgatgggccaaaaccttcataaagtgttcccaaaattttt

SEQ ID NO: 46155 - DNA, 508 bp, Triticum aestivum
  Clone ID: PAT_TA_46155
gcagcgtggaatctttcgtctcgttcgttcgtcggacctcttgaagaaaatcgaccgccaacctctgatgatgatgacggctcttgttttttttctttttacctggcagataaatcgcaaagtttccccccccttttcaccttttatccttggcccatgtctagcacctagcatttgtgtatctctctctattctattcccgtcttgttgttcattaagaagtggacagggcctagcccatcccgatggatcgccaccaaagaaggctttctcatgtttacggctttctcccccttgtcttatattggtcctgtcttttcgttcctgtctatcggcctgttattagaccgtgccctggtgaaagaagaggagatgaatcgttttctgttacttctaaaaaagaccacttccccccaaagttacaccccccttacatttttttcttacaagggaaccgaaaaaaaaaggggggacggtggcctcatttcggtttttttcctcccggggg

SEQ ID NO: 46156 - DNA, 471 bp, Triticum aestivum
  Clone ID: PAT_TA_46156
cgcgattccatttcttgcacacggcacacccatggctgtcgccggaggaatggcgctgagcctgcacgtcccgtcgtcttctgcgtcgccggccgtggggcggcgccggcgggcagcggtgaggtgcggggcgacgagggcgaggccggccgtcccgggcggggggctggaggaggaccactaccggacgctgaggctggcgccgggcgcctccaggggcgaggtcaagagggccttccgccgcctcgcgctgcagtaccacccggacgtcgcgcgccggggcggcggggacggacacgaggacgacgccatcgacttcgagcggatcaacgcggcgtaccagacggtgatgcgcaacatgcgggaggcggaggctcggctcgagtactggcgccgccgctacgggctcgcggacgaggacctcgaccgctaccgccgtttccttaacgacgaggacgaggacgactggtt

SEQ ID NO: 46157 - DNA, 512 bp, Triticum aestivum
  Clone ID: PAT_TA_46157
cacaccatggcccccatgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacctgccacccctctccacggaggccctcctgaagcaggtcgactacttgatccgctccaagtgggtgccctgcctcgagttcagcaaggttggtttcgtcttccgtgagcacaatagctcccccggatactatgacggtcgatactggacaatgtggaagctgcctatgttcgggtgcaccgacgccacacaggtgctcaacgaggtggaggaggtcaagaaggagtaccctgacgcctatgtccgcgtcaatcgcttcgacaacctgcgccaggtgcagtgcgtcagcttcatcgcctttaagccacccggttgc

SEQ ID NO: 46158 - DNA, 456 bp, Triticum aestivum
  Clone ID: PAT_TA_46158
aggagcgcgtgggcacacgcaccgcgcggagcggttgagctctcgcgcatcactgagatggccctgcgcctgcactgtcgctacctcacacagagccagtcggctgcagttgggtggggactttctcgtgtcggctaaaaagactgtcttacagtgaggcctttaatttgacaaggcgcatctcgatctgggagatgacgacaaggggggactggagctggagcatggagacggaatggagcgggacgctatggacctcgagctactaataaaccatgtcatcttcctcctgcagcacatcctgaagataaccggtaacaacagcatggggaagacgaatgcggtggatgctgaagaaggacacgatgaaggcggatcctgctgaacagcgcgagctcctgctcattcatggcgctggctaccttttaggaacagcaaaggcggcgaggaggagct

SEQ ID NO: 46159 - DNA, 433 bp, Triticum aestivum
  Clone ID: PAT_TA_46159
ccgcccacgcgatccggctgactacacctggatattcccaggccatctagcggccatgcagaagaataatagcgggacacatcaggagcgtgagcatgggcatgtatgacatgaacgacgggctgcggtcgaggactgttgaccataggagggcacttatccacaggatgttgacaaactgctgcaggaagctgatgatccattatcatcctgatataacgtttgatcgggagagaatgcccaaagcatcttgggttatgccttattaggcaaatgaccgagtgtccatttcttgaagtatcttacaacccagaacagggtgctcacccacgctagatcgcggatccaagcatgacgaaattctcacgcaaagtcctacctttcaagtatgaccatagacggtatggatatgaagagtctcttaagaagtatg

SEQ ID NO: 46160 - DNA, 484 bp, Triticum aestivum
  unsure (1)..(484): unsure at all n locations
  Clone ID: PAT_TA_46160
gtgccatgctcgacacaatcacgcggtggcatctcatcattccgcgtnaggtggaccgtatgagacgcactgttatctgaaaaacttaatagacttcaacaactacagcgccgtggaaaaggaacggatacaagagaacaggggactcgactagatatggggctcatccccaacatgtaggcttacataatggctgatgatcccacaactaaaaaatggtacttgcggggaggcagacggccataatgtacttctatgccacatggtacagctgcacggtgggaggagcactaaatcatgcctggctgatcctgccttgttcgaactacggtagaatgatactcctacttgacactaaaatagtcgggacatgaacaccagtaggaactgatgttacatggtttagtaaccacaatggatacacctgcaatgggcaaaagtgctcctgtcagtctatgctattcatgcacaagaactagttata

SEQ ID NO: 46161 - DNA, 516 bp, Triticum aestivum
  Clone ID: PAT_TA_46161
tcagtatgtttctcatacctgatttgatttttgacctttttcttaatttttggttggtgatccatgaaaacagagatgatagcaagacagggacatcagaaccctgaatttcagggttatgacagactacgtctataatgggaatctctctgatgttttcgatttccccaagttaaattgatctgattttctcttttctatcattattctttggaatatggtcctctttttcttgcaattcagaacttggatggcaatgctcaggtcatggttggcctcatcaacaacattgtccgtacatcagttatacaactggcaactgaagcttaataacattttcatgaatatgaacagatgtttatccaaaaattctcaataggataggaaaatggtggactgctatacaggaacaatgtacatgatcttaacccaaaggcttccagatgaccctacagtggcaatgtaggtttgattcaatacgccaaacatataattggatggggcctatagagcttt

SEQ ID NO: 46162 - DNA, 479 bp, Triticum aestivum
  Clone ID: PAT_TA_46162
cgcctccccacctagcaattcacgtactccgccatggccccagccgtgatggcatcgtccgccaccaccgtcgcgcccttccagggctcaagtcgaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacgggcgatactggacaatgtggaagctgcctatgttcgggggcaccgacgcaacgcaggtgctcaacgaggggggagaggggaagaaggagtaccctgacacctatgaccggggaatgggg

SEQ ID NO: 46163 - DNA, 456 bp, Triticum aestivum
  Clone ID: PAT_TA_46163
ccgcatccagtttggtcgccttccgatttgaacctacccgaatatacgtactagtcgacagtgaggccaaatgcgccgccatggacccgtacgaagacagaccgcccgctaagtatcaccggcggcaaaggcgccccgcaagctgctcgccaccaaggcggagaggaagtctgctccgacgaccggaggggtgaagaagccccatcgctacatgcccgacaccgtggcgtctcctggagatccgcaagtgccaggagagcacgtagctgctgatctcgaagctgactttccagcgcctggtccgatgagatcgatgcaggacttcaagactgaccttatgcttcagagccacgccgtgctggccctacgagatgcggtgcgaagcctactctggtggggctgttcgtagacaccaacctgtgctccatccacgccaagcgcgttaccttcatgccc

SEQ ID NO: 46164 - DNA, 432 bp, Triticum aestivum
  Clone ID: PAT_TA_46164
catcactctgtgtccaactagctagcatctgcagcagcatcctgggagagaaataatggtgtatgaggcggtggaggccattgctctcaggagccagcttcagagaagaaacaacagtgtcagtgtgagaagccatgagcatcaggtgaaggccacggaggagaatgagcccatatggggcattgttctctggatcatccggaaggtttgcccggccttgtaggccatgctgccacgtatggatgattagagtttaacagctcaaggtggattcttgttttgcttcgagcagagattttgcaaacgtcatgtgtcgttatgtatattctactgtatgtttttaggggatatctactatgtatttatgtcatgtatgtatgtattgtttagccagttcaggcaaatgtgtatgtcacttgtagttagtaggaa

SEQ ID NO: 46165 - DNA, 485 bp, Triticum aestivum
  Clone ID: PAT_TA_46165
gccaccggcaaagctacgagccgtcttggccacgccgcgagcggtagaacgctgttttagcagggtagtggccagggcgtgccggggtgctgcggtgcaaggtatgaagcggtgctacggcagtggtcgtgggcgctgcgaccggctgtgacagatgctgtgtccgacggcaacagatgctacaactaagggtagtgacgttgaactgctgcagccgatgacgttgactgctgcgaccggcgacgtcgactgctagcaccggtgacttaggatgctggaactggtaccggaggccgggatacgattgtcagccgtgggagctgcaaccggcagcagccggtgccggagatgaaagtcacccgattgtgggatcgtggcactagatgctggaaccggctggcgacagagctgcaaccattggcagcataagtttgaacccaccgggggagtcatttttttggtgggaccagcgactttcaatgttc

SEQ ID NO: 46166 - DNA, 482 bp, Triticum aestivum
  Clone ID: PAT_TA_46166
ggcatgcacttacctgcctgaacactggtttacttgctcatccctggcctttttagcaaccacagtccactttactttctcaacactaaaagatcttttcaaagatggggcttacttgccatattgcaaagattcatagtgaggcatcagtggagaaaaagcacgggaactgaaactatacatcgaggagctctactggggatctggcaaacaggttttgctcctgggacatagcaagggcggagtcgatgcggctgccgcactctcgttgtactggtccgagctcaagggcaaggtcgctggtctggcactggttcagagcccgtatggcggcacccccgtggcttccgacatccttcgagaaggccagatcgctgacagggagaccaggaggatcatggaactgatagtgtgcaaacttatcaagggcgacatgagagctctggaggatctcacctatgacaagaaaaaaggacttcatt

SEQ ID NO: 46167 - DNA, 368 bp, Triticum aestivum
  unsure (1)..(368): unsure at all n locations
  Clone ID: PAT_TA_46167
tccgtggctactgtctccanatatgcatggncggcgtattctctntgaaagtccgntatttatagtttcggtgtcctggtgatagagnacatcactggcaanagnaactcgagcttttacgacgacgagcttgatctcaacctccttggttatgcatggntgttgtggnaaagaagtcggggtgtggagctactggatgaagcatgggcggcacctttgaatacgatgtggtgctcaagtgcatacaagtcgctctcctgtgtgttcaagtgcatcctaggacaagccactgatgtcctcagttgtcatgttgctgagcagggaaatgcaacaatgccagagccaaacgaacctgggagtaaacattg

SEQ ID NO: 46168 - DNA, 459 bp, Triticum aestivum
  Clone ID: PAT_TA_46168
cttatttcgtccccctgtgatttcgaaatcacgtcccaacacctgttattttggctatcatagtcagcaccagaatgctctcaactcatttgtcacaattttatttagagtgctcatagaaactattcataggtcatcttcacccgccaaacgaatatcccatcattttccttaggtattcgcgttatccgtaatatgagatcagaaccatcaaccgaatcaccctcacgcacatggagtgatgtgaccttgcccgagtgagaggcactcacgctcatttcctatacaaagttagcatttatatcaaagaacaacgaccagacaataaattaccatcttcatggcagagagaatcgcaattgggtctcccttcttaacctcggagccctcgtggacgcggagctctaccaggacaccagacataggcgcgccgacctggctcgagtcattagcatcggc

SEQ ID NO: 46169 - DNA, 428 bp, Triticum aestivum
  unsure (1)..(428): unsure at all n locations
  Clone ID: PAT_TA_46169
gcaacatactatatactgtgagatcgacatcaagcaaccacaatccagagcacacagatttggggccatttctccccaaagcgattccatgtgctatatggtatggcaccccatctgtcccgtgacgcttcaactaaactaccaaccaatctgtacccatacacctatccacatttccaggtgaccttatgacatatcagtactcatacacctatccatattagaacagcataatccaaccaccttgcagttccactgtctctgtcataactccttgtgctctctcttgtccagactagctgttaggcaaagccagttggatcacccgcaccgcccacctncacccttatcgttgccatcaccctcatctttcttcttaggaggggggtgattaggcatgctctgaaagaacccgatcgagaacagcg

SEQ ID NO: 46170 - DNA, 344 bp, Triticum aestivum
  Clone ID: PAT_TA_46170
cagaacacattcagaatcgggtgacgccatctcagctgcttctgacagctctgaagataacaaagatgtggctgactcggacaatccctcggtttctcatacagattttgtaactccgcctcaaccctctgttgacgataacgaagatgctaagctagattttaaataattcttaatggtttggtgcagcaacaatgatgtacgtatatgataattgcagtgtctatttagagagcactgctgacagcagcatatctgttgtgtgaagtagatgattggtactgatgatacattgatagaagcctttcttggcgtcgacataaatggaattcagtgtttgttgt

SEQ ID NO: 46171 - DNA, 430 bp, Triticum aestivum
  unsure (1)..(430): unsure at all n locations
  Clone ID: PAT_TA_46171
atggcgtccccacgcgaattctaccggncaacaacagcatggccgacaccccatcacgatgcacgattgggatgctcaaaaatacccccctccctctgactcgaagcccgaagcgctgaatttccccctcactcactacgaaatgtcccgtgacaccacgccgttcattcctcctcaacgttacccgagccccccgcagaacatgtggtacgaagtaccaaaagataggtcgtctccccagtcaaagcatgctccggagatctttccctgggaacgtaatcaaccacgacccacgagaacttttgcaggagagcctcaaccagaacctcagccaagtcctgaagagaccagtgcgcaactttcggtaaaaactgaaggcatcacagaatccggatccgaatccaagaaccaatctagctggagtacccct

SEQ ID NO: 46172 - DNA, 431 bp, Triticum aestivum
  Clone ID: PAT_TA_46172
gacccggcccaatctgcagtctgttcttgaaatccccttcagtacacgatgccatctgttacaaactagcgtggtgactaccacgacacccgtgaccggttctgactggaccaatacttgtgtgcgacgagatcactctcgatcgtccagccattgttgttagtgacggctacaatggatcgtctgtacgacgtacgtggagtttacaagagtggctgactccttctgttcgctaaattgcactgacgtaaaatgagtgggatcatgtgttaagatattttgcttttgatacttgtttcttatgcacattgtaatactggcactggatacattgaccaagattgtgattttgcacgctttctttttgacaaactataggtataatatgacacggacttgttattattttacattaagggtggtgccaagaa

SEQ ID NO: 46173 - DNA, 407 bp, Triticum aestivum
  Clone ID: PAT_TA_46173
gcgcaacaagttccagaccatgatgcagctggagcagcagatcgaggcctgcagtcccaagtagagtagcagtaaccgaagcaaaaggagcttagctccctccatgtgacccctgacatgatggggggcagtgtgtatgtatctctgaagcttgtaggcagtgtaacggggtgtcgggggctctggagggcgtgtgcgcgggaccggaccgaccgattcccgcggcggaaccccaggctcgcgaccccttgaaacagaacttgcttgtaccgtgtcaacgctataccctctgtttgtgttgtgcccgccctcaagctgcgtgtaaactcctactggtgacttgggttttgttgttgtatgctgttggggtccaaaaaaaaaaaaaaaaaaaaaaaaaaaaagggcgg

SEQ ID NO: 46174 - DNA, 449 bp, Triticum aestivum
  Clone ID: PAT_TA_46174
ctttacaaatacaaacgcacgcaaggcacagcgcagaccaacgctttgcaggcccatggctccgcgcgcattgctttgtctgagcctcctctgcctcgccgtgctggccagtggcggcgccgccgccgagtctcacacgcagtgcaccgacaacccgccggacctcacggccgggggcgacgaggccggcgcggtcgtcgacgacctcgccggcttcaaggcctacgtcaccggcggcgccgcccactcccacagggccgtcgtcctcgcctccgatttctacggattcgaagcgccattgttgaggaaaattgccgacaaagtcggtgaagctggatactacgttgtgggtcccgacttcttcaatggacaaccttacacaggaggcacaaacagaacagaatggttcctggctcactctccggtaaaagcaggttaagatggaaaac

SEQ ID NO: 46175 - DNA, 503 bp, Triticum aestivum
  unsure (1)..(503): unsure at all n locations
  Clone ID: PAT_TA_46175
ctcctggccncagcccggcttcatgcctcaggtggtcgtggcgttcccttcccccaggtggcatgggaatgccccagggccgtcctggacagttcccctaccctcagcagggtggacgtggtggtgttccccagcagatgccccccaacatgtacggtatgcctggccagttccctcctggatacggccaacccggcactcctcagttcatggctgctatgcaggctcagcaggctgctcttggcggccgtggcgctcctcaaggcggccgtggtggtcctcagggtatgcctggcatgcctcccatggctggtaacatgcccggcttcccccctaacaacaaccgccagggtggccgaggtggacctggccgcaacggcaacggacctcaaggtggccgtggtgccgatgctgccggactctccagtctccagcaacagcttgcttccgcccctccccctcagcagtaagcagattctgggtgagcttgatctttcccaaga

SEQ ID NO: 46176 - DNA, 430 bp, Triticum aestivum
  Clone ID: PAT_TA_46176
caagcccctcgcgcccggagctctcctagctgtgcgcctccgcacgttcttcccgaagaccagcagcgctcgccgacctccttgcttgttttggtttgggagaggagctcccgaccgtgcctcccgctggcgagagcccactggatccagccgcctaccgtctccggcaaacctagcagatgaggaaacgaacggggctcgcccctgctgccatggccaccggcgaccggagccgccgtgtgtgtccttcccgtccctgccatccttgccgccggatcgggccggctctgcccggctcctctcgcctcgactgcccgtgctcgcctcccgccgtggggcctcgtctctgcttcggtcagacgaacgaagctggcgccgcccgcttcgtcagtttcaggatgcgagcgctgctcgcattggccggcccctg

SEQ ID NO: 46177 - DNA, 326 bp, Triticum aestivum
  unsure (1)..(326): unsure at all n locations
  Clone ID: PAT_TA_46177
gtagcacacaanactagatggatcaatgtgctggccctgtgcatgttgatcgaattgtgctatgtcggtacaatctgcaccttgtgtggttactatctcactgagacgagtaagaaggtcatattccctgtctctagcattgtaactgggattctcctcttcatctacttcatgatgttgcggcgtccgggtccgaggaactgtggcccaaagaagaagactgcgaagaaggatgaaaagtctccggggggtggtgcctgaagagagttgtgcctgaagagtgaacagagctgtgcctgtatgtctcgagtgctgggtgagaagag

SEQ ID NO: 46178 - DNA, 421 bp, Triticum aestivum
  Clone ID: PAT_TA_46178
ggcctccttcgcggtgtcgcccccaatcgccgcctgcgccgccgtcctccgccgcgccatgtcgttctcctccgtctccgctgcgtcgcagacgagggtgggtgtggtgcagatgacctccgtgggggacctcgacgccaactacgccacctgctcccgcctcaccaaggaagctgctgcggccggagtcaaatttctttgcttccctgaggtcttctccttcataggatccaaggatggcgagtctgttaagctagccgaaccattagatggcccaataatgcagagatattgctcacttgcaaatgagtcaagtatttggttgtctcttggagggtttcaagaaaggggcccagatgattcacaccagtacaacactcatgtattaatcgatgaatctggaaaagttaggagcttatac

SEQ ID NO: 46179 - DNA, 453 bp, Triticum aestivum
  Clone ID: PAT_TA_46179
gcgcgacccagccggcacactactctctcccgcagagacacctgggccagagttgctggggcatcctacctcgctctccgcagcttcatggtgagctacttcggatgccttagtgaagaacaggccacacgctacctccactgggcacgcggtgatcttgtccgggccgtcctgctggtcgagcacgatctttacgatgccgagcttcagatccccaacccggcctcccaaaggacgcaagccgccctcaagtgcgccgcaatctatgtgtcgcaccctgcgcctgatgtccttgtgcggctccaggcgtcgcccctgccccaacagtggcttgacgctgccgccccgttcctcaagccgcaagggcgcaagctcaccctcgatgatgttgagctcatcgtgcgtatgctgcgccaccaggacggtgccccccttgatcttcagggcaagttg

SEQ ID NO: 46180 - DNA, 449 bp, Triticum aestivum
  unsure (1)..(449): unsure at all n locations
  Clone ID: PAT_TA_46180
cggncgcgtgggtttaagccggaggggacaagtttccaatccgtccatcctctaatcccgtagcagccagcgtagccgcccccacctgctctcctctgctccgggatcaatctaccccggccgtcgacctagggttttgtgcaggccatggcgcggaagatgctcaaggacggggaggcgcccgtcgtcgccgacgacggcgggagctacgactacgacctcttcgtcatcggcgccggcagcggcggcgtccgcggctcccgcacagccgccggcttcggggccaaggttgcgatctgcgagctcccgttccaccccatcagctccgagtggctgggaggccacggcggaacgtgcgtgatacgtggctgcgtgccgaagaagatactcggttacggggcatatttccggggggaatgtgaggacgccaggcaatttggggggggaga

SEQ ID NO: 46181 - DNA, 432 bp, Triticum aestivum
  unsure (1)..(432): unsure at all n locations
  Clone ID: PAT_TA_46181
ncccacgcgtccggnaaaataacaaggtcatccaaattgcttggaaggatagtactatcgtactcttcctttcgactgtgcatagcagagcttctcacgagcgcacaccaaaaaagaggaaaatgcccgccaaaagagcacaaaggcagagcaatatcgccttcaagagtacttcaacgggggaaagcttcaagataatctctattcctactattgccgctcagtataacaatgaaatgaatcacgtggaccgcggcgatcagatacgctcatacacaacatatgagcatcgctttcgccgagggccttggcaggcgttactatggtctttcctgcttgaagtcgcacttgcgaatagctttattttacagcgagagacgacacaagcccattggaagcctacataacgctaaaagattagaaggaatgcat

SEQ ID NO: 46182 - DNA, 407 bp, Triticum aestivum
  Clone ID: PAT_TA_46182
ctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaaaccccaccgctacaggccggggaccgtggcgctccgggagatccgcaagtaccagaagagcacggagctgctgatccgcaagctgccttttcagcgcctggtccgcgagatcgcgcaggacttcaagacggacctccgcttccagtcccacgccgtgctggcccttcaggaagcggccgaagcgtaccttgttgggctggtcgaggacaccatcctgtgcgccatacatcc

SEQ ID NO: 46183 - DNA, 592 bp, Triticum aestivum
  Clone ID: PAT_TA_46183
cccacctcgcgccaaccaaccccggccgacgcagctcactacctccccgcctcccgcgatggtcgccacggcgaagatcccgcagcggcagctcttcatcgacggcgactggcgcgcgcccgcgctcggccgccgcctccccgtcatcaaccccaccaccgaagccatcgaactggccaatgatactcattatggtctggctggtgccgtgatttctggtgaccgtgagcgatgccagagattagccgaggagattgacgcgggatgcatttgggtgaactgctcgcagccttgcttctgccaagctccgtggggcgggaacaagcgcagcggctttgggcgcgagctcggagaagggggcattgataactacctgagcatcaagcaagtcacggagtacacatctgatgcgccgtggggatggtacaaagctccggctaactaagatgtaattgagctggttcgaggacctggatctgttccatcaggataaatctgtgcgccgggcctttgtagggggggaataaatgtagtttgggcatggactgggggaacctttcttgcgaaaaaaaatggttggagttttgagggc

SEQ ID NO: 46184 - DNA, 467 bp, Triticum aestivum
  Clone ID: PAT_TA_46184
cgcaactccaccaattcgcgatcttctgcgccgaatcattcaattgacttccaccatttccgaacagcgactttttctttcacagctttaatcatggcccaacaaccactttcctcgtcggcgcagcccaccgacatctacggaggagatgaggtttccgcgcttgttctcgaccccggatactgctctacccgggctggatttgctggcgaagatgtccccaagagcatcttgccatcattctacggccacgtaacaggcgacaactcccgcgatctatttggcgatgagtgccttatccctcgcgagaactacgaagtccgcaactacatgaacaaggacagcgtcgtggaagattgggatgtcgcagctcgaatttgggagaatatgcttgtgaaccgactccaaccagaacgacagacaccctcctcaaagaacggtctgaacgacgaccccggacctgaagg

SEQ ID NO: 46185 - DNA, 459 bp, Triticum aestivum
  unsure (1)..(459): unsure at all n locations
  Clone ID: PAT_TA_46185
acagnattttggtacaacaccacataccattcctccttggggtgcactcctttcaaagcagtatatggccatgaacctaacctggggcaacttcctcaacctttgcaagcaacacatcctgacttgcagacgtggctccaggagagaaatcaatactctgactttctccatcaacatttgaacagagctcagaccaaaatgaaggcggatgctgataagaaacgctcctccagggaatttgttgtgggggataaggtgtttctaaagctgcaaccatatgctcaaacatcagtggttaacagaccctatccaaagctagcaatgaaattctttgggccgtttgaagtgctggagaaaatcggaccagccgcctacaagctcttgcttccagggggcagtcaggtgcaccccgtgttccacacatctcaactgaagcctcatgttgcagatcatacacca

SEQ ID NO: 46186 - DNA, 477 bp, Triticum aestivum
  Clone ID: PAT_TA_46186
gtccaatagctaaggtccatccggaggcttaattgggttgagtacagtcaggcccagcagaagttagaggttcgtttaagttagacggaaggcatgacgaaggtacagtgtgttagtgtgctcacatttgttgatgtactaacattatttactactgttggtgaaatatgccacatttgacaaagttgtccttcctataggttgtgcagcaggcacaggatatgttggatcaggtgaattcgcattggttcttacttgacttctaaattatccatgttttcagcaacaaccttccagttctcgtttctgttctggcctgctggtctcatttgctgtagttacgatgcctattaacttatcttcagaaataagcaacttagcctactgtctatctattttcttgcatgcatctcgagtttcattgtttgatggaatactttgttacatgctgagttgtgagcatagtatggcacttgt

SEQ ID NO: 46187 - DNA, 486 bp, Triticum aestivum
  Clone ID: PAT_TA_46187
caataatccattgagtcaagtcctatatggtcttgctttaagacacggatggggttgcgcaccagatccagaaggcgctgtcaagtatctatcggctgcagcctctaattccgcctccattgagcagatggctctccaggccggcatgacgaagggcggagctgccaagggagagcttgttctggccatctttgagctggcaaactgcttcagacatggttggggtatcaacaaagacgcctatgccgccaaacagtattatgagactgcagcgaacctaggagacactgatgccatgaacgagattgcttggtgctacgttgaaggcttcgggtgtaagaaagacaagttcgcagcagcccggtattatcgactggccgagaagtccggcaacaagacactagggaactcttggatctggaaggaaaagtccaccctccgggcgagggcagtcacaagtagtgggggagaggcaggcatgttgcg

SEQ ID NO: 46188 - DNA, 523 bp, Triticum aestivum
  Clone ID: PAT_TA_46188
caaaactcatacctatcattagaggccttgtcagttcattaaatacaatcccctgaagacaccaactcgtatacaagaattccagttacaaatcagcccaaatgagcagtcacaatatccctagctacaagctgaatgacggcaatgagatcccagtgcttgcattcggattgggcacagcccagtttaagaaagattctcaaagtggacttgaccagcatgtggttgacatcacaaccaaggccatcaaggccggatatcgtcatcttgatggcgccgaggtctacggaaatgaggaagagcttggagaggccatcaaagcaggcggtgttccccgagaacagctttatgttaccacaaagatccctgccgaaaagaaggggtccgccattgatgcctttgacgtttccctcaaaaagcttggtcttgaatacgtggacctctacctgatccacggcccctggtttggcgagaccgaggggggactttaggagggaaggtttgaacttgaggaaaataaaag

SEQ ID NO: 46189 - DNA, 472 bp, Triticum aestivum
  Clone ID: PAT_TA_46189
cagggcaatattgcaacctctgagttcccgacacaatgcgcctcacacatcctctccgctcacccttcacctttcgaagctactgtcgttcgtcaattgcgcaaacgtggtgcgaccgttgttgggaagactaacatggacgagtttggtatgggatctcactctacaaactcggttcatggggcagtgaggaatcctttagctaagaatgacaatgtttccgctggtggaagctctggtggaagtgctgttgcggtgcgcttaggagacgccgatgtcgcattgggaacagacaccggtggttcaattcgattaccagctgcctataccggaacggttggctacaagcccagttacggtatgatctctcgtttcggcgtggtcccgtatgcaaactccttggacacggttggcttcatggccaaggatgtcaagccgatacatgaccttgtgttcaaaaccaaaatgcatg

SEQ ID NO: 46190 - DNA, 406 bp, Triticum aestivum
  Clone ID: PAT_TA_46190
tccgccacttccattaactcagggcagcttggccagtgttatcattgaccctcctttcttcagcaatgattgtcagacgaatttgctctgaccggtcgctggctcattaaaccaaatcgccccgtgtcattgtctgcactggcgagcgaatggctcccatcatcgacaagctttacagctctgttggagtctacccaaccacgtttgagcctgcccacgcaggattgagtaaccactactactgttacgccaacttcggagagctcgacctgggactggcgaccgggtgaatccgattagtatggcggaaggacggagccgcaaatctttgggaaagaagaaacttgctgtacccaaaccgccaataaaagtcgtgcaagacatggacacacaactgaatggaaga

SEQ ID NO: 46191 - DNA, 355 bp, Triticum aestivum
  Clone ID: PAT_TA_46191
accagctttctttctgctgactgtcctgctgatagcaaactgctgccaaatccgcgcatagcatgctcacactcttttgagcacttacacgagctgttgcacgagccatcgcatgataccgcgagctttaccggaagcatgagtggcaaactcagtgctgtcctcagtactttagacattgtgccgcccatcgtgccggcacccgtggaggcccttgaccatgcctgaggccaaacaagatggaaaacagtatatgatcctggtgatgagcctgactttccactacactggtatcttcagggttactcccttgcttgcagccttacatggggcaagtatacagggaactattcta

SEQ ID NO: 46192 - DNA, 495 bp, Triticum aestivum
  Clone ID: PAT_TA_46192
cctgaacgagggaagcgagagcgaggaagctctggtttgagcggtgtagagctggagctgtagtcgccggcggcggagagcgatgagtggaggattagacagcagctttgtcctcttagtgttgttctcggctatatttttttctgctggttccccttctctaaatgtttctccccagttgatttttgtttgagcggcgtagagccggagctgtaggtgccggcggcggagagcgaccttgtgtgtgcggttgttgctttcttgaagctttcttagtgtaattgttcgcattctctctagcagggtaattgttgatgattgttctttgtaactagtgttattccatggagtaactgtatgatatacatgtgcgtgtgtgtgtgtgtgtgtgttgagggggtagttctgtgttagtgatcactaattagtgttttgtatgtagtgtgacttcttgtatatgtttgcaatggtgcttgagtgtaactttggggtggg

SEQ ID NO: 46193 - DNA, 471 bp, Triticum aestivum
  Clone ID: PAT_TA_46193
ggaagtttctcttggcaaagccattttggtcttcttccttggtgcatgtgtgtgtccgtgcgtgtgtagagttcgtcaccatgtgtgagagttgtgaggaagaagaagggcgctgcggcgaggaggcggcgccaacaaccccgaggagctcgcctccaggggctccttcttcaactggtggtgcttcgccacaagcggcggaaacaccatcaccatctcggccttgaactacgtccaggagagcgtaagctggcagttcgggttcgggatcccgtgcgccgccatggcgctcgctctctccgtcttcttgctcggaaccaggacctaccgcttctacccaccggaaaagaacggcgtcctgctcacgcagctcggtgaactgctcgtcgcgagggctaaatcctggcactcgtcatggtgttccagttccatatttcccgatgacgactcactcccccttgctggctgatg

SEQ ID NO: 46194 - DNA, 416 bp, Triticum aestivum
  Clone ID: PAT_TA_46194
ctgctttctttgccgattcatacccactcaaccagttgtcctcggaggttgttgctaaccggctgccagttccaccatccacaatagtcatttcggagagacacatcatctcggtcgtgcccgtaacccatgtcactatgtcgcaccgtaagcgatcttttatcttctatgtcgttggatatggcagggatgttttcgtccagaactacccttcgaggttttgctggggcctctgccgttgcttcgaatggtttgggaattagttgcattttatgccatgtgtgtgccaccttcttttggtgtccaatgttcatagtatcaaaacctgtgtgtgtacaactgtagagaggcaggtgggtttctggtgtgcaagcgtaatgatgtggtacggtgtggtggggtacaggacagatact

SEQ ID NO: 46195 - DNA, 454 bp, Triticum aestivum
  Clone ID: PAT_TA_46195
agtgagctgagcgcaggcgggtggaggcggacggacgccgccggcgtcaaccgcgccgacacggtccagcggcagggccggtacccgccgccgcccggcgcctccccctacccggggctcgagtgctccggcaccatcctcgcgctcggggccaacgtgcccccgcgctgggccgtcggcgaccaggtgtgcgcgctgcttaccggtggcgggtatgcggagagggtggtggtgccggcggggcagctgctcccggtgccggagggggtgtccctgaccgacgccgccggcttgcccgaggtggcctgcaccgtctggtccaccgtcttcatgaccagccacctctcccccggcgaatccttccttatccatggcggatcgagtggaatcggtacattcgctatacagattgcgaagcaccttggtggtaagggttttgttactggggggagcg

SEQ ID NO: 46196 - DNA, 547 bp, Triticum aestivum
  Clone ID: PAT_TA_46196
aggctcactaggaatagtcactaaagtgtcaatacttacacctgcaaagctaccttcaactaatgttgcatttctttcctgcaacgactacatgagctgccagaaattgctactggcagctaggaggagcttgggtgagattctttctgcatttgagtttatggatcgtcagtgtattgatctggctatgacgcatttggaaggagttcataatcctttacctgtctcgccatacaaattttatgttctaattgagaccacaggaagtgatgaatcatatgacaaagcaaaacttgaagcttttttattgagttcaatggaagatggccttgtagctgatggagttatagcacaggatattagccaagcatctaatttttggagaatccgcgagggtatatcagaagcatctgtaaaagttggtgcagtctacaagtatgacttgtccatacctgtagagaaactatatgatattgttgaagaaatgcgcagccgtgttggtgatacggcagaggtattgggttatggtcaccctggtgacgggaat

SEQ ID NO: 46197 - DNA, 421 bp, Triticum aestivum
  Clone ID: PAT_TA_46197
caactctcagaaacccaaagcatctgaacttcagctcaatcacctcaactcatctacaagatacccaaacacttttaccaactacaccaaaaacaacaatcatcatgtctggtctcatcaacaaggtcaaggaagctatccactccgacaaggacaagaagcacgactctaccacccacggcactcacgacacccacaacactcacagcactcactcttctggccttcccgagggaactgctggtccccacagcagccgtgctgccaacgccgccgacccccgagtcgactccgacttggatagctctcgacgcactggagctggccacaccactggtggtctaggctctaccaccggcactgctggccacaccaccggtcacactaccggcggaattggatcttactttgagaacatgcc

SEQ ID NO: 46198 - DNA, 381 bp, Triticum aestivum
  Clone ID: PAT_TA_46198
cggacgcgtgggcaaagcgttcgatcaatcagagaaaacatccctccatatctctctagctcttcttcctcctcctcagctcccgagttcttcctgagcgaagcaagccaagctaggtagcagatccgagaaggcgaagcgatgtcggacgtgacggcggtgatggatctggaggtggaggagccgcggctgtcgctgccgccgggcttccggttccaccccaccgacgaggaggtggtcacgcactacctcacccccaaggccgtcaacaacgccttctgctgcctcgtgatcgccggagtggacctgaagaagagggagacgtgggatatgagagggaaggggaagatgggagaaaaggaggggaactttttggtggat

SEQ ID NO: 46199 - DNA, 480 bp, Triticum aestivum
  Clone ID: PAT_TA_46199
tacagttctaaatgtagaatatttgtctgatatacatgcatcattatttgtaatctcttaattactaatgatctcttagttactattgatacaccaatttatatttcgttcgtaatttgtaccccaatctccagatcatgttgcttaagtagcttgaactaacaggtgtttttatctgttgcagatctatgatatcttccagcttcttccatcaaagattcaggttggggtgttctctgctaccatgcctcctgaggcccttgagataacccgcaagttcatgaacaagcctgtgaggattcttgtcaagagagatgagcttacccttgagggtatcaagcaattctatgtcaacgtggagaaggaagagtggaagctggatacactctgtgacctgtatgagaccttggcaatcacccagagtgttatctttgtgaacaccccccgcagggggactggctcaccgaccagaagagggga

SEQ ID NO: 46200 - DNA, 472 bp, Triticum aestivum
  Clone ID: PAT_TA_46200
gtcggttatcctgggacctgcaagaggtgccatcaccacctcctcttcaccctttgctgggagatgacctaagaagctttcaaaaggagtgctgagatctgcacgaaaggctccatgagcaagctcatagacctaaaggcctttgctggcatacagcctgcgtgactaaggatggaccacgcgtacgcctactatcaggagagggcaccatcacccaactttgctgtgctatgccatggcactagaagatgacacagaccttatcagctctgctgctaaaatctatgctatcatctatattaccatctatcatgtatgggtggcacgacgactctataatggaccagtcattatcctacccacggatatgggtttgaaaactttctgacaatggtgggaagacacctgcaacggacatcgatgttattggaaactgtcgtgtttatgataactgagtatattatgacctggt

SEQ ID NO: 46201 - DNA, 458 bp, Triticum aestivum
  Clone ID: PAT_TA_46201
gttcgataattcttgtcgtcgttttgaactaaaacgacagcagggttatggaacggagggagtacctatgaattggcccttttacaaatctcttctcatagttttcatctgaagctgaatgtagaggctggtacttcagcagatcgcccaaagaccttttctaagaagaagcaagaggtatctaacagaagggaagagtcaattgaggaggaaagcgatgaagaggttgagaagaccaaacacaaaggcactgcaggcctcatcgagattgacaatccaaacctggtgaaaccaaagagtattaaagccaaggatgttgatgttgataggacaactgatctctccaggcgtgaaagggaggagcttgagaagcagagagctcgagcgcactatatgagacttcaggaggaagggaagacagaacaggctaggaaagacctagatcgccttaccttgat

SEQ ID NO: 46202 - DNA, 468 bp, Triticum aestivum
  Clone ID: PAT_TA_46202
agcagagcagaatccttggagagtatcttcttcttccatagtaacccactccaccctttgccaagatgtacaacgctccgtcggggcaggagatgtcctacacggagcacgtgcagaagcgccacgaggagaagggctgcatctatgcatgcgtgttcacggcgttgtgctgcttctgctgctacgagacctgcgagtgctgcctcgactgcctctgctgctgctgcaactaaaacagccatggccgccatggacggacggaggctgcaaggcggagcggatatccaccggcctccgccgcctttcataataagcatatgtgtctagtgccttagctcgatgagaactgtatcagatgttgctgtattattattgtccaggacaagactatcattgtaatcaccgattatggtttgtgttgcatctttttttttgccgggggtttggggtggatcttaatttaattag

SEQ ID NO: 46203 - DNA, 462 bp, Triticum aestivum
  unsure (1)..(462): unsure at all n locations
  Clone ID: PAT_TA_46203
ccggnagtattacaaccagaagagtgggaatggatgattgagtactttggcacggattcaaaatttcaggaacgcagccaaaagaacatcgataaccgtacgaaactgaagacaaaacacataattggatcaaaatcttactcgcaagtaagttttgagaaggtatgagtccaactaaatattggaagaggagtgaacatcaagactggaatttgaaaagaacatgatggcaaagtttgcagaatggagtcaacagatgggaacccaacaggtgcctacgaagagggttgacaacaaagaaaatagtaatccaaacttgcaaaatattctgttacagagatctagtcctaataagacttcaggttcaaggcctactgctatttcttcaaatgcgctcatacaagctggagcaaggtaattcccggatgttttaaagcaatggatccaaataactagttggac

SEQ ID NO: 46204 - DNA, 322 bp, Triticum aestivum
  Clone ID: PAT_TA_46204
gcaggaggcaatccagcggtgcgccgccgccgccgccgcggcaggcggccggcgcagggcgtcgcaggccttcgagtggctcccatacaacgccaggttccgctacgccttcgccaggagcatggtcgacaaacaagccgccgcggtgctagcctagattgttctcgccttcctagttgctagctgctgcagctgcagctgccgagtactggtatatatatatatatatatatatatatatatatatatggttttgggattgagatggtgatgtgaaactcaaactagcaatcaaagcatggatgaaacttactagggctca

SEQ ID NO: 46205 - DNA, 483 bp, Triticum aestivum
  Clone ID: PAT_TA_46205
ctaatacctccttcccctcatcgccgccgccgccgccgccaccgccaccgctgcgatgtcttctgagcctctacccgcctccacagaggctctcgaggcagatctctccgccgctacgatcagcaagaagcagcttaacaaggaggcccggaaggccgcaaaggcagcgaaggcagaaaacgcagggaaggccgaaaagtctcaggcggaagaagaagacgacccctttgcggtcaactacggtgacgttccactcgaggagatccagtccaaggtcatctccggccggtcctggacggacatcggcgacctcgatgaggccgccgtgggccgctccgtcctgatccgcggatatgcggagaagttccgcccggtctgcaagaagatcgctttcgtcgtgctttgccagagcatgaccaccgtgccaggtgtgctcgtcgctagcgccgacaccggcgtcagcaccccgatgggtgcgctttg

SEQ ID NO: 46206 - DNA, 452 bp, Triticum aestivum
  Clone ID: PAT_TA_46206
gtcatatccttggaagaagcattggggacgccgatcctcttgccttttagcccgtttttctttaggaactgcgtgtacccgccgtgcgggatgtacttggatgccgctccggtggccgcggcgtcttgcgcgtcgtagccgacgatggcatccagcacgtgcaccgcgtccgacaccgtccggcacatcggtctgcattttatttccatcgagcggcaccaagattttcaggttaaatgaatatgaaacaacagcaagaagaagaaggaagggttacccgacggtgtcctgcaacggggtgatggggacgacgccggcccggctggtcaaccccaacgtcggcttgatgccgacaaccgagttgaacgacgacgggcaaagtatggagccgtcggtctcggtgccgagcgttacggccgccatgttcgccggcacgggcacgccggacccgg

SEQ ID NO: 46207 - DNA, 547 bp, Triticum aestivum
  Clone ID: PAT_TA_46207
atcaacaacccagttatcggcatcctagtgttgtatcgggtggggtatggacaagtacacgattggcatcgttgcactagccctactgtctctacatctcgtatgctgtgctactattgctcaatgtaagtcgtgttatgcaaccttaatctttttcagttgccctggaagtataaggttagtactacaactagtgaaggaagcctttttcttttggttatttttaatctgttgtacgtttatttattctactctaaaatatataatcgcttaacagttaattgttcatttgttattccataggccgaatcagggctgacacagatagcgacaagatcaatttaccaaatgggctatgtgctgatttgcctaagcatcgatgcaccaatcctgatgcgtgcgtctgttgtactgtagatggaatatgctacgtaactatggatgagtgcaagaaagagtgtaaaaaaacgtcatcttcagaagacatattattggcgatgacatcccctcctttatctgctccttatttttccagccttgaggctta

SEQ ID NO: 46208 - DNA, 528 bp, Triticum aestivum
  Clone ID: PAT_TA_46208
ggctggacccaggacttgaggacgagatgcgaggcatcctgagggtcatcaaggccaaggacgagcaggagttcctgaaggtgggcaggctggtgctcagcctcaacaggggcctcgccgtggccggcccggcgctggccggcacggcggcgctagccacggtgttcatcggctccggagaggccggggcgtgggcgtcaggcgcggccgtcttcggcggggcgctggcggcggcggtgaacacggtggagcacggcgggcagatgggcatgctgttcgagctgctccgcaactgcgccggcttctaccgtaaaatccaggaggacatcgaggccaacctcggcgagcccgacgtggagcggagggagcgcggcgaggtgttcgcaaccaaggtggcgttgaagctcggccggagcatgtcggaccttaagcagttcaggaagatggccctcccgtccgtcagagacgaggacatcaaggaattcgccgggaaacttttctgatcgacccaaccattcactgacttac

SEQ ID NO: 46209 - DNA, 553 bp, Triticum aestivum
  Clone ID: PAT_TA_46209
cgggagcgtgggcggagactaggacagacagggtcgcccaaatcggagcatatggcggctgaagcggaagcggagacccggacggcgctggtggttggtgcgctcgtggtcgtgcagctgatgatgctttacgcataagcgagggtggctcgacctgccgcccaggggaccatatgcctatccagggagatccacgccaagtggcggtggtcatctgactacatgcttatgtactaggaccacactaccggaaataccaccgggtgggtgaagctacctcttcatatggtaatgctgtacataataaataaatggcggatgggatcattacaattatacagctacgtacaatgcaaactacggtatcttcattatgaattgataaccaacacaaaggatcacgactctttctaagtttagaaagtacgaaaattattgtgacaaaaaaataaaactatgttgccaagaataaaaaaatcaaggttacttaattatacctgccaaaacttaaatcttctatggagtcaattaattataacttattatatctcaa

SEQ ID NO: 46210 - DNA, 581 bp, Triticum aestivum
  unsure (1)..(581): unsure at all n locations
  Clone ID: PAT_TA_46210
ccctgttattgtgagaattcttaattcaagnattatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgncctttattgggatgtactattaaaccaaaatt

SEQ ID NO: 46211 - DNA, 578 bp, Triticum aestivum
  unsure (1)..(578): unsure at all n locations
  Clone ID: PAT_TA_46211
gtgagaattcttaattcaanagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaacaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagntgaacaagtatggtcgtcctttattgggatgtactattaaaccaaaattgggattat

SEQ ID NO: 46212 - DNA, 592 bp, Triticum aestivum
  Clone ID: PAT_TA_46212
cacatagcagcaacggcctccgcagccggcgcgctcgagctcgccagtgtgcgggccgaggccgccgtggcagccggaaccggcgccgtccgtcgccgcagagccacccaccgcggtcgacgtacaccctggctccaccagcgcactccaatccccgtcgtcgccgtgctgccccgtcgttgactggatcaaggagccggcgcgctcgagctcgccggcgtgcgggtcgaggccagcttggcagccggaaccggcgccgtccgtcgtcgcagagacacccaccgctgtcgtcgtgcacccttcctccacaggcgtactccagtcgtgctcgtcgccgcccccgttgttgactggacaaggagccggcgcgctcgtgctcgccggcgtgcgggtcgaggccagcttggcagccggaaccggcgccgtccgtcgtcgcagagacacccaccgctgtcgtcgtgcacccttcctccacaggcgtactccagtcgtgctcgtcgccgcccccgttgttgactggacaaggagccggcgcgctcgagctagccggcgtgcgggtcgaggccagcttggcagccggaaccggcgccgt

SEQ ID NO: 46213 - DNA, 566 bp, Triticum aestivum
  Clone ID: PAT_TA_46213
gaaacgtaaacatcgtaaacagcttgtaaccaactcaccatgaaacacatggtcattctgccgctctcattgccctcgcggacgacacaacgaggggcgcacctggacactacatgtagccatggctgtgggcaatgccagcagcagaccgcaacagaaggtgaacacatgcgctgatatcctgctaaagttgcaggcccgacaccatatgtacagtcacagatgtggcaggcaaaccgatgccaggtgatgcggcaacacagctggcagccgttggcccagatctcagagcatgctccgtgccaagctgtctgtaacgagggccatgttatcatgcgacagcatcaagggcaacaattcagatcagcctctacaacaacaagtgcaaaggttcaggcaaccacatcaacaggttccggatgagataacgaggatggtgcttgagacccttgcatcggtctgcagcgcgaacatcccacaatattgcgccaccaccccatgcagcaccatttttcagaccccctacaacatacctatggccgatacctgagctggtggtacctgct

SEQ ID NO: 46214 - DNA, 576 bp, Triticum aestivum
  Clone ID: PAT_TA_46214
cgctaatccgcccgccgctctctcctctcctgctctgttcagctcggctcggctctgctctgctctgggctccggccgctttcttcttcgttgccaccgccgctgccgctccgatcggtgctcttcccacgccacagccccctccgcctccagattacgatgggttctgttggcactggattgctgaagggcttgaggagagtcttagagaagcaaaggaaaccagttgatttatgcagaacatcacgagcttggagttctacagtttctttctccgatattgatgagaaggatgacatgggtgatgatagcgatttgaaagattcaaggagagagttagaaccccaaagcgtggaccccaagaagggctggggattccgtggcgttcatagggctataatatgtggtaaagttggacaagcacccgtgcagaaaattttacgtaatgggcggacgattactatatttactattggaactggtggcatgtttgaccagcgggtaattgggtctgcggatacaccaaagccggctcagtggcatcgaatagctggtcatagcgagcatctaggtgct

SEQ ID NO: 46215 - DNA, 595 bp, Triticum aestivum
  unsure (1)..(595): unsure at all n locations
  Clone ID: PAT_TA_46215
gtcgaccgcaggttctcggcgttgcngaactggnaagaatgaaactcagactgttgaagttgacctgtcgcttattggtgttggaaaggcaaacgcacgagatgtctgggctcatgaggatcttactatctcgggtactcagaagtttgagctgaagcctcatgagttgcgacttctcgtgctatcagatatcactcagactcccaagcccaagcaatgggggtattatgcggcacctaaggcggcactagaagggactgcttcacttgtcgactgcggagcaaacgaatgtatgccagttaacaaaaagatcaagtccatcggtaaagacgccaaggtaacgttcaagtttgtcagcgctcccaaggatggcccattatacgtcggcgtcgactacatcaaccacgaataccaccacacgattggtgactgggaaacaaacacgcgaaacatgtccatctctgtcaatggagaggatgccaagcgatgggcattcccgaacgctggtggcgattggttcgagagtgatcgtatgacgatccttctagacgggttcaagaagggtaaagataacactgtcacctttactgcttct

SEQ ID NO: 46216 - DNA, 526 bp, Triticum aestivum
  Clone ID: PAT_TA_46216
gctagacaaacatcctttagtactcgtataagacacaagttgaacaggagcctgctggagccacactgcaattacaaatgcactgtggcttggggactgaggcatacaacacctggataccgatggaccatttaaggcctactccggattacctgtatatcgtgtgcaagataaaactgcatgtcaagaactacgctgatgttttttaatcaaatcaacaaccaccataaaaagatacatatataagacctccagcatgagacaatagaatcaaaccttattctacacatccaataactagacacaaactatgcacttatgagggagtttgtactggacaaaaaatacagcgacacttacccacactaacatattctataggtactataacacgttgttacaataatcacattatttgtgtcgtaatggaaggcacatttttttggaatggcatcacttctgaagggaggacacagacatgtatacaatatgaccacttgctctgttcgaaaggaattctcccatg

SEQ ID NO: 46217 - DNA, 537 bp, Triticum aestivum
  Clone ID: PAT_TA_46217
gatctagccatagcatgtctcagcatattcttgctttggctgctctggccatagacatggacagaggggctgtaccactcatggccacacagcaggcagactctgtcatacctgctcaatcgtgcccgagacaggaggacgagcctggctcccatggctgtgacgacaagcatcctgaacacctttgtgcaggaacttggctgagacaaatcgccgaccattgcaggatgcactactccaccagggcggaagagaagaacatcttgacccatttcggtcacaagctgacggctctccacaccaccaagctggagaaatgactagatgcgaactaccatactgaccgtaacacctgcgaccctgcaaatgtgtgctgtcactacactcatgtatcgatcatcaagtcgaccgggctccgcttgtctcgcataggtttaacgacaaaccgatgattgttcatgacgtgtgactccccatgccaagactgtttgaacgggtaacacgcgatcgctttgctcatatttgatactaaatccc

SEQ ID NO: 46218 - DNA, 582 bp, Triticum aestivum
  Clone ID: PAT_TA_46218
ccccgcgtccgatccacacatatcatcttggtgcaaagatcgatcaactaagcgatgggattgctactactcttcgaagctagcctggtcccagctggtcctcgccttggccaatggcagccgccatcacctcgccgtgcgctgcccagaaacgccccggcggacttcgtgagcctccacaactctttgcgtgcgcttgtcgaagtcgggccggtgacatgggacaccacggtggcgaattacgcgctgaactatgcgaaccagcgcaaagccgactgcaacctggtgcactccggcgggacgtacggggagaacatcttctggggctccgccggcggcacctggacggcgtcgagcgccgtcaccatgtggaccgacgagaagcagttctacgactacgccaccaacacctgcgcgaccaacaaggtgtgcggccactacacgcaggtggtgtggaggtcctccacgtccatcggctgcgcccgcgtcgtctgcgacagcaaccgcggcgtcttcatcatctgcaactacagcccgcggggcaacatcgccggacagaaaccctactagctagctacatta

SEQ ID NO: 46219 - DNA, 574 bp, Triticum aestivum
  unsure (1)..(574): unsure at all n locations
  Clone ID: PAT_TA_46219
ccccacaaccatttccccagccacaacaaccacaacaaccttttccccagccccaacaacaattcccacagccccaacaaccccaacaatcaatcccccaacaacaacaaccgttgattcagtcatctctacaacaacagatgaacccatgcaagaattttctcttgcagcaatgcaaccctgtgtcgttggtgtcatcccttgtgtcattgatcttgccacgaagtgattgccaggtgatgcagcaacaatgttgccaacaactagcacagattccgcatcatctccagtgtgcagccatccatagtgtcgcgcattccatcatcatgcaacaacaacaacagcaaggcatacagatcctacggccactctttcagattgtccagggtcaaagcatcatccaacaacaaccagctcaattagaggtgatcaggtcattggtgttgaaaactcttncaaccatgtgcaatgtgtatgttcgacctgactgctccaacattaggacaccatttgccagcacgaacgccggcattggtggcccatgaaaaagttggtgttatgccaattggtggat

SEQ ID NO: 46220 - DNA, 565 bp, Triticum aestivum
  unsure (1)..(565): unsure at all n locations
  Clone ID: PAT_TA_46220
gncccttcctgcaatttggcatgacgcctcggncgagcccgactgccccaccacattcaacttcgactttgaggttgttgaggacgttggtcagatgcgtggtatgattttggatgaggttcaacgattccgacagaatgtccgtaccgtgcccggccaaagcggtggaggtcttcagggccagggtgtccccgttcctctgcctcagggtaatggtcaatggactgctgaggaccctcgacctcaggaatatgctggtcatggtaacaccggacttgagcaggatcttcagggaggcctggatgcttctcgaagataagagctgctacgcaaagtacaagggttgaaaaaggatatatcctagaggattaagaacggcatgctctctggttcaaaatgaaagatacacccaaggcactggaaatagggacgatgctaggtgggtttcgagtatttaatgcctggaatgagaagagaaggatggaaaaataaagctttttggcttcagcaggctgaggggggcatgcccttaaatgggttgagagggcagtgaagcgtttccctc

SEQ ID NO: 46221 - DNA, 567 bp, Triticum aestivum
  Clone ID: PAT_TA_46221
ctctcctcattctcgcgggcgacttgctgcggcgactggcgaacgagtacatcggcggcggcagaggtcagcctccgatcccctctcttctccccggccttcccctctctctttcctctcgaatctcccgtgtcgcggcggccccggcaggatgcgccaggctgcggctactaggggcgcggcggcccggcggatttggggcgcgggtggctcggcgaatttggggtcacggcggtccggtggatttcggggggcgcggctgtttcgcggatttgggggcgcgaacgacgggccggattttgggggcgctgcggtggcgaggatctgatgggaggcagttgcgtgaggaggcagaggggctgtgtgcgtgcgtgcgtgctgccggcgtgcgtgcttgctgtgtaccgtactgatctcttccgtctccgttgcacaagtttcagggcaacagggagccatccattcgagtctcgatcgtgtgtggagactgccatggcgctgtggactgggctgggtcaggcggccacggtggcacagctggtcggcgcggacgttggcggcctcatc

SEQ ID NO: 46222 - DNA, 584 bp, Triticum aestivum
  unsure (1)..(584): unsure at all n locations
  Clone ID: PAT_TA_46222
tccgacggntgtatgatcaagnacacgaccaanagcgacgtgtacagcttcggggtggtgctgctggagatcatcacggggcggcggccggtggagcacgcgttcggcgaggggcagagcgtggtgcagtgggtgcgggagcacctccaccgcaagtgcgacccggcggaggtgatcgacgcgcggctgcagggccggccggacacgcaggtccaggagatgctgcaggccctcgggatcgcgctgctctgcgccagcacgcgcccggaggaccggccgaccatgaaggacgtggcggcgctcctccgcggcctccggcacgacgacggcgccgagtcgcggaagatgagcggcggcggcggtgggtccttcggcaagtggagtgagcagagtagaccggtgccgctgccgcgcgcgggccagacgcaggcccagacccagacccactccagctcgctggcctactcaacaaccgggagcgtgtagctggatcagtccaagcaagaggacggatcccgtcccggtgacgccaaacgcagcactgtggcgcctgtgacacggcgacggggaccgcgcgcgcgtcg

SEQ ID NO: 46223 - DNA, 581 bp, Triticum aestivum
  Clone ID: PAT_TA_46223
cctcctcctcgcctcttgccgcgtttcgtcaggtacttcccaatccaaaaccctagcctctcccatcagatcaaccactctcttcagcctaatccggcactagatccgcgcaaccagatctgataccttcgatttgatccctttccgcgtgcgcatcgtaggttccggcggcgatggcggcgaggctcgcgcagctgcggaccaaggcggcgcaggcggcggaattcgcctcgaagcacggcggcgcctactacaaggaggcgatggagaagaacaagcagtacgtcgtgcagcctccctccgtggagaagtgccaggagctctccaagcagctcttctacacgcgcctcgcgagtctaccaggccgctatgaagcattgtggaaggaggttgacggtgtcaagcagctttggaagaacaggaaggagctcaaggtggaggaccttggaattgcaacactgtttggggttgagctttatgcatggttctgcgtaggcgagattgcaggcagaggattcaccttaaccggctataaggtctgaattagatgtcgaggcgcgccttataatatactcttagct

SEQ ID NO: 46224 - DNA, 472 bp, Triticum aestivum
  unsure (1)..(472): unsure at all n locations
  Clone ID: PAT_TA_46224
cgtcgnctacatcaccgccgncaagttcgacaaggatgccaacactggctacgccactgacaaggacggtatccccgacggctggcagggacttgactgcggtgaggagtccgtcaagctctacaaggaggccattgccgatgccaagaccatcctctggaacggtcccgccggtgtctttgagttcgagaagttcgccagcggcaccaaggccactctcgacgccgtcgttgacgctgtccagaaggacggcaagatcgtcatcatcggtggtggtgacactgccaccgttgccaagaagtacggtgttgaggacaagattagccacgtctctaccggcggtggtgccagcttggagctcctcgagggcaaggagcttcccggtgttactgctctgtccagttgggcgggcaaggctagtctgtagcgaaccagaagaaagtaattgaataccaaataccaatagagacgt

SEQ ID NO: 46225 - DNA, 573 bp, Triticum aestivum
  unsure (1)..(573): unsure at all n locations
  Clone ID: PAT_TA_46225
gccaaatggatcgactcagnaccganaaggatcaactttcagaacagctcaacgctgcgaccttgcgttacttcaaagcagagaagaaactggaccgcgcaaagagttctcaggtccagaagatggaacaacaagccttcgctaatgccactcgaccttctgcctctggagatgttaataccgattctggcgagacgaatgggaactcaggcgagctactgcttaagtatgaggaggcgactgcggctgctactaagcaaaaggaacagctagatgtttttctggccgagatcaaggcactgcaggacgaaaattcgactctcaaggcgaagagagataccctaaccgacgaagatttcattcgaaccgatgtctttaaacagttcaagaaccagaacgaggatcttatcaaacgtatcaacacactcgaggccacaaacaagcaactgcgagaagaggccgagaggctacaagcagagcgaacggctttcaggactatgcttgaagcagatgcgaatcaagtgactcaggagctcgagtccgagatcatattacgggatcaggatcttgccc

SEQ ID NO: 46226 - DNA, 581 bp, Triticum aestivum
  unsure (1)..(581): unsure at all n locations
  Clone ID: PAT_TA_46226
gtaccacacaccacgcctgcctcatctctcggnagcagaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcggcggctccaggactggtacaacccgggctccatggggaagcagtacttcctgggccttgagaagtacctcggcggctccggcgaccccgcctaccccggcgggcccatcttcaacccgctcgggttcgggaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctcagaccccgtcaacaacaacatcctcaccagcctcaagttccactaggcgaaaatcgatccgatccg

SEQ ID NO: 46227 - DNA, 525 bp, Triticum aestivum
  unsure (1)..(525): unsure at all n locations
  Clone ID: PAT_TA_46227
ccgaacggcggcctacggcgacgaggacgcgtcaccggnaacggtgtccgtggcgagggcggagaagacggcgtgaaagcgtcgcgctcctcgaagccgacggccagcgacgccaagaagctggtgttcgtgggaggtgagccggaggtggcctacgaactggaatcgctgctgcacgcgtcggccgaggtcctcgggaagggctggctgggcacgacgtaccgcgccacgctggagggcggcgtcgccgtcgtgaccgtcaagaggctgagggaggtgcccatccccgagaaggagttccgcggcacggtggccgcgctcggcgcgctccggcacgaaagcctggtgccgctgcgctcctacttctacagcaaggaggagaagctcatcgtctacgactttgtcagcgccaaaggcctctcctcccttctccacggngcgggcagcgagcgcctcgacttcaccacgcgagcgcccattgcgctggcgtcggcgcgcgggnatcnccttnattccacgggccgg

SEQ ID NO: 46228 - DNA, 572 bp, Triticum aestivum
  unsure (1)..(572): unsure at all n locations
  Clone ID: PAT_TA_46228
cgcctccacacccgcngaaaccctacctcatcgccggngcgagagaagggcggcggcgacgtcgaggcgggcggcgacatcgaggcgggcaccgcggcaccgaaggggcgccgtacgccgggacgacggagagccccgagctgcgctgggcgctcatccggaagatctacgtcgtcctctgcctgcagcttctcctcaccgccgccgtcgcggccgtcttcgtcacagtcacggccatcccgcactttttcgtctcctcctacgccggactggggctgtacatcttcattctcgtcttccccttcatcgtgctgtgcccgctgcacatctaccgccagaagcacccaatcaacttgctgcttcttggcgtcttcacagtggccatcagcttctctgtgggcttgacatgcgcctttaccagcggcaaggtcattttgcaggcggggattcttacaattgtggttgtcttgagcctcactgcttacaccttctgggctgcaaggaggggcaaggacttcagcttccttggtcctttcctatttgcttctctgatgattttgctcgtctttgct

SEQ ID NO: 46229 - DNA, 540 bp, Triticum aestivum
  Clone ID: PAT_TA_46229
gttgttagggcagtttttttttacatttataagctttgctgtgattatgcactctttgattctgtgtgtcctttgttcgtggtataattatgaaaaatgattttgtccaaaacgattgtattgcctatattgtacagtctgaaatgcaaagttcttacattttctggatttttcttgctgcatttgttgaacaacttagctaaacacatatcagttctgtgttcacataaactttttatctattgttgttgtgactatggctgtcctttttatattagatagtgtactgtgcattaacttgtttgacatggtgtcatctctgaatttctagtgtgacagtgtacattcaagattcaaggtcttaatttgtgtatgctgacatatgctgactttggagtcatctgtgtgaaatagttctgctaattaatataactgcattctaacctgggtctgggactcggtgtgtatttattagcttgagtgcacatttctttaattgtttcgagatgtgtagaattacacttgctatgtatgagctac

SEQ ID NO: 46230 - DNA, 574 bp, Triticum aestivum
  unsure (1)..(574): unsure at all n locations
  Clone ID: PAT_TA_46230
tgtgnaaatttatcattgcgttttggagagcaagtcattccttgaaaagagactgtgactgaacacaccttgcctttctttctgccgattcgagaagtagaaactgaccacctgtcatctaacgccatcaggtttattgatcatcttgaagaaattttgcagtcgtatattgacaggagagaacaggttcgtcttatcaaggagctctacggcaaccaaatcggggaattgttctacagtcttccatataccttgatagagtttacattggaagactttgaatgcaaggttacggtgagtatccgatattcggatctaatcttgaccctgcctagtcaggcgagggtcttggcctggccgcttcgctctgcaaagagaatatccgcagcagaccgccgtgctcagcctgtaccatctcgcctctcctatgccgagaacgcgttgaagaccttgagtttgccagaagcatacgcggagattgtcctggagctgccccgtgctctgaagcagatgttctactctcaggaaagcgactgaagcgaagcgtgcgtgtagagagtttatttaaccttac

SEQ ID NO: 46231 - DNA, 403 bp, Triticum aestivum
  unsure (1)..(403): unsure at all n locations
  Clone ID: PAT_TA_46231
agtttggcgacaacagnagtcctctgaagtccccggcgggagcgacacgtttgtgaagcagttcttggaggacaatctgggcatcaagcacgatttccttgggtatgtggtgctggcgcactttgccttcatcatcgccttcttctttgtgtttggctactccatcaaggtgttgaacttccagaaacgttagggcaatgtttattttatttatcatagcgtttgtttgtgtgtatatgaatggagtaatgtatagtagaaagagtagagttgacaagggaaattgttgcatagataggccagacctggtggtataaattagaggaatgagacctattttttttcttctttcggttctgtttcaccattgatattaaatacggaaaagttcatttttggtgtg

SEQ ID NO: 46232 - DNA, 326 bp, Triticum aestivum
  unsure (1)..(326): unsure at all n locations
  Clone ID: PAT_TA_46232
nggcaaacgnaggatcaacatacgaccggcacggtgttctgggagctgctcgagctgggcatgcggtgcacggccgacgcgccgcacgagcggccggacatgccggtcatcctcgccgcgctgctggacatggccggcgacgcgggctgtgcatactgcatgagctcaggacacagcgacggcgagcaaacaagttctctgacataggtgttgaaggttacaaaaacaaatttattctttgtgtacaaaaatgctgttgtttagttcagctgggcgttcattcatgtatgtaggtaggggcaaagataaagaagcaaagttttggt

SEQ ID NO: 46233 - DNA, 585 bp, Triticum aestivum
  unsure (1)..(585): unsure at all n locations
  Clone ID: PAT_TA_46233
ggnagagttgttagagnagatcacatggtcgcagctcggaatccatgacaaaccagttggcttgctaaacgtcgacgggtactatgatccgttactcgcgctgttcgacaagggcgcggcagaaggttttattaaggccgattgcaggcagataatcgtgtcggcgccaactgcccacgaactgctgacgaaaatggagcaatacacccgttcacaccgggaggtggcgtcgcggacgagctgggagatgaccgagctgggctacgggaaagctgcgccggagccagaggaggaggcatcgtgctgatgtgtggcaggcgtcgtcgtccctggttgctcaactggccactgggattgcaattgcaataatcgtagtgtgttgtggttttccgttgttggttgcctttcatgtaaccctgtacgttggactgcgacttggtctggcgaagaagcctaagattgtgtatcggaatgaatgcagcggcgtgagcaaatgctgactgataaccaccaacgtcagaactctggtgaagtgaaccgatcgggcagtcgttttcttgggtgtgaatgaatgattgtgcatgc

SEQ ID NO: 46234 - DNA, 577 bp, Triticum aestivum
  unsure (1)..(577): unsure at all n locations
  Clone ID: PAT_TA_46234
tccgtgcactggnaacctcgcctacttgggtggagtcagtgctagttgcgcaatctggtgatagaaattttagcttaggcgaccgaaaaagcgtcggcttcaaccaaccccgccgccgatctcctcttccccagcccctcgccggcgacctcctcctcccctccacagccctatccccccccccccccccctctgcctcctgagtcgcacgcgcgtgcggctccggaggccccccatccctccgcggcagagctccagatccgcggctcctcagccgctgccgccgccgccggcggcggtggtggcggcgcccggccatcaaaggcggcgggcaggggtggcgcgccccgacgcacctccttcgcgcgggggagctgcgtctagcgggcgccgcggcggctggcggcgcgctgccttagcgcgagcggcgtggtctggcgcggngttcttctcgcgggcggcgcgggggctcgcggtgcggttggaggcactgcgggggcacggngagggcgtttgccggatcctggcgccgagcgctactggtaggtcgcttnnggtggagcgccagcaacggcgg

SEQ ID NO: 46235 - DNA, 239 bp, Triticum aestivum
  Clone ID: PAT_TA_46235
acattagatcagactccaccacccacagtcctccatggtcgagccgaaatccctattgcccctgacggtgaccgtctatactgcgctcgggtcgaccatgctgctggcagccgcggcggctgacctgtacgacaaccgtagcgcgctcgtgtaccagtggaccctcctacaggaccctgacggcgccctgggtatttagaacccggagctgagcccctgcaactggcccctcttatacc

SEQ ID NO: 46236 - DNA, 574 bp, Triticum aestivum
  Clone ID: PAT_TA_46236
tgaaaaatcaatcatcatggcatctaaaagcctgttgctcttattgttggtgcatctaggggcatcggtcgtcaagttgccgttgacctcgcctctaatggctacgccgtcgtcgtcgctgcaaaaactatcagtgacacttcaaatctcccatcgcctttcccaccaaatcccaattcatcagcctcgacaatcacaaccgtcgcccatgaaatcactttagcaggaggtgacgctactgctattcaagtagacgttcgctaccccgagagtgtcgactccctgatagcacaaaccatctctacctatggccgtctagatgtcctcatttacaactcaggtgccatattctgggctcccgtctcatcaacaccccttaaacgattccaactcatgcagcgcgttaatcccgaaggactatacgcaaccatccaagctgctctgcctcatcttccctccacaggccgcatcgtagtcgtcagcccacccatctatagtcgtttcttccgtggtaaaacagcttatgcgatgggcaaggttggcatgagtgtgcttacaaagggtctcgccatgg

SEQ ID NO: 46237 - DNA, 555 bp, Triticum aestivum
  unsure (1)..(555): unsure at all n locations
  Clone ID: PAT_TA_46237
gtaaggctttgaactgtgatgacaatgatgcccgatctgaccattagtatattctcatcaaagtgttgttagaacgcggagattctatgcaaggactgacatttaagaaggatgtagtaacagggtgccttgttcttacaggatttcagagagtatggaccaccatatggctgaacaagatgccattcttgactgtcattgtccttagtgtgttgctgctattttcctggcagggtagaatttcatggcagttctccaaagctgcttggcaagaaaatgattgcacttctcaactgaccagttacactactagggaaaaggctagcagcaccgcgggttttaggtgtatcagtagcgcggagaggggcgctactaataaggcgctacagttaacacatagcagtagcgcgtggtcactggcgctattgctacacaagtgtagcagcagtgggttattggaagctcgctactgctagtagctctagcacgctttgcaacgacgcgctactgctatcgcggtgctactgctaactnttatatactcgcttctgctaa

SEQ ID NO: 46238 - DNA, 577 bp, Triticum aestivum
  Clone ID: PAT_TA_46238
gttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaatt

SEQ ID NO: 46239 - DNA, 588 bp, Triticum aestivum
  unsure (1)..(588): unsure at all n locations
  Clone ID: PAT_TA_46239
gtgaccaagttgttgggttaatccgagccattgagcggacatttcctttcattttctttagtttgttctgaagctttccccaattctgtacatcaccactgcgtttttttggatactgcagtttgaacaaacttccaactatagagtttaaaatatgttacctacataaaaaggagttaaataaggatgaccttacacagcttatccttattttagcaatgagagtattttgtatatagagttgatactctgaaacttctgtttttattgctgtattatattatgaaggttcaagtatttgggttctagctcctacttggatatggtagatgcttattcattttcctattagtctagcaggattacatcattgatgttacttcccaaccaatattaagctggcagttgtttattttctcttttgcctaacacatcaaaatctagagcaacactttttgttgattgatatttctgacagatactgattactcccctttattttattgtactgttagccaattaaaaaggttttgttgtaggtgtatattttttctgtatggtatatattatgcnagttatttctaatgc

SEQ ID NO: 46240 - DNA, 566 bp, Triticum aestivum
  unsure (1)..(566): unsure at all n locations
  Clone ID: PAT_TA_46240
ccccgcgtccggnggnaggangggtttttggagaggagactcttgccattcctcgccggccgcatctttgctcacctcgccggccgcttcaatcaatcagtgttgattaatcggcgtcggatccgtcgatctaggagatccatgccaccaagagatggggtctcgtatggagtgcagttcagacgagtcgtcagagctaagtgacactgatatcgatgactatgctgagaaggcgtacacagacctcaagtctggcaagcttgtggcgaggttcggcgccgacaggtttagatgcccgttctgccccgggaagaagaagcaggactaccgctacaatgagctgcttcagcacgcaattggtgtgggcgcatccaaccgtgctgccaaagtgaaggcaaaccatcaggcactagccagtcatctcaagactgaccatgctgatgcagcaggttcgttgccaccgcgacaggccgtggcgctgatcaaccctccaaagccagtccaggaccaggagctgtttgtttggccctggatgggcatccttgccaatgttccagtagagcaaa

SEQ ID NO: 46241 - DNA, 395 bp, Triticum aestivum
  Clone ID: PAT_TA_46241
atgcgcgcacgcatgcgtccggaaggcttctcagggaacgcatcaggagggccatctataacctgcaattgctagtttggtctacctgagagcatccgcctgcataaaccactatttattctagagtcggcagccatcgacgtacaagagcaagatacttccagacatgttgtccagaaatgaggcaaaacttgttgcttaaggctgctaaacatgaagaagtaagggttcaatagaatatgaaatattgaaaaaaattgctaataacctaaaaaacacacatattttagtgagaagcaatttcttgtattcatatatggtcgggataataaaatatcaacactggtccattggattccaaaaacaaaaacaaagggcggcaattttaaagaatc

SEQ ID NO: 46242 - DNA, 571 bp, Triticum aestivum
  Clone ID: PAT_TA_46242
tgctggtaggcatggagctggggctgagcttgggggaggccatggcggacgccggccgggagctggttctggggctcggggtcggggtcggggtcggcccgggggcggcgagggagggcgaggggaggagggatcacgatgtcgccgccgccgccaggggtgggctcgcgttggggtgcggttcgtcgccggagccggccatgcggctcgcgctcctgcccatggtgcccagcctcggcttcccgtggccgtccgagagcaggcatttggaggcgtcgacgcgggggttcgacgtgaaccaggcgccgtcgtccgggggctcggcctggggcgcctgcgcggcggcggaggaggagcaggaggacaccgccgcggcggcgcgggcggccgtgtcgtcctcgcccaacgacagcgggggctccttcccgatggacttctccgcgcgcggcgccagcgacgccgccccgggcgccggcggctcgcgcggcagcgacgaggacgacggccgctcggcgcgcaagaagctgcgcctctccaaggagcaggccgcgttcctggaggagagcttcaa

SEQ ID NO: 46243 - DNA, 582 bp, Triticum aestivum
  Clone ID: PAT_TA_46243
cttgatcgcgtgagcaagatggtaacatgctgctcaacatttcacccatggccaatggagtgctgcctgaggagcagatcaggttttgaacgacattggtgacttcctcagccgttacggcgaggctgtttatgatactcgcgcttgggatatctatggtgagggaccgaaccaggtcgaaggtggatctttcacagcgccgttgcaaggaaacagcagcgatattcgctttacgcgcaacaaggaagatgatgttctctatgtcactgttcttggttggcctgaggacaaccttgtttcggtcaagaaccttggatcaaatgctttggttgatctcgaatcgctcaagtctgttgagttactcggcgacaaggctggcgattatgtcaaggtttctgaatgggaacagtctaaggacgccctggacattactcttccttcgcagcccgctgagtctctcgcttatgttctcaagcttacctttgatggtggaattcctgtgcctcagcctgagcgtggtgcagctgtcttctccaaggcggatgctactggaaagggcgttgcccttgcgttgggtacttt

SEQ ID NO: 46244 - DNA, 360 bp, Triticum aestivum
  Clone ID: PAT_TA_46244
cggccgcgtgggccggcgttcgccgagctgctgcggcagaactccttctcgtgggtcgacaaccagccggcgcaggcggacggcgagccggggatggtccaggggagggacaccgccggggacgcctccttcaggttccacaacttctcgctgcccaacaactgggtctgaagtttgatgaaacgcctcgactacgtgcttggccgctgtgctgtacatatgtacatctcgattagccggtttgtgatgagaagaaacaacgctttgcagtgtcacagcttactgcccagagtggagtggactataactttgacccctaaaatagtgttactagtgctgtgcgtttgatgtttcagctca

SEQ ID NO: 46245 - DNA, 583 bp, Triticum aestivum
  Clone ID: PAT_TA_46245
gatgtacggtcgacttccgctctaccacatttgcaatgttctctttgtcattttcaatgtggcttgcgcgttggctccgaatctaggtggtctcatcgccttccgtcttcttgctggacttgcgggctcctgtccactgaccattggagctggatctttggccgatgtgatctctagggaaaggcgcggagctgctatgtcttcatgggctcttgggcctctttttggaccagtaattggaccagtcgctggcggatacctctcgcaagccaagagctggcgatggtctttctgggttgtctctattctggccggtgcaatcacaataatggcattcgtgtttatgagagagacatacgcgtatactattctcgataacaagaccaagaagcttcgcaaggaaacaggaaaccctaaacttcgctctgctctcgccaaagaaatcaccacaaaggaactctttagcatggccatggtgcggccaacaaagatgctcctgtttgcgcccatcgttactctcctatcgctttacatggcccttgtttacggttatctctatctcctctttacatccctgcccacc

SEQ ID NO: 46246 - DNA, 581 bp, Triticum aestivum
  unsure (1)..(581): unsure at all n locations
  Clone ID: PAT_TA_46246
tccgcggncgcgtgggcgtcaacttggcgccatcccctcagttatgtacacccaccccgaggttgcctgggttggccagagtgagcaggacctcaagagccagaacatcccttaccgagtcggaagcttcccttttgccgccaactctcgagccaagaccaacatcgacaccgagggtatggttaagatgcttgctgatcccgagaccgatcgcattcttggagtccacatcatcggccctaacgctggtgagatgattgctgagggtactctggccctcgagtacggtgcttccagcgaggacattgcccgaacctgtcacgcccaccccacactcgctgaggctttcaaggaggccgccatggccactcatgccaaggccatccactactaagcaatgcttgagcggtcgagattagttggataggttgctgcgcgccaacggcttgaaatgtgtcggtctggtagcagcaggtctcttctgtgctttctgcggcgatgaatagacactcttcaatgtataggtttgaaaagactgtctgtagtcgctaagagcgtacctaaaatatcacacagggtca

SEQ ID NO: 46247 - DNA, 310 bp, Triticum aestivum
  Clone ID: PAT_TA_46247
ctccatcatcaacgtcgccttcgatctcttatgcgactatatgtgtgtgtgctatacatactccactcctaagtacttttgtatttgcttaaggcgtgaaatcagggcggaacgcatcaaggcatgcatgcattacgtctgtgccgtagtaaattgcaattgtacgcgtgtgcatggtttgtagaagggtagagagggagatggtggaattgttgatgcattgtttgagcatcgtgggcatatattatattgtagtacaatgaccaacttaaagtataagacaaaatagaataaaatcctacattatcct

SEQ ID NO: 46248 - DNA, 556 bp, Triticum aestivum
  unsure (1)..(556): unsure at all n locations
  Clone ID: PAT_TA_46248
gttgtttggnaacccttgggataagnaggcaaaagctatgcaagattttggggattcagaatacaagcacatgctttgtgtggagcctgcagccgttgagaagccaattaccctcaagcctggtgaagagtggaaaggaaggcttgggctctccgctgttccttccagctactgcagtgggcagttagatccattaaaggtccttcatggttgagtcctcacttcttcctcttgtacagaagcacttcattgcccttacctatttgatgctgggctgactcggacattgccttgacctttcttccttttcatcatcctctatcttttgccctttttgtatctacaagtgggtagtagggcagttctaaaataacagaccacgtcagttgtttttagcccagagcaggtcaactcgtccgtaatcaaatccatcagtctaaagtaacgtttcgtgtggttcagtggccatactaaggaatgttaccatgtggtgcagttgtagcattttatgttaaagtagcattttcttcccgcaaaaaataaattatgtagctat

SEQ ID NO: 46249 - DNA, 563 bp, Triticum aestivum
  unsure (1)..(563): unsure at all n locations
  Clone ID: PAT_TA_46249
gnacgcgtcgtgcccggcgaaaggccagcggccacctccggactacgcgtgcgccagcagcaacagctactgtgtcaacgccacagttggcctctcgggctatgcactcagctacgtgtgcaaatgctcggagcactacgagggcaacccttacatcgccaatggatgccgagacatcgatgagtgcaagttccccgatctatactactgctcgagcaaaggcatatgcaagaacaggccgggaggatatgattgtccatgcaagccaggaatgagaggcgatgggaaattaggacagtgtgttgagaaatttcccctggtagccaaggcggttgtgggtatcattggtggtatttctgtcatagtagttatatcatttctagttcttctccacaaagagagaaggaagaccagggnagttctacgaaaagaatggtggacctacactagagagagcaaaaatattaaaattttcaaaaaggaggagcccgtgccaattttaaaggaaagcaatcttattggaagaggtgggttcggtgtagtttacaagggcactcttggta

SEQ ID NO: 46250 - DNA, 464 bp, Triticum aestivum
  Clone ID: PAT_TA_46250
ccccgcgtccgataaaaaagggcttcgggctggagttggtagtgaggggcggttctcatttggctgcattggtcgaggcaaggataaaacaaactgccttgctttgaggcattcaattcaaaaagacgtcaaatcccaaccccgaaagggctcttcgcacctgagctactcgtttttgatgatataacttgatctccctttcatgcaacggttatcggaaatcgatcctgtccactgggaggggagcttcagcgatgaaacactttctggtggttgggattcgggaccggtgtttggaactacggtcgtgaatagggtacaagcgaatcatcgatgaaatgccaggtccagggcctctattacggcagtacacaacgtccctgaaagctggattgtgatttgactcgtatggagaaattttgagccatggttggcgtctaatgatgaatcagaaatgtctattg

SEQ ID NO: 46251 - DNA, 593 bp, Triticum aestivum
  unsure (1)..(593): unsure at all n locations
  Clone ID: PAT_TA_46251
gccttcatagtcttctcgaacagccacaaanaatattttgacttcagcttcaagcttcaaataaacggttaccctattttgatatcaaagactcacctatcgaaccgtctgagtgtcaatgtccccttctgctatcaccaactcgcctccccagcaggctgtccagcctactactgttcccattgcctcttccctcgataaagtcgacaatacctttgcggttcagccgccccccaacttcaccggatatgaccacataacctggtgggttggcaatgccaagcaggctgcctcctattacaccaacctctttggcttcaagcccattgcctacaaaggtctcgagactggcagccgatactttgcctcatatgtaattgagaacaatggcgttcgatttgtctttacctcgcctctgcgatctgaagctcacttccccgacgatgagcccatctccaagtcagaccgaaagcttcttaaggagatgtacgctcatctcgaacgacatggtgacgccgtaaaggatgtcgcctttgaggtcgagaacgtcgagggagtctaccacaaggctgtccaggagggtgccgtcgctg

SEQ ID NO: 46252 - DNA, 599 bp, Triticum aestivum
  unsure (1)..(599): unsure at all n locations
  Clone ID: PAT_TA_46252
tccgactagttctagatcgctcgcgatctagaactgctntaatgcttgagtcaaacatgagggaaacagacgacaagggtcagcccatcctaggaatgacaattgaagaagtgatagaggaatgcaaattgttctattttgcagggtcagagacgacatcggtacttctcacttggacaatgatcgtactggccatgcaccctgagtggcagggccgtgcaagggaggaggtccttggcctatttgcgaagaataagcccgagaatgacggctttagcaaactcaaaaccgtgaccatgattctttacgaggttctccgtctttacccgccggctgttgcattcatgcgaaaaacatacaaggagatagagattggaagcatcacctaccctgccggtgtgatcatcgagcttcctgtgctgcttatccaccatgacccagacatatggggaagcgatgtgcatgagttcaagccagaaaggtttgctgatgggatagccaaggcatccaaggatcctggtgccttcctcccatttggttggggtccacggatctgcatcggtcagaattttgctctgcttgaggccaagatggctctg

SEQ ID NO: 46253 - DNA, 548 bp, Triticum aestivum
  unsure (1)..(548): unsure at all n locations
  Clone ID: PAT_TA_46253
cgccgggnagacgagctccgnacttgaaccacccaaaaccctaccgcacctcctcccgtcctcgccgccgccgccctcgctcttccggaacgatgccgctggggctgatactgagctcgatcgggaggtcgatgcggcggaagcggacgtcctcgctcaacatcctctcctccaagagggcgccccgggactactacaagggcaagaattgcaagcccaccgggttccacacccgcaaaggtggctatgtgatggtggatgcaaagttaccaagattcgtggtccctgacttgactgattttaagttgaagccatatgtatcacaatgtgccagggacgaactcggagcctcctcagctgaaaacaagaactgatgtttctagatgctctagttgttacttgttttacaagaatgcaatgcagctttgcaattatgttttctcacggtgcccatgttcagagcatctaacctcgtcaagattggtcctagtgtactagtcgtaataacaaactttgtgcctcagcatgaattcgattttttttttacc

SEQ ID NO: 46254 - DNA, 206 bp, Triticum aestivum
  unsure (1)..(206): unsure at all n locations
  Clone ID: PAT_TA_46254
ccgnacagttgatgctctgttcagntattaccttcgcaaatgcaagccgcttggcggctttaccagttttgtgataccgtgttgtacagagcctgtaacttccgtccgagccacaaactaggccctggggngaagagactacacttgcacatatgtgtacattattgttcatagtctctttgttgaaattattcacattcatttgt

SEQ ID NO: 46255 - DNA, 602 bp, Triticum aestivum
  unsure (1)..(602): unsure at all n locations
  Clone ID: PAT_TA_46255
acctatcaagcgagtagagcttgntctacggccccaactcacanagccgcggtgtcgccaacgtcaccttccacaaatccgatggcgctagcaaggccttccagaagttgaacggtcttctcgttgacaaccgaccgatcaagattgagatcgtcgtcggagccgcccaggctgacaaggtcattcctaccgccaagagcctcgctgagcgtactagccagcccaaggcccaggccaaggctcaacccaagtccgctgccgctgacaagcacaacgctggtgcggccaagggagccgccaagggagctgctaacaagaagcgccgtggtcgcagcagccgtcccgccaagaagacacaagaggaactcgactcagagatggctgattactttgtcgcccctgccgctgaggctgccggcaacactgctgctcctgctaccgcgccagctcccactgctgatgctgatatggatgagattgcttaaactaagcaacttgtaacgatggcgatgagggagagttaataataaaatatcacgaagttggctgatggctgatgggaaagattgcgagtttcngttgtccagttttgcttctgcatt

SEQ ID NO: 46256 - DNA, 584 bp, Triticum aestivum
  unsure (1)..(584): unsure at all n locations
  Clone ID: PAT_TA_46256
ggntgtcaccccccatgnatgaanaanaccctcgggngnaaattctacaatcctcaaacatctgttttcgctcgttttgaggccgtcgctactccatctgttgttgtcgtcgagaagatgctcagtggacctgttgatgagcaccatcgaaatcagtgaaagtgacattgccaggtcttgggtgcgatccttgtgctgcacagacgagagtcgctacacggtcgaacagattaagcagaagttctccaccttggcaggtggagaccaggaaaagattaactcattactcaaggaagccattgatactttgacacagcagagaatcatttgcaaaagcaaacggcttccgctttctgggaggcccttcagactcaacgaagcatttggacatgtactcgggaagcttgcgcaacggaccaaatacaaggacgctgccgatttcaaaacgcaactggatgctattttccgccgcggcgaggcctatcgaatccctttcacactcaatgatgggtcggtaatggcgttgataaatctcaatgcgagtgaaaggatcaaactggttccagtcaacgtgcctcacattc

SEQ ID NO: 46257 - DNA, 316 bp, Triticum aestivum
  unsure (1)..(316): unsure at all n locations
  Clone ID: PAT_TA_46257
cggncgcgtggngaaataaaaaaaaaaaataaaaaaaaaaaaaaaaaaaaaaaaaaaaggagaaggaacgatataaaggaaaaaaaaataaaaaaaaagagtgcgtgcaaacaaaaaaactcatatatataagtgacactatgggtgcaatgtactaggccgttgtttggcaacgtctaaaactgaataaaacgctggggtttcccaaattgaatcgcattggaaaacctccgcctttccccagttgaattgctggggaggaggcccccatcgggccccctgccaaactgttgaacagcctgaatccattttggct

SEQ ID NO: 46258 - DNA, 303 bp, Triticum aestivum
  Clone ID: PAT_TA_46258
tgctgttgatgatgccaaggtgggaggcttatcttctatgactttgggatgatgggaagtattagcccaaattccgcgaaggactgcttgaagtattttatggagtttatgaaaaagatcctgataaagtgcttcaagcaatggttcaaatgggtgtccttgttcctactggagatatgacagccgtcagaagaacagctcaatttttcctggatagctttgaagagcgtctagctgcacaaaggaaagagagagagatggcaaccgtggaacctggatttaaaaaacaattatctaaggagg

SEQ ID NO: 46259 - DNA, 500 bp, Triticum aestivum
  Clone ID: PAT_TA_46259
gccgagcgtggggatgcggctgccgccgtggacgtcgccgaggggcgcggcggagagtgtggagccccggcacccccgccggcttcgcgggctccgggagccacgtcaccccgcccctgagcgccggcttctgctcctaccgcgccaccccgccgacgagcggcggcgggtgctcccggccgccgagggcgccgccggcggcggattccccgtacgtgagggcgaaacaggcgcaggtaacacggtcgaccaccacagccaccgtcaggcgcgatcccttcccgttcaggttccgaaacccagcgccgtgctatctcgtcgttcgggccattctcccgtcggcaggggagggattcggggtggctaattagatgcaactgatagatatggtagatcaacttgctgtgctacgcttcgtgttcctgattgttcgtagaaactcgtggactacacttcttctcgggatgattgtggagctgaaatataggagatattcaatt

SEQ ID NO: 46260 - DNA, 543 bp, Triticum aestivum
  unsure (1)..(543): unsure at all n locations
  Clone ID: PAT_TA_46260
gngcggccacgcttcctctgcttgngatcggatctggtgcgaggaggaagaggaagaggaagaggaagaggaagatgaaggtccgcgcatcggtgaagcggctgtgcggcttctgcaaggtggtgaagcgccgggggatcgtcttcatccactgcacctccaaccagaagcacaagcagcgccagggcttctccaccatcgccgcctgcctcccagccccgccgccgcccacctccgcctccgccgccgcgttcgccgaggcttccaaggtggccaggcaggagatgtcaacgaaattcaactggccgctgggtctagctgccatgttcaagaatggtgacaagtaatcagatgatgaatactagctagtcgctgttttggtattaagtggagtttccagttgaggaattcctgtaacgaaaattagaatataatcgtgtatccgatgccattggttaaactgttcgtttcatggaataatattggcatacactattactctgtctcgtgatatgtttgattcaaacagagccgctttgactt

SEQ ID NO: 46261 - DNA, 511 bp, Triticum aestivum
  unsure (1)..(511): unsure at all n locations
  Clone ID: PAT_TA_46261
gggacgcgtggccaatgcatggaggcgagggttactgacttcaaccaacagcctttgccgatgcaactgaaacacataaaagatcatggaacgtaatgagacatggggcccgcgtcgtcttacatctgtcaagttgctccactgaacgagggaacctatctaaaatggtcaaatgacactccatatggacttgccgagggtctgttcacagtaaaagattgctggtgcacacaaagcagccctcaagctctaggctggcttggaatggattaactcgtgtggtgattccacactttggtattccatttggtggctacaagacttcaggcattgcatcgcgagtcgtgacagtatgctttggatgcttacacacaatccaaggctgatcatgtcaacttgggatctgaattatagatgggtttcatcgtagattttctgcaaccatagctgaatgataccattgagttacagagaataactagctttggtcggtnaaaaaaaaaaaaanaaa

SEQ ID NO: 46262 - DNA, 147 bp, Triticum aestivum
  unsure (1)..(147): unsure at all n locations
  Clone ID: PAT_TA_46262
gttgtttaggtgaatatgntaccgtcgaaagnanagcaatggtactatgattgtactgttttatgctcgatgttaaagaatactcttgcaagcagttagcgacgagctgatggtgcattatattgtatagaagattcttttgatccc

SEQ ID NO: 46263 - DNA, 332 bp, Triticum aestivum
  unsure (1)..(332): unsure at all n locations
  Clone ID: PAT_TA_46263
gcattatgatgactgatccttgtaaactgcattacatataatatttataaagctctcttcttgtaaccattgtatatgcataantcgaaaaccaacccttaattagtggcacaaacacactgacatccaaagaatggattaagtgctagggagaagggagggcgaagatgaaggctctgctatgtaggtggccttgatgtaactagagcattctttggtcatgttagagacttattagtgatagagcagtaaattattttgttaggataataaattgtgtgttacgttcttttatacggatgattttaatcccaaggtaggagtgttcgtac

SEQ ID NO: 46264 - DNA, 590 bp, Triticum aestivum
  unsure (1)..(590): unsure at all n locations
  Clone ID: PAT_TA_46264
gngngtgacaagaagataaaagccgctcgcaaagaactgttagatcttttgatggcaccatccactgcggaaagtttgtaccaggatatcaccaccaactggaccaagtggggatacctttttggtatggtcccagtgttctatggttttaaaaaggcagattttgcaaagattttcaagggtgactttagcggtatagatcctcgggttgaggtggtggagagcagggcttgcccatgtggcattccctggccgcagaaatgctcaagatgtggcagaggactccctaacttcgttggtgattcgggttagcacatgtccctgcttctcttactcgtgttgagtaattggcattggtttcatatgtttgtttaattttgatcaacaggtctcgtcagcttccctggtattgcaggcgtcaagggcgaaaccttcacagccgtcactcccactcccgtcccaagggcgacatcgcctcaagccaccgcagccgngaagtgaattgtttttcatatgttgccagcggaagtggtagtgcctctgcgtaggcctgaactgttttctgtttaaagaatattgtgcaactggtt

SEQ ID NO: 46265 - DNA, 588 bp, Triticum aestivum
  unsure (1)..(588): unsure at all n locations
  Clone ID: PAT_TA_46265
tgataaatatccagcacaggaacagcagccggnaggaataagaagaaggaaggggtggtggtatttttgcaaactttgtttgagcaatggaagggctgatcccgttcgtgatcgacgcgatcaggaagagccaccagagggacagctaccgctgcgcctcgtcggacggcagctcccacggcggcagcggcagcaggcggcacctcatagactaccgggagctgccggccggcgcggccgacgtcgacgccaaccgccaccaaggcccatggtcggagtttatccaggcgccgaccgacgtgcgtcgctcggaggagccggccgccgccgtggtcgccgggtcggcttatcgctggaaatgaacacgacgcaggcgttggtgcctttcaagtctcaaggcactttgttctattggattggttttcttcactgtttgccttaggaatgtaagcagggatttcgttttcgtgtgatgagcgtcaaagggcgtctttgccatgtgtgcatatatgtttgtcaaataaaaatgaaagaacgacggattagttaccatggcgctctgcacctcgcgcatgcagtgcaggctct

SEQ ID NO: 46266 - DNA, 576 bp, Triticum aestivum
  unsure (1)..(576): unsure at all n locations
  Clone ID: PAT_TA_46266
tgctttttctgccanatctccccgctggctttccggaggagagaaacaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagctttttttgctggggctggccttcaggccttccagcaatttaccggcatcaacactgtcatgtactacagccccacgatcgtccagatggctgggttcacttccaacaggctggccctgctgctgtccctcgtcgtcgccgccatgaatgccagtggaaccatcgtcggaatctacctcatcgaccgttgtggccgccgccgcctggcccttacaagcctagccggggtcgtgctctccctcgtcatcctcgccacggccttcatactgcagtcatcgtccagcctctgcgggagcctgttcagcggntcctgccaaggcgtgctggggtggttcgcggtcggagggctcgctctgtacatcgccttcttctctccaggc

SEQ ID NO: 46267 - DNA, 307 bp, Triticum aestivum
  unsure (1)..(307): unsure at all n locations
  Clone ID: PAT_TA_46267
ggtgaagagnacagnataggcctcgccgccatggcaggtgcaccaccaaaccgtgggaacgtgctggggctgagggaacatccggtccgtcgcctttcaaaccaccatctggtggcagcactagcgatgtcgtcgaagcttttctggtnacagctaaacctggagaaaccattgctgctacagaggggaacatgtctgccaatgtaaataaccccatctcgaggcctatgccccaacgtccttggcagcaaacaggctatnggaaattccttatggaaggaacaggatatggatccaatatgtatag

SEQ ID NO: 46268 - DNA, 472 bp, Triticum aestivum
  unsure (1)..(472): unsure at all n locations
  Clone ID: PAT_TA_46268
ggagnacagagcacctcccttggagacacttcttcttcctagtaacccaacccaccctctgcaaagccgggcaagatgtacgacgctccgtccaggcaggagatgtcctacacagaccatgtgcagaggcgccacgaggagaagggctgcctctacgcatgcgtgttcacggcgctgtgctgcttctgctgctacgagacgtgcgagtgctgcctcgactgcctctgctgctgctgcaactaaaccagccatggtcaccatggacggacggacgggcctccaatactgttaattatccaaaaaataatttagaatttcgtaataatctagctagaagtttagctcgatgagaactgtaccaggtactcctataatattatctgcaccagacaagactagcactgtaatcactgcgcttattttaattagcatcagattctggtcctcgcctgaccactgcgcttttcatttg

SEQ ID NO: 46269 - DNA, 586 bp, Triticum aestivum
  Clone ID: PAT_TA_46269
tcgttgtttggcagcgaggcgttcgtcgccacaaaatctctgtgtgctcacttcttcttctacctccgtccctagagagctagctagggttagacccaacagcaagggctagggtgctgctcgttgccgccgtggtatggtttttggcaaccacggcgtgccaagccgcccagccggactacgccaccgcgctcaccaagtcgctgctctacttcgaggcgcagcgctccggtaggctgccgccgactcagcgcgtccaatggcgcggcgactcggccctcaaggacggcgccgaccacggggtggatctcaccggcggctactatgactccggggacaacgtcaagttcgggttccccatggcgttcatggtgacgatgctctcgtggagcgtggtggagcaccgtgaccggctggccgcggcgggggagctgggccacacgctccaggcagtgcggtggggcgccgactacctggccaagacgcacgcccaccccgatgtgctctacgtgaatgtcggcgacggcaactcagaccatgcgtgctgggagcggccggaggacatggacacacccccggaggccca

SEQ ID NO: 46270 - DNA, 581 bp, Triticum aestivum
  unsure (1)..(581): unsure at all n locations
  Clone ID: PAT_TA_46270
gngnattcttaattcaagnattatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaacaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgca

SEQ ID NO: 46271 - DNA, 575 bp, Triticum aestivum
  unsure (1)..(575): unsure at all n locations
  Clone ID: PAT_TA_46271
cggatccgcccgcctccgcggngcgtgcgtgagcaaggaagaaaagaactcccgggaagcggcggagaccgaccgggaacttcttcctcttcttcccccggtccgccccggctccgcgacatgggcgcgaatggcgcgctggagggggaggaggagaggccgcgggccgacggggaggaggaggaggagggcggggcgacggtgttccggggcaccaactactcgctgccgcggacgatcgcggcgctggcgctgtggctcgggggaatccacttcaacgtcatcctcatcctcgcctcgctcttcctcttcccgctccgcctcgccgccctggtggtggcgttgcagctcgtcttcatgttcacccccctcaacgacgaggacaaattgggccgcaaaatcggcaggttcatctgcaagtatgccatgggctacttcccgattagcttgcatgtggaggactacaacgccttcgattccagcagggcttatgtgtttggctatgaaccgcattctgtgctgccgatcggcgtggcggctctggcgaatcatgtcgggttcatgcctctgcctaa

SEQ ID NO: 46272 - DNA, 523 bp, Triticum aestivum
  Clone ID: PAT_TA_46272
cccatcgttcgctgtactacatgggagtacggatggcgattcaactaccgtaagacgcatttcgacaagtgctcgtcaccagacttgtacgcaagggtgggtatagcaggaagcggttgcaaacacaatgatggaaggacaccaacgtgatcatggacaactggataccgacgtgggaccaccagttcgagttcccggtgttcgtgctggagctcgccctggtgcacgacgaggagcaccagtaaaacaaccaccagaaggaccacttctgcgggcagacctgcctgccggtctgggagctacggtccgggatactctacgtcaggctttacgaccggcatggctaggtgctgctcttgataaacctgctaatgcgcttaaagatttagcaaaggatcgagctcgtgggcgttctcctgatgatcctggcgatgttgaaggggtgtgaaaaaagtttggaaatttttgctcgttggtgcccctgtgattgtactcgtgcttatgctgtatatgatgagattag

SEQ ID NO: 46273 - DNA, 587 bp, Triticum aestivum
  unsure (1)..(587): unsure at all n locations
  Clone ID: PAT_TA_46273
gnctagttctagaccgcgagaaactcaatctccatctccaaaccgtagcagcagcagcacctcctccttggccgacgaccccccagccccgatggcccgcacgaagcagacggcgcgcaagtccaccggcggcaaggcaccgaggaagcagctggcgaccaaggcggcgcgcaagtccgccccggccaccggcggcgtgaagaagccccaccgcttccgcccgggcaccgtcgccctccgtgagatccgcaagtaccagaagagcacggagctgctcatccgcaagctccccttccagcgcctcgtccgggaggtcgctcaggacttcaagaccgacctccgcttccagtcctccgccgtctccgccctgcaggaggccgccgaggcgtacctcgtcgggctcttcgaggacaccaacctctgcgccatccacgccaagcgcgtcaccatcatgcccaaggacatccagctcgcgcgccgcatccgcggagagcgcgcctaggctctgcacgcgccccgtccgccgcgcttggttgctagctgttttatgactctgtagttgnttgccctccttgtatgtcctgtgg

SEQ ID NO: 46274 - DNA, 450 bp, Triticum aestivum
  unsure (1)..(450): unsure at all n locations
  Clone ID: PAT_TA_46274
ggnatccgatgcgggtgggacttggagtggagacggcacaggctgggcagagggagacggcggaggatgggcagggggagacggcggaggatggggcggtggaggctggggcggcggcggagacggtggtggaggctggggcggtggaggcggaggaggagacggtggtggtggtggaggctggggcggtgggggtggaggtggagacggcggcgcaggcatgggaggtggcggaggcggtggaggtggtggcggttgttgaggagcacatcgttcattcgagttcttgaaaaaagtcggaacatgggttcaagcagcaccgccggcgaaaagcatcgatcgatcgccatcatggttgcaagaatgtgttgtgttttactccttgaactccatgactccgtgttgactgtnaatatttgtatattcgtcttcctatctcacgcttaaaat

SEQ ID NO: 46275 - DNA, 348 bp, Triticum aestivum
  Clone ID: PAT_TA_46275
ccgggccaccgctcgtaccgctgcatcgtgcgctacgggtaccgggacgtgcaccaggacgtggactcgttcgagacggagctcgtcgagagcctcgcgtccttcatccggctggacgcgctctttcggtgcagcgacgcccgcagcgatgccgactacgagcgtgagaatgccttcacggtcatcggcagcaacccgctccggcgccgcatcagctacgacgacacccacgacagcgcatcgtccgtggagatacgcgtggacagtccaacgggcagcagcaggacgaacaccatacagctcgatgccgtgtcacggccgcgagcgtgcgacagggtgacgctcctg

SEQ ID NO: 46276 - DNA, 549 bp, Triticum aestivum
  unsure (1)..(549): unsure at all n locations
  Clone ID: PAT_TA_46276
cggncgcgtgggcggacgcgtgggcaccaacccgtcgtcgatacacagacagatccgcaaaatggctggaggcaaaccccgtggtcttaacgccgcccgtaagctgcgaacaaaccgaaggaccagaatgggccgatctcgcctacaagaagcgtgccctcggtaccgcttataagtcctctcctttcggtggttcttcgcacgcgaagggcatcgtcctcgagaaggtcggtgtcgaggccaagcagcccaactccgctatccgaaagtgtgtccgtgttcagctcatcaagaacggaaagaaggtcactgccttcgtccccaatgacggttgcttgaacttcgtggatgagaacgatgaggtcctcctggctggtttcggtcgcaagggcaaggccaagggtgatattcccggtgtgcgattcaaggtcgtcaaggtctccggtgtcggtctgcttgctctgtggaaggagaagaaggagaagccccgttcttaagcgaagagcgcgtggatggaaacaaagtcatatttcgacacgtggagtctat

SEQ ID NO: 46277 - DNA, 246 bp, Triticum aestivum
  unsure (1)..(246): unsure at all n locations
  Clone ID: PAT_TA_46277
gntatagtaaactcatctatcatggatggttactttgattttttagatgtaaacagtttctcaaaccttcctactaacttgactattacctgcttaattactacgtttggaccggcaccttcgcaccaaggcgcacaaccggctcaccgcaagtacacctacgccgccgcctccccggggggctgcaaggtgaagtggacggccgaggagaagccgcacggggctgggctctcnaagtgggaggcg

SEQ ID NO: 46278 - DNA, 593 bp, Triticum aestivum
  Clone ID: PAT_TA_46278
tcttggcggtcgagctcgacaccatcatggacgtcgagttccgcgacatcaacagcaaccacgtcggcatcgacgtcaacagcctcatctcacgccaggccaagcaggctgggtactacagcgacgagaacggcgcctttcaagagctgaggctgaacagccgccaaccgatgcaggtgtgggtagactatgatgcacaggtcagacgactcaatgtgactttagcgcccgtgcagctaccaaagcccaagattcctctactctccgaactcattgatctctccttaatcatggcggacaagatgtatgtcggcttttcggcttccggaggttggggcgtaggtacgcaccactatgtccttggatggagcttcagcttggacggacctgccccgccgctagacttctccaagcttcctgtcctaccacgcctgggtcccaagcctcagtcgaagatcttggatgtcgtgttgccactagccgcgacattgcttgtcattgcaatgctagctgccatcttcttcttcttgtggcatcggcgtcgatttgctgaggttcgagaagattgggaagacgagttcggcccaaccgtt

SEQ ID NO: 46279 - DNA, 384 bp, Triticum aestivum
  Clone ID: PAT_TA_46279
cccagcgtccgtgttgttgttgccgtggccttctccctcgctcgccggagctctctgtacttctctctctcacagagactgaagaagaaggaggaagaagaagctgcagtggacacggtggtggttttctcggcactcgaacgcccgccgcacgaacggcaaatttttctcctgcagcacgaactgcacccacaactgaaccagtacacaggaggtagtcttatacgcgtacgcgcacatacgacgccgcgctccactctccaacggccacgatccgcaagctcggcccatgacgcgcacgaacacgtcctacgcggccggctgcaaccccatcgctacgcaacctcccgctactctagtcaacagactcacgcacgcacgcac

SEQ ID NO: 46280 - DNA, 528 bp, Triticum aestivum
  unsure (1)..(528): unsure at all n locations
  Clone ID: PAT_TA_46280
gaatagcctggctcgtaagtattcgtcgttgttgtggcatccatcctcatattggtgctcctcatgtcttgtgacgtggttcaaagcacatgccatgactataccagcaaggtccgttgtggtgactcccgaacttgttcttggtggtgcaagtacaacggtgctagtgatggtcgctgcaataatcgtttatgtgtgtgcacggactgcgggcggcacgtgatgggttctacttgattagttcctttgtatccgaaagttatttggtgatcaggggtctcgtactcgcagaataaatagtatgttatgatgaaaaaaaaaaaaaaaaaaaaaaaaaaaaaaaaaaaaaaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaggggggngncntttaaaaaaaaacaaattttanaanggggggtttggaaagaaaaatttttttttttggg

SEQ ID NO: 46281 - DNA, 254 bp, Triticum aestivum
  Clone ID: PAT_TA_46281
gcgagagcatggtaccctaagagagcggagtagaactcatgacagcagcatagaaagtatgcgtggggtgtctaatgtattactaccgctagacatgccgaatgcgaacatgtatattcttggaggctgtaatataataagattaacttactggataacaccggacctgttctgcacatgccctcaacaaacaataccgaaatacaaaaaatgatcgaagatcagtggatcctaaagaaaaaaaatacaggcca

SEQ ID NO: 46282 - DNA, 574 bp, Triticum aestivum
  Clone ID: PAT_TA_46282
ggcttacgagccatcgcgtcaggtccatccactcgcgatccagtccccccgcatccactcgcctaatcccgatcggagcggaggggaacgagacttccggtcgatccatctgcccgcccagtcccgatcgaggcttagggaaacgagattgccggtcgatcccagcgaccggaggagaggagcagccggtgcggctggttccatcaactgaagacgggttgagggatgggatcgaattccattcggtcgattcctgtgaccggaggagcaggatccgggtcgaggcaatccaacccagcgcgtgaaaaaggtgggggcgagggagataatggcagactcctcgcctgcttgacactgctccgccctccttcaagcttgcaatcatggccctcctcaggagaaaggttgagagctttaatggcagttgatgtgcaccactcgcccggggctgattattgcaaggtgccatgaaaaaggattgtcgctgatgttagtggtaggttgtgttggggaattcctaattcctagcttatcatttgcaatggctatcagccatattgtacgtgaattctcg

SEQ ID NO: 46283 - DNA, 335 bp, Triticum aestivum
  Clone ID: PAT_TA_46283
cacgcaccactcctatgatcacatgaagctcttgctatatacatcaggcataagctacattggatcaaagacgcgcaccaaggaaacgcccagagcgtatgtcaatgattctgcacagcctcgcttgcagacattgaaacatctaatccttgcgtcatgtcctgcattgtaggtcactatgaactatattactaagtagggcgtagaatcgatctagtaagggtgggaggaattttggttggaaacatagtgaaccgatgcgggtactgaaataagcttatgtgcttgcttagaaaactggtgaactatcgtgggttcggaagaaaaaagagaaa

SEQ ID NO: 46284 - DNA, 513 bp, Triticum aestivum
  Clone ID: PAT_TA_46284
tgcctagaatgggtggccttcgcagaatttgattggacagggaagaaaagatatggtaaagctacaatcctcggaagaatatgtggctcttggcactgttgaatctgctgtagcaacaagcaactatgggggagcacacatattggatttatgccgatccattaaataactactgcgtcgccatggttgttccaaaccaccatgccttagagaattgggctcagaattccggcataaactatgaaggctttgcaaagctttgccaaaacgcaccctgcaataagggaggctcaccattctttatcaaaggcactacaagcatcgaggctagaaaaattcgatgtgccaacgaatatcccgctgttgcctcaaccgtggacccagcattccgctctggtgaccgaagcccttaaactgagtagggagcatataaaagccaaatgcaaagaccatctggacattctataccactgaatacagtacagatgacggtctaatttgcacctactgctt

SEQ ID NO: 46285 - DNA, 237 bp, Triticum aestivum
  Clone ID: PAT_TA_46285
ctctctgatcagcgcaccacagaccggtcctgatcacggtcagcactagacttcagctagccaccctgttcctctgcggccatgttcttgcatcaaccacaggcagtggccaccgctgacgtccagacacccataggtcgagcgtgtaccggaaggcaggccgcccgcggcgggagacgccagtggccgccgaggaggccgccaagacggaggaggtccccgcgccggcggaggccg

SEQ ID NO: 46286 - DNA, 611 bp, Triticum aestivum
  unsure (1)..(611): unsure at all n locations
  Clone ID: PAT_TA_46286
tggtcgcctgcggtcccgtccgnattccgggtcgaccccgcgtccgggtagaagaagatagnatagccatcgcggcaaccacagacaaacccagctgataggcgcacacaccaccgtgccggttacatgggaggaggccgcggcctggtcaccgggttctacgtctggggctgggagttcctcaccgcgctgctcctcttctccgccgccgtctcctgctagatacctctgcttcttgctcatatacatacatactccaaacttattagtattaggtagagagacagcgatcttttaggtgattaagccggcgaggatggccggggcggcggcgcagcagcagaagggtggaagtggtggcggcggcggtgctgtgagggtcggcggcggagggccggcgccgttcctgaccaagacgcaccagatggtggaggagcgcgggacggacgaggtgatctcgtggagcgagcacgggcggtcgttcgtggtgtggaagccggtggagctggcccgcgacctcctcccgctccacttcaagcactgcaacttctcctccttcgtccgccagctcaacacctacggtttccggaaggtggtgccggaccggtggg

SEQ ID NO: 46287 - DNA, 574 bp, Triticum aestivum
  Clone ID: PAT_TA_46287
ctagtcggaacccgccctttttttttttttttggagaaattcctgtaccatccatgatctgaaagagttgaactttaagaatcccatgcaagtcgcttctatatgggcacaaagctccataagttcttcaacgttggagattttctgctcttgcaggtccactttgcctacaaatggctgttcttgaacattgcgaagttctgtagcaccttgaatgcatattttggtgaactccaaatctcttgctggaaatctaaacgtaggtaaatctcatcactactatatctatataccacccaccaatggcttcactacagtcctaaaaagtggcaaaattcatacatttgaggctataactgacaaacttatgacatggttacataatttgagcttcatgcccgttaaatttaaaaagaaaaaaatatgcttattgacaaatataatagaattttgtcaaaacactgtatattaagtaaagcaaattaactcatcgcactaatgcacatcttacattacagacataatctacagatatgttacaagtatgtaacatgtctagtttagatcgcgagcg

SEQ ID NO: 46288 - DNA, 579 bp, Triticum aestivum
  Clone ID: PAT_TA_46288
ccattatctcttgctttctctcctttgacttgacctttaccgtcgaaaaaacaaggcctgtatcttcacttcttcttaccgagaaagtttcacgatcgccactctctcgatcgtgtctactttgcttcgtcagtgtgcattgattctgcatctgataaaccatttctctcacattttcatacattcattcactacttcgttcttgtatcccaccctgtcgcaggatcgattcataaattgaaccaaaataccaaaaggatatcaagcgatacagctattttcgacgttgaccgttcctttacaatcatcactcgttcactgcaaagccggtcaacgtaaaatcactctccttctcgaagaatcgacaaaattgaatcgcgccagacgtcacagtttctgctctagaagccggatcttggaagcaaaagaaaggactggattcctttgtctcatctcagtacaacacacacatattcagaaactcttgtaccgtttctttttctcgctcgcaagctcagctttcggttggccaaactttcagcaaagactttcctcgaaaagtaaattagtgttgagtca

SEQ ID NO: 46289 - DNA, 307 bp, Triticum aestivum
  Clone ID: PAT_TA_46289
cttggtttgggctgcctgtgctttatcagctaagcccaagccaaatctgtggcaatggaaagagcgttgaaacgcggctgcaaaatgagaaggaagggcagactaaaatgattgatttagagttgatgtacttttacctgtaacgaatggaactttactagaattacagtgcagttggtaggcggcaattcagtgagggaacgatactcgggtcattatgctaggtacttattggaaaacattgatcaattttgtcttctgatagttcttctcaacatacggatgaaatatgagacatgcgtcttgg

SEQ ID NO: 46290 - DNA, 574 bp, Triticum aestivum
  unsure (1)..(574): unsure at all n locations
  Clone ID: PAT_TA_46290
ngaggcctcgacggcgttctntcgacgcacttctgccacgatgagttgcggtcgacgcatgccactgatgtggcgaaggaggtggtgggtagcacggtgccggtgctcgacggcgaggatttttccgttagggtgctcgtggaccactccatcgtgcagagcttcgtcatgggcgggaggatgacggcgacgtcgagggcgtacccgacggaggccatttacgcggcggcgggggtctacctgttcaacaatgccaccagcgccaccatcaccgctgagaagctcattgtgcacgacatggattcgtcgtacaaccggatattcacggacgccgacttggtagtcctcgattagactgatcacttacaacaagtaatggattttttgctcggtccgtggagcttccttttatcttggacagatttttagcggtggagcaccagcaagtctacctgtcatcttgatttatgtttttggttccggttttggttttagtaagatgaattagatgatgttggtcacctgtaaatcaattacgggtaaattaaaagggcatggatgcctaccacccaaa

SEQ ID NO: 46291 - DNA, 550 bp, Triticum aestivum
  unsure (1)..(550): unsure at all n locations
  Clone ID: PAT_TA_46291
ggaatacctcgccggaacggttcgaggtggccggcgccggcggcgagatcgacctcaaggacccggactacaagctgctgccgttcggcggcgggcggagggggtgcccggggtacacgttcgcgctggccaccgtgcaggtgtcgctggccagcctgctgtaccacttcgagtgggcgctgccggccggcgtgcgcgccgaggacgtgagcgtggaggagaccttcgggctggccaccaggaagaaggagccgctcttcgtcgccgtcaggaagagcgacgtgtaccagttcaagggggaggagctcaacgaggtttaaattattttttgcttagtaatttcttgtcatgcaagtagtaagttttttctcttcttcagacaatgcaaataagagagtagtaggtagctaggtaaaaaaaagcaaggaagagagagaatacgtaaaataaaaatggagctagtacagcacgtgttggtgcctaacttgctgtggtaaaagacagacgtgtatgtgtgtaattttgttgtggtaattctttactactatnt

SEQ ID NO: 46292 - DNA, 523 bp, Triticum aestivum
  Clone ID: PAT_TA_46292
attcaaaatagcagaacgtttctacctgcttagcgatattttaccacattttacatcatcactcatcagcttccaatcaccatgtcagacccccaagcgcagctccaggccctgtctgaggacttccagaagcttcaaggcgaaatgcagagcgctattgagtcgcgacaaaagctcgagggtcagaagcaggagaacgttggtgtgcaacaggagtttgaacggctacaagagggcgagaccatctacaagctttctggtcccgtgctactcaagcaggacaagtttgaggccgagaatacagtcaagggccgtctagactacattggtagcgaaatcaaccggctagaagacacaatcaaggaaacccaagggaagctcgagaggaagaggacagagattattcagcttcaacaaagcgcccaagcagctgctcaaggcaagggcaaggaagcatccaagtaatttcacgaaaagagggacacaggaatgggttaaacaaaaatagaccatgagttgagtt

SEQ ID NO: 46293 - DNA, 585 bp, Triticum aestivum
  Clone ID: PAT_TA_46293
ttcagaaattgttaaacctttctaagttaggaggcagatagtgctcattatttcggccctacaaccaagcttcatgcatcttgtcgatgaacttaatggtaatcatgtcatacataagtgcttgtcaaactttggcgcagaagagaacaagaatcctcgctatgatattgatttccaatataaaatgtatgtacacaaggatgtgttggtgggtccctaccacaaaaggaagcttgtgaagttggtcaccaagttcactttggacctggattaacttagcgtccaattcctctagatattttttcctgctttattatatcaacaattcagcgatgccatgaatctcaggcattttgagggcattgataatgcaacatcaagctcgttttgctatttggaatgtgaatcgggtctttgaatgtacgttgcatcttgaggcaaaggatccagacaaggagggggagcagccgcgcccggaggaggtcgtccacggcaccagaatcctcgttgaggaggttgtccagcgcccatatcctcgttgtcgaccttgcccatccagacgaagtatctttgggacatcaacct

SEQ ID NO: 46294 - DNA, 234 bp, Triticum aestivum
  unsure (1)..(234): unsure at all n locations
  Clone ID: PAT_TA_46294
ggntaggctggtccggnaggagatcccgagttgtgcttgtttcaaagaagctgaacaagaagcggaagaagctgccgggtaccaaagggggaaaggtgcgacgtggataggctggtccgggaagaggatccggaggttgtgcttgtttcaaagaagctgaagacacatccggtgagtgaaccgaatgcatcatcgagggaatcgatctgggaatccagtgagccgctcacgggt

SEQ ID NO: 46295 - DNA, 521 bp, Triticum aestivum
  Clone ID: PAT_TA_46295
gtcccttcttcactctgtgtctagcatctgcagcagcatcctgcgagagaaataatggtgtacgaggcagtggaggccgttgctctgaggagccagcttcagagaagaaacatcagtgtgagaagccatgagcatcaggtgaaggccagagagaatgaactcatatggggcattgttctctggatcatcaggaaggtttgcccggcctactaggccatgctgccacacgtacggatgactagagtgtaacagctgaaggtggatcctttttgcttcgagcagagattttgcacacataatgtgtttttatgtatattctacagtatttcttttggagatatatactatgtatttatgttatgtatgtatgtattgtttagccagttcaggcaagtgtgtgtatctcacttgtagttggtaggagtagttcatcaaggtcatgtaatatcagtgtccaagaactccagtcttggcccaactgagtgtattttgtgctttaattatgaataatgttagctagt

SEQ ID NO: 46296 - DNA, 585 bp, Triticum aestivum
  Clone ID: PAT_TA_46296
ccagaagccccgcgctcaacccccatagccgcagcgccgccactccacccgcagcggcaaccatggcggtcggcaagaacaagcgcatctccaagggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaacca

SEQ ID NO: 46297 - DNA, 585 bp, Triticum aestivum
  unsure (1)..(585): unsure at all n locations
  Clone ID: PAT_TA_46297
cctgttcctcttccttatcagggccaccgcgtcgngagtggtgttccccaaagaagccttgccgaccaagtccggctacctccccatcccgccggcaaacgattcttcttcactctacttcgccttctacgaggccacgcacccgctcacggcgccggagtcgacgccgctgctcgtatggctggagggcggccctggctgcagctccatgctcagcaacttcctccagctgggcccctacctactcgacggcggcaacgcttccctcacgcccaaccccttcgcgtggaaccgtcgtttcgggctcctcttcctcgacgccccgctcggcaccggctacagcgtcgtgccgacccccgccgccatccccactgaccagtccacgatcgccgtgcacaccgtcgcggccatccaggccttcttggacgctcagccgggcttcttccgcgcccgcccgctcttcatcaccggcgagagctacgcagggaaatccgtccctaccgccggcgcgctcatcctggccacgaacccagcgctgccgcagcgcgagaggatcaacctgcgcggcgnggccgngggtaacgg

SEQ ID NO: 46298 - DNA, 530 bp, Triticum aestivum
  unsure (1)..(530): unsure at all n locations
  Clone ID: PAT_TA_46298
actttactttttatgtacaagnataacacctacagtaggcaaatatccgacatgctcgacgccgctctaagggaggctataagtgaaagggtaagagctgtggagacttgttcgacctatgatttaagaatcaataatacgatcaaggaacgcgacgaggccaaggcatcagtcactagattagacgccgacctcaaagagatttcgcagcgcaggatgaatcttcagcgctctggtgaacaaacctttcaatgcagcattcgaatgagcatcaacgctagagacgaagatggtcatttgttcggggacttgactattcctttggaagccattgcccgtgagcaggacgggtaaagtcttagtctacaaagataaataatctaaaggtatagtctaagtagcataaactggcctactaattttgtctcctatatcctcagcggccaatttttctgataccctgaggccatggtgatttttctggtgtatataatcttacttagtaatattacacccttgtctcaactgcc

SEQ ID NO: 46299 - DNA, 586 bp, Triticum aestivum
  Clone ID: PAT_TA_46299
cggccgcgtggggattgtagaaggcaggtctcttgcctaccttgaagaagtcggctacaaccctgaaaggttcccttcccccccatctctgggttccagggtgacaacatgatagagaggtccaccaaccttgcactggtacaagggcccaaccctgcttgaggcgcttgaccagatcaatgagcccaaaaggccctaatacaagcccctccgtcttcccctccaggacgtttacaagattggtggtattcggaactgagcctgttggccgcgttgagactggtgtcatcaagcctgctgtggttgttacctttggtcccactggtctgacaactgaggtcaagtctgttgagatgcaccacgagtctcttctgaaggcgcttgctggcgacaacgtcggcttcaacgtcaagaacgttgccgagaaggatctgaagcgtggctgtggtgcatacaactccatagatgaccctgccaatgaggcatgcaacttcacctccacagtcatcatcatgaaccaccctgatcagattggcaacggctacaccccagtgctagactgtcacaccttgcacattgctggcaa

SEQ ID NO: 46300 - DNA, 352 bp, Triticum aestivum
  unsure (1)..(352): unsure at all n locations
  Clone ID: PAT_TA_46300
cggttcgccccagcgtccggttagaagagacgcccagccccgcggcaacacagacaaacccgctgaaagcgncaaaacaccgtgccggttaccatgggaggaggccgcggcctggtcaccgggttctacgtctggggctgggagttcctcaccgcgctggtgatatgatccgcctccgtctcctgctagagacctcccccccctgctcattccatacatactccaaaattattagccccacgtggagccccagcgatcttttatgtgaaaaacccggcgaggatggccggcccggcggaaaaacaccagaccggtggaagaaaaaacagccgcggaccccccccggtgggcg

SEQ ID NO: 46301 - DNA, 252 bp, Triticum aestivum
  Clone ID: PAT_TA_46301
aggaggtaatgctcccatgatcgcccttggtgcgggagaagctttacgcgaggtggtttttttcccccccggtcgccgagagaacaaaaccattggcttgtatggtgcaagacccaaacaatattttttttagataggaaaccccgctccttttcttttgttttaaatctccagaacgccctaccagggaaatgcaaattaaaagaggtgaatagtgcctatgaggatcttttttagtgtaagatcgatggc

SEQ ID NO: 46302 - DNA, 419 bp, Triticum aestivum
  unsure (1)..(419): unsure at all n locations
  Clone ID: PAT_TA_46302
aatttccttggaaaattgctggaatttagccgccgctgggttggctgtgctttccactgtttttggaaaaaaaattctccccactttcctgccctttgattcagcaaaattggctcggcccgatgatgagtcctggtagtgtattgggaagctgctgtgttatccattggggctatagtcataggatccatcactgggttatatccccaccttttacagatggtccgccccccctcaccccacttttttttaaaaagaaagctcttcttaggagcttttctcgttcaaaaccccccacccccccccccttattnataaacacttttcccctttcaattttttnntttcccttttctccccttctacnttttttcttttatatttttttttttttttttttttttttttntttttatttt

SEQ ID NO: 46303 - DNA, 576 bp, Triticum aestivum
  Clone ID: PAT_TA_46303
gctttcacgaggtaaggttgcggctgagaatgagactaattaatcctgatataaatcttctatcaaagcgaacgaatccattatgcacgaaaaaacacagatcatagatgggtgcttctgctgccttcttctacctcttgctgcccctctgggttcaggatgcagctgcggctggtcttggtttcacacgaagtgatttcccacggcgattcgtctttggaactggaacctcggcatatcaatatgagggcgctgttgctgaggatggccggagctcaagcagctgggacactttcactcacgcaggcaaaatgccagacaaaagcacggcagatgttgctgcagatgggtaccacaaatacatggacgatgtcaagctcatgtctgagacaggcctagaggcctataggttctccatctcctggtcaaggctcattccaaatggacgcggagctatcaatcccaaagggctggagtactacaataacctcattgatgaactagtgaaccatggaattcaaatccacatcacacttcaccatctagatctccctcagattcttgaagacgagtacg

SEQ ID NO: 46304 - DNA, 504 bp, Triticum aestivum
  unsure (1)..(504): unsure at all n locations
  Clone ID: PAT_TA_46304
anacacggcgccggcgagtgtctttcgccggnatcgcgtgcggatttttctagcgcgcagctccggcgagcggtgctcgtcggtgacctctgcgacgcggccgagcgcgtgcaggcgtccccgcaacgacgactgaggcgcgtcaccagatccgttacggtggtgggtccccaacgcctacaagcaagcgaagggccacgggaacagcccgtgcagcgggcggcgttgctccggcgccgccgtggccagcgacgacggcgaggtccgtaaggttaacgtcgctaccttaattgtagggggatagggttcttagggaattttgtggattttcgcacgaattttaaggacaggtttcggatcagcggatgattaggaatagcacacattgatccattcgccttggaaaatttgacccctagggtttcagaataaatgtataccagagatggtactgaactgtatatgtgaagatattagatgaatcatgaattattgtcagattac

SEQ ID NO: 46305 - DNA, 571 bp, Triticum aestivum
  unsure (1)..(571): unsure at all n locations
  Clone ID: PAT_TA_46305
cgagttcaactccccacaaaatcccgcagcgcaagtcgaggaggaaccgcagatagagatggcgcgtacgaagcagaccgcccgcaagtccaccggcggcaaggccccccgcaagcagctcgccaccaccatcgtacgtctcgccgcctcccttgtctccttcttcccctgttcccatcggttgctatttcgctgatgatcgacggtttcgattgtggcgtttccttttcaggcggcgaggaagtcggccccgaccaccggcggcgtgaagaagccccaccgctacaggcccggcacggtagcgctgagggagatccgcaagtaccagaagagcacggatctgctcatccgcaagctgccgttccagcgcctggtgcgggagatcgcccaggacttcaagaccgatctgcgcttccagagccacgccgtgctcgcgctccaggaggccgccgaggcgtacctcgtcgggctgttcgaggacaccaacctctgcgccatccacgccaagcgcgtcaccatcatgcccaaggacatccagcttgcccgccgnatccgtggcgaacgcgcctaa

SEQ ID NO: 46306 - DNA, 578 bp, Triticum aestivum
  unsure (1)..(578): unsure at all n locations
  Clone ID: PAT_TA_46306
cagcttcctgaccacacgcctggnggggggatgctttgtgttgtcggcaaaccagttctgccgcagacaggactaccctccgccatccgagtacgcctttgccggtttaggagaagagccttctccagacaccgttgtttgccctggaggcagtgttatcatttcgccgtcgggcgaagtcctggcaggtcccaattacgacggagaggcgctcatcacagccgaccttgacatgggagagatcgttagggccaagtttgattttgacgtggtgggccactactctcggcctgaggtgctgagcttggtagtggatgaccagccgcaccgcccggtgtcattcacctctgctgcggagaaggctccggctgccaagagcgacggcaccgcaaagccctgatgaccatcggctcagtcacaagcagttgattatcatcgatagttttctttttgtgtgaaacgacctctatcgatcgatagcttaataagccgatgaaatgtaggcttggatcacccgcatgtctgacgcagtgacgcttgtgacgggacaatcagctgaggtctgttcaccgtgtgat

SEQ ID NO: 46307 - DNA, 318 bp, Triticum aestivum
  Clone ID: PAT_TA_46307
ggcggccgagggcgcgggggcgtacgaggacctgctgccggtgatggcggggcggctgggcacggcggggctgctgtcggagctgcgggcggggttccggctgctggcgccccggcgcggggcgccatcacggccgagagcctgcggcggagcgcgggggccgtgctgggcgtggaggggatgacgccggccgcctgagccgtcacctgcatagctagccatcttgattgttatgtactactacttgcgtcgctactgactgtatgttcgttgtatcgccgccgtgtagtcgccgttgttgtttgagtgttcgtacgt

SEQ ID NO: 46308 - DNA, 588 bp, Triticum aestivum
  Clone ID: PAT_TA_46308
taaaaagttaccaatttaccaattccggcgacccctcccccccccctgacgacgacttcggcgaggtaccagcggccatcatgtgtggtggagcgtccctcgcggacgtcaaggttcccacggtgacgtggaaagtgacgaaggcggctctatgtcccaagaagaagaagccccggcatggcagcaacgggggccgatgcttcacagggcttggtgggtgcatgggacccgacgtggacgacaacgaggaggatttcgaggccgaactcgaagtgttcgaggtcaacttcggggactccgacgtggagctcgggcgcactagggtggatgagaaggatgacgacaacgaggtcgtcgagatcaattcctttgccgccgccaagagttccctctcccaaggttttgatggtccttcagcaaaaaggaagagaaagagtcaatttaggggtattcgtcagcgcccctggggtaagtgggctgctgaaatcagagatccaagcaagggtgcacgtgtctggcttggtactttcaacagtgctgaagaagctgcaagagcttacgatgttgaagcacgcaggatccgtggca

SEQ ID NO: 46309 - DNA, 576 bp, Triticum aestivum
  Clone ID: PAT_TA_46309
tttcaggtgaaaacccaggcccatgtcgatgctcacagtggagtgttgctcaaccacttcggattaactgaagcacggtattacactgtcttgttcggtgtctcaaggagcataggaattggatctcagctcatctgggaccgtgcccttggcctaccgcttgaaagaccgaagagtgtcaccatggagtggctggaaaaccactgcaagaaggttgcggcttgaagctacaccagttcttcatcttacaactcgagttgcctttgatgttaataattcgacgacataaattaggcacatttagcctcatttccccatctttttcctgtccaataactggagcaagaggggctcccagacggtagaattttgtacccaagtcgaacaatctgttaaacctggcatgaaagagtaggacacgatgcttgggctttgtgtcgctcggcaacgtttttgtactttatgtttttcgagttctgaaccacaccagttagggaatacggcagaataatctgacatttctactgaggtgtttgtatttgtgagttataccaaaaaaaaaaaaaaaggcggccg

SEQ ID NO: 46310 - DNA, 574 bp, Triticum aestivum
  Clone ID: PAT_TA_46310
gcacgatcctcccgcgtaccaagccaccgaccaaatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaaaaccaagctcatgacccgtctcacctacacccttgacgagatggaaggcccgctcgaggtcggcgccgacggcaccctc

SEQ ID NO: 46311 - DNA, 436 bp, Triticum aestivum
  unsure (1)..(436): unsure at all n locations
  Clone ID: PAT_TA_46311
cggncgcgtgggtcgctctggtgctattttgttttacgtggtgcaactgcnaagtggatatcgtccgcccaagcatgatgtacagatcaccattgtccaggttaagactaaagcaacaaccagcagcaagaaaagggaaccagtgcgagttacccccgtggactgtgtcacgcggttcatacatcacgaggaagccgtcgatgccagatgctgctttgcgctctagctccatcttgtttgtgatggatgcatgcatgcatcatgagttaccctattattacttatatgttcccagcatgcaatgtttgtaacctctaaccttgcttgcatggcatcttttggaagctgcaactagttgtatattttggtgatgtataacttatatttatctagactattagttgtattttggttgtggtgaaacttatatttatct

SEQ ID NO: 46312 - DNA, 588 bp, Triticum aestivum
  Clone ID: PAT_TA_46312
tccatttccaaccagtcacaactcgccactgcaccaataagccggccggtccgtgcgatccaagagtatcagtatactgtatacgtcgctatagccatgctcggggggagaaacaatgggccgtcgacgacgtcgaaggcccgagcggacggcgctggcctcgccggcgccagcaccgtcgtcgccgacggcgggcaggcggaggtcgcagcctcgcagttcgtcgtgcagctagatgaggcggctcgggagaggctggagcgcatgaaccggaggctgagtctgctggagcagcagatggagatgctggaggcggaggttgggagggccagcagtaccgccgacgactaggagtagcggcgccggatgcaagtagaagccttccttttcttcttttcccttctcagcttcttgctgatggaagaacacgcacgcacggtgatagtatcatgcgcttgcttgttaggccttttcttgtagtgatggaagaacatgactatccagaaacaagcacgacagtggaaacccaggcttctccccgctcgggattcctggccgtcggatcttcctttgatgcattctggaccg

SEQ ID NO: 46313 - DNA, 578 bp, Triticum aestivum
  unsure (1)..(578): unsure at all n locations
  Clone ID: PAT_TA_46313
ggcaaanaagcctgatctatctggtgccggtatgcccgtcttccagnatcttattaagccaatcaacgaggcacttatggctgtcaccgagctcaaggatagcaaccgccccagtcccttgatcacacaactgagcactgtttctgagggtatcatggttctcgcttgggtcactgttgacgctcgtccctttaagcatgtggacgagtgcctaggcgcagctcagttcttcggtaacagggtcctcaaggagtacaaggagaaggatcctaagcagatcgagtgggtacagagcttctaccaggtgttccgtgatctctccgattatgttaagcaatatttctcaacgggtatcccatggaaccctcagggacaatctgtccaggaagtcttacagtcgctgtctggcgcccccgcgccttctgctgctcctgctccttctgctgggggagcacctccaccaccacctcctcctggacctcctcctgttttggatatcaagacacaggaggctcccgcggctgcgccgtctggcggtctgggtgccgtcttttcggaactcaacagggtgacgctgt

SEQ ID NO: 46314 - DNA, 580 bp, Triticum aestivum
  Clone ID: PAT_TA_46314
caaccattaagttcaaattaattactgcggcggcacagctcttgcttacttgcggagtttcatcatctctccgccaccgtgacagttactctgaacgagaattactgttacctaacggcgtgccattcgatataattcaagaccgggcaacccatcacgagatcaaactttccaaggcctcaaggctcgcaactctattaattgtcttgcatgaccttgattcgcgatctcccattccaggctacagccttgttgacatttatcaacacttcaaaaaccctggcaaccagtggatttctcacttgcaagacaaggtccagccatacaacaacaagcctgactcggctgacacacagggcaacgactccaggtggtagcctaccggtagcctttgccagcctcgcgtcgcacttgtgtgcccatcaagaaagtggtaactgatagtgtttgcatgggttcggaaccaagcaaacggtgccccaacaagtcgataactttctgggatccttgccatcgtttggccgctcggttgcgtcagcttcgtattcccgtatcttaacagtcctaccagcactctacg

SEQ ID NO: 46315 - DNA, 570 bp, Triticum aestivum
  Clone ID: PAT_TA_46315
cccagcgtccggcctcgactcgctcgctcgatcccgtctcctgcccacgcccggcctcccccgaggagatcaggccaccgtgcggtgcagacagggctcgccggccgtcctcgcgcgcgcgggaccgtctagcgtctctcggctcgtaggcgtcatggcgcagcgggacaagaaggtggaggagccgacggaggtgcacctgcacgccgccgcgtcgccggccgcgcccgtctacatggccgtcgaccggcctgccgccgggccggcggacccgaaggcgtccaagtcgtcggtgaaccgctgccacaactgccggaagcgcgtgggcctgacggggttccgctgccggtgcggcgagatgttctgcggcgcgcaccggtactcggaccggcacgactgcagctacgactacaagtcggcggccagggacgccatcgcccgggagaaccccgtcgtgcgcgccgccaagatcgtccggttctgatcaccacgactacaaatccgaagcagcagagcccactcttttcctttctttcctttgaaaaaattaaaggcgtccccgagagtttc

SEQ ID NO: 46316 - DNA, 392 bp, Triticum aestivum
  unsure (1)..(392): unsure at all n locations
  Clone ID: PAT_TA_46316
tagnacggcttgattctggtaaaccctagcggnacggcagnactcgctgtgtgcccccattacagcagcgcgacgagcagctcttagccggttggggatggaagtggaacatggggtgccgcctgatgaccggctgttcggttcttgtgttgtgtgtgcgtgcgtgtatctgtttcagacagagggagagagagggagatgtctggactgaacggtcgcgtggggcttggcagctggtgttccatatccaaaaccccgtgcttgtcctgctcgtcgtgcagcaactgctttagcaggggttggcgcgcgcttggatcgccgtctctgttgggtttcctgccgcggtgaaggtttcttaacatacacttgatatgagcctccaaggtctgaag

SEQ ID NO: 46317 - DNA, 559 bp, Triticum aestivum
  Clone ID: PAT_TA_46317
cggacgtcgtggggtcgtctggggacaggcgcggtatactggttacgatatattggtacgatggtcgagcatggaggttgaggctgcaaggtgcgagtgctgcggccttcacggaatgagtgcacgccgtgatacatcgcggcggtgcgggccgagtacatgggccgctgggtctgcgggctctgcgcggcggccgcgggacgaccagatccgccgcgcgggcgcccggagccagcgcgccatcaccacggacgaggcgctcaaccggcacggcgcgttcgcgcgggtaggcgccgtgcgcgcccaggaagaaggcgttctgagagctcgcggacgacgtctctcgcctgctccggctctgcctcgactcgccgcccgtgtcctccgccgctccgaatgggctcaaggtggccgatgagcccacctgcacggacgccgaagatgattgatcaaggatagctagttatacccgggttgctgctgatgccaatgattgctcacaaggcgcaacataataatacttgagaggcatgtgccttgagcggttaggctgccttcc

SEQ ID NO: 46318 - DNA, 354 bp, Triticum aestivum
  Clone ID: PAT_TA_46318
gcatatcgggcggcacgtgactgctgtacaactccatgttccccaggacacaatgagcggatggacaggacaggaggtcgacgttgctagggaggtggccaaaatggaggtgccattgtctcgccaccatctggatgatgcggcagccttgtctaggtatgacgataacaatgacgatgacttcccactcaagtctgcttacttccgcatgtaataggcttccctctgaatcgtacatcacctaacgtcccatttttccagacaatccctttcatatagttactgaaaaccgatctgaccattaaagcaatattactgattttagtaaaaaaaaacataaaaggcacgactgaa

SEQ ID NO: 46319 - DNA, 591 bp, Triticum aestivum
  unsure (1)..(591): unsure at all n locations
  Clone ID: PAT_TA_46319
gcgcggnaactagcaaataaagcatcggagttctgtcgacgtagtagcagactagcagcctcctacagagtccatggcgatagagaggttcctgatgacgctcgtcttctgcgaggcgcccctcgacggctgcggcaccaccggggcgatcaagcagctggtctccggcggggcgacgaagcctgcgccaaacaaggccgatgcacaggggcaggggttgtccggcaagtcaacggcggagcggcgtgctgggttcgagctcgccttcgacggcctccactgcttcgacaccgtcgtcatgcactaattaagcatgctctggtcgattaactacgaacggaactgtatgtcgttgtcaagcctgactgctctctttctctcagctcacccacggacaaaggtggacgaaagtgaggccacgaccaggagctaagctgcggcggactggagattttccctgtgttaatgccctctctctctctctaaacttccatgtctgccctctgggttaacttactctctgttaattctctatgaagaatcaacataacgtgaatcccanactctgaatgtgtgcaacgggttcagtgg

SEQ ID NO: 46320 - DNA, 571 bp, Triticum aestivum
  unsure (1)..(571): unsure at all n locations
  Clone ID: PAT_TA_46320
tgagagtgcgcagnacctcacattacccttgttctgtcaatggaacttgcaaaaactacctggtctatttgagtgtttgtgccccgacggttacagaggcgacgcaaaaatgggacctgcgagagacctccgcgcaaccaaacacttggtcttggagcaaaactcgcaattggcgcttctgtcggcattttggttgctcttgttggtttccttggggtagaagtgatccggcacaaaaggagtataaaaagacaagccctcaatagacagagcgacgagtatttcaaacagcacgggggcgagatactggcagagatgaccagggacgggcacgggcgtagcatcccgttcgccgtctacacaagggaggagatcgaggcggcaacaggtagcttcaacaaggcgaacatcgtcggggaaggcgggcaggggaccgtctacaaggcggtcctccgcggcgccgccgtcgcggtcaagaggtgcaaggaggtggacgagagcaggaccaaggacttcgtgcaggagctggtgatcctctgccgcgtcgaccaccccaacatcgtcaagctcc

SEQ ID NO: 46321 - DNA, 592 bp, Triticum aestivum
  Clone ID: PAT_TA_46321
ctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcacttccttcgccagcgacactggtaca

SEQ ID NO: 46322 - DNA, 593 bp, Triticum aestivum
  Clone ID: PAT_TA_46322
attttatttacccatccacaataccattctcgtttcagcatttcctgtctctacacccaacaccattgcatcatggctgagaatggaggccgagagcctcaaatgatgcaccacctgcatcaacgccagtcatcccgtgggctattctcccccgaagtcgttgatcttgtgctaccgcctctgaagtttggtggttacgctggaactgctggtgttctggctggtgttggaggctcaatttttaaagaggcaaaccctataatttggggtgcggtttctggcttccaatggttcactttagggacaagtttctggttcacaagaggtattgttctaaaagcatggggcggtgaggaaagactcaaaaactccgaaaagacaatggccagcgcaatatctggtacagcagcaggcgccgttggtggcttgatccgaggacctaagaatattctacccgccatgtttgtctggacaacagtaggagctgttgggcagataatagcgaaccgaatggcagttcgcaaacccaaagtggatgatgagaaggaaggattcctcacgcggtgggactccgctcaagaagctcacagacc

SEQ ID NO: 46323 - DNA, 609 bp, Triticum aestivum
  Clone ID: PAT_TA_46323
gtggtatgtctacatttggcatcccttggttccattcattatgttacttatggtaggaagtaagatggagcacatcataacggaattggcttatgaggttgcccagaagcacacggctattcgaggggatttagtagtttctccttcagataacttcttttggttccaccggcctaaattagttcttctgttgatccacatcgtgctatttcagaatgcatttgaaattgcatttttcttctggctcttggtgacatatggttttaaatcatgcatcatggggaaaccagcatatgttattactcgagttgtcataaggtacaatagatatcacagcagcagcaacatcatattgagacatcttgagaacatactcattacttttacttatttcagtgtaatctgccaagtcctttgtggttacagcaccctaccactatacgccgtcgtctcccatatggggaattccttcaagaagactatatttgatgaaaatgtgactgaaggccttgtcaactgggctgaaaaggctaggagaggcacaagaaccccaaataaaattactacagatgcaagtagttcaccaattgatgaggcaaatggtggcgc

SEQ ID NO: 46324 - DNA, 518 bp, Triticum aestivum
  unsure (1)..(518): unsure at all n locations
  Clone ID: PAT_TA_46324
ctccgccgcctcgccggcggcccggcagnacctcccctcanagccgaccgtgcctgcgcgcgtccctgcgccggaccgcgcggacgacggccgaccgcgcgccacgaccatggcggccaccgcggatccgacggcgaagacgccggccacgcagccgcaccgcctgaagccgtggggtccaccacaaccgcctcgtggccactgcgtgccttccctgtcgtcggtctccgggggggccggagccatccgcgatcggcgccgctcctcgacgtcccaccgacgcggtggtgccgacgccgtagacgagggaccttacgacgacgggctggaagatctccgggctaagctcatgggccacgtccatgaagccgccgaccgccttcggctgcccccggcgacgccccagcggtcgccggagcccgagcctccggcagcgccgcttcctccgccaccgcaggacgccgccgcggttgtggccgccagcatgccgnggacgctgagggagcgaaagcgtcgtc

SEQ ID NO: 46325 - DNA, 364 bp, Triticum aestivum
  unsure (1)..(364): unsure at all n locations
  Clone ID: PAT_TA_46325
acaccattattttcctctccctcctcctgnccacccacccaccaccagccaccaggcggccgatctcccctcaccgccaccgctaccgccgacgccgcagctccggcagccgttcgtctcgaggtacggacgagcttcccctccccttcccttcccttcccccggcgatcctcccagccaaatccctcccgctaggggacctcgcacgccgctctagatctagatccgccccgtcgtgcccgcaggcgttcgatccctccctccctcgctcgcccgcccgcgcagccaggcagcggatccggcgaggcgaggcccaagtagatcgatacctccgcctcgccatgaagggcccttccggttcctc

SEQ ID NO: 46326 - DNA, 604 bp, Triticum aestivum
  Clone ID: PAT_TA_46326
acgaattgacaccgtcaacggaccagttcctcggcctctttcaataattttgcattgaatccatcaacacaactggctagctgcaagcttgtacgtacgtacttgtgccgcctgcatatatacacgcataggaacttgagagttgagaccaagcaccggaagctagctagcgttgcatgcattaaaacacggtcacacactgctaccacagccacgaatctcaggtgatcaccgaagcaagcaggcgaagatggtgcacgccgcgacggccgagtgcttcagcagcgtgttcgcctcattcgaccgtgaccccaacgacaggatctcggcggctgagctgcggctgtgcatgaaggcggcgctgggcgaggacgtgtcagcggaggatgccaaggcgctcgtggcatcggccgacgccaatggagaccggctgctggacgagcaggagttcctccggctagtggtacggtcggagatggaggaggaggaggaggagcggtgcgggggctgaaggaggcgttcgcgatgtacgaggccggcgtgcctgatgcgaatgctcgccaggctggggtccgagcagggcatggaggagtgctgcgccatg

SEQ ID NO: 46327 - DNA, 581 bp, Triticum aestivum
  Clone ID: PAT_TA_46327
caggactgggctctgagcggacatcgattacggatatcgacaaggactttcattcaaaccagccccgagttattgataccaaggaacctgaaaggagaaatctggtagctcgtcaggaacttactcttcctgttcttggaggaccacgacccaagcaggtcgacgcctctgcctttttattcgctgtttcgacaacttatgatcgagtcgttagagacgactacgctgttgctaaggactgggcgagatggatgacgggtggaaacaagaatggcaatggagcgagtttcttgcttgttctcgatcagggacatcaccagcaggccgacaaactcaaccaagttcttgcgtcctatggtattgatgctcacgtcacttactccgagggtcagatgtctactgcaaagagatactttaacatgattgaaacggtcaaaaagcacagtgctacacttgctcaaaagggacagatgaagcagtggtacggcattctggatgaggacatctttcttcccaatctatctcatcttcaacaacgcctttttgcgttcaactctgaaaggaactctacgtcggcctac

SEQ ID NO: 46328 - DNA, 533 bp, Triticum aestivum
  Clone ID: PAT_TA_46328
ggcaatcagcctcaagcagtactcctcttggtgtgtgtgtatgtgtcttgtgttgcactagtgagtgcgtgtgttactagtgagttgagtgcaagtactaccgttagatagtcaggaccctctggtctcagtagttccgggctaacaacgcgccggtgcccaggcgccttgcatccatctacagcgaggtgcagacgagccgcatcgcgcacacgctgcccctcccctccgtcctccgctcccacttcacgctcgccgacgagccggccagcaccgccgctagaagccccgacgagatagccaagctgttctccagcctgcacggccgctgtccacggccgtgctgccgtcggccgagcccgtcgcgacgaagccgctcaagatcggcatcgtgcttcctggtggccaggttccagggggacaatgaatcgacttctttggagggtgccaaaggcagcaccatgtatggattaagggaggcccgctggtgtcatgaagggcaactacgtcgagctgactgctgatttcgtgta

SEQ ID NO: 46329 - DNA, 228 bp, Triticum aestivum
  Clone ID: PAT_TA_46329
cacgcaaacgtgtctccttttggcccccatgtattgtagcggccgtttctgtgcgatcacgttgctgagtagcgattacgaggttaaatctgcagatattcgttttagtggacacttttgcagctgttagcgtgttttgagtgtacttggggtaatccgtgctcacaacttcctaacgtacgtaccattccttgtcactgaaagttcagattaaaactattcaacgtc

SEQ ID NO: 46330 - DNA, 595 bp, Triticum aestivum
  unsure (1)..(595): unsure at all n locations
  Clone ID: PAT_TA_46330
catcatccttgtggttgtgggcatgtggttcnattggaaagctcgatggacacgatcttgaaattggcacctttcgtgcctcgtgttcgcagctttacactgcacttgtttgtgtcgccgtgcctctgggtctgattgcctcgcctttctcgaccctgctctggctcatcggcgcatctggcgtgactatccttggtcacgccgcatttttggacaagcccatcgatgaggctttttccggggaggcggtctaagtggtcggccgcaatctcccgaattcgcgccccaatggggaagaccatcgaggcgcaggcagaggagaacagaaggggatgctgcgtctcgcggacgtcatgggagagacgtccgtgtggaggaattggattcaggtgatgatgcacgaggtgtcggtgcttcgtcagggtcccgctttgcgagcgaccctcttcgtttcacaggaacagatgtgggcaactcggaacggggtttggtacgcaggggtcattacgaggactcggaggattcagaagatgatagcgacagcagcgaggatgaggagttcgagcaatatcttgcagaactggcttctcatgac

SEQ ID NO: 46331 - DNA, 601 bp, Triticum aestivum
  Clone ID: PAT_TA_46331
atttctattcatgccatcttccagtcacttgatacgatcaagcattagatagtgaaagcttaaatccaggagagcaggtgaaattgtaaggagggtgttgcttaaactgtccttgcaatctggcatttttggtgaaattgaccacactaagctcaaaactcatttccatctccggactccgcatatttctgcaatgcaccatgacgacacacccaatctgaagatagtagaagaaaaactggaagaaatcctagagattgcaagcacgtccttagagacgcggaaaatggttgttgagatctgcgacattgttgcaagaagggcagcccggctggctgctgcgggccttgcagggatcctcaagaagcttgggagagatggctgcgtcgacaagcatcggtcggtcatcgccatcgatggaggactgttcgaacactatgccaagttcagcaaatgtttggaagctactctatatgagctgctaggggagcagtcatcgaagtcggtagtcatcaagcacgcggacgatggctcggggataggggctgccctgatcgctgcttcccaatctcagtgcagaaatgttgaatagcagtaggca

SEQ ID NO: 46332 - DNA, 594 bp, Triticum aestivum
  unsure (1)..(594): unsure at all n locations
  Clone ID: PAT_TA_46332
gctcctgctctgctctcatcggcanagcagcaccttggnaagggaaaacaacaacaacaacaacaacaacgaagattaggagttgttgaaattcgctctcttctccgtcacagcgagatttggcttcgccggtgcttcgattctgaaggatctcaagagagaccatggctcgttttcaggaaaccaagccggatctgctgaattccggcagcgatacgcggatgatggccgaggcccgcctccccaaggcgcgaaagccgtacatgataaccaagcagcgggagaaatggaccgaggaggagcacaagctcttcctggaagccatgcagctccatggccgcgcctggcgccgaattcaagagcacataggcaccaagacggccgtgcagatcaggagccacgcacaaaaattcttctccaaggtcacccgggactcgtccggggacagcggcggcagcagctccggcgccgggccgccgatccagatcccgccgccgcggcccaagaggaagtcggtgcacccgtacccgtgcaacctgaggagcgcgcagccggggaagcacgcccatgccgcgctcctgcgggtcgacaagc

SEQ ID NO: 46333 - DNA, 577 bp, Triticum aestivum
  Clone ID: PAT_TA_46333
ctcgatcccactttccccgaccttcgctgccctagttctcgattccctctttccccgatcttccccgccctagtttccgatccctagtttccccgatctcgattctcggagttttcgcgcacctcgtcgaacatggcagcgatcatggcggcgcgcgggcagaggcaggtgcaagatttcgacttcttcgtggtggtcgacttcgaggcgacgtgcgtgaaagacgcgcggatctttccgcaggaaatcattgagttccccgccgtgctcgtcgacggcgccaccggccgcatcgagtccgcgtttcgcaggaggacgtggacggcggcgtggaactcggcgaggcgctctggatgcacgactcctggctgaaggcggcgacggcgggggcagggagcttggccgtcgtgacatggggagattgggattgccgcaccatgctcgagtccgagtgccgcttcaaggggatcgagaagccctcctacttcgatcgctggatcaacctgagggtccccttccaggcggcgctcggcggcggagggcgggtcacccttcaggaggcggtccgggcggcggg

SEQ ID NO: 46334 - DNA, 595 bp, Triticum aestivum
  unsure (1)..(595): unsure at all n locations
  Clone ID: PAT_TA_46334
atcagttctcccagccaccgcgnagcagcaccaaaacggcgatgcggcgccgtcgccttcgccgcgctccggcgggtccgccacttcccgcaccccgcctctgcacctcctacggcggcacggagatgcccttacactccccgcctctactccaccgccgacatgaaccagcagctgcctgcaaacctggtgcagatcatggagcagagaatgaaatcgatagagcagaagagtgcatacctccaggagaaaatcaaccagccggctgcctcacccgaggaatactcgagggctaacaaggagttccacaagctggagagcaccatggaattgatcaaggagctacggtcaaagcagaaggaaattgaggggttgacagccttggtgacaaactccgttgaagagaaagacatgcgtgaaatggcagctgaggagctccttgaggctgtcgaggaggagaaacaactgcagcatgagttgttcagaactttgcttccgaaagatgaagctgatgagagggactgtatattggaggtgcgagcaggaactggaggagaaagaacttcgttgtttgctatggatatattcaaaatgt

SEQ ID NO: 46335 - DNA, 374 bp, Triticum aestivum
  unsure (1)..(374): unsure at all n locations
  Clone ID: PAT_TA_46335
accacatctactacaaccatttaaatttaccaggtgatactaatcgcatctgcaatgatgtgcaattgatgaaatgtcactacagcgaacatttgtattgtaggaaagacaaaaaaatcaatggagtggataggatcaagtcaacaggatattacaggactagtaactataacattactaatgactctgcgggtctgatgtggcttctccccccggaattctagctgctcaatgtcattgcagtatgtattggtcttatcttgagccttttaattagctggtttagactttgcatgtttgacatgtttaggcctgcttgtttcaacctatgtatatatattatctccctcccaaaaaaaaaaaaaanaaaaana

SEQ ID NO: 46336 - DNA, 533 bp, Triticum aestivum
  unsure (1)..(533): unsure at all n locations
  Clone ID: PAT_TA_46336
gctgtacaggtgtgccagtcccttgnttgccctgcaggctacgacgtgtttgacaagcttgagaagaatacaaaaaatggctcaatggtcgagggcagacaggaagctcaccttcgacatggtaaactccatactgtcggaaattcttgccccatgtttggacatgcacccttgggcaactactgcaaggaatatggcgccagcgtggggctcagagggcctgttggagaaattgttgcaggtgttgactcggcggcgagaagaacttgcgccaagagtgcataagaaggagaaacaagtgttaaatcagaaatggccagacttggcagattacatcgacagggcaggtagggatgttgagaggatgataaaggatgatcttctggaagagctggttctggagttgatgtccagctagttgcaaagcctactgctggagttgctgtcagctttcttaggcccaaagaagttacaaagtttgctgtaggagtgtaagtcattgctttctgtgttaggtcaggttgatcattggt

SEQ ID NO: 46337 - DNA, 607 bp, Triticum aestivum
  Clone ID: PAT_TA_46337
aggtttcctgctagggttttggtccttcggtttcggcggcgcaagatgggggagagggtcaagggaaccgtgaagtggttcaacgtcaccaaggggttcggcttcatctccccggaggacggcagcgaggacctcttcgtccaccagtccgccatcaagtccgacggctaccgcagcctcaacgagaacgacaccgtcgagttcgaggtcatcaccggcgacgacggtcgcaccaaggcctccgacgtcaccgcaccaggaggaggagcgctctccggcggctcccgccctggcgatggcggtggtgaccgtgggggccgcggcggctacggtggcggtggctacggcggtggcggtggcggtggcggctgcttctcctgcggcgagtccggccacttctcccgcgagtgccccaacaaggcccactaggcggcacagctcttcagatctgagtgccccgtttaccctcgctcctttacctacctcctgattctgcagcaagtcataccctatacctatcagtactagtattagtcgccgtagcgtttccccctgctgctcgatccgagcttggttccagaagaattgctggtggtgtgttcgtcgt

SEQ ID NO: 46338 - DNA, 597 bp, Triticum aestivum
  Clone ID: PAT_TA_46338
ctttatgctactattcgtgcaactggctctggtagttgtgaatgtgtcagcatgggtaatagtaatactggatattagttgcacttgttatagctgctagtctgctactatctgaatacttttattttttaaacttggacagaactctgttctttttgttacatatgaaatttaattaaactaagcagttaaaccagccattattctgtgcatgggttagcgtctgtgtgaagcttcttatggcttattaacttacagcggaaatggccaatcgcctatctacttgcaggtgaccgatacctgaaaccatttctgattccaaagccagaagtcagcattgttgctcgggcaaaagatgacgactgcctcattctagcaagcgatggtctctgggatgtcatgtcaaatgaggacgcatgcaaagttgcccggcgacagatccttctgtggtacaagaataataacgacggtgcgaattccgatggaggcagcgaacccactatgaacccagctgcaaaagcagccgctgattgtctcgtgaggctagcgctgtcgaaagggagcggggacaacattagtgtcattgttattgacctg

SEQ ID NO: 46339 - DNA, 563 bp, Triticum aestivum
  Clone ID: PAT_TA_46339
ccgtagaacgaggggcaccggtggtggtggtgttcgctcggtggactctgttccattttctttgctccttcacgctttggcgattccttctgttccctttctctgcttgttttgatttctaatgtggcttgttgattctcatggcaactccgagggactgttgtgcaaaatcgcgcacgacgacgtacgacagaaacccaattctctttattagccgggctcggccagcgccccgacggccccgacactatgcccaggcggaggtagaggagctcccccaccccgcgtcctcctcctcctcctggtccgccgacgacgcctgggtccttggtcgccaacctggccgcgagctcctccagccgcatccccatgcgtaaatgcgcggatgtgctccccggcactggccggtggacggcgcggcaccgaatcgaccgccgcacggggtggggtgcctcctggcggctgggatcgggaggcgagggagaaagaggagagacggttggggttatgtttctttttttacttcaaaaagaccgcgggtttaataccgcaaactgtaggga

SEQ ID NO: 46340 - DNA, 403 bp, Triticum aestivum
  unsure (1)..(403): unsure at all n locations
  Clone ID: PAT_TA_46340
ntttttactcccaccgtcggtttttctgcaagttggtgattgaaaaagtacatcttgcagtcgtgcacggcgacttgggctccaaaagttcctaccacgttcgccgatagagtttcatgcttccacagatctctaacagaataggcagatgaaccatcaaggcctacagctggcaatgacattgtgatattaaccgtctccgaacaacgattccataaagcaacagccaaacggttgccagagagggggccagcccacacctcacggcatccaccctttccctgacccaaaattcttcttcctattctgntagagatctgtggaagcatgaaactctatcggcgaacgtggtaggaacttttggagcccaagtcgccgggcccgacttgcagaagtacctttt

SEQ ID NO: 46341 - DNA, 594 bp, Triticum aestivum
  Clone ID: PAT_TA_46341
ctcgcccggcagagccgtggctcgagatgtcgccggcgtcctgatccgtggatcagaattcatgctttccagttacgccggcagcgggtgcagttaatgcgggtgccgacagctatctcctacctccagtccttggatcttggattcttaagagctgtgaagcggtcgagataactcctgtgacaaagcgatcgattgcccgatccggcgagtatggagttcttgatgcagaactctgctagaggtcaacgagaacaacatccccacgagtcctcttcagtaccctgtgaggatgcctccggccgttgcgttgccgacgcacagatttgtgctgctgaggctgctccagtggcaggcagtggagacaagcgtcagggttcagagaactccatagagcatgttgacccgaaaactcctggctggataaaaggtactcacagttggattgaaccaacttatgttttggttagatgtgccaaaacaggctcggaagccaggaagatgtaaaaattgtggcgttgaagagggcatcgttgccacaaatcggctgagcttagactgaagagttgatctgattaattacttgttatgttg

SEQ ID NO: 46342 - DNA, 554 bp, Triticum aestivum
  Clone ID: PAT_TA_46342
ttgtaaccgacgcttgcgagtcaacccaagctgtgcaaagggatagaattctatatgttcaagaccacaataggaacgtggactatatatggacctacagatacaggaagctgaatgcattgggcttggtacacaaagctgtgggaataaagataactcaaaatcaacttcacttatactctcaaggaatgtgtagaactgaagagatagccagattataattgagcgtgcattaacattgaaattgctatcaaatgaatggacgcctgcaagaactatggatgtaaaactggcataccccaagttttactactggattcgatgctcaacaagaatgacctgatcgactctccatacctgaatctactgacgatgatcctatgacctctggcgtgtataatgcagaagagacacccaaggatatatgacttctacatgcgcgctcatgctggaatgatggggactacaatgacaactcactaccatatgctggatgatgagatacactttgacgcctatgacctgtacgatcttgggcactacctctcatatgt

SEQ ID NO: 46343 - DNA, 175 bp, Triticum aestivum
  Clone ID: PAT_TA_46343
gcgttttgtaccttttgaaaactgtccaccaagaccaaaaatattggcaacacttgtgggcggatacaaatttgatgctatttggatggctggccacgtagaacaggcaaacttacattgaaaaagagtgtttaattgtctcgccatgagtacaaaaacaacacttcttacttcc

SEQ ID NO: 46344 - DNA, 227 bp, Triticum aestivum
  Clone ID: PAT_TA_46344
aagaacaagagaattcacctctttataacctacaaaatcggataaccacgaagaggacattgctggaataaattgaggatcgtgaagcaaacaatgaaaacttgacacaatactttcataaaaaacgaatgcattataaatagtatttcgactttggactccatcacctatgaaagatgtgttttcaaacaacagatcttactattatgttgtattaccactttata

SEQ ID NO: 46345 - DNA, 575 bp, Triticum aestivum
  unsure (1)..(575): unsure at all n locations
  Clone ID: PAT_TA_46345
gttgcaaaactgtgatccttgcgcaaaaactcaagcttttcctccacctgcaagtacagccccgggaaccattctcagtaaatctgtcttgcgattctgngacagatgaaaaagattcaagcaaaagccgtcaccttctttggtgttcgaggacgacccttctgtgtcaacacccggccacgccttgcaggtgcagtgctttcctttctcgatgtcttcgtagacggaagcgacatgcttgccgcaccccttccaggtgatcttgccgcatttgtcgcactccaccttgtagcacatcctgtattcttcttcagttgatccctgagcccctgttggaagtgtagtatgctgttctggactggactagctagtgtgcctccttcgctctccgtgggttcagcatttataggaatataaaccaagtgtggataagctctatgtggcccggcgcggttggtggaggaaacgaaatccggataagttgtgcgattctgcagcttgtaaaactgttaggtattcccaatgctgcggcgaatatgattcacttgtaaaactattaggtatttccaatgctg

SEQ ID NO: 46346 - DNA, 596 bp, Triticum aestivum
  unsure (1)..(596): unsure at all n locations
  Clone ID: PAT_TA_46346
gncggataccccgacattgccgtgcctggtgccgtctccctccgcgtgcagccgcgggagacccggggagtgctccacgacgggtgatgggccgccggcaaacagtgcaaagatgagggacctccccgcacgacatgacttccccggcccgccgtgtcgtggtctggtacgctgcaggctggagtcaaccgaccaggtacggcccagggcctaggcgcacgggaccgttttcggccagagtagtgcggttgttctccatcggactacaggcagcccagccgctcgacggccgccgcgtgcctctctctccgccaccaccgcaaggctcggcgctatagacctgcagctggtgatcacctgcaacctcggccggcatgtctctttgggtaacggcgcgacacgcgtgccacgagctcgaccgccggccggactcgacgcttgcgctaggcgctcgtgccctgcgcacctcgcctgacaatgtctttactgttccttctcctctgctcgatggtgcccaaggtgggggtggtggttgcttcgacgagtacagtttgtcgttgccgagaagtggccggcactggcaagtggaactgggg

SEQ ID NO: 46347 - DNA, 520 bp, Triticum aestivum
  Clone ID: PAT_TA_46347
cccagcgtacgcggaagcgtgggcggtcgcgtgggccgacccgtggataaaggactggttcttgacgtcgtaatagcattcgatatggagatgagttttagagcaagaaactcagatggattacggagatcttatgcacgcagcactctcggtaagggtagccgtgggtgtgcccactctgactgtaggagcgacagtcccgactgtcagattctgaagactttgcaaggataactttgacttgaaggccggcttctattgctgttaacgttcagtataagaaatgtggagacaggttcatgaatacctctacttacgcgtactttgggcgtgataatgccgattttacctgtgagagtatgaagctcctagagtttacatggtatttggctaagatctgtgattctcttggtctgccatctgttaagtttgtcaataagaaatcatgttgcttgtgcgaagtctgaataatcatttaacattgtaatgacgctctaaattggtcattgttgtttggtaa

SEQ ID NO: 46348 - DNA, 588 bp, Triticum aestivum
  unsure (1)..(588): unsure at all n locations
  Clone ID: PAT_TA_46348
ccccgcgtccggcctcagnacactagttcttgcataccgtcagctcgaggagatcgagtacgcaaaattcgaaaggaagttcactgcagctaagaattctgtcagcgctgatcgggatgagctgattgacgaggctgcagatttgatagagagggatttgattcttcttggtgctaccgccgttgaggacaagctacaaaagggggtacctgactgcatcgacaaacttgctaaggctggcatcaagatatgggtgctgacgggcgacaagatggagaccgccatcaacatcggatatgcgtgcagtctactcagacaagggatgaaacaaataaccatcacactggatacaccagatatcattgccttggagaaaggtggtgacaaaggagccattaataaggcatcgaaggttagtgtggtgcagcaaatcagtgaaggaaagaaactcataaatgcatctggcaatgaatcttttgctttgatcattgatgggaagtcacttacatatgcgctcaaagacgatgcccaagccgcgttccttgatctcacaattgcctgtgggtcagtcatttgctgccgttcttc

SEQ ID NO: 46349 - DNA, 485 bp, Triticum aestivum
  Clone ID: PAT_TA_46349
gggagctgatgatgcgtcaagccagagttggacgatgaaggcgatgctacgaccttcattagcggatgctacaaccttcaatggcgggagctacaagcagcgatggcgagatgggaaacctatgaccatggagtcgatttgctgggacgggggagggcggtggtggcagagctgcaacagcgcactggtggtggagagtgtgccccctacaaccatggggcggtcgggcgcggcgacagcgacctctggcgcgccggcacaagcaaactgacggcaagcacgggtcatggggcggccgaagagcgcatgtcgcgcggccgtgggggaggacggcaagcgtggatgaggacgagcgcaaccggatgaggacgagcggttgcgttgggctctgtcccctttttttctttagatgactgacaaatcgtacagtttaaaagtgacgtatcgtgcggcccaaatttgggccggcgcgccggcgcctatca

SEQ ID NO: 46350 - DNA, 543 bp, Triticum aestivum
  unsure (1)..(543): unsure at all n locations
  Clone ID: PAT_TA_46350
cggcnaggggaagaggcgatgcggcggctccggcaggcggtggatgggctggaggtcggagtgctggtgaacaacgcaggcgtggcgacgccgcacgcgacgtacctccacgaggccgacgcggaggcatgggtgaggatgatacgggtgaacctgtgggccgtgacggaggtgacggcggccgtgctgccaggcatggtggagcgggggaaggggcgccgtagtcaacatcggctccggcgccgcagaggcgttgccctcctacccgctctactccgtctacgccgccaccaagcggtacgttgctcagttgtccaggagcctacacgttgagtatagagtcaagggaatcgatgtgcagtgtcaggcaccgctgtatgtggacacgaagatggtgacgaacatggtgacgcggggagggctcctgtcctggctgatctttccgacgtcggacgcgtacgccggcgctgcggcgcgctggatcgggcaccgccgcccggtctgcatgcccaanctcggccaccggctgcagtggtgcctctc

SEQ ID NO: 46351 - DNA, 577 bp, Triticum aestivum
  unsure (1)..(577): unsure at all n locations
  Clone ID: PAT_TA_46351
anacgtaaatgtctcgcaatatcaacgacgacgctacaagcgatgatcacgaacacgcgacccacaccaaatggctacgcgcngaaacctcaatggcgaccatgtcgatatcgaattgggcgccgaagcccgcaaaaggcatttccaggcgatcagcagcctccgctacgactcaaagatcgcgtcgtgcgagtaacctggcaatggttcccctgtacaatgtcaaccggtggtcttgccaatttgttaggcgagcagccctacacctttactgggttgcaaacaattggcaaggttgtctttattctgaaccttgtgctgttcgtaacgtttacctgcttgatgatcgcgcgcttttgcatcaaaccacgagcctttgcgacaagtctgcatcatccatccgagtcattctttttcggttcattctgggtttcgattgccctgatcctcaatggcgcgcaatcttatggagggcccgctacgggagaatggttcgtcacagccatgagagtggttttctggatatactatgcctgcgagatgattgtcgcagtcacgcagtatcacatcatctttg

SEQ ID NO: 46352 - DNA, 424 bp, Triticum aestivum
  unsure (1)..(424): unsure at all n locations
  Clone ID: PAT_TA_46352
ccaanaccgcggaggtgtggaactccagggcctgcatgatgggcctcatcgggaccttcatcgtggagctgatattgaacaaaggcgttcttgagataatcggttttgaagtgggaaaaggcctcgatattccattgtagtctgatctcccctccctgccctatgagatgctgatgctcgggacataagagccancatgaaaattaaggttgtagccaccaatagctatgctctgcatcatactaaatatataaacaagctctaagcattccgttgcacttgctatttttcattttacactcgtcttaccaaagtcatcgacagagtgatcttcaacactcgacaatattctgctgagctgggtgatagttcgtaccgatnaaaaaaaaaaaaaaaaaaaaaaaaaaaaaaaannaaggggcgg

SEQ ID NO: 46353 - DNA, 587 bp, Triticum aestivum
  unsure (1)..(587): unsure at all n locations
  Clone ID: PAT_TA_46353
gcgacatttctttccccctccgtccgtccgttcctctccggggtccgngagccccctggagccgggagaccccgaggagccacgcccccctcccggcctccccgctccgccttatgacggacagaggtgatggaccaattggtagtctccctgaacatctccttgtagaaatattggctcggttaccaacccacgagtgggttcaaatatcatgtgtcagcaagcattgggcaagcatgttccgaggagaatacttgtggcaaaccgctattgcaaggaaatggccatcagctggtttccggaaacgctggcctgggccaattcccagaggctctgctaggagatcagttcattgcttgtggtaggacaggagagaaggcccatgaacttgcttcgaatatatggattgcagtcattgacaatttggaagaaaaccagcagacgttcatgctgttaaaacacctagcgcaagaaggagattttttccttccatttccatattcgaggtcgtataaagtactgtggagggtgtttgacaagctgttcaccgacttccgtgactgtttcaacggggcagattaccatga

SEQ ID NO: 46354 - DNA, 566 bp, Triticum aestivum
  Clone ID: PAT_TA_46354
ccatcctcttcgacgtgcaatgaaatcggtgctagactggccgacgcggctggggatcatcaagggcgtggcgagggggctcctctacctacaccaggactctcggctgacggtgatacacagggacctcaaggccagcaacgtgctgctggacgcggagatgaggcccaagatagcggatttcggcatggccaagattttcggtgacaaccaggtgaaggccgacaccaagcgcgtcgtcggaacatatggctacattgctcccgagtacttgacggcgggcgtcttctccgtcaaatccgacgtgtacagcttcggcgtgctgctcctggagattgtgagtggtgtcaggatcagctcttccgatggcatcatggagttcccgagccttattgcctttgcatggagcttgtggagggaagggaaggcaagagacctggtggatccatccatggcagggagctgttcaactgatgaggcattgctctgcatccacgtcgggctgctctgcgtcgaggacgaaccaagcaggaggccgctcatgtcatccgtcgtgtccatatttg

SEQ ID NO: 46355 - DNA, 369 bp, Triticum aestivum
  Clone ID: PAT_TA_46355
gacgaacaaccccaacgggatggatccgttgacactttattaccacacaaacagacgcgcatgcaatacatgcatggaaacacacggcttacaatacagagtagaacgtatgagctagctgctggcttcagcgcttgcgctgccatgctgcctgacggacggtgctgtggcgtgcaggcggagtcgccagggtcgcagccggcctagcagcccgtgccggaataggtgcagcggcatctggcctcgcagggcggcgggggcgtgcacacagcgatgcagaccttccctttcgggcagggcacacacccgcagcgcccgatgcacgtctctagagcgttcgtcggctgccccgacgcagccggggccagc

SEQ ID NO: 46356 - DNA, 574 bp, Triticum aestivum
  unsure (1)..(574): unsure at all n locations
  Clone ID: PAT_TA_46356
ccccgcgtccgccacaaccagnacgggagaggagagcggcggcgaagaggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccagg

SEQ ID NO: 46357 - DNA, 183 bp, Triticum aestivum
  unsure (1)..(183): unsure at all n locations
  Clone ID: PAT_TA_46357
gntctccaagtataccggcccgactggctgcttattctaatggcaagttgagttctcctcttcatgagaaaatatttttattttttggagagcatgacatttaagagatgatttgatttttggtaaggggaaggaatccatgcttggctcagcttcttttgtgaaaaattatgactttcaccc

SEQ ID NO: 46358 - DNA, 559 bp, Triticum aestivum
  unsure (1)..(559): unsure at all n locations
  Clone ID: PAT_TA_46358
catccgnaacccgccgcgnaacgaacatcttgaggcgcgcacctgctgcctcctccctgaccttccctggcgccgccgttcgccgtcgccgtcgccgccgtttcctcctcatcccctctcttttcctcctcatcatcccgccccatcctccgccgccacccgctgctgcgttctatctccgtgcggccacggcaccgctcggctgtggcctccgccgcggcgaccgagtccgctgggaagctccttctcgaggtacacgggcttaccgcctccgtcaaggagaatgggcagcagatcctaaaaggcgtcgacctcaccatccgcgagggcgaggttcatgcgatcatggggaagaacggctccggcaagagcaccctcacaaaggttcttgttggccatccacactacgaggtaactggtggtaccattctcttcaagggtgagaacttaattgacatggagccagaggagagatctcttgcaggcctctttatgagcttccaagcgcctattgaaattcctggagtgagcaattatgattttctgctcatggcaataa

SEQ ID NO: 46359 - DNA, 457 bp, Triticum aestivum
  Clone ID: PAT_TA_46359
gcgtatcgccctgcagctgctgccagtgtcactcaccactcgccgccggccaccgtaggatcgagagagagcagcatgagcgagcagggggcagggcagggtaccaaggagcagtcaccggcagagctcgagctcgaactcgaaacggaccaccctgccctgcccccgccccttgctcgaggtggctctgccagtgaggtgctggccatcctgccgtcctacacgggcaaaacggtgctggagctcggcgccggcgtcggcctcttcaccggggagctggcaaaggaggccagccacgtcatcgctctggagttcatcgacaacatgatcaagaagaacgaggagatcaatgggcacatccacaagaacattaccttcatgtgcgccgacgtgacgtcgccggagctcaagatcgatgacaacttcatttacctcgtcttttccaaatggttgctta

SEQ ID NO: 46360 - DNA, 170 bp, Triticum aestivum
  unsure (1)..(170): unsure at all n locations
  Clone ID: PAT_TA_46360
ccgagnacgatattgatgctattggtagtgacgagtgatggagcttactgaacagtaatttattttctttgtatcaatagggttatcgttgggggagtgttgaaggaatggagatagagtcgttttactacttggtttatcatttatcttaagaaacatcattatacatc

SEQ ID NO: 46361 - DNA, 539 bp, Triticum aestivum
  Clone ID: PAT_TA_46361
cggccgcgtgggcggcttctctgcctccccaagctaaggccaccagaaaaactttggagagactgccttctctgccgccccaagcttcggcccagcaggaaaacttcggagagactgccttctctgccgccccaagctcgcgccactagcaaaacttcggagagaccgccttctccgccgccccaagctcgcgccaccaggaaaacttcggagagaccggcctctccgccgccccaagcttccggcaccatcaaaacttccgagggaccgccttctccgccgccccaagcgaggttaagtgaccttggctggtagcctctgctagacctcatgtgatgggggtgcatgagcatataccagaagtagaaaaaaatagcacccagatttgggcctatttattttagatttaagaagaaacagggccactaggtgcagctctttaggttgagatcatgtagcaaggtgaaaatgaaaatggaaattttggttgctgtaacaaggtgattggtgaatgtggatgggttttttttttaccctgt

SEQ ID NO: 46362 - DNA, 459 bp, Triticum aestivum
  unsure (1)..(459): unsure at all n locations
  Clone ID: PAT_TA_46362
tctgtgcgtatctaagtggttctagnatgtagttcttgctggacttgatttggtcttgtgtacatcatttatcagtcaatcaagtttgatgggactatggtttttcactgtcttagcacgccttctcttccccacgtttgatattttgcgtcatagctatgagtaatcagtggaaatacacggagacgagcctattgattcccaagtactgaacctaatctgatcgtaaatgggctctgtacaacggtcccctttgttgatgacaacgacacgtacgtttttttgacaaatgggtggctcaagagtcaacatcgaccttgcaaagaagatgccaagtaaggagaaaccaaagaagtagaaaaacaagtgtggcaccattcgaaagacgtctgtggtttcatgatggagggtggtcagttttcgttagtgtgcttgttaggagtttcattgtgttcttca

SEQ ID NO: 46363 - DNA, 608 bp, Triticum aestivum
  Clone ID: PAT_TA_46363
caaacactaagcactctgctaagcttcctaactcaaatgccatgtgtccgccttatagtggtagttggtggagacaatgcaaatacgccatctacaacagcagctgctggagtggaaatcataacttactccaggctacacagccagggaaagatgagttctcaaacttaccgtcctccaaaacctgaagatgttgccactatctgctacacgagtggcactactggcacaccaaagggagctgttctttctcatgagaacttaatcgcgaatgttgcaggatcaagcttgggcgttaagttttacccctccgacgtgtatatctcatacctacctttagctcacatctatgagagagctaaccaaattgcactgcttcactatggagttgccattggattttaccaaggggataatttgaagctgatggatgatttggctgctttgagaccaaccgtattcgcaagtgttccccggctatataacagaatttattctgcaatcacaaatgctgtgaaggattctggtgggctaaaagaaagactattccgtaccgcgtacaatgccaagaggcaagctcttatgaatggacgaaatccttccccaat

SEQ ID NO: 46364 - DNA, 440 bp, Triticum aestivum
  unsure (1)..(440): unsure at all n locations
  Clone ID: PAT_TA_46364
gcccggncggcggcttcgaggtctacttcccgcgggagtgcgagttcctgctggcgaagcagtggctggtcaggtacgacgcccgcatcgccggcgccgtcaccgcgggcaggctggcggcgctggagggcgtccacgtcaaggtgctcttcctgtggctccccgtcgccgaggtcgaccgcgccggcgaccgcctcagcttctacgtcggccccgtctccacgtccttcccgctgagctccttcgccagcagcccgcactgtcgcggctacgacgccgtcgccgcggccgtctcgtgaatcataagccgttgtttattatgatttgaacaagactcacatgggccattgtttcagttaaccttctgtaccgtcgtggatatcacaatgagctctatacgattccagtttagcatgagagccaatgctgaattttttctc

SEQ ID NO: 46365 - DNA, 579 bp, Triticum aestivum
  Clone ID: PAT_TA_46365
gcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggccccctcaactttgaatg

SEQ ID NO: 46366 - DNA, 230 bp, Triticum aestivum
  unsure (1)..(230): unsure at all n locations
  Clone ID: PAT_TA_46366
cgtcgggacgagacagcttagaagtacactatggaaaaaatnaacgaaggtggcgtctaagcgaccagtcagtcggcgaagtttcaaggaagccaagccgggctgggataccaaggggaaggggaaggaagtggcatacgagtctgacgacgaggctgaaacggacgacagtctgtttcaaaaaggaggctcattgtaaaaaaagagggggaacatggcatgtgtaggcg

SEQ ID NO: 46367 - DNA, 232 bp, Triticum aestivum
  unsure (1)..(232): unsure at all n locations
  Clone ID: PAT_TA_46367
ggggttatggttatggtgggactgacgacaatgnaattggnacnngccagggccatgnaaataagagtactttgattttgtttctgttttcgagtttgtaccgaaacaggtgtatggtatggggccttcggcaggacggataggaaagcctcgagcctagcagagctggtgatgaatatgtacagtcagccactcaacaagtagttggtaaatcaaggctctctatgcacac

SEQ ID NO: 46368 - DNA, 243 bp, Triticum aestivum
  Clone ID: PAT_TA_46368
gaagtcaaatttggggtaccaataatactaatagcaaccgccaagcccaccaggaaaagaaatgcgctggcgccctcggtatggctggcggcgtaacatgagcacggcaaggggcctccacacacgaccgatgggagagctgggtacataacatactgagggatgaatatgacgggggggggactcgaaaggacttaggaaatcaatgatgtttatgcgcacaaaataaataaaaagaggttg

SEQ ID NO: 46369 - DNA, 604 bp, Triticum aestivum
  unsure (1)..(604): unsure at all n locations
  Clone ID: PAT_TA_46369
cggccgcgtgggttttgcaataagcttgcaatttatcatcaaccaaaccagcctggtgaaagacttgcggtccgcagggctaacggtatatgcgcaggtgttccgcaatgagttcctatcacaaccttgggacttcttcntcggatgaaacagtnggaaatcaatagctatgcccagtcgcttaaagtcgatggcttaattaccgacttccccaagacagtgaggagatacaagaggaattcttgtacaggaaaggacaagcccgcctacatggagaccgttgatgtcggcggcctcgtgcagctactccagagaaatgccgctcctgaggcccagccgccagcggtggcaccgatgccagaattgaacgaaacagaggtgcagcagccgccattcccccctgtcgcgcctaagaatgcacctcctggtgccgccgcacctcccggttcatcgccatctgatgctcacacgacggctgtaagcacctgcattctgctggtagcggcctgtgcagctctgctgctttgagcagcagaccatgaggctgtgtgccagtaggttaagttaccggaggagccgttagacttgcgcaagcaagctatta

SEQ ID NO: 46370 - DNA, 593 bp, Triticum aestivum
  Clone ID: PAT_TA_46370
gtctctacaaggcgtagtcacctacgctgccattcaacgatcggtactgttccgtcttctcgtgtacggttccgctggccagcttaaggctatgaaccaggtgctggttccctgaatcttttcttggcccagtaccgtgaggttgctgctttcacccaattcggatccgatttggatgcttctaccaatcaaaccctcaaccgcggtgagcgtgcaagttgaaacaagctagaaaaaaatttgaaattcaacatactgactattttacaacttacctgagctcctgaagccaaagcagcacatgcccatgggtgccaccgagatggttcctctcatcttcgctggggctaacggcttcctcaacaccattcctcgttaacaagattctttagtgggagtgtgacttgcttgcccacctgaagaccaaccataccgaactccttgccactattgacaaggatggcgccctctccaaagacactgatgccaagctcaatgacgtagtccactcctttgtcaagagcttcctgtgctgaaatgtactcaaaatccacttgtgcagagaatagagcaggcctctggggatgtctctg

SEQ ID NO: 46371 - DNA, 600 bp, Triticum aestivum
  unsure (1)..(600): unsure at all n locations
  Clone ID: PAT_TA_46371
gtcgcctttagnagagcccaccgttccagtaatcccaaactgtgcaccaacactatcagttgtggaatcggccaatagtgtccaaaatcaagatttgagtgatgctacctcatttgcagaaataaattccccaatgcttctcattgatgatgcgagtacaccaaaaaaaaacaggccttctctcaagagggttctttgtataaaccccaatgtgatgaggaattgaagccaaaagtggggatgctatttgatgacattggctcagtaatggaattttacaagacatatgcacaccatgtcggatttggtgtacgtcttgggcagcaaaagatcgtagataatgtgcttctgtggaagcgcttcttgtgtgcaaaagaaggctttcggcccgagaaaggtctgacttctcccagcacaagattgataagcaagaggcactagtactggaggcaaaaggcagtagcttttctgttgtgtaccaaacagagcaaacttgatgcaaattctgacggcaagcttgttcagcagacagcggtgcttactttagtcctgcatactttgtngtgtctgggatgtaccaaaaatgatcctctcatgtta

SEQ ID NO: 46372 - DNA, 591 bp, Triticum aestivum
  unsure (1)..(591): unsure at all n locations
  Clone ID: PAT_TA_46372
ggcaaagctcagtcttgacttcatgtgngagattatgtggttctttcaaattagtctcaagagggaaagcagggcgagcacgacaacagctgcatttcacatcacactagcatgaggaaccccaactccttgtccgcttccatggatgatatattgtcaagaatggcactaaatttgacaaaagcatcttagatccaggttgtggattttaaggggtgatgcagtgcagattatctgagcaaattgaccagccctgttgaattctctaactagtttggtagtcagtcctatctgtacatgatgtgaggtcgatcgtgagttccagctaggctgtctgaaaccttggcgtcgtctatgtggaacctggtgttgagtcgtactagcatcgatggtggatgtgtacacgtgtgcgcaccgtgacacgtgcctncgcccgggacaaaaacctgccaccgtggcttggcttctctccttcggtgattccaccgctcagcgccagtacaaagcaaccagcacgcaccgggtcaccgttccagagcaccgatcgccgttcagatctacagatctctctgccccacggactgggttgtg

SEQ ID NO: 46373 - DNA, 537 bp, Triticum aestivum
  Clone ID: PAT_TA_46373
cccgcaagacccgtctcctggctgtggtttacaattcgtcaaacaatgagcttgtgaggactcagacccttgtcaagaatgccattgtgcaagttgatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttacttgttggattttcttagatgttgcgtccatgtcatgtttgcagacatactgaacaccattttctgtaaactgttcgagtcctaggttgaactgagaatgttttgcctgttttggttgtgatctaaagctatccagattctatt

SEQ ID NO: 46374 - DNA, 386 bp, Triticum aestivum
  Clone ID: PAT_TA_46374
gaatgttgttgtgatgctttgtgttggtgagcatttgatagtggtcgatccaacaccgccttgtacctgaccatctgattgtcataatcccatccaccataatattcattgtgtgccacatcagccgctcaagtgcggggttcgccgcctcaagcgcaagagaagaaagatgagggccagatccaaataaacgcatcgcatctcaacctgacttgactcatctatcatgatgttacgacctcgcacgcctcaacgataccttggccgaagcagggcacttgccgttctggcgcctctgggatctcccgcaacgcattgagctgggatttgactttgggaattacgtcaggggggttgaaccccgcacttgagcgggtgatgtggca

SEQ ID NO: 46375 - DNA, 592 bp, Triticum aestivum
  Clone ID: PAT_TA_46375
cggccgcgtgggcggacgcgtggggcacggcgtgttcaatgagtgtaattggaggaacaaaagaaaatacttggtgtcatgatgaactggctcgagtgggtcctatcacagtcgcttcttcggattgcggagtgcaatccatatggcatggatgacttctggttgcagcagggcacatcaatgctgctgagcctggtgaagagctcacaggaggatgtgcaggagcgtgcagctacaacaattgctacatttgtggttattgacgatgaaactgcgaatgtggatgctgcaaggtcggaggcggtaatgcgggatggaggcattccacttctgctggaccttgcaaggtgctcaagggtgagtgcacagtctgaagcagcaaaggctattgccaacctatcggtgaatgcaaaggttgcaaaggtggttgcagatgaaggaggtatcgccattttcactaatttggctaagtcgacgaatcgacttgttgctgaagaagctgctggtggcctttggaatctctccgtgggtgaggagcacaaggcggctattgcggcagctggtggtataaaagctttggttgatcttatat

SEQ ID NO: 46376 - DNA, 603 bp, Triticum aestivum
  unsure (1)..(603): unsure at all n locations
  Clone ID: PAT_TA_46376
ggctgtgcggcggtcgtcgcggggatcatgccaacggctncggacactctgggccgacgccggagaattcatccgtcactttcggagacgatgaggccgacaacgggttgcagctcagtgatggcgctgagcccgtgaccaagcgccggaaggagcatgccgacaacgagggcagttcaggtggcaccggcggctgcgggaagcccgtgcgcgagccgaggcttgtggtgcagacgctgagcgatatagacatactcgacgacggcttccggtggaggaagtacgggcagaaggttgtcaagggcaatcccaaccccaggagctactacaagtgcacaacggtgggttgcccagtgcgcaagcatgtggagcgggcctcgcacgacaaccgcgcggtgatcaccacctacgagggtaagcacagccacgacgtgccggtcggccggggccgcgcgctgccggcgacatcttcctccgacagctcgggcgtcatctggcctgccgccgtgccggccccgtacaccctcgagatgctcaccaaccctgccgccggacaccgaggctacgcggccggcggcgccttccagcgcaccaaggacgagc

SEQ ID NO: 46377 - DNA, 466 bp, Triticum aestivum
  Clone ID: PAT_TA_46377
ggataaaccctttttctttggttaccccccaaaatttaagggcggccgggggggggttttccttggtttggctttgaaaaaatggggtcccaaatttttttccgggggccttattaggaacaattagggggcgggcccttttcttttttttaaaatttggcatcccaaaaaggttcaattatttttttcccccccccggggggggggcactacacttattactttcccatggttgggaagccccaccctcaagcaaaaagattgggtttgagggggaaaaacggccccccctggggggaggtccctaccttttatgaaaaggaaccctttggttattggccccgggcaaattttttgggggccctttatttcttttctttttttggaacttcaaaggtttggaaaaaataaaaaggggtggcaaatttacccctatgggagcataaaagttggacctggcaagggt

SEQ ID NO: 46378 - DNA, 135 bp, Triticum aestivum
  Clone ID: PAT_TA_46378
aaacgatcaaccagatggatatgcattcaatatcattctacagaatatagcaaacaggacacagatactggcgattcacattaacagacgacgtaaccctagaacgagctttaatacaggcggatgactgtgtgg

SEQ ID NO: 46379 - DNA, 345 bp, Triticum aestivum
  Clone ID: PAT_TA_46379
gggtggggggtttgtttttttttttatttttttttttttttttttttttttttttttttttgggggggtataactgggatttttttcatccatttaaacggggttcaaacatggggttccaacttcacatcccaatccatgacagaagggattgggggggggggggggaacacgaccgaccgaccgcctgaaagataacaaaggggggtttttcctggggggaccgggtttaattaacccggggcggggggaccctggggctgggggtcaaaaacaccacggggcgggggggcacacacgactcaggactggctggcccggggacggggggggggcgaccctgaa

SEQ ID NO: 46380 - DNA, 536 bp, Triticum aestivum
  Clone ID: PAT_TA_46380
gacgactttaaaggccttgtttatgccgggagctgtgacaccgaatcatcactgacattgagcaacgtcactggtaaaatcgtcctgtgctatcaaccggcagcagcgaatagcatgccgcctccacaagcacttcccatagccatcaatctcaccatcatggctggcgccaagggtctcatatttgcacagtacactactaacctcctcgacttcctgcctttgtgtaagggcgttatgccctgtgtagtggtggattttgagatcgcacaccgaattgtctcctattggaggtcagacaaagggaatgcggtggtgaaagtgtcacccgcaatgaccgttgtcgggaaaggggtgttgtcaccgagggtcgcctcattctcgtcaagaggtccaagcatgttgttccctagcatactcaagcccgacattgctgcacctggcgttagcatcttggcagcggagcgcaactcctacgtgttcaaatccgggacatccatggcgtgcccgcatgtctccgctgtgaccgcactgct

SEQ ID NO: 46381 - DNA, 417 bp, Triticum aestivum
  Clone ID: PAT_TA_46381
aaaagcaaatttttttttgggaccctttttaagacccataaaaggcccctaaaacactggcggggcataaaaggctcgaacggggacggggttttttaaaccctggtaggggccaacacaggtttggttttatacaggttctgttttaagtttatccaattaactgccttaaacagccttaaggggtttgggaaagggggccttgcggagcttacaaggagcaaaagctgctgctttggtgctgaaggggctgccctttaatggaaacatggaccgtcaatttcctttccgccgaaggggggctccccatcttgttcttgatttctgagaacagggtaaaaaaagctgtctccacattgagggattccttggcccttgcctaaaaaaaattcattcccaacaattttgaaaaagcct

SEQ ID NO: 46382 - DNA, 452 bp, Triticum aestivum
  Clone ID: PAT_TA_46382
ggaaagggctaaagcccaggggaaaaaaaactctaaaagggttcaagaggggattcaagatccaattttttaaaggggccaaaaaaaaaactttttttgggggaaaacattttccaagggaattgtttaaaaaaaaaccccccttaaaatttggggaagggcccaacccaattttaaaaaaactttgggggaacgttggaaaaaaatttatttttttttggaaaaaccaaaaggtttttctttcctgccgggggttttgggggggtaaccacggaccccccccccccagtggggacccaaaccacgaggggtccgggtttttttgagcccttaaagggaatccctgggcttaatgtccacggggttggacacaacctgggaaaacccgccccccttggggccctttttccggggggggaaccaggccggccccttaaaacaggggggggttg

SEQ ID NO: 46383 - DNA, 486 bp, Triticum aestivum
  unsure (1)..(486): unsure at all n locations
  Clone ID: PAT_TA_46383
ngagtgccaatcgaggnaacctggcaagtacaagctttatgctaccatgagggtaaattctgcatcacttattaatctttgctatacattgaagatgcaaaaaaagaaaagaaatagatggtccccaatatagttgtccggggacaatgaacaaagggtatctcttcatgaaatgtatggtacttccatcatggaggtgccgtcttgcccctgcagacctatcatcttgcctggaggtgcgggctgacaatcatggggaagtaataagtgtagtggccatcgaccgggggcggggagaagatgattggaactttttgggatgacaaaatttgagagagaggagatggtactgctcctgattgttgctgatgatgtctacgggagagagattgggaacgcgatttgtcatatgcatatcaatgtatagctaccaacggactgctctgaatttctggtagttatcgaaggatagaggattattcaana

SEQ ID NO: 46384 - DNA, 449 bp, Triticum aestivum
  Clone ID: PAT_TA_46384
cacatctaccacaaactacaggtcatccttaccgatgataataaagataagcgacaatgattacccgctcggagggtatgaaggagctctgaagggcggttccaacgccaccgaggtctcgcaaaacatacatgcatatcaccgtattcgagttgcctctgcacataacgcatttggctatttactagagacccggagacttatatttgctacaaacgaattcctacccgcaactacacctactaccactcgaagaccgcaccacctggacgtactatacgaactcaagcgccaacaacgcacacttatacctatttgtaggctaggccaccatcaccactcagattagaatgtctaggatcgcactcgttcaactaatctgaggatctcgctgattcttgctatactgtgtacaatgacatcgtatgagaatcgcactactttatcgt

SEQ ID NO: 46385 - DNA, 618 bp, Triticum aestivum
  unsure (1)..(618): unsure at all n locations
  Clone ID: PAT_TA_46385
ngacggtggttgctctaatcttggttttcttaatctaagctcttcaagccttaatgtcctttggctatcagatctttgctccctttcggaatcggtcataagctgccctaatatgagcgagctctccctgtgtttcacacaacaaagtactgaatgtactgacctgagggtgccaacctcaggggcttgtgcatgctatccttgattctcggttcaaaaatgacagatgcagctgttgcatctatcgtcagatcttgtgcaagcttggcattgcttgatttaagtggatctagcatcagtgatagtggtgttggtatgatctgcaaggcgttccctcatactttatcgaggctgctccttgctctctgcccaaatattactacatgtgggatccaggccgcaacagcacaattgccacttcttcagctcatggactgtggaatgagcttacgttctaacttgcagaatgaaaaacagggggcttattttggtgagatcaatggaaggattagattgtgcccaaaattacccaccttaaaaaagcaacctatgcgccaaaagctaatcataaagcatgataatttgaagaagctcagtctattggggctgttcagcaat

SEQ ID NO: 46386 - DNA, 618 bp, Triticum aestivum
  Clone ID: PAT_TA_46386
cccgggtcgcccagcgtccgcattttgtcttctgcaagtactgagatggggctgcagtaattaaatatcagctttattttgtggagttttgtttgtttgggacaaagtattctagaagcctagaatacatgatcatctgattcaggaatgtctactttctacccaagtccagttgcctgcaagacttaaaaacaccctgaaattgtgataactgataatatattttttggatccagtttgatgttcattggatcctatccctttggtttggtttgttaagatcacaaactgcttagtttagtttgacaagcttatgctcatgatccaaggaaactacatacatggtaccagggaaatatggtccgcactgtgtctttccattgctgtagtctggagaacaaactagtggttttattaagtagtcataagtttaataacatttattatgttacacattataggtacgttcaagctgaccctgcaattcacagaagattaccccaacaagccaccaactgttcgttttgtctcaaggatgttccacccaaacatttatgcagatggaagcatctgcttggatatcctacagaaccagtggagccctatatatgatgttgc

SEQ ID NO: 46387 - DNA, 573 bp, Triticum aestivum
  unsure (1)..(573): unsure at all n locations
  Clone ID: PAT_TA_46387
gctcgttagtgccatcacacttgctagcaaaggagcgtaacacgttgcgagctattttttttttttgagggaaacgcgttgcgagatggttgcgtcgttatggttcttcttctggctggcctccctcggtgccctccaagttttcgctctcagcatacgcctcctcgccaatctcgtgctcttcctgcgccggcccaaggatctccgttgcacatacggagcctgggctgtcgtcaccgggccgacatcaggcatcggacatgccatgtccctggagctcgcacggtctggcctcaatcttgtcctcgtcggtcgtgaccccaccagactccgcgagatctccgaaacgatctctaggacatatgccatgcagaccaagaccgtgttgttcgatttctccctcgtatccactgcgcaaggcgacgaggcgatgagtcgcctccgggaggccgtggcgggactgaatgtaggggtgctggtgaacaacgctggggtggcgaagccgggcgcggtgtacctccacgaggtggacgtgnaagcgtgggtgaggatgatacgcgtgaacgtactggc

SEQ ID NO: 46388 - DNA, 646 bp, Triticum aestivum
  Clone ID: PAT_TA_46388
ggcctcccctatccccccaccgcggcagctagtcccattcccacacccgcgccaccgtcctctccgcggcgccgcgccaatgcgccacccctcgccgccgccggagctccccgcggccgggggtgagatccaggccatggcgcccgcctcggccgcgggctcatccagcaccggaggctcgttcacggcgctcctggggctcccgacctcacaggccatagagctcctgctccccggcgcggcgccggcgcccgcgcccgcgcccgccttcccctccgacccgcacctcgtcgaccgcgccgcccgcttctccgccttcgcgtcgccgtcgccgtccccgacccctcctcccgccgcctcctccgccaagcgcaaggctgaccccgcctccaaggggaaggtggcgaagaaggggaagacgacggcgggcggcggcgaggagaaggactcgggcgaggacgagaagccggcgtacgtgcacgtgagggccaggaggggccaggccacggacagccacagcctcgccgagcgggcgagacgggagaagataaatgcgaggatggagctgctcaaggagctggtccccggatgcagcaaggtatcaggaacagcgctggtactggaaggagatcatcaatcatgttca

SEQ ID NO: 46389 - DNA, 621 bp, Triticum aestivum
  unsure (1)..(621): unsure at all n locations
  Clone ID: PAT_TA_46389
cttccctttcccacacggccaaggaaaaagaaagacagggctcaaaaccgcaaaccctcgctttctccgatcgaattgctcgcccgaccaccaccagttcgccggcctccccaccaccagtcctcgccgccccatccaggcctcccgccccccgcgcccgcgccgattcccccaacacgcgacctccgagctcggccatgtcgctcacctgaggatacggttggtgggctgtttcttgcaagagcctcctccgagccccaagagaaacagcccggggggacctcagtcgccgattcgatcgtcgcagcgccgccgccgcccaggccaggccaagcgagcgttccgtctaggtttggtttagcttgcaggccaaggctccgtttcgcatctgagggagaggaggagcggtggtggtgcctggtggcggtagcgtgcacgggtccctggttgggcttggcttgggcttgatgcggaacggcgcgcaggctcctcgcggcaccggcggcgggggcggcggcgggctcttctccgcgcgctcgctctccagctacatgcgcatcgtctcctcgggggcgtccacggccgcctncacgctgcgctccgncggcgcctcgctggtca

SEQ ID NO: 46390 - DNA, 564 bp, Triticum aestivum
  unsure (1)..(564): unsure at all n locations
  Clone ID: PAT_TA_46390
cggacgcgtgggttattcttcccgcacctcccaattccgccgcaccgccgacgcgacgaagcgcgtgcaaggctgggagaaatactccacgagatagtcagatcacgtagaagaattagcccagcccgagtcatggacagcaatgatgatgacgaaggcgatgtgttgcagagcttcatagactcaaaatacagtgatggccgatccatgacagagagcgagattgttgggctactcattgccatcttgttcgccgggcagcacacgagctcaagtaccagcacctggacaggagcttgcctgctaagcaatcaaaagtacatgacagctgccatgaaagagcagaagaaaatcattgagcaaaatggagaacccatagactacaccatcttgtcaaagatggatgccttgcgttgctgtatcaaagaggcactgaggctttattctccgacaccattactactccgtcatgcacacaagagcttcaccgtgcaaaccagngatggcatggaatatgagatcccagaagggcatgctttagcatgctccatagtggtcagcaac

SEQ ID NO: 46391 - DNA, 619 bp, Triticum aestivum
  unsure (1)..(619): unsure at all n locations
  Clone ID: PAT_TA_46391
cgttatgaggaaatctcaagnaatctcttcgtacctgaagaagtcggctacaaccctgagaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctggtgacaatgtcggcttcaacgtgaagaacgttgctgtcaaggatctgaagcgtgggtttgttgcatccaactctaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggta

SEQ ID NO: 46392 - DNA, 564 bp, Triticum aestivum
  Clone ID: PAT_TA_46392
cccgggtcgcccacctttcgtgctcgccaggcaggcggcatccatcaccgggaggctgcagacagcggccggcatccgcctccaagcaacgtagctccggtcgcctcctccttcccgcaggcagtcgcgttgcgtctctccggccgctgctcctggatctggactctccacgccagtaccgtgaaccggcccatcaagcccatacaaacaagaacgctctcgtccccctgtcagccggcggtggtggtgcgcggccggatcttcttccctcccggcgcgctaatttggggtcgaagcaaagcaagcacccacgagccgcgccgtctccatgcctccctctgaaaataagcggagggactgggctggtctcggcgacgggctggcggggacgatcgccgaccgcgtcctcgcccacgacgtcgccgactacctccgcttccgcgccgtgtgcggcccgtggcgccggtgctgcgcggacccgcgcgcgcacggtggcctcgaccgccggttccacccccgacggtggctcatgctccgggaaccccgggagcggatcgacgctcc

SEQ ID NO: 46393 - DNA, 572 bp, Triticum aestivum
  Clone ID: PAT_TA_46393
gcacgccggccggggacctcctcctccacgccgccgccgccctaattcctccctccctcactccaagcctctactccatcaccaatctcccgccgtcgccacgccgcggtcgagggtctagtccgcctttcctggcgccgccggagggtgacgaccgccggcgaccggagcggacttcgctcgagccgtacgcctacgccgactccggtggccactccagtgccgacagcgctcgtgcagcagccctgctgaacctaaaatggcggccctgccactggccaccgcggaggcctgcgacgcgaactcgcacatgatcaccagcggcgagctccgcgcgctgcagccagtcttccggatctacggcgggcggcggctcttcgcgggccctgtggtgacggtcaaggtgttcgaggacaacgtcctggtccgtggcatccttgaggagaaagatgagggcagggtcctgggtggtcgaccgcggcgggagcctccgccgcgccctcctggggggcaacatcgccatgctggcgcagaacaacgggtgggccggcatcatgatcaacggctgcgtc

SEQ ID NO: 46394 - DNA, 449 bp, Triticum aestivum
  Clone ID: PAT_TA_46394
ccaaaaaaaagcggggggaacacaaaaaaaaaacggggggcaaccgcaaaaaaaaaacgggggcggggaaaaaaaaaggggcccccggggggggaccggcaaaaaccccaccccttccgaaaaaccggccccctggggccacccggaaaaaaaggaccaggccccgcagggggaccaatgttccccaacgggaggggcataaaaacccggggccagaaggaaaaaaggggagcccggggggaaaaagggagccccccaccattcccaaaaagagagcagcccaaagccaaaagcgcaaagcggggggggcccaaggcagggggaaaaccaaattaagcggctggcgcaaaaagcccgcctaccaaaagggaaaccgggggggcccgctgggcaacagaggggccccacccccccggaggggcggtacccccatagccccccaggggggc

SEQ ID NO: 46395 - DNA, 519 bp, Triticum aestivum
  Clone ID: PAT_TA_46395
aaattccgaaccaaatttaatttcaccttcacataaattaatcacgcattcacatcaatttccagacatgcaacagtccagttttattcgagtgcaagtagctagtatatacacgagatggggtcactgtataagggcgtgcatgggggtagagtaacttgtgatgatacgttacatacattacataggaggcatgcattgatgccgcatatagtatatgcgtctaggccgccgttccgttacataaaccgatcgatccttgcattgttttggaagatgaggcctgcgcacgggtgtaattagggctggccacctgccggtggtacattacagccgtaaattttgctgcacggacgaccggtgtagggtttaccaggcggcgacggaaaacagggtggttagggtcgttgctaccagtgcctactacagtggcgtcgtggccagcggcttcaaggcagacggagctgttcatgatcaccgcggcgacgaccagggaagagagcgatctgctggagcacc

SEQ ID NO: 46396 - DNA, 565 bp, Triticum aestivum
  Clone ID: PAT_TA_46396
caatgcaacggtccagattgattcgactgaaccagtttctttttccaggcgactaggtaattgtcagccccgttttagaacgaaaaacaagattcagacatgtaagggcaccatgatgctttatttcacactggctgacatatggaccacagaggaggagttcaatatacagggcaggcaggaggtaattcaaattgctaaacaccacaaggccaacacaaaagtattccccattgccacacaaggtgggattaaaacttgacaggactttgatgtcagaccaacactagcagggacgccgaagatttatttcttgtagaagagggctcctatgaatggagggattcggcttcggagaacagcttcgcgcgcttgaggagacgagtcccgagcgtcactcgaccaccatgctctcggcctccttcttgatggagtggaagagcaccgacgaaaggtagcgctctccgaagctcgggaacacaacaacaaagagtttccctgcattttcaggcctctgagcaaccttgattggagcagctgcagcagcaccaggaggaatcccaac

SEQ ID NO: 46397 - DNA, 590 bp, Triticum aestivum
  Clone ID: PAT_TA_46397
attatcgggtcaggctgctacatttgtgattaatatcaagtgttaaagaatggattatatagcccacggccaaccaaagaacactactactttacaaacgagagggaaggggaagaaaaaaattgtagcagggttaacaccacatcaaaccaagaaaaacttaatggctggcctatttcgaacacaggaatttcacaggcaatcgtcgaaatcccgtaggaacatataggggccacgtatagagctataatcaggaagtaacgcctagattcgtgagggggtgggaataggctgtaaagcctatggcaacttcacgttggccaggtcccccatggacgatttcacagtctcttccgctgcaaagtcctgcaggcgctgcatcaagtacatcaagaacaaatgcacaaacaccagatagaatagaaggctgactcgggcaacaggatgccgccacaaaaatcttgtcgccctcacagcccctgaatctaaaaacttcgcagctttttgtaactgatgatttgccgttgccatgtgtcgatgatgcagtggaagaggctctagcgcattgatatcagtatcttcttcccatg

SEQ ID NO: 46398 - DNA, 470 bp, Triticum aestivum
  Clone ID: PAT_TA_46398
ccaaaaaaaggggaattggtttttttctggggggggcaaatcccacaaaaaaatgggccaggggtccaccaaaaccctggtggccctggtcttggggggggggggggacctgccgggaagggaatgggcttccccctcccccccaaaaataaaaaaaaaaaatccccaaatgttttgccgggattaaaacttgggccctcaaaaaataaaccttgggacaaaagggggggccaaatccctttaaaatgggcaaccccccgggcattcccttggggggggccccccaaaggtttgaacctatttttgggggcccccacccggacgggaaactgggcgtggggtttcccggggggaacaaaactttgggaggttttttgtgggggggccacccctctggggccgggcccggggggggaaacggggcaacccttttttggcccctgggcttgggggggggggggggctcgggg

SEQ ID NO: 46399 - DNA, 232 bp, Triticum aestivum
  unsure (1)..(232): unsure at all n locations
  Clone ID: PAT_TA_46399
gtcttcggccaccgttccaccaccgtctgggtccccgccctagctcaaaaaaggttatacatattccataacccccgacaccttctgcatgggcaagnagtgccgcaagcacacccagcacaaggtcacccagtacaagggctggaaagcctccctgttcgcccagggtaagcgtcgatgtgaccgcaagcagtccggttacggtggtcagaccaagcccgtcttccacaag

SEQ ID NO: 46400 - DNA, 582 bp, Triticum aestivum
  Clone ID: PAT_TA_46400
atcagcgaattaactacttataaaatagataaatgcagggacacgttaaagacaagatatagatgcctggagctgaaggtaattaaccacaacaatcgaagcaagagctacactgttgaaagcgccacgagttgagctgctcttctttttttccatctatatcagacgattcttcttttccttgtgcagaagaccatcagacaatccagtgtggctcgcacagaacttgacagcaagcagggtaggtatgtcaggatggaaatctttggaaggctcgactctccacggcggtggcgctggtaagccatctttgatcggacgatggctgcaggacaggagagactttgtgcgcatgttgatgctgatcacacactcaatctccctgcatagccgagcccctccctcccaatcgatgtagtaatctcccagcaagaggtagaggacaccatcctcgtcggccttgaggactgggcactgcggcatggcctgcggcagcctctcacgcttgtaggcctccgactgccagagcagcggcaagggcagctccatgtcttcatctctcgtccatgattgaaggtctgg

SEQ ID NO: 46401 - DNA, 525 bp, Triticum aestivum
  Clone ID: PAT_TA_46401
gtcatcaataacttacggtatgagcagaacatatacatattcataaggaagcacaagacataatattcataagggagcacaacatataaattgtgagaaaccacattattagtgccagagcatgagcgcatacttctgtagtgaagttctatgtatctagccaagtgaacatgcatatatatcaggggaaaccaaaccagttgctcaatcggacttgtgctgctcgtgcgccgcaagggcatgcttaaccgggcgcgcctttacccctccaccctcgcggctctggagcgtgaagggcatgtacgtgccgaggatcttgtcccacacgacgaaaaagggctgtgagaagttgtgtttctggccgtagagctggtggtggatgttgtggaaggcgctgttgttggcgaagacggcgtggatgacgttgccgggcagccagaggccgcagtggtcgtcgacggtcttgatggcgccgagggagatgaagaagaggcggtccggggggtcatcccggaagcgaggaac

SEQ ID NO: 46402 - DNA, 285 bp, Triticum aestivum
  Clone ID: PAT_TA_46402
gcgcaaaaggcgacaaatttttgggccagcaacgatacaaagttcccagttatcaatgtttatgggccctggattattttctgaacaagggcggggaaccgaaaacaaagcaaagattgcgctttcaacgctttacaaaatttattcttccatttttggacatttataaacacaaatggcccccaaatgcgtccaagatgggggcaccttcaggcgggcgaagatcgctccttaatagtaccctaggcctttttgccttgggtgccggacttagccttgtaggac

SEQ ID NO: 46403 - DNA, 294 bp, Triticum aestivum
  Clone ID: PAT_TA_46403
aaaaggggaatttttttattgccctggcctggggacacaaatttcaatgaaacgcccattgttgggggctaaaatgtaatacggggggtgtaaaaaaaaaaagggatgttttaagcagtccaccttttatttatttgggcggatttttacgaaccccttttattgatttggggggcaacctataaaggttttatggacaaaaggggatctggtaattattattgccaattaaagcgtgtgtgggaaccatattggggggttaatagggttgcgggggggggaaaatggggtccc

SEQ ID NO: 46404 - DNA, 509 bp, Triticum aestivum
  Clone ID: PAT_TA_46404
aaccccccattaaagtaattaatttcaacttttacatgtttgggttttttttttgggccacttttcatgggaatttggggggggggggggggatttttttgtgggccaagatcgcccccccgtttaaaccactaatagaatggtagatttttaaacattggttggggtaaacaggtggtgttttttaattgggcacccttttttttttaaaataaaaatgggcatttttcatgctcttaatcgcctgtggaaatcagggggcatttttactccctccttgagggacacttttggtttggaaccaagttgttgagcaacattgttgcagttgaacgttttttttaaggttggatacttaatgcttgcggaagttaggatgccaggttggcccatttcttatggaggagaatttttatgggggcttcaatttaccaaaattttttttgggttggaaaaatcaaagggttttttaaattaaataggttttttggtttcaaaatttttccaaa

SEQ ID NO: 46405 - DNA, 597 bp, Triticum aestivum
  Clone ID: PAT_TA_46405
acagaaggtattttactttattggtctaagcaacgctatgtacagtactaaagataatcaatcacagctacaagtcttcatatctcaaacttccccatcccttggccctttgtctaacgattcccaaatcatccatattcaaaagtccaatctcattatcaatcagaacacgccatgcaatatctctcagatttggtggctcagccggtgtatcccagtaccgagccaacaatcctcgtgattcagcctgctcaatctgtgtcgatgtcatgtctctctctcttcctggcaaaacatcaagggcgttgtcatactcagtcctaaacagcttggcgttttggaaccttgtggatgcaaagtatgagttggaccggttgaaacggaatgttggaggcttggtgtcgaagttatcttccatggataccagacgttcaagcttggcatcccagaagatatctctgtgcgtcgagttcatagctgtaacggattcgaacggtgcgtttccgcttaccacgatagtaagcggacgcatgattcttgctgtgccgttccaataggtgagatagtccaggtctcgtagaggttgtaaatgtcgat

SEQ ID NO: 46406 - DNA, 230 bp, Triticum aestivum
  Clone ID: PAT_TA_46406
gggtctcactattgaaaaagatcctccctttgtaaagaaaatttaagaattggttagatcaggaatttcggggtctaaataatctttattttttatagaagggggggttcgggtaaacccggccaagccaattacgactaaaaaaattaacgaatttggggaggggggccccccacccccaatcaaaagttgggggccgccctgcaccttttcctgcaccgttccccaaa

SEQ ID NO: 46407 - DNA, 540 bp, Triticum aestivum
  Clone ID: PAT_TA_46407
ggcaaaacatattatgttctatttccatggcaaatggcgacatactttgtgtttccatggcaagatattagatattttgccatggtaagaaataatttaaactgggacggcagcaaaagttgaggcaacatggcaacatattttgtgtttgcatggcaaaaacatattttgcctttccatcaactataatttctaaaaaaatgcaatgcaaaattggtcaattaacaccacatgaaagtaaaaagagtttctgcaatccatgaatgactgagaaaatgaatcatacaataattgcatcatatggattgagctaaaaaagtgaatcaccgtcgagaggtcatgtgttgagccagtaacataaaactgaacctgtccttcgagagttcatgtgcagcagacgagtttctgaacgcccgagcgggcggagaagaccagcaggatggacccgtcacccatgggcagcgcctggtcgccctgctaagagaagacatggcctagaaggcgcccccacacaggatggcgccatagacttccggtgaa

SEQ ID NO: 46408 - DNA, 304 bp, Triticum aestivum
  Clone ID: PAT_TA_46408
ataaaaaaaagggtttgcccatttttttttatttatatatatatttatttatatatatatttttcccatttccataactttatcaaaaaatgaaaaaatcccccgcaaaaatgtaagtccagataattttttttcaaatctggcctactactttgggctttactattttgcatccaccaaaaaaagcccccccgagcccttccgaaacataaatcaaactttatccccatggtttttccctggccactgatctggcaaacttttttaaaataaaattaaaataaagacaaccccctaaaacccc

SEQ ID NO: 46409 - DNA, 353 bp, Triticum aestivum
  Clone ID: PAT_TA_46409
gcaggcaaccaaacaagttgcaaatggcgtattagggcctgtttttgctcaaacaagttgcagatggcgtattagggcctgtttttgcttaaccagactgggttgaaaagtgtttgcgatgtaaatactggaacaaacgggaaccaaacacccccatagaggtttcgtggacacgtttcaacaacgcgccaggggaatccccgatgcagaaaactactgcacagggggtaagaccacgggaacacatttcacagcattttctgcagaaggaaaaaagctcgccccaccaacacttaaaaccaacctagcattttgggcgggcgctttattacatctaacacaccattgtatcc

SEQ ID NO: 46410 - DNA, 579 bp, Triticum aestivum
  Clone ID: PAT_TA_46410
gtgagaacgaacctttcttgtcctagactgatatacattgtgttggcatgacagaaacagtacttgtaacagaaaacaacaacacctgaaaatgaaaatctaaatactatgtcaatgacaacccaattctcttctatttacacctgttcacgtctggtactttgagttgtacaagggtcttcagagacaagtcttccggaacggaacgaatttatggcatggcatagacaacacaacagggggtagaggcaccatggcaacagaaactccacatacaaaggtaggccgcacgcacaacccgaatctcagtaactaccacgcaagaagctcccaggctcatcaagtagttttggatgactggataacacggtatcaatttgtgatataaacatccacttcagtatcgggcccaacattttcaccaacttggatgatctggagaagctagtgtgaattctttcatttgcagccatatattcctgtagctgtattcaagaacattatgcagagtcttttcttctgtgcctggggtgtttaaaaagctgtctacttctgtctttatcagatgaacttctacta

SEQ ID NO: 46411 - DNA, 498 bp, Triticum aestivum
  Clone ID: PAT_TA_46411
gggttaattgatcatgcgaaggcgcaccaccaaacttgcatttttaaagccatttcctataaaacaagcctgaaaccgaggacgacgagcctgcgtgtgactgtgcacatccatgatgccgcaaagccgacaagggaaggatggaagtggagcccctgtgaacccacacacaacgcgccgacaaaacgggcagccgcaccgtttgaagaaaccgtaccaccgagcacgaagggcttgcatggattcatctccagctggagcttggccttgccctcggcacactccaagctaatgacaaccttcctggggcggcttggccttcttggggaagacggtcttggtctaaccaccggaaccggactggtttcggtcatattggatcttaccctgggggaacagggaggcctttccagccttggactaggagaccttgcgctgggtgtgcttgctgcactgcttgcgctttcaataggtgttacggctcttgccaatggtgac

SEQ ID NO: 46412 - DNA, 252 bp, Triticum aestivum
  Clone ID: PAT_TA_46412
gcagcaacagcggtagcagccaccggcgacgcgctccgagccgcataactagcccctcccgctgccgtcttccgactcctccctcctcgccgagtcttcctcctacccctgcaccgactcttctcctactgctccccgaccgcccctacttgcgccgattgctccgactcccagccgggggcgtggcctgccttcatggacgctcagttagagtccttacggtcgcagctcgatggcttctacggcctacga

SEQ ID NO: 46413 - DNA, 453 bp, Triticum aestivum
  Clone ID: PAT_TA_46413
ccttcgtttcgcgcgcagagggggagaggtcaaggaaccggaagtggttcaacgtaccaagggttcggttcatctccccggagacggagcgaggacctttctcacatccgctcaatccgacgctaccgagcctaagagaacacaccgcgattcgaggtcatcaccgcgacacgtcgcaccaagcctcgactcaccgaccagaggaggagcgctctcgcggtccgcctgcgatggcggtggtgaccgtgggggccgggcgctacgtggcgggctacgcgtgcggggcggtggcggctacgagcggggtggcggttacggcggtggcggtggcggctacggtggtggcggcggcggccgtggatctcaagtgcggcaggagggccacatctccaggactgcccccaggcggggcggggcggcggtacggcggggtggctatggaggagcggcggc

SEQ ID NO: 46414 - DNA, 590 bp, Triticum aestivum
  unsure (1)..(590): unsure at all n locations
  Clone ID: PAT_TA_46414
gnagnacccgcgcgggngggcaaaggaaganaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgctacctctgggga

SEQ ID NO: 46415 - DNA, 636 bp, Triticum aestivum
  unsure (1)..(636): unsure at all n locations
  Clone ID: PAT_TA_46415
gngttggcaagcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgtagctacctcctgtgaatgtatgtcatcaacgatgcaaagtaattgattcgaacagatggtttatgtatgtacgtaacgcagttaccatatactcctacttcctactttggaaactgtaaaaaaaaaaaaaaagggcgg

SEQ ID NO: 46416 - DNA, 568 bp, Triticum aestivum
  unsure (1)..(568): unsure at all n locations
  Clone ID: PAT_TA_46416
taaccatctccaagctagaggaggcaatccatcagtgtgcgctgtaaagatctggggtgttggggatggccttcgcggtctcggacgagctactgggcacgttcgtgcccatcgcggtgtactggctctactcggcgctgtacaacgtgctggacgcgctggggacggtcgactgctaccgcctccaccccaaggaggacgaggagaccaggaacataccctccaagcgcaccgtcctcaggggcgtcctcctccagcaggccgtccaggtcgccgtctccctcatcgtcttcaagatcaccggcgacgggaggcgcgacgcgagggagcagcctccggcaccggtgatcgcgctgcagttcattgtggcgatgtttgccatggacacgtggcagtacttcgtgcacaggtacctccacaccaacaagttcctctacaagcacgtncacgcgcagcaccacaccatcctggtgccctacgcgttcggggcgctctacagccacccgctcgagggcctgctcatggacaccgccagcggcgccgtcgggttcctcgcttccgggatgac

SEQ ID NO: 46417 - DNA, 682 bp, Triticum aestivum
  unsure (1)..(682): unsure at all n locations
  Clone ID: PAT_TA_46417
cggccttagtagggnagccaccatcttagtccaagcacaatgcgnngtcgtggctttcaaagnnaccctgnaaaaggctaggnnaaaaatcatggnacctctgnncgttggnaggggtaaagtatnngccaccannnggcagctcattaagggcagcncnnctagtggncatactcanngtgcctgagnntggcagcccaaagnagcaggctcggnacccatgtcgannaggtcgtggaagaacctagnaacnntgctactcaacnnctcgtggatgaatgttcccggtngagccggtgatgcatngtagcttcactaagatgacacttttaggaaggaaagaacaangaagaagaaatggtagagaagggagagcagtaacgagggtcacctgaaataaagccaagcctccgaagaagaccgttagagggagggggaaccaaagcgaggagctttgggagtggaacacgcccagagaagggaagatctagtgtaatagtaggacactttctttggtggaacgtggatgtacatgttgatggttgcacactagttttgattggggggagggggtcccccttccctaattcgttaatttttttagtcgttattggcttggactggttttaccgtactactccttctataaaaaataaagatttatttagatcactatatttac

SEQ ID NO: 46418 - DNA, 628 bp, Triticum aestivum
  Clone ID: PAT_TA_46418
gccaagctaagcttcgcttcagttcttgcacagttcagctatacatcctgggaggtagaggtgatgatggagtacgaaccacagagcttctcctggccggccgcgctggcgtcgtggctggcgagcttctgctgcggctctgaaggcggcagccacggcgagccggtcgccggcgacggcccggccaggcggatggccgcggctgcccggcacctcaacggcgctcacaagattaagttctcctagctagttcttccagctgctaccttctgcttcacctactggaaattaatatttttctagcaaaaaatggtttcccctccgatttcattaagagaaaccacgcagaccagtaccagttcagttcaaaagcaaaagaaaaggaacaaaaaaagaagctaaggcaaaagaggatttcacctactggaatatactatgatgatacaattatgattcgtgtagccactacgtaggttttcccttctcgctatctgccgtagtgtgtgcgagaggggaatcgtgatgtaaccctctgtggactgtggtgaactttctttcttcggtgccgatcgatcgatcgatggatcacgatccaaagttggaaatgataggcgtctcacgtgccatg

SEQ ID NO: 46419 - DNA, 622 bp, Triticum aestivum
  Clone ID: PAT_TA_46419
ttacgaaatcgctggcttcatgtgaaaatgcaagggctgaggctcatgatattcggaaacgtctatccaaaagaatgttgctacgatatcacatacgaagacactggctgagatacatcactggcctgttactgtgcttgtctgttggcgagctcatctatatccactacctcagcaaaaatctagtccgtatatctaacgacccatacgacattcgcttcagcgacctcacctacaagagccctgaactttgggacgatgcccaccaagccttcctacggaatgccgaccctgtccccattcactcccataacgactacgaacgccatatccctctcttcgatgctctcggttcaggatgcatcagcgttgaagcagacgttcatctgagaaagtcaaacttatacgttggtcactcaagcttgggcctcagcagtaagaagactctcaagtcgttgtaccttgagcccattcaacgcatgatcacagcccagaacgtgaatcttacaggccattggcgtgggttgtttgataaagctccaaaccaaacgttgactctgttgattgacttcaagtcatctggaacaaagacatttgctgagttggatcgacatttacaacc

SEQ ID NO: 46420 - DNA, 266 bp, Triticum aestivum
  Clone ID: PAT_TA_46420
cgtccgggaggaaggagtgaagccccacctcccgccgccgccgccgccgccgccatggcgctccggctgatcaatccgagcaggaagcccctcctccacgtgccccgcccctcctcctcctccttctcctcctcctcgtcctcctccaacaacaacagcccccccttcccttccccgccgacgccgtcctccgacgaccccggataccctccccctaaccacggtgagggccctcagaggccgtacgcctccttgatctttctcga

SEQ ID NO: 46421 - DNA, 373 bp, Triticum aestivum
  Clone ID: PAT_TA_46421
ggagccaggcgggctcaatttggtttaccattaacagaccatcagcttaataagctgcaccttggtctgttccacggcggcggttttaaccggcttgacgctctaaccccgtcttcccggatatctaagggctttgtgctcagcagcgcaccagcccatgacagcgtctcttgcttgttgacaatcggtacaccacagagcacagaaaaatctgttgacagaaagacaccacatataatgttgtttggaaaggccattcttaccgagcagcagatgacttcaagtggatcaagagagacactctcctttggggctactggaaatagttcacctatcagtactgcgctcaaggcaggaaatgcatccgatggtt

SEQ ID NO: 46422 - DNA, 427 bp, Triticum aestivum
  Clone ID: PAT_TA_46422
cgtccggcggcgagctggccggaccttgccgagttcatagctcgcctcgtggatctcttgggcatcaccgtctcgttctaaagatgcaactgcaatgcatctctccgtgatctgtaataactttgtgaacagaacaccgaacactgtcacactctgcagatcacggaacgtggtgcctggtgacagcgtgtctggcagggcgtacaaggggcggcactgcaagaagttctacaccgaggagggatgcccctatggcgacgcatgcactttcttgcatgatgagcagtccaaggcgcgtgagagcgtcgcgattagcctatcgccgtcggttggcgggggcagctacaactctgctgctgctgctgccgcctctccaaatggaccgacaattctgaagccgtcgaattggaagacgaggatttgtaac

SEQ ID NO: 46423 - DNA, 410 bp, Triticum aestivum
  Clone ID: PAT_TA_46423
cgtccgcccacgcgtccgggggtttcaaaggcagtgctggcgcagtggagcaatcagggtatcaggttcagctctgacccagaaacagctatgggactggtacaacatgaaggtggcccttgtggtgtcttagctacagtgcaggcatatgtccttaaatatcttctgtttttctctgataatttgggtaacccagaggtcagtgacccgtcatttgctctgggacaaagacgattttatcagagttcttttgctgcaagggatgatttttcttctcttaccgaggatggaaagacgagagcattggttcatgctatggtggaaattctatttttatgtggaactgggaaaagagctgttgttgcattcattggaggtgtcactcgtgagaaagttgatgctgctttgga

SEQ ID NO: 46424 - DNA, 390 bp, Triticum aestivum
  Clone ID: PAT_TA_46424
cgtccggcacaaacaaaagaataatggagttagccatggccgccgcctacacctcgcgcctgggcctgccccccgccgcgcacccgtacgacgacgcatccctggcctgcgccctcggccagctctactccaccaaggatccgttcgccctgccggtcagctgcctcctcccgcctcccgagctgccgccggccttcgggttgcccgtcggcggcctcgcccccgtctgctgctgcgccaaagccgcgggggcgccggcgttcccgccctttccatgggcgcacgcgccctcgccgcctgcgccgccgcgctgcgccatcacggagatcgacgagtcccgggaggtggagtcggaaggacaacctctccctcgctccgtcctcacgccct

SEQ ID NO: 46425 - DNA, 296 bp, Triticum aestivum
  Clone ID: PAT_TA_46425
cgtccgcccacgcgtccgtggacgcgtgggcggacgcgtgggatgaactgtaaaacagctacctatgcgaagagtcagacatcgctgtgatccaattgagctggattctaatgctgcacaagtggttgaaatacagcctgtgcttcccacgctggagttcatgaaagaacgcggagtctaccaccaaccaggatatgatgcatagtgcgatccaactattgggtactacatgtattgtacccaaccagaaaacactgcacaatgtgtttgattgtgatgagaaatgcacacccaaa

SEQ ID NO: 46426 - DNA, 175 bp, Triticum aestivum
  Clone ID: PAT_TA_46426
cgttcgtaacatcaaaggtgttaaacaacatgttaattattgaaagaattccacagagttcgtgagcgttctaactatagccagctcaattttcaatattaactaaggaaagatgtatccactcaaactacttgcacatgtcacacttgtttgtaataaaaaagtagcacaggct

SEQ ID NO: 46427 - DNA, 416 bp, Triticum aestivum
  Clone ID: PAT_TA_46427
cgtccgaagccaaccagatcagcctcgacgagggtttagggggaagaggcgcgcggagaaccctagccgccgccgccgccgccgccgccacgatggggatcttcgacctgctcgacctggccgacggcgcctcgggggacgaggccgtcgcccgcgtcgtcaacaaggtcctcccgcccgacgaccccgacaagcccaccaaggccgccaagaaggccgccgccaaggacgcccccgccaaccccccgccccagcaccacgaccagcagtacccccaagatggtggaaactattacccaagggagggcaactttggtggaggccggggcagaggccagggctactatggtggtggtggcggcagaggaggccgtggaaggggacgtggcgccggatccagtcgtgtctttgaggat

SEQ ID NO: 46428 - DNA, 418 bp, Triticum aestivum
  Clone ID: PAT_TA_46428
cgtccgcccacgcgtccgcccacgcgtccgcccacgcgtccgcggacgcgtgggccggccgcctccgcgctgcagtggctcgccccgccgcagaccgcctcgggcctccccttcgtcttctcccagtgccagtccatccacgcccgctccgtcttcccctgccacgacacccccgccgcgcgcatcacctactcgctcctcctcaacgtccccgcgcagctctccgccgtcgccgccgcgcgccacgtcgcccgccgcgaccccgtcccctccgaccacagcggcgcctgcgacgacgcgctatggtgcgcccccggccgaatcgtcgaggagttcgagatggcgcagtgcgtgccgccttacctgttcgtcttcgccgccggcgggatcggctcccgggacctcggcccccggacgc

SEQ ID NO: 46429 - DNA, 390 bp, Triticum aestivum
  Clone ID: PAT_TA_46429
cgtccgaaaatgcgtaccttattccagttccagcactcacaaccaaccaaggaggagaatccccaatcacgatcagactgagaagcgatggctccctaggcggataagaagccgggggcgaagaagcccggggaggacgagccgacgacggagaaggccgagaaggtcacggccgcgaagaagcccaaggcctgtaagcgggtgccggtgggcatgaccgactccataggagggcggcgagataaggagccggatgaagggcaagaagagcggcgagacctacacgatctacatgtttaaggtgctcatgcaggtgcaccccgacatgggcatctcctccaaggacatgtccatcatgaactgctttatgaacgacatcttctagaagct

SEQ ID NO: 46430 - DNA, 310 bp, Triticum aestivum
  Clone ID: PAT_TA_46430
gggggacgcacgacgcctcccacgcgttcgcgatgggccaggatgggtagatagagctaaacatccatttgatggaatatgtgagtttggttctgaaaaaagggcgcatggaccccttatcctatttttgagggacggtgagaaagagtgtgggaacacttactcttatcatggtctaaagagcaaggtcgaaattttttcagcaggaggttttgttattgggtcttaaacccaggcagacagtcgggaagataagcttaacggggctcctttgctgtcgaagtttccatacgggcgagcagaaatactt

SEQ ID NO: 46431 - DNA, 405 bp, Triticum aestivum
  Clone ID: PAT_TA_46431
cgtccgcggacgcgtgggtttttttttttttttttttttttttttttttttttttttttttttgttttttttttttttttttttttttttttaacaaaaacacaccatccaattccacagggccagttaaccatagcaggagtccaaaaagttacccaccggaccctggaatcgctgggaaaaaataggggcggggcccctcctaatatagggggggcctccgggtgggaggttactactggcgactggaaaaaacggccgtccactactgggctaacggtgaaagctacgggagctagccccaaatcggtcgggcggggggagaacccggccccctttttcgtccggccggttggtgggggggaaccgaacttacctacgtaccgggctataaaccggggggac

SEQ ID NO: 46432 - DNA, 218 bp, Triticum aestivum
  Clone ID: PAT_TA_46432
tagatctttagcctctaccgtttactaaagctgtccaacaactgcactggactgcagggcatcctggtcttcaacgccgtcagcggaggaaccaggtctgggcttgtatcgctgctcctcgagcgccttgacgaggactatggaaagaagttcaagcttgggttcaccgggaaccaatttctctaggtaaatgaccttttggggcgagccctacaaca

SEQ ID NO: 46433 - DNA, 348 bp, Triticum aestivum
  Clone ID: PAT_TA_46433
cgtccgtccacgcgtgcgcggaacgcggtcgtaacacgtacgcgtatccctcacagccggtgcgcctgactttgccgtgagacgtgcagtggctatccatggttcttgcaaccggccgtacggacggtcgagaaccgggttctgggctttgggtccgatccctgcctcggagtcgtcatgtaccgaggaactatgcgaaatgaagtaacaggcatcgcactcaccgtgtacccatctgctcatgggtcgacctattgggcgagccctacaacagtgtgctgtccacccactacctgctggagcacacccatgtcttcatgctggtcgacaacaaggccatctacgaca

SEQ ID NO: 46434 - DNA, 101 bp, Triticum aestivum
  Clone ID: PAT_TA_46434
cgtccgccactcgttcttttacacgtgtacagacgcgttggtcgttctgctaattaaggaccggttccttcttgcgtaacagctttattaatattgtgata

SEQ ID NO: 46435 - DNA, 335 bp, Triticum aestivum
  Clone ID: PAT_TA_46435
cgtccggtcagggttcggacgtgtctacaagggccgtcttgacggaagccagggtgtcgctataaagcagctcaatacggatggaaaccaatgaaacaaagatatttctggtggagggcctcaagctcagtttgctgcatcatcaaaaccttgttaatttgtttggctattgcgctgatggaaagcaacgccttcttgtgtacgagtatatgccccttggatcattggatgtccatcttcatgatctctctcttgtttaggatccgatgtactggcacactatgtctaaaattgcatatggcgctgctaaaggactggaatatcttcatgacaat

SEQ ID NO: 46436 - DNA, 446 bp, Triticum aestivum
  Clone ID: PAT_TA_46436
cgtccgcccacgcgtccgcccacgcgtccgcggacgcgtgggctccctccctccctcccatcccgtcgccccgtcgccgacgcgtcctgccgccggcgcccgaccgattcgccgatccacgcaccgcccgaatggagccggcggaggcggaggcgggaggcggcatcgccgccgcgaggagcagcccggccgccgtgcaggccaccaacgacgacgccgcggcgagcaagctgtcctgtgttaccaaagggtacatgaaggatgattacgtgcaccattttgttaggcggacaacaaaaagggctccaataatcaatcgtggctactatgcccgctggtctgttcttaggaaacttatgctccagttcctcaatgctgggagtggcagtgatgatcagaagaggaaacagatattatctcttggcgctggctttgacacgacattt

SEQ ID NO: 46437 - DNA, 244 bp, Triticum aestivum
  Clone ID: PAT_TA_46437
cttccgctgctctattccctatctctgacctcgtttctctcggcttgttcgacgccgcgcgccttgaccctatgctggcgcctctacccatccctccaccgccgatcctagttccattctctcctaagtgcccgtcctctgtccgccgttgcctaatctggtcgaaatcgggaaaattctgccgtattttgcgttgttgctcattgcctatgcggggaggactaacgaactgctcttcggactt

SEQ ID NO: 46438 - DNA, 242 bp, Triticum aestivum
  Clone ID: PAT_TA_46438
actcggaagtttcgacccacgcgtccgatcaattccactcccgccgtcacctccctctactacggcgctctttcggacgctccgggatacatacgtacttacaagcggaagcagcctgagccagccatgtgccctggggcgccggtcgcggcggtggctgttgacaatagcgtgtgcgtgatggacgcgtccggcccgttgggccaggcgctcgttcaccgtcttattcgtcggggctacac

SEQ ID NO: 46439 - DNA, 383 bp, Triticum aestivum
  Clone ID: PAT_TA_46439
ccgtaccggaacgccagtttcgtcccatgcttacgaactccttcccaaatccaactcgcgcaacagctcctagaggatcgccagcgaccatgttcgggcgcgtcatgggcggcaaggggctcggaaagggcggcgccaagcgccaccggaaggtgctgcgcgacaacatccagggcatcaccaagccggccatccggaggcttcgctcggaggggcggcgtgaagcgcatctcggggctcatctacgaggagacccgcggcgtgctcaagatcttcctcgagaacgtcatccgggacgccgtcacctacaccgagcacgcccgtcgcaagaccgttaccgccatggacgtaggctacgccctaaagcgccagggccgaaccct

SEQ ID NO: 46440 - DNA, 387 bp, Triticum aestivum
  Clone ID: PAT_TA_46440
cgtccggccctctgcatgttgacatctctgccatggaaccgaagctccgccgtctgcccgctcctcgccggagtgccttgcagtgcctcgcctcccaaccatgcttcccgtcctggatgcccgaacaagctcgccggtgtcctcgcaccgtctgccaccagcagaactagggcccatgcctcgcgccctcctattcatcgtccttcgtcacctggagttcgttggttgctcgcgccttgtcccgccccagcgcccttgttcctctgtcgtggtccgcgccattcccggcgagcatggccaccattagcgccacagccgtcctcattcatgtgctcgagtccacgagctaggaccttgctgcgttcctgtccaaggacctcccggtcc

SEQ ID NO: 46441 - DNA, 302 bp, Triticum aestivum
  unsure (1)..(302): unsure at all n locations
  Clone ID: PAT_TA_46441
cgtncgcggacgcgtgggagtttttcctggtacaggtcttcttcaaaagccattgctaaataagcaggcttcacctcaagaacacccaggttctgaaggagatgcagatgcggagacccaaggttcggaggtcatggatcagctgaacagctacaaagaagatgctggcagttgcatagattgacgagccttgtcttcagttcattttggcccgacaagacaacgcagcctgcttcgtatgagagacagacagacatggatggtgaaaccatttatgtatcttgtgttaactcagtctgtct

SEQ ID NO: 46442 - DNA, 150 bp, Triticum aestivum
  Clone ID: PAT_TA_46442
cgtccatggacgcgtgggttcatcagctcattgtcatcggcgggtagctaatggaggcggcgaaccccatatccaccgaggtgctgcacacctgcctgggcgtgttccaacttatccccatggtggagctcgccaagctctttctagggc

SEQ ID NO: 46443 - DNA, 163 bp, Triticum aestivum
  Clone ID: PAT_TA_46443
cgtcctctgtacttttctctattatcttcttctccacattcgacctcagggttaggggtccgtggatgctttccaccaccatcttcaccttcgccaaggttaaatggcaatgctattgcttcacctagcgccttcacctacaccaccgaatccaagttcaagt

SEQ ID NO: 46444 - DNA, 185 bp, Triticum aestivum
  Clone ID: PAT_TA_46444
ctttctaccacgcgttcgtcaattatttgcgtgcctgcttagattccgtacgtagtgcttgccgccggttctgagcgcgcctggatgatgcggaccctctgaccggagccgattacgtcgtgcgccgaccatggtgcattcgtattccgaagaagggggtttaccaagcttgggaagggaataat

SEQ ID NO: 46445 - DNA, 189 bp, Triticum aestivum
  Clone ID: PAT_TA_46445
tcgtccgactacgcgcaagctcctccacactcactcatgctcatatgatccgaaccgttgacgcaggcgcgcaaccgactgtgatgggccacccaccctgaccgtgctttggagctctccgtggaactaacaagcatgctgttcatgcgcaccgccgccgccgctttctccgctcgttctcctgtggaa

SEQ ID NO: 46446 - DNA, 359 bp, Triticum aestivum
  Clone ID: PAT_TA_46446
cgtacgtaaaaaaacactgtagccgagtccgacaaagcacgctcggccggtgaggcgagtgagaggcaactcaaccatggagggcggcggtgcatgcgaggtgcggcactggaacgctgacgtcaacggcgtctccctccacgtcgccaagcagggccccgccgccggcccggcggtgctcctcctacacggcttaccggagctctggctctcctggcgccaccagatggctgctctcgccgaccgcggtttccgcgccctcgcccccgacctccgtggctacggcgactccgacgcccccgtggaccccgccggctacaccatgctccacgtcgacggcgacgtggtcgcgctttttg

SEQ ID NO: 46447 - DNA, 381 bp, Triticum aestivum
  Clone ID: PAT_TA_46447
acttcccggtccgaccgacgcgttcgtccacgcgtccgaatctctctcgcttctctccttctcctttcttcttctcctcgctcaattgggttgggtagggaggctccaatccaaaatcgaatccaatcccaccggactagagtagagccggcgagatacgactcatatccgtgtcgggcgcgcgcatggagaagaagctgctcttctcttgtcgtgcttgagcttgagctagccacgactctgcttcctgctgctgcttcgtgtccgggggcaggaagatgcgcatgcgggtgctgccggccttcaccttcagcaccagcccgccgccgtctgcatcggatcctcctccttcggctgctccggaaccggctccggcgccgg

SEQ ID NO: 46448 - DNA, 236 bp, Triticum aestivum
  Clone ID: PAT_TA_46448
cgtccgttcgcacgaatgttgtaaatgcttccttcttctactctgacggggggaaggcggttcaaaggtgcgttcttggcccggtgctccgcctgaaagcgccgtctgttcccatgaggcacgcgtctgggcttacttccccaccgatgtggttcacctcgtcaccagccgcctgcttggccggcgtacatggtggtctacatgttcttccgggccgtctgttcctgttggcgcaa

SEQ ID NO: 46449 - DNA, 244 bp, Triticum aestivum
  Clone ID: PAT_TA_46449
cgtccggcgcgccttgccaagtcgcatacacccactggagctcgtgagttccatatctaccacccgtgcggcacgagtcggggggcccaggtccgccatggacgcttgctctccggccctcgtcgacatcggggcgctggtcctcctcctgggggcctcggcgccgacggcgatcgcggagcgcgccatctttgtctttggcgacctcccttgactacaacgggaacaacaactaccttatgac

SEQ ID NO: 46450 - DNA, 398 bp, Triticum aestivum
  Clone ID: PAT_TA_46450
cgtccgcccacgcgtccgatcttagcaagatatggttcaagcacatggttccaacattcgctttgctgacgggagaggactacatcaaggagtttggacaattacattagtcttggttaacaacttaaaccggtgagcgctaagatcagtcttcgtgtttgcattcatactgcttgtgattttgaccctatgatggtggaatgtgcagatccgacatcactatctcaggaggtcaattgcatatgaggtgatctcgatgagaggtaacatgggtgagttgccatgagaggtaacatgggtgagttgcccaacttcatgatcgagaaagtcttcttctgatgtgggagtgctgatctggtaccatgtggttgcttttgggtgggacttttttttttggg

SEQ ID NO: 46451 - DNA, 141 bp, Triticum aestivum
  Clone ID: PAT_TA_46451
cgtccgtccacgcgttcgtggacgcgtggtctgaggtcaacctaagacttattgtttgtaagtggggcctcacggtgtctagggggtaggctaatcaagagagtttttgggtgctgatttaccggaacagggtcagtatga

SEQ ID NO: 46452 - DNA, 302 bp, Triticum aestivum
  Clone ID: PAT_TA_46452
cgtccgcccacgcgtacgcggacgcgtgggtttttttttttttttttttttttttgacagaggcagatcacagtgataagtgggaggagcaaatgccaaaaacacaaagatctgaaaccatttacttggacgattttgcacatatatgtcaccacgacaaatactttccaagccaaatcatgggatgcaagatttatttattatcacaccacacaggacatgattcagacacgctttagctggctaggaacacacacaacgctaacgcttcctaagccttcctggaaacgttttcctagcac

SEQ ID NO: 46453 - DNA, 220 bp, Triticum aestivum
  Clone ID: PAT_TA_46453
cgtccgcccacgcgtccgcggacacgtggacgccgccgctgtcgtctgctctccccgctcgcgccggccgccctagaaaaggccgggactttcttgacgacggcaacccccgccgccgcagggatggccgaggacacggaaacgaggcccgcgtcggcaggcgcggaagagagggaggagggggagatctctgactactggaacggtttctccgccgggg

SEQ ID NO: 46454 - DNA, 353 bp, Triticum aestivum
  Clone ID: PAT_TA_46454
cgtacgtggacgcgtgtgcgaactcttggtcggacgcgtgggtttgagaggtcaaggagttttcataggagcatcttgacatgctgctacatgttttccggtggacgacacccaacatcgccagtttatgcacttatggactgaataaaaaaaatggaaatgaataataaaagattagcaattttattatatgcgagtctaacaaacattttggaggtgtgaatgcttctttgggtctgactagtaatcaattattgatggtatactgggatttttctcatacttttagcacttccttattgacaaaaaaacatgtggtttcacatcataaggctatccaggtattttttttt

SEQ ID NO: 46455 - DNA, 314 bp, Triticum aestivum
  Clone ID: PAT_TA_46455
tcgtccgttcccatctccctctctccaccctcccccgcgcttgctttctctcccatccattgcccttgctccccctcccctggcgcccggccccggcccgatgaacctgtggacggacgacaacgcctccatgatggaggccttcatggcctccgccgacatgccggccttcccatggggcgcggcggccacccctccggcggcggccttcatccaggacacgctgtagtaacgcctgcaggccatcatcgagggctccagggagacctggacctacgccatcttctggcagtccttctcctactccggtgcct

SEQ ID NO: 46456 - DNA, 368 bp, Triticum aestivum
  Clone ID: PAT_TA_46456
cgttcgcgtacgcgtggtcgactgctgcagatcgcccccgagaaacccaccatattcgcagaacctacaccgttttactcaggcggacccacccagcagcgtggggggcaaggacaaaggcggaggcagtttgcaggaaagcccccgtactattctgcctcgcctcgcgcttccttccttgctgccgttgctgcctgcctcctcgtcctcctccctctcgtcgtctcgcctcggcccagggacggcgacgccataccgcgagcggtcgggcgggctcatcccatctactctcctctcttgccggcggggagggtctgcgcggtcgtccgccattgtcgcgtcatcccgagtggagctctgattgggga

SEQ ID NO: 46457 - DNA, 224 bp, Triticum aestivum
  Clone ID: PAT_TA_46457
cgtcctccaactcgtgcatattgtaatagcgatccgtaccgtaccagacctattgcaccacatccagtgtggactttcttgagtgggggtgggcccttcctatttccgactatccgaccggcccttccccgcctaccgctccagtctagtgagttctattgttagtgcttaaaagaattttgagttggccacttttaatggcatgatagtgttcgacactaaga

SEQ ID NO: 46458 - DNA, 188 bp, Triticum aestivum
  Clone ID: PAT_TA_46458
cgtccgcccactcgttcgtccactcgtgcgtccactcgtccgggagaacaagattctctctattcgggataggggtgttgggatgaccaaggaacatctcattaagaaccttggaaccattgccaagtctaggacttcaggtgtcgtggaaaatatgcaaactgggggagacctcaatctctttgggc

SEQ ID NO: 46459 - DNA, 300 bp, Triticum aestivum
  Clone ID: PAT_TA_46459
cgtccgcccacgcgtccgtccacgcgtccggcaactcattcttctttctcaagatctcccactcggctccccgcgtcggcggcgaacccactccgccgccccgtcgccggcagcgcccccctcccccgatggccaccctcgacctcctcttcaacctgcgcaacctcttctacctcggcgcctaccagtccgccattaacaacagctacgtccctggcctcgacgccgactcctcggccgagcgcgacgtcatcgatttccgtttctacattgccctcggatcctaccagctgggtgatc

SEQ ID NO: 46460 - DNA, 274 bp, Triticum aestivum
  Clone ID: PAT_TA_46460
catcctcaccgttctacgaggcttatgaaagtagcatcctctccctctaggcgatattggggtatattgaggcacgcgaggtatacgaaggattatgctcatggcttgtactaagctaaccgcccgtaagtacactggaggaaaggctctcaggaagcagctagccaccaaggctgcccgtatgtctgctcccaccactggaggagtgaaaaatcctcaccgttatccgccctggaactgttgttcttcgggagatccgtgagtaccaaaagag

SEQ ID NO: 46461 - DNA, 125 bp, Triticum aestivum
  Clone ID: PAT_TA_46461
cgtcctatgaaataaatgcttggtatcgatatggttatggtccactttcaattacaccgaagttcatggaggatgcaacatctagttgtgagacaagcgtattaatcattatgaagcagaattga

SEQ ID NO: 46462 - DNA, 380 bp, Triticum aestivum
  Clone ID: PAT_TA_46462
cgaacgctgatctcctgcctgccgacgcgttcttagccagcgcccaacgtctataagtacagggggcgtgcccgacctacggggagcaaccagcttttctctctttgtaccgtgctctccagctctcgccctcctctgctttgcgttggggttttctagggtttcccagaggccgaggtcttggcgagttcgtgttctgggtgcaggaggtgcagattcttatctcgaggaggggaggtgcgcgaacattaggctatctccgttccttcatcgccggagcaaaactgtcgtcagtgactatccaaatgaaaattggggatggcgtttacaccatatggtcaaccactttggtccaaccgtgagaaagcgatccataggca

SEQ ID NO: 46463 - DNA, 343 bp, Triticum aestivum
  Clone ID: PAT_TA_46463
cgtacgatgatcatgaatagccttttgctatggcatctttagggcttacatatcctcaagagagggggtctctggctgaagagtcaggagtgctttttgaggctattaaattggtttttgagaaaagagagaaggaaatatggaacttggttttttgacatggatgaccagatagcaaactattttggtactggtgcggcttatatcagagctgtactcttttggtataccactacttatgcctttttgatgctaaaagggttgttggatacatagtttattcttacgcctcaacaaatgcttttttagctattgttattgttatcgaagcaaatcaatgtct

SEQ ID NO: 46464 - DNA, 276 bp, Triticum aestivum
  Clone ID: PAT_TA_46464
cgttcgcggacgcgtgggcggactcatggggcaacggcgtgacgctgaaccggttgacggtgggcgcgccggaggacagcgcgggaacaccgtacggtatacacatccacatgttcaggcacgtgtccgtctacgacgccaacatccgcaccggcgacgactgcgttttcgtcgggcccgggaactgctacctctggatcgagcgcgtatcctgcgggtccaggccacggcataagcattgggagtttggggcatgaagaagggctggacatggtg

SEQ ID NO: 46465 - DNA, 151 bp, Triticum aestivum
  Clone ID: PAT_TA_46465
cgtcgcccactcgttcgctccgtatttcctaaccaggactcgcccactgtatacgcattctcacagctcgatcgcaatggcgtgggtcgtcgccgttcatccggtcgccgggaggggcctggccggcagcttcatctccggccgcaagctc

SEQ ID NO: 46466 - DNA, 250 bp, Triticum aestivum
  Clone ID: PAT_TA_46466
cgtccgcggacgcgtgggttttttttttttttttagtagaaaacggtatgactgatctgttgtagtgaactgcaatcgaaggtgcgctagaataaaatataaattactagatacaatctttgtgggctgtatgaatgaattcacattcttgatctaggcataaaattctgcaatggaattcataatcacgtaataaagaggatttgggacatactctatggttgaggagaggatactaaaacattgaact

SEQ ID NO: 46467 - DNA, 368 bp, Triticum aestivum
  Clone ID: PAT_TA_46467
tctttcgagtacgcgtgcgctcatacattcccttacacattattatcgaggtataggggagtgagggtgtaacctctggcttggatggctattagcttgtctagcgacttatctagtcattgttattatgttctagggacagatagagacccaggcaatcagaagaaggtagcactccttttgtaacttaccatgtgctaatgaggggctggtgcttgtcagggctaaccttttggaagaagggaacttttacgttgccgttgagatctggtagggcgttttgcaaaccgcatattctattatttttaacatttatttttagaggatgaaaatattgtttattctataatacgatctttttataagtt

SEQ ID NO: 46468 - DNA, 344 bp, Triticum aestivum
  Clone ID: PAT_TA_46468
accgatccgaaatttctaatggaccgagtcgtcctctgactctagatttcccctacctggttcacgcgcagagcatccatactatttatgcggttcaggtggtgctcatgggcttgatcgaggtttaccgcgttggtggaggacccctcggcgagggcctcgacatcatctacccaggcggggccttcaacccacttgtccttgccgactaccccgacaccgtaattgagctcaaggtcaaggagctcaagatcggcctgctcgccatgttttccatgtacgaggttttcgtgcatgccatcgtcaccggataggggcccgtagagaaccttttcgaccacatt

SEQ ID NO: 46469 - DNA, 285 bp, Triticum aestivum
  Clone ID: PAT_TA_46469
cgtgcgcggacgcgtgggcggacgcgtgggcgcgcgctcatggagtagcactcgtcaacgatccaggcgcatctgatgcggggggaggatgcccaccatagcgagtacgtatctgatcgtgtcaagcggtagatagttatcaacgtgttcactaggaggcgtgagatgggcccttatgactacaaagggaggtgttattatggacagatggacgatacttattggagggcaagaaacaatgtacggatgtggcgggaacttattgcgcatgggtagaagacccac

SEQ ID NO: 46470 - DNA, 257 bp, Triticum aestivum
  Clone ID: PAT_TA_46470
cttccgtttaagtttattgtgattcagaatctttgaaactactttaagtagcagctgttgtggacatgctggtggaaactcccttgagggcagaagcatatgtatgatttgtctgaacagcattggcctgcataatggcaaccgaatctgatggtgagacgaagaatcttataccaagaaccatgttgcggaatgttgctcgctgctgctgaggagttataggaatcgcaaggcttaccaccgtcattgcataataa

SEQ ID NO: 46471 - DNA, 256 bp, Triticum aestivum
  Clone ID: PAT_TA_46471
cgtacggtaaaaactatgcgaaggtttctgctttcccagaaacacattgtatataccgaaccgcgtgaaatacgtgccggaaccacagtggatgtgctatacaatccctctaacacagtgctaaaaggaaagccggaggtttggtttagatgctttctcaacctttggaggcatccaaggggggcattgccaccccagaagatggtgaaaatcagggtatgggccggtttttaaagccacagttaatggacccacc

SEQ ID NO: 46472 - DNA, 226 bp, Triticum aestivum
  Clone ID: PAT_TA_46472
cgtccgcggtcgcgtgggcaccagttggtagaggatacttacatatgtaccgcggtgtgtctgtgaccgatgaaggtgggggggtcaagtttgttcatgttgaccgtattgatggagagcttggtggcccatctgattgtgggtacaccattaacctaccatactttgtagataacagaggattgagacatggggtgagtccaggtatgatattatgcactcagat

SEQ ID NO: 46473 - DNA, 340 bp, Triticum aestivum
  Clone ID: PAT_TA_46473
cgttcgcatgagggcaaggcgccgcgacggggcgatgggtcgccgcgacgtctacgtgccccgggctcccgcgctgcctatgtgaacgcgtcgtgccccggtcccttgccgtccagatcacacaccaccaccacacttgcttctctgttctcgcgcatcgtgttcatcgcccagagcacgcacgcgcacgccgttccttcaccttctcaacccacaaattttattacgccctcggctgtaggcgccgccggtgaagccctccgtcgtccggtctgttgagtcgtcggcgccatgaagaatgtggtgctgaaagctgggccttgcacgacgacaggctgaa

SEQ ID NO: 46474 - DNA, 348 bp, Triticum aestivum
  Clone ID: PAT_TA_46474
cgtccgcggacgcgtgggcacgcacgcgctctagttgtagacccaccggccaacttcggacggggatcatggcgctcgcatgcgggtactgcccaccgctgtcttgcaccacgggtgcgttccagcgcgcccccttaatttctgggcatcggactcgcagcgagagctgagaccccgcagttgccgactactacgactacgaggagtacacacaatcgagcccttcaccgcatcacgagctcgaaggactacgcaccgtcgagccccctgcagtcgccggagccgaactacacttcattgagccccgactacactccagggagccctgactacactacagcgagcccg

SEQ ID NO: 46475 - DNA, 225 bp, Triticum aestivum
  unsure (1)..(225): unsure at all n locations
  Clone ID: PAT_TA_46475
cgtccgcggacgcgtggggtccaagtcctccgtgatgctctagaggaaatatttgtcctttgtttttctcctgccggttgtagcaagccttcgtgggatataatattctgcgacctgtaacgcgactatctgctccccaacttgctatactactcgcggtngttcggcgacaacgggccggggtttcccttcggtccggtgccctaacaagagcccgacttggcc

SEQ ID NO: 46476 - DNA, 308 bp, Triticum aestivum
  Clone ID: PAT_TA_46476
cgtccgcccacgcgtgcgctgaccctgaggctgaacctgaaggggacgcaactagacactagacgaatcccttctccacttcaatctccactgcaaacgacatggctcaggacgaggttcccccgtcttcttccgcctcttctctggtgaacgcccgcgtgaacgccttcacgcctgagtccaccgcccgatacgacgcccatcaccatgcccatgcgcatcaccatgagcaccaccatcaccaccaccagcatcagcagccgcatcaccagcaccggcaccagcaccaccaccagcaccagcatcag

SEQ ID NO: 46477 - DNA, 367 bp, Triticum aestivum
  Clone ID: PAT_TA_46477
cgcctgaggcaccggtgcagtattcggggggacacacgcgcgcgcccacacgtccgcggattactcttgcaaatacacatgggtgctcgttgctgtagacgtagctgtcggtggaccgggccaagaggaacggtggtctgggcgcggcggtgcccttcaagggcaccatgaaggtgtacgtggtggtgggcatcaacacggcctttaaagacagggtgcgacacgactatgtccaggacacctgagtgccatgcgacaacatgatgggtgggttggacccagacacaccacatttggtgcggttcgtgatcgggcacagcgccacgcccggcggcgcgctggaccgtgccatcaacgtggacgaggc

SEQ ID NO: 46478 - DNA, 347 bp, Triticum aestivum
  Clone ID: PAT_TA_46478
tatacagtatgatctcacacaggtattgcgagaatgaaccgtctgcattgactgcattgccctagcgcaagaaataacatacaactgcactgtattgaaccctttgccacagccaaggcatgaaacgactacagaaagataacatgtggatattgaccgcataaaactgtatacatattaaccgtaaacaggaaaaacgatgagggtggctgactaacgaatccaactgaacagcccaatggattacaatacaggttggttcacactgggcaggaaaacatagcacaggggtgactcaaccgaccacaattgctatacagactcctctgggttttttctagctttgc

SEQ ID NO: 46479 - DNA, 342 bp, Triticum aestivum
  Clone ID: PAT_TA_46479
acgcgtccgacccacccctcgtcctgacccgtccccggctacgactttcctgcggaaccctagccaggcaggcagccatggggcggggcatgctactgcggcggttaccgagcgcgcggtgcctgctgatggtggcgacgctcgcgatctccgactccactgtgccgctcaccattgagaccatcgatgcccttgcacggtcgatatcgttgacccgggctcccgggacttatccaccacttccgccgaggtggttgtcttgttccacgacatgttcctcatgcgccgcatggagatcgccgtcaacttgttctacaaggccaagttcattcgcggaaagtg

SEQ ID NO: 46480 - DNA, 326 bp, Triticum aestivum
  Clone ID: PAT_TA_46480
cgtccgcccacgcgtccgcggacgcgtgggccaacccaaagaggaggaagaacaccaaggactgactgccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccact

SEQ ID NO: 46481 - DNA, 347 bp, Triticum aestivum
  Clone ID: PAT_TA_46481
acgcctgcagtactcgtctcgaattcccgggaaaaaccacacacatacgaagaccaacaaaaccaaaaaaaaaaaaaaaaaccataaaaaaaaaaaaaaaaaataagagacaaaaaccaacaacaaaacaaaaaaaaaacaaaaagctgaataaaagccggggggggcgcttttggggatcctgttttacgccgcctttttccaactcgatggtttttttatgggcgacgttaactgcagtcctggggcccccttttaccaggggagacagggcaaaaccctggcttttcccaaattaaatctttttgatgccaccccccgttttgaccgcttgaggtatgcgaaat

SEQ ID NO: 46482 - DNA, 319 bp, Triticum aestivum
  Clone ID: PAT_TA_46482
aatttcgactcgaccacgcggacgcaacgcagactttatattttcttctctcgcctcccgtcttctttgccctacgctgcgccaccccactacggtgcggacccgaccggaccggactacttcccaccccgccgcccggccggtctgttccatcctccccccttgccattccctccagcgtggccggtggccgggcgggagcagcagctggtaagggagggaggcggggacgaggggtttggatggcggtgtgatctgcggaggggcgcggcggcggtcgaaggcgaaagcggtgttcggggtggcggcgggttgcgcg

SEQ ID NO: 46483 - DNA, 465 bp, Triticum aestivum
  Clone ID: PAT_TA_46483
cgtccgctccgaggcttgcgaagaggctctgcggctccgcagaagggatctgatcggcggctggggcggcgccaccgttggcttggaaatcgccgaggcctcaacgaggtccacaggagtggctgctgcggctgatctgatcgaacgccggcagcgctctgagttccaatcaagcatcaaaagcaccctcacggcagccatagaggcaaagccagagctcgtcccatctctgctcaccttggcactgaatgatgctatcacatatgacaaggcaacaaagacaggagggccaaatggatccatcaggctaagaaataagcagacctgaaaacagtgggctttctgctgccttggatctgctagttgaagcaaagaaagagatagattcatattccaagggaggtcccctttcatttgcagatttgatccaaatagcagcatcacaagcccttaaaaaaacatttc

SEQ ID NO: 46484 - DNA, 402 bp, Triticum aestivum
  Clone ID: PAT_TA_46484
agtctattgggaagagatgttttctgattaacacatcaaagctaaagccaaaggcggtatgaacttggcagttgccaccgtcacagaatgtacaggttcactttcatgactcaaaggttctcgtatgaacaactacaccctcaaagcagcaaacatgaaatcttctcgcgcattgctgccacagaaacgacaacactgtcatagaagatcgcagggctgttaaccaaatccaggaggtgcatcaaatccaggaggtgcatcaggatcctcatcatcgacgtcccccaagctaccagcggcgactagctcaccaccatttgatttcacttgggcatgattctggccatcatcacatggctggtcctgctttactatgatgttgctgcgctgaaggtcactcaa

SEQ ID NO: 46485 - DNA, 458 bp, Triticum aestivum
  Clone ID: PAT_TA_46485
cgtccgtatgttaaaacatgaaattcgcaagcttgagcagctacaacaacaacttgaggttgaagcgaaccgagcaattgatgtactgcacaaggaggttgaatgccacaaacatgggaaccaagatgcagcagaaactattgctaaacttcaggcagaaatcagggagatgcaatcttttagatctgagaacagagatgttgagatggttacagatgaaggaaatgggtctgacttgaaagatgaaattactagacttcatctgcaagacagtgatattgccaaacttgaggcaaaactagaaaatgtacagagatctattgacaaattggtaatgtcacttccgaatgttgagactactccgaagtccaacagatcaaagaagaagaagaggatgcttcttccactgggtgtaagcaaaagaccaaatctgataagagcaccttgcactccccact

SEQ ID NO: 46486 - DNA, 439 bp, Triticum aestivum
  Clone ID: PAT_TA_46486
cgtccggctgccccctccaccctgcctgcagcctcccctcgtctcctccgttcccgattaaaggggaagccaaaacctctcgtcgttaactccagcccccgtgccgcgccgccccgccatgtcgccggccgctggaggcgccgcgcccacgcaaccggcggccagcgccggactggcgccggcggcgatcgccgcgccgccccaggccccgtcgcgggagaacccgcgcgatccggccgcgcaggcggagggggccgatcccggcaatgcggcggcgaggaagacggcgtggaacgtgccgccgccgcccccggcccctgtcggcgggatcatgggcggcgacaagtcttggccggcactcgccgacacggccgcgcgggcgtggcccaagtgctcctcctgcgactccctcaagtgccttttcgacgggtttggcccc

SEQ ID NO: 46487 - DNA, 477 bp, Triticum aestivum
  Clone ID: PAT_TA_46487
cgtccgcggacgcgtgggttccgtccctccccccccctctctctctcttcctgcctcgtcctctcctcgtcggggggctcccctcctcggatccctcgccagacccgatccagctccgccggctgctgttgttctctgtttcttctctgtgcgtgtgggtgggtgatctaaggggttgaaggaggagtggggagtggggagtgggggagcgggcgggggatggatccgtcgggcgcgttcgcgcggagctccagcaatgtgtcgctggcgacgctggtgaggagcgggagcagcgggagtagcgggagcagccgcgggaggggcgggagccggaggatggtgcgccgggtgctccgcggcgtcatcaccttcatcttcgccatcgccggcctgttcctgggagccgtcacgggcgggctgatcggcctggccacggagagcggcctcttccgcggcaccggcatcggcgccatcacc

SEQ ID NO: 46488 - DNA, 428 bp, Triticum aestivum
  Clone ID: PAT_TA_46488
cgtccggcagcacagtgccgcagccgctgcaacacgcaaagagagagccaagcattttccctttggggggggacagacagagccgtggtaccgcggctagggatggggttcctcccgctgctccaggtcgtcctgctagtcgcggcggcggcggcgagaggtccggcggcgcatgcgtggggcgaggagggccacttcatgacctgcaagatcgccgagggattcttgacgagcgaggcgtcggcggcggtgaaggggctcctgccggagtgggccaacggcgagctcgcggcggcgtgctcgtggccggacgccgtgcggcgccaaatgccgtggtccatctccctgcacttcgccgacacccccggcgactgcaagttcagctacgccagggactgccacggcacgaaaggggagaaggacatgtg

SEQ ID NO: 46489 - DNA, 425 bp, Triticum aestivum
  unsure (1)..(425): unsure at all n locations
  Clone ID: PAT_TA_46489
cgtccgcggacgcgtggggccgccgccgctgccccacgcgcggacggtcttctcggatctcctcctcggtgcgtaagggtacggtggcaccgncaccgtcgtcacgcgcggtcggtcttctccgtccatccgttcttggggtcccctgcttctgttttcctgcccgcaagcaatccccggctcctactgaccccgcagcttcatcatcgcagtcgccaccaccgtcgccttcatgaaccagccggtgcagaagaacacccgctacataggtggactggcggatgagggggagagaagatcctgcatgcggtgttcgcgccgtcttggttcaaggagatcaagggcgtcaagaggccgctcgaccaggccacgcagaagcactgctcctttgggttctttacgttcctggagcgcgaagaacaccg

SEQ ID NO: 46490 - DNA, 386 bp, Triticum aestivum
  Clone ID: PAT_TA_46490
tttttgcttgctgaaacaaaatcattgattgaatcaaatgcgagagaagacatgacaccagcacggacgcaacggccaacggcggccaacaaggaggccgatcaatcccagacccacatttatggtacccacggcgatcatcgcaccagcaacggccgcggacacggcaggagccgccgtcgctcccgccggtcacgaggaccccgtcacggctgacggcgggcccaccggcgccgccatttcccgcgccagcgactgtggcagcgtcggatggcgatggtaccagtggcagtagcactgcatcggttgacatctcaagactgggcggtggggccccaagtgtcgggcgcccaggtggggccttcctccagctcgcgcacccagtc

SEQ ID NO: 46491 - DNA, 465 bp, Triticum aestivum
  unsure (1)..(465): unsure at all n locations
  Clone ID: PAT_TA_46491
cgtccgaaggtcgtgtcattactgttgagaagattttgttgacagcagcaggttgatgcctacagctggttgggatcaattcaaaagatacacaacctaagatcgaaacaatgctacctcaaccaaagggcaaagcgaagacgaggtcgaaccccaacaccgggaaggtatctgggcgccaaatcatcgcgtggaaggaggtattcccgaagcaggtcacctgttaggagagaccgttacagctcacgctactcgcctgagcgagaacgctcttattctccttatcgcagaggacgatcatactctcgtcgtgacaggcgtagatcatacttcccgaaaggaatcatacactccttccgacaggtcggagtctccctacgacaggcgaaggtcctactcaccgtacgacaggcgcatatcttactcaccccaccatggtcaccgncaccgtttcagatctccata

SEQ ID NO: 46492 - DNA, 472 bp, Triticum aestivum
  Clone ID: PAT_TA_46492
gcgcacgcgtccgcccacgcgtccgcccacgcgtccgggtgcccctctccgcccccgtcctcctcgcgctggggggcccccggtcgccctcggccccggcgtcctaccgcgtcctgctcgccgtcctcgcctgcgttgccctcggtgcgcttgtctccctctcctcctcggtgcccagcgggagaagcatgaggcgttgaagctactgctgctcagcgggagaagcagcagccgtaaatcgatgacgccgaccccctcctccacggcagcgccttcgtccccgacgacacccagcagcagcccactcccggctgttctgagcatgtcaaggctgaagtgtgcacttccgaggtttgatttatgggcccttttgttcctgctgattggtgtgccgattataatcatatatgtacatggccagaaggtacttagagaagatacttagagaagaggtgcatcaatatgaagtctt

SEQ ID NO: 46493 - DNA, 460 bp, Triticum aestivum
  Clone ID: PAT_TA_46493
cgtccgcaagccaccactgaaagccgggagcgggagataggggtaggcatggaaatcgacggcgatgggcgggcgccctccctgccccggcgccgccgtctccgctccccgcactcgctcctcctccccccgcatctccctccctcccacgcagccgcctctctccctcgctcgctcctcatctggcgacggcggcggcggctcccgcgcccgcgttcttcctcccaccaaccacggcgctcctccgcatcgccatggacgagcttgagctcgaggtgctccttctctgcccacgccgccgccggctccttctcccggcctgccggatcccgtcgtccgcatccccggcgtcgttgccatcgccgtcgtcctcgcgtgcactcggcaggagaagcggagcacgagtcgagtgtgccacccccgattctgcagtgcgcccgatggctgcttctgcaacagc

SEQ ID NO: 46494 - DNA, 472 bp, Triticum aestivum
  unsure (1)..(472): unsure at all n locations
  Clone ID: PAT_TA_46494
ggtccgcaacccaccactgaaagccggcagcacctcatagggatcaccatactaacccacncacacaagagcaggaaggaggttcacgcggcgactccntattccctcaccgaagtgatttggtggccccccgcatatccctccctcccacgcatccggctgtctgggtgagtcgctcctaatatggctactggggcggaacatcccattgccctcgttattgctaccaccaaccacggcgctcctacgcatcgccatggacaagcttgtgctcctaccaatagattattacacacacggagccccgatggcttgcatctggctgccggatcggggcgtacgcatcccctgcttcactagccatcgccgtcctcctcacgtgcactcggcatgagaaacagatcacgagtcgaggtgtgccacccccaattctgcaaagcgccccatggctgcttctgcacaacaatgaaag

SEQ ID NO: 46495 - DNA, 429 bp, Triticum aestivum
  unsure (1)..(429): unsure at all n locations
  Clone ID: PAT_TA_46495
gcgcacgcgtccgcgcacctctctctcctccgttcgctcttctccctcattcaccacagccacanccccatgagcggcgttgtccctgtggaggagatccatggcctcccgacgtgctcatctgctcatgtcgcgaggaagccgggggaggaggagacctcgtcgcgagggagctgcgggaggaggagctcaacccaagaggagaggatgccagccagggagtcgtcttggctcgacgtggtccttcgcgtcttgaacctagcaccgtaggcggctcgtttagtggcgcagcggacggcggcctcagcgggtgggtgacggtagccgcagctggtgcatgacctcgcatcctgggtgcgtgctcgattagctcgcgtcttcatggtcttcaagtgcgcagctcccaagatttaataagctggcttgggc

SEQ ID NO: 46496 - DNA, 224 bp, Triticum aestivum
  unsure (1)..(224): unsure at all n locations
  Clone ID: PAT_TA_46496
gcgtccncncacccttttctcctctcttaaatagaatacataatcacaagattttcacacctcttagaggggcgtccatgaggggggtgtcacacttcctccttctcccataccctaccgtcttgctcgcctgcaagttcaccgtgatggcctcctttgtggaggcttttgccgccagcacgacctcggtccttgttatcatgggcagcggattcttcggcagc

SEQ ID NO: 46497 - DNA, 399 bp, Triticum aestivum
  unsure (1)..(399): unsure at all n locations
  Clone ID: PAT_TA_46497
gcacgcgtccgcggacgcgtgggccggcactgagattccatcctcttgcatcaatccaatcctcctcacacgggcatggggagcgctagggatgtcgacacgacgacggcggcgaacaagcagcagcaggccacctgcctggcccccaaccccggcaaggccacgatcctcgccctgggccacgctttcccgcagcagctcgtcatgcaagactacgtcgtcgagggcttcatgaggaacaccaactgcaaggatcccgagctcaaggagaagctcaccaggctatgcaagacgacgacggtgaagacgaggtacgtggtgatgtcngacgagatcctcaagagctacccggagctggcccatgatggcttgccgacgatgaagcagcggctggacatc

SEQ ID NO: 46498 - DNA, 336 bp, Triticum aestivum
  unsure (1)..(336): unsure at all n locations
  Clone ID: PAT_TA_46498
cgtccgcggacgcgtgggttcatctccagcttactcctttcttccttcctcgcatanaaaacgggaggagcgctggtccgcggccgagctcttcttgagctgcttgatcagaccagtcactgcctggcctctcccacggaggaagctgccacatccatacatggaggccgaggacgaccaacctgccaccgggtaccggcacgggccgccgtgggtgttcaacggcaacgcattgtaccatctgcatatggtgaacgcggacactgcgcgggcgttcatgcccaaggagctgcgcctggtggaggccttctgctacacgctcggcggcatgttcct

SEQ ID NO: 46499 - DNA, 380 bp, Triticum aestivum
  Clone ID: PAT_TA_46499
cgtccgccaccctagcctctcccccaaccaccccctccactcccctttccttccccagtgactgacgaggcgggagaccttccgccgccggccgccggggttgagttccggcgcccgcccgcacgcacgtccgggggaggcgtggcggctttggcgtctgggtctgggttcgggttcgggttctgtgtctgtgttgtgttgattggttcgttgcggggcggagagaatcccggctccgcacgctaacaaccgcctcgccccaaggccaagcaagagatctcgccccggacgccagcgcgcggggtataagaccgcctcgtcgtcgccgtccccggggcgaattccgcgaggccgcccctcgatttcgcattgctgagatc

SEQ ID NO: 46500 - DNA, 366 bp, Triticum aestivum
  unsure (1)..(366): unsure at all n locations
  Clone ID: PAT_TA_46500
gcacgcgtccgcgcacgcggatgtacgcagtacgtgcgtgcgcgcgcatgcaaagcgcgatgcatgaggagggggcgccgcccaggaagcgcgggggcgccgtgcacgggtcggcggcgagggagcagcatcagcaggcggacgagacgtcgtcgtcggccgggccgggggcgccgtgcggcgcgtgcaagttcctgcggcggcggtgcgtgccggggtgcgtgttcgcgccgcacttcancggcagcgggcgggagcgcggcgcggcgcatttcgcggcggtgcaccgggtgttcggggccagcaacgtggccaatctgctgtcgcgcgtgcccgtggcgctgcgccnggacacggcgcgcaccg

SEQ ID NO: 46501 - DNA, 373 bp, Triticum aestivum
  Clone ID: PAT_TA_46501
cgtccgcccacgcgtccacggactcgtgggcggacgcgtgggcaccgtcgagcacctgaccacgggctgcgaccccgacgagggcgtatgctccacccacgctgccgcctcttcccccgaggagatcgcgccacccgtgcccacgcccctgcctcctccggcggcgtccgcggaggacagggtggagcgcgcgtgggctcactggaagctgctggcgtcccctacgctggcggtggcgcccatggtggacaactcggagctgcccttccatatgctgttccggcgttacggcgccgacgccgactacacgcccattctacactaccgcatgttctgcgaaaacgagaatcacagggacatggagttcactacc

SEQ ID NO: 46502 - DNA, 274 bp, Triticum aestivum
  Clone ID: PAT_TA_46502
cgtccgagcaagtgcacgaggagtctggtgccgacctgaacgaggagatcacgctgccgttgggttgggggtctagcctgggagctggacctatacttcatcctgcccaactgggtgccgatgatccacgtgtacgcacgggtcatgtcgctcgcgcctgaccgtgagtgtctaaaactggaaaatgatctgctgctactccaggacacggacatccatatgatgcgcctaatgatccgcaagacagacggcgtatctatcctgggcaactacc

SEQ ID NO: 46503 - DNA, 474 bp, Triticum aestivum
  Clone ID: PAT_TA_46503
cgtccgcccacgcgtccgcccacgcgtccgctgagcgatatagacatactcgacgacggcttccggtggaggaagtacgggcagaaggttgtcaagggcaatcccaaccccaggagctactacaagtgcacaacggtgggctgcccggtgcgcaagcatgtggagcgggcctcgcacgacaaccgcgcggtgatcaccacctacgagggtaagcacagccacgacgtgccgatcggccggggccgcgcgctgccggcgtcatcttcctccgacagctcggccgtcatctggcctgccgccgccgtgcaagccccgtgcaccctcgagatgctcgccggacacccatgctacgcggccaaggacgagccccgggacgacatgttcgtcgagtcgctcctctgctagctaggcaggctaggccgcggcccttcgttccccctgtggcgtttacatgtgggtccacgtgtacaatat

SEQ ID NO: 46504 - DNA, 417 bp, Triticum aestivum
  unsure (1)..(417): unsure at all n locations
  Clone ID: PAT_TA_46504
cgtgcgcccacgcgtccacggacgcgtgggtctggggatagattccctcctgattcatgcaatggtgggagggggggagctaggggggtggcgcgctctggtcaancaactggagaggtcaatgctacaattcactatgcatcaccttatgacccggatgggcatggcggccacacagcgtggaccgcagctggaaatttccatacaccagcaatttctaggggttacaactttggatatgcaagcgggatggcccccggagctcgtcttgcactctacaaagcggcgtacccttttggtggatatatgtcaaatgtgatagctggtggcgaccaggcaaganaagatggggtggatggtatcagtctttccatggcaccttcttcagtttcacctggccctgcaggtttcctcaac

SEQ ID NO: 46505 - DNA, 338 bp, Triticum aestivum
  Clone ID: PAT_TA_46505
cgtccgcccacgcgtgcgcggacgcgtgggcgcgcacacacagtcacgcactaggcatttcgggctgggcctgtccgtccgtgcctgcgtctgcgtgctctccggagcccacgcaccacgacgtacgcccgctttctctttctcgctccgggatggggataaagcggccgggccaatgcggcgcgcggcggccctggccctgcttcttggactacttgtcatctcgcctgcgtggggatgcggttgggccgtggggagccgctgaggaggagcgctcacaaaggggagcttcccgacagggttcgttttctgcaccgactgcggcgcgtaccaactcg

SEQ ID NO: 46506 - DNA, 472 bp, Triticum aestivum
  Clone ID: PAT_TA_46506
cggtcctcagggtcgagcacgcgtccgcccacgcgtccgcccacgcgtccgcggacgcgtgggtgatccgagccctgctcggactgagaagagcagagcgaattgttaacagggctaccttcatcataagtgctggtacaaatgacatgctcctaaactacatcgcgtcaaaccgatcagctggccccatcgccatgctgcggtacgagaaccacctgatagcacgcctcggcaactatacccaggtgatgaggatgcttggagcgagaaggtttgtgttcgtcgggctacccccgatcggctgtctaccgatcgcaagaacattgctcggaagggatccagatggatgcgacagcgacctaaaccagctggcggcttccttcaactcgagactggttcagctgtcgaaattcgtcaactaccagccccgaatgaagagcgcctacatagatacctacacaatcatacgggc

SEQ ID NO: 46507 - DNA, 387 bp, Triticum aestivum
  Clone ID: PAT_TA_46507
cgtccggacggatccgcctcctctcgtctggcctgccgtcggagctcgcccacgaagccgacattcaggtcccactcatcaggctgccttgaagcttgccccgcctccggctgcctctccgtccatgggagctcgcccgcgaagccgtgttcatctcctactcatcaggctgctgggagctcgctaactcggctggttcgcacgcaccgcacaaggacaggtgccggcaccggagcagcacaaacgcaggcgtccgaccgcgacggcacagggaggttgcagcagctggtccagcgtggcgtggaggccgacggcgacgacctcgtggctcttggtgacgcctagccatgcctggcccactgccgaagcctctcctcctggtcgacg

SEQ ID NO: 46508 - DNA, 317 bp, Triticum aestivum
  Clone ID: PAT_TA_46508
cgtccggcctccccgacagtctcgacagtcaccggcggccgcctagctctaagccactcgccgacatagctcggcaattgcgatcaggggggagccggggtcttactgtttggttcagacccgacgaagaggttgcacgtggcccttacggggaccgatgcactgaacagccaatggcagtcgcggataatggactactggtacaagcaaatgatggtgacggctggctcggatatgggcagcttcacacggatccttcactccggaaagccggatggtttgatggatgatataacgaccttaattgttgaccccct

SEQ ID NO: 46509 - DNA, 181 bp, Triticum aestivum
  Clone ID: PAT_TA_46509
cgtccgtttgattgtaacattaaactaagtttagttagtacttgagaaatgatagttcatagtggaacaagaggtgcttcagtttaattaagaaatgagaaagttgcattttggtgcaaaaaaaaaaaaaaaaaagataactaactatacagagaacaaacatacaaaaataaaataaaaa

SEQ ID NO: 46510 - DNA, 450 bp, Triticum aestivum
  Clone ID: PAT_TA_46510
cgtccgcggacgcgtgggcggacgcgtgggctggaagagcaccactggactgggagacgagagtgaagatatcgctcggcgccgcacgagcgatcgctcatcttcacaccggagcaggcggcaagttcatccacggcaacatcaagtcgaacaacatcatcctctcgcgggagctgagcgcgtgcgcctcggactttggccttgcgcagctcatggccacccctcacttccacccgcggcttgtcgggtaccgcgcgccggaggtcctggaggccaagaagccgacgcaaaagtctgacgtgtacagcttcggcgtgctgctcttggagatgcttaccgggaaggcccccctccggtcccccggccgcgacgactccatcgagcacctcccgaggtgggtgcagtctgtggtccgggaggagtggacgtcagaggttttcgacgtcgacc

SEQ ID NO: 46511 - DNA, 445 bp, Triticum aestivum
  Clone ID: PAT_TA_46511
cgtccggtggataacaaggagattatcaaggcggagcggcggtgagtatggagctcataatcatcagttcatcaccatgaagcagaaggaatggtatagctttgccatgctggactttggcagccgctgctcctcggcaatcaacaggaggtacagccgctgccaccactccttcgcagcgacgcaggccagcgacgaggaggctcgcaatggtgggggacacatcaccatcttccagagaggagaaaggcatacctaccccttaacgattgaaatgcaggtccagggaaaacatctgtactactattgggccaattgatgctaggtgtacattgagatgttttagaaaaatagatccttgatgccggacatagtgcaatggtgagatccacttatttatgatggcgaggatgattgttaggctggcatgtggagctgtactaat

SEQ ID NO: 46512 - DNA, 290 bp, Triticum aestivum
  unsure (1)..(290): unsure at all n locations
  Clone ID: PAT_TA_46512
gggttccgggctcgacccacgcgtccggcggggcaagatccgactgctaganaggagaaacgtgcggcggtagtggacgtacagagcccggcggaaatcggccggcgcgattgaggtgcggattctcctcgggcgggctggttccgggtggtcggatcgaggcggccctcaatctcggaggacctcgattcgattcggcggcacggcccgtgccgctgttgattaatccatttggctccatggatggataggccaggctgngacgtgatctccttgcatggttcatcctt

SEQ ID NO: 46513 - DNA, 148 bp, Triticum aestivum
  Clone ID: PAT_TA_46513
gcctacgacctacgcgtacggggacgcgtgttttccaaagagtataagaaaatgaactttctatgtgtattatggcagccaatacaaactacaacggctctgttgtgtttgtggtatatattatacataaggctgactggtgggatga

SEQ ID NO: 46514 - DNA, 446 bp, Triticum aestivum
  Clone ID: PAT_TA_46514
cgtccgcggacgcgtgggcgcactcgaccacaggcctctcgctcccgcctagggttcctccagcgccgccgccgccgggcctctgctcctcgacgcccccatctccggcgacatagccgacgggtaggcctgcatctcccaccccagctgcctcgggcgctttccctccctcccccggtgtctagcagcagctcctggcctggtccagccagggatccactccggtggacgacgcccactctggtcgacgtgccactccggcgaaggacccccgctcccctcccctcctccctggccgtgagcccgagcatcagctatgagctcctcttattttgattttgcaaaattttcatgtagatttgctatgaactgttgctgatgtatgttggttttatcttgatttgctacgaggtgttgctcatatatggcaagaactaattttatat

SEQ ID NO: 46515 - DNA, 182 bp, Triticum aestivum
  Clone ID: PAT_TA_46515
cgtccgggacatcatggtcaacttagtcggcaacaccaccttagacgagaggtatgttgacgtcaaggatataatcaccgttaggccgaaaataatcatgagcatagtaaactcgtgttgaaggatcctacaaaggataagggcgataaaggaggacgtcaaaacaatagtaaggcttatta

SEQ ID NO: 46516 - DNA, 261 bp, Triticum aestivum
  Clone ID: PAT_TA_46516
ggcctagacctacgcgtacgcgtgggggaccgagagagagcgctccaccggctgccccgtctccgatggccacaccgccggctccggtgccccaggccaccggcaactacgtgccgacgcctacgcagacagccggcaaggccccacccttgtcccagcccacgtatactgccggtaccctaaagacggagatccctcccgcctgcacctgcgacgacaccgacgacggagttgccgccgagggagcctcagtcgaggact

SEQ ID NO: 46517 - DNA, 404 bp, Triticum aestivum
  Clone ID: PAT_TA_46517
cgtccgcacaaaccttagcagaccgttggagcccttcagcgtcgaccggacttaaactgtgtccttgcttctgcgaaccaagatgaagtacattggtgcctatctgcttgattacctctgtgactaccccaggcactgtgcactagaccttacatacatactggagtcacttgctagtaaaactgactatgaccagatcgaactgatgctgtgccaagcgaagggcaaggacatgaccggaatcttcggtagcttgggggagaaacccgcgccatttaactcgctggcatgtggggctctcgctcaacagctgcccatactgctggaggcgctggtggccctgcagcttagtcaaaaaaagaagctattgtcgacgcggaagaagagtgagatgaacacatggc

SEQ ID NO: 46518 - DNA, 439 bp, Triticum aestivum
  Clone ID: PAT_TA_46518
cgtccgagcagggatcatcatttatgccggaactaacctagtatggcaaaagaccatggggtccaggggcatgaccatcgcgctcgtcaagtgtctgcgtcagcgtacttgccgtgaagatctacaaggagtacggcatcacacaggacaacgtcatggtgcgtgccaaaaccctataagatcatgacactctgcgaggatctgtcatccttgatgccaaagaacaaacaccacatttgtgaaggtctggtgcccataagctttgaaataacggagggagaggaggatatgactaccacggtacgttagtggtatttcatggcatataataaacaatgccttttagatttgcctaagattacattcgagatatatcgcgactaataaatgatgcggggatgtggggagcctgttcaaaatgtggactggttttctgatt

SEQ ID NO: 46519 - DNA, 342 bp, Triticum aestivum
  Clone ID: PAT_TA_46519
cgtccgcggacgcgtgggtcaccacttgcaacaggcacctgtggccatcaccaaatagtttctcggtctgttttgtttgccaagttccgtcgacgccgccaaaggaaatcgatcgactggtcgctcggtcaagccagcttcacgtacggagtctgcgctaggcacgtacgttggaaatcaatccacctgctagctagcttgctagctagtcgcacgtacgcgtatctacagagggctgtgagggatcaaaagctatagcacactccttgtcgacgtcctcgtccgtgatggcctgccacactataagggttgggagaatgatcttcatcttcaccgtccaca

SEQ ID NO: 46520 - DNA, 246 bp, Triticum aestivum
  Clone ID: PAT_TA_46520
cgtccggacaatatcttcttattctctagcaagcgactaagctaggcttggatgctaccgggggtgcttgtcaccaggatcagcgtgcatagccaccgagaagtcttcgatgcgggcaccctcaacgcggtcctggtccagttaatctgcacgctcatctttgacttcaccagccatggctttcacatgcacttcatcaagttgaccccctacagcgctggcaccggcgattgcctgatctttgct

SEQ ID NO: 46521 - DNA, 336 bp, Triticum aestivum
  Clone ID: PAT_TA_46521
cgtccggccatcgtggccgcgtccaacgacatccggtcgaagcggcggatggcctgcatccggcaacggaaacgccggagtccacccactccatggcggcgacgagtggtgaggcggtagccgtgaccgtcctcacggatgaggcgaaggaaaaaggagacgaggcctggcatctcaccggcggcgagtcctcctttccttctcactttctctgttttcttttgctctactctggtaggcaagtgctgataacatgttgaagtagaaatcgagagagagaatcgaaagagatgtaaatgaatcaagtgtatccttattgcatcagattggttacat

SEQ ID NO: 46522 - DNA, 372 bp, Triticum aestivum
  Clone ID: PAT_TA_46522
cgtgcggggacgcgtggctctttacctacccacctgtgtcggttgcgcgtacacggacccttttgttgaaggtacatacagcttttcctgggagtatggcatgagctacatacttcagcgccgtatcgcctggtatgagcatactggagaagcaatcgcttgtgcactgggatcatacttcaacgcttcatcgcttgctactcggaccttggataaaggcattttctctacgtctttttaccctgaaaaagcagggtgatattgtgtccttaaacctatatccatatttacgctgacctagcctgctacgtcgctccgtaccaactaggggtcgtacaggaatattgacctgttgtccatcgactactcctt

SEQ ID NO: 46523 - DNA, 371 bp, Triticum aestivum
  Clone ID: PAT_TA_46523
cgtccgcggacgcgtggggtcaaactcctagccgcggcggaccggaccgatgcgtccgtggttccgctagaacacctgcaaaagtccaaccttggcgcgctgccgtactggaacagaagaaccgcggtctcctaaggcgttatacatacccaccgaagacgtggtgtgcaacctgtgatcagacttgttcgccgacgaatacggatctccttggtcatgagctgacgctgttcatcatgcttttctttcacatgtatgacataaacaacatatactacacgactgtgaaggacacgcgcacgaaggagaggatggactctgttaaatcttaccacattcttggcacccataatgggctatgttgtgttgac

SEQ ID NO: 46524 - DNA, 193 bp, Triticum aestivum
  Clone ID: PAT_TA_46524
cgtccggtcagggtagctaccctaatcttacggtcctgtcatttgtccttgttggacgagaaggcgatcgatggcgtcatacttgatgggagatacgaccgcgctggaccgtgatggcggtggctgagacagtgctggcggcgcactactagcaatcggctgacatgagcgtctgcgcctactaacaccatct

SEQ ID NO: 46525 - DNA, 155 bp, Triticum aestivum
  Clone ID: PAT_TA_46525
cgtccgaccgggcgtacgcccacgcgtgcggccacgcgtgcttccgggtgctcgtcaccaaacctgcctccaccctcgtctcacattcagggaaggtgtctttgccgcgcggcaacgcgtatcatggtgatgtggatgttaaggccacagctctg

SEQ ID NO: 46526 - DNA, 449 bp, Triticum aestivum
  Clone ID: PAT_TA_46526
cgtccgcccacgcgtccgcccacgcgtccgttttttttttttttttttttttttaacagcaaaatttggttgatttctactgaagagaaggaaagaacagagctacatatgtattcggtcggtcgattctactagtgaggagtgagaagaaagagctacatccgcattgagagtacaaggtagtaagaacaaaagaatcaacccagccggccaggccccggcgccgggctctccatgtacaacggcacgccccggcacgacgccggcttctttcgacacgacgccacctccctccctcccgtttcctatgctgtatttacactgcaccgcggtctcgctcgctcgcggccaaaaagtcgtccattccacttctgtcgatctcggggtctctgacggtctctgtctttgctctgcttaaaacggggccggcatgccgccggcgccgggct

SEQ ID NO: 46527 - DNA, 422 bp, Triticum aestivum
  Clone ID: PAT_TA_46527
cgtccgcggacgcgtgggcggcatctccgtcggagggcaggtcctatgcatccgatcctgggacttcggcatggacgacgcggggtctggcggggtcattttggactgcagcacggccgtgacgcggctccagtgggccgcgtacgcagcgctccgataggcgttcgtacagggcacgcaatgcctccaccgagcgtccggcatatcgatgttcgacacctgctacgacctcaccaagcgggataacgtgcaggtgccatcagtggctcttctgttagagggcggaagtgagctgaagctgccggcaaaaaactacctgatcccggtggacggagcggggacctactgcctggcattcgcggtgacgagcggtgcccagtccatcattggcaaaatgcatgcatcaaggcgtgcgcgtcagc

SEQ ID NO: 46528 - DNA, 274 bp, Triticum aestivum
  Clone ID: PAT_TA_46528
cgtccgcacgttgccaccctttttttctcccttacccatccccatctttcgtccagccctgcacgtccgctggcccctattgccgaggaccccattcgccctgcggcgccggcgacgataacgttgacactacccgcgaatctgcttcttcccaatggcggaaaggaggcatggaactccagaggctgattaaaggaatgggcctaccggggacaaaggcccggctttttggggaaatcttttcaaccaaggtggggaaaaaattcccgccaac

SEQ ID NO: 46529 - DNA, 448 bp, Triticum aestivum
  Clone ID: PAT_TA_46529
cgtccgcggacgcgtggggtacatacgcgaatactcgtcacatatccgtacatactttaatactctcaaactgtgacgtacacatacatacctgaataactgtgcaatttttttaattcagctaaataggtctactgagtgtcaacttcggcaaaggctggcgcctttgcctagtgttgctctcggcaaactacgtccatcagattgggtagtagagattatgaagagcaacacggacatctactttactcacgggtaatgtaggtgtaatacatagtgcttttcatggcaagggttctactaaatatatgatcatcatagtgtagtacatcccaataatcactatgaaaatatagcagatgcttgtatattcattccactttaattcttatattctcggatctcaagctcatctgctaagttgatataatcaaatgggtgatagcat

SEQ ID NO: 46530 - DNA, 347 bp, Triticum aestivum
  Clone ID: PAT_TA_46530
cgtccgcggacgcgtggggcagcagcgatgcccgccaccatgccgctgaccatatccccaccgtgcctacttcaccggcaccacggccgagccacgctccagcagcagcgccccaccgcccgcctcgcgctcctcccgcgccgcgccgctcggatccgctgcgcccccgacgaggtcgcggccacagccgccgagccggagcagcagggggaggaggaggagttcgtgctcctcgcctccaaccgcagcgacttcaacgagggcatgatggtcatcgactcgccctccaaccgctacctcgtcctcgaccccagccggaatgtgcacaggattcttcccaaagaaga

SEQ ID NO: 46531 - DNA, 413 bp, Triticum aestivum
  Clone ID: PAT_TA_46531
cgtccgcaaatagttgcttaataccacgaacggaaccaccagccctggcagagccatggtgctcaggggagacatcactgcgaccaacgtcgacagtgacatgaaccgccctgacaacactctgctaaagagcgacgcgctctatacctacatcctcgacaccaatacgttacaacgctagcacgagtgcatgcacaatctgtgactgataagggacaagcacccatggggctacatgcagtacttactaagacgaggcgcagaatgctggggatgctgatcaagactgtggcatccaagaagacgatctacgtgggcgtgttcacggactactcgctgctggccatcatactggctctcccgcaagacgggcacgtggtgaacataaactccgaccgatagtgctacaaagt

SEQ ID NO: 46532 - DNA, 212 bp, Triticum aestivum
  Clone ID: PAT_TA_46532
cgtccgcccacgcgtccggtggctcgtcaaggtgttcgtcatactggttaactccactgagggaggtgataacgtgcgagtcgttactgacggctaacgaacccgacactcctacagcgcaaatcgagtacttcaaaggactggacatgttcctcaacaaaaccgtggaaggggacgaccgatcagtggtgtaactgtgcccggaaatgctg

SEQ ID NO: 46533 - DNA, 440 bp, Triticum aestivum
  Clone ID: PAT_TA_46533
cgtccgcccacgcgtccgcccacgcgtccgcccacgcgtccgcgaaaaccgaacgcgccattccaaatccccaaaccccccaaccgccccgcccccctcgacccatcgccgcccccatggcctcgaccgccccctccgccgacgccggcgacgacaagcccccggagatcgccccgcgcagccccgccggccccgatccccacaggaatatcgggcccccggcgccgccgccctctgcgccggtgacgtcgtcgggcgatggtggtgcgtcggtgacggggacgatggaggatttctacccgctgccgctgtgggccttggaggagcgggcgtgcatctcgtgcgcgcgcaagaagatgctccgcgagaagtgggaggcggcgcgcggcctcgatcccctggcatgtccccgaagtgacgacggggtgccatcgtcgtcg

SEQ ID NO: 46534 - DNA, 306 bp, Triticum aestivum
  Clone ID: PAT_TA_46534
cgtccgcggacgcgtgggtgaggggtttcgcgtagaagtgccaccttcgcccatccacttgttcctctgctgggcttccccgccagacggtggtggcacgagtctactcaccgtgccggcttgcttcctatccccttccgagcatcagtagagcgccctgcctatatttaatccatggggaaacgattgacttaagtcatggatgggaacaaactatcaagccttgaagtgtgataagcttgcacagactgcgctagcatctggagattgacagtctgcagacaaatttatccgaatgtgccaaag

SEQ ID NO: 46535 - DNA, 401 bp, Triticum aestivum
  unsure (1)..(401): unsure at all n locations
  Clone ID: PAT_TA_46535
cgtccggcaggatttgttcccatcgcatctcccgctccgccgccgccgccgcccccgacccgcgccgcccgcacgcccgcacgccgctcctcctcctgcgcctcccacgccgtcccctcggatgcatcgcgcgtccccctccgccgccccgctgctcctccgccgcgcgtgcccgcctcctcctccgcctccgccgaggcggcctcgttcttccaggcccgggagaagcccgtgaggttactgtattgcaagcccaggcagcaatccggctgagctcacccgcccacatcaccaggggtcgtccggccaccaccgcgcgtngccggtcgtgtcactgccgccgcttctgctgcttatgagagccctcactgccgccacaatctccttcccgatacgcgccc

SEQ ID NO: 46536 - DNA, 420 bp, Triticum aestivum
  Clone ID: PAT_TA_46536
cgtccgcggacgcgtgggtccgattcgaaatactccttccccagctagggttttgctgcctccgccgccgcctcccgccagcgtcgtccccccatggcgctgccgaaccagaacaccgtcgattaccccagcttcaagctcgtcatcgtcggcgatggcgggactggcaaaaccacttttgtgaagaggcatctcactggagagtttgagaagaaatatgagcccactattggtgttgaagttcacccattggatttcaccactaactgtggaaagatccgtttctactgctgggacactgctgggcaagagaagtttggtggccttagggatggatactatatccatggtcagtgtgcgataatcatgtttgatgtcacttcaaggctgacatacaagaatgtttctacgtggcacagg

SEQ ID NO: 46537 - DNA, 425 bp, Triticum aestivum
  Clone ID: PAT_TA_46537
cgtccgagccgtgtttgtctcgtcacttttctacctttgaaaattttgatgcctatccagtcagtaatgcaatttggcattctagggaagtcgacatgaaggatcttggagatcctgtcaatttctttggcaggaaccgaatgtttgattcaatattatacaacaagcttgtaggcagacctaaaagcaaggacggaagggagatcaatccgtatcttgccaagatcatcaagatgaacccaagaatggtgtctgaaatatttgcttatgcactgagatcgttggcggttattactgtggaaaaccatcggatgggggttcctttaggtgctgctgtgaagctatctaacctgaggatctcttattctcatggtaagtttgtcttgctcaatatcctgccaaagtcacccggctacaagggtttg

SEQ ID NO: 46538 - DNA, 333 bp, Triticum aestivum
  Clone ID: PAT_TA_46538
cgtccgcccacgcgttcgcggacgcgtgggcggacgcgttagatttttcctcacatgcgcccgagatcttattaggcgtaaactggcgatatccctgaagatctattgcgctgcagaagcctccccaatttgatggacaattacactcgtttatgattgattcatccctgtatataacatgagcgtatcttttttctttaatggatactgtcgttctcgaaatacgttttcgagatctaccattaacacgaaattgctcaacatctttagcctgaggaggcttttaggacagcaaacaaacccaattgacttatacacagcatctatagcatg

SEQ ID NO: 46539 - DNA, 422 bp, Triticum aestivum
  Clone ID: PAT_TA_46539
cgtccgcgctatcctcgtagtcttatccagttctctggcgatggcgatggcgatggagacggcgacgggtttctctggcgacggcgacggcgacgggttgagggctacggggacgccgcggcgaggaggggcaggtgctgcggagacggcgcggcgaggtggggcagtggcggttgtgcggcgaggcggggcaggtgctgcggagacgtcgcgcggcgaggcggggcagtggcgtcgcgggcgaggatggaggacgccggagcagaggacgacagctcccgccgtcgcttctgtccgcgcacgcccgcgtgctcgcctccgtccgcgcctgcgccggagcgctgctttctgcgcgcgcccacgtgctcgcctacgtccgcgcccttcagctcgcctctgtccgccacgccctttagctcgcc

SEQ ID NO: 46540 - DNA, 425 bp, Triticum aestivum
  Clone ID: PAT_TA_46540
cgtccgcccacgcgtccgggcgtacggggtggtgttcgcggacccgctgggggtgcagcaccgggtgtacctccgggacgggggcaagaacgaggtgatcctgtcggcggggacgctggggagcccgcagctgctgatgctgagcggcgtgggcccgcatgtgcacctggaggcgcacagcatccaggtgctggtggaccagcccatggtcgggcagggcgtggccgacaaccccatgaactcggtcttcatcccgtcgccggagccggtggggctgtccctggtgcaggtcgtcgggatcaccaagtccggcagcttcatcgagggcgtgagcggctccgagttcggcatcccggtgtccaacggcgcccgccggctggccaagcttgggctcttctccccgcagaccgggcagctcggcacgc

SEQ ID NO: 46541 - DNA, 379 bp, Triticum aestivum
  Clone ID: PAT_TA_46541
cgtccgcgacgctgcgatccagtggcttgacgccaaccagcttggtgaggttgacgagttcgaggacaagatgaaggagctggagggcctctgcaaccccatcatcgccaaaatgtaccaaggcgctggtgctgacatgccgggaggcatggacgaagacccgcccgctggcaacggcggtgctggccccaaaatcgaagagggcgactaaggtaggcgcttttatatacgccatttgattcaatcctgggtggccatcatattacctgggctggaaggtttggtggacttttgggctgtagcatcaatggcgtaaacaaagcaaagaagccaggtttggcttaatggtgaattcaacttaaaggctattgtgtgtgcc

SEQ ID NO: 46542 - DNA, 324 bp, Triticum aestivum
  Clone ID: PAT_TA_46542
cgtccgctcaggcactgagataccattctgttgaatcaatccgatcctccttacacgacgaccatggtgagcgctaggggtgttgccacgccgacgagcatggaacaagcatgagcatgccacgtgcctgacccccaaccacaagaaggacacgatcctctgcctgggccacactctcccgcaggacatcatcatgcaagactacctcgctgagggtttcatgatgaacacccactacaacgaccccgagctcaaggagaagctcaccaagttatgcaagacgacgaccgtgaagacgatgtccgtgctgatgtcgaacaagat

SEQ ID NO: 46543 - DNA, 412 bp, Triticum aestivum
  unsure (1)..(412): unsure at all n locations
  Clone ID: PAT_TA_46543
cgtccggccccgtccaccaacccactcccttcccctttctccgtcgaggccctgctccccgctccccgccgccgcctcggnccgcgcccatcgtcaccaccttcacctgcgcgcctccgcggccggcccctcttctcactgccgcgaccaggcaccaccaccacctnccactgtcgcgaccgcacgccaccactgtcgcattggagtgtcggcgaccagcaagcaaagcaagagcgagagctgggagcagcgccatctatgccacctagcggggaagagctagaacaagaaaagcgttgttgccaatggtcaaggaatcgggccgcgaatcgtcggcaaatatcttgaaattaaacccctaaaaatgtgtttttccactcaaatctatggttctacccgatagaggcgggaa

SEQ ID NO: 46544 - DNA, 394 bp, Triticum aestivum
  unsure (1)..(394): unsure at all n locations
  Clone ID: PAT_TA_46544
cgtccggtgaattatgcgaagagcacgcttgacgaatagtttgggtagatgaaatccagcttgtagttgctgttgtataaggtaaaagaagggccgtatagactgttgtacagtggactgcatatcaaagcctgctcttcagcccattgttctcacattttaggagtgatgatgtacatacgaatatactcagtatttctgaatgtcaaggagaatactcgttctccccaaaaaaaaaaaaaaaaaaaaaaaaaaaaaaaaaaaaaaaaaaaaaaaaaaaaaaaaagaaaaaaaatgttaaaaaaaaaaaanattaattaaacataaatggggcggccgatcttgtggtatggaggtacctaaattaaatttgctggccctggcttttcatttt

SEQ ID NO: 46545 - DNA, 351 bp, Triticum aestivum
  Clone ID: PAT_TA_46545
cgtccgtcgagacaatggtgagctcagccaagggcaaagtgtgtgtaactggggcctcaagctttctcgcctcttggctcatcaagagacttcttgagtgtggatatcatgtgatagggacagtcagagatccagggaatcggaaaaaagttggacacctttggaaattacctggtgcaaatgagaggctccaacttgtgagagctgatttattggaggaagggagctttgatgatgctgtgatggcttgtgagggtgtctttcacattgcatcacctgtccttggaaaatctgattccaattgcaaggaagcaacacttggtcctgcaattaatggtaccctaaatgtgc

SEQ ID NO: 46546 - DNA, 410 bp, Triticum aestivum
  unsure (1)..(410): unsure at all n locations
  Clone ID: PAT_TA_46546
cgtccggtgattagtgaagctggtacgtaacacaatcctccattgaagaccgactgttgccttctacatgaaccccctccccagcagaagatcctcggcacgaccttcttcttccatcccgacacgagctcgaaggagatctcgaggtgcagcggtgtgagcacggcggctcccgcagcgacccccatctccggcgtccgctcctcccaaaaattctcttgccacggataagatttttgccctctcctcaccactctcaatttctattctgctaggcttccagctcatctgccaagagagaggtgtaaacgaacaattatacgtagacagggatagtgcaagaaaggattagtggggattgggtgacggngtgaggatcacccaaaccctgcgtggattgaatccactag

SEQ ID NO: 46547 - DNA, 412 bp, Triticum aestivum
  Clone ID: PAT_TA_46547
cgtccgcccacgcgttcgcacaagctcaagaagcctactccagcgtttgagaggacaacggtcgaccgacgacgcacgatggcgccgagcaccgtcccgcgcgcgctcctggccgtgtccctcgttctcctggtggtcggcggcctcgggccggcggcggaggcgcagcggccggggggggtgcgtgccgcagctgaaccggctgctggcgtgccgcgcgtacctggtgcccggcgccgccgaccccagcgccgactgctgcagcgcgctgagcttcatctcgcgcgactgcgcgtgcagcaccatgggcatcatcaacagcatcccctcccgctgcaacattggacaagtcaactgctcggtttgagtcgtaacgaagaaacgatccaggttacagagtgactaataatga

SEQ ID NO: 46548 - DNA, 371 bp, Triticum aestivum
  Clone ID: PAT_TA_46548
cgtccgcccacgcgttcgaggactcgtggtcggacgcgtgggcaggtcaattgggctgatagtacacctaagccatatttggctccattgccaaccgccagcgtcaccacacgcgtgcactattgcgctgtcgaaccagaacagtggtgattaccccagcttcaatctcgtcatcgttggcgatggcggtgactggtaaaaccacatttgtgaagaggcatctcactggacagtgtgagaagaaatactaacccaccattggtgttgaagttcacccgttggatgttaccactaactgtggaaagatccgtttctactgctgggacactgctgggcaagagaagtttggtggccttagggatggattctat

SEQ ID NO: 46549 - DNA, 144 bp, Triticum aestivum
  Clone ID: PAT_TA_46549
cgtccggccacgcgcgcaacgtggtgaccgagagcgctaccggaaccaacacggcgacgcagctagctagcaaagccatggggtccttgccgccgggagagaggccgcacgccgtgatgatcccctacccggcgcagggtcaca

SEQ ID NO: 46550 - DNA, 194 bp, Triticum aestivum
  Clone ID: PAT_TA_46550
cgtccgctccacttcactccactccactccactgtaaatctatctgtgtgagggaagcaaggaatttgaagtcgacatgaggagctagggtgagaagcgaagcaagcaggcgacgcaagatcgacagccctcaccactctcacggtgctaggagggacgatgccgctccacctgctgctcctcctcctgctcct

SEQ ID NO: 46551 - DNA, 148 bp, Triticum aestivum
  Clone ID: PAT_TA_46551
gacccacgcgtcccgcatccagtagttctgcgtgtgggtgtggctgcggtatgtgccgagccagagttcgtgctcaatagaaaaattgagctgttcgtgcagccgaagcgccgttcgtgcggcagggcgtatgtgcgccggaaatatc

SEQ ID NO: 46552 - DNA, 382 bp, Triticum aestivum
  Clone ID: PAT_TA_46552
cgtccggtcccgatcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttc

SEQ ID NO: 46553 - DNA, 335 bp, Triticum aestivum
  Clone ID: PAT_TA_46553
cgtccgcccacgcgtccgcccacgcgtccgaccacgcgtccgcgccgtccaccggccgacgcgatggccggcgccgcctggccggtctgcgacgacgcggacctcctccacgcctacctctagctgaccctgctgctcggctcactcgtcatcgtcctcgtgctgggcgtaaccagcgttttattacgagcacattacataagatcagatgcatgcactcactgtagagcgaccgccagctaagacgcattaattgaagaccaaggattgctcaacaatgttctatggccatagagattcgaccctgcttagaagtacaaacccatgatagagcc

SEQ ID NO: 46554 - DNA, 401 bp, Triticum aestivum
  unsure (1)..(401): unsure at all n locations
  Clone ID: PAT_TA_46554
cgtccgcaaggtttcagagatcagatggtggcatccgtgagaggcttctccggttccaagagcaacgggctcttcataaactcgtgtttcgcccactgccagtccgaactgccggccacctggaatggcacccctgccattcagaacaagaggatcgcgaaatctgtcggcgattggtactttggccgggccgaagtgaaggcgatcgattgcccatacccttgcgacaacacatgccgcaacatcatataagaagatcttgcaagcaagggccgattcgaacctcatgattaggatttagaactcgaggcaattatttgttagtttttcataaagacttcacttcaggccggatgatatgtctttgtgtatgatgtaattatgaaggtctcctcnnnnna

SEQ ID NO: 46555 - DNA, 447 bp, Triticum aestivum
  Clone ID: PAT_TA_46555
cgtccgcccacgcgtacggccacgcgttcgcaagactacaaccattaggccgttgctagatggaggtggagactgtgatgcctcctccggcggccgggctggaccgcgtggactctgccgcgcgggagccgactcacacggagtccttcttgccgtccccggcggctggaggcggcgcgaatggcgcggcgaccaaggtgcagaaggtctaccggagctaccggaccaggcacaagctcgccgactccgccgtcgtcgtcgaggagctctggtgggaagcgctggacttcgcgcggctaaaccacagcaccgtctccttctacgacgacccggagccggagaccgccgcctcgcgctggaaccgcgtcagcctcaatgcatccaaggtgggtcagggtttatccaaggatgccaaggctcttaagctggctttccagcactggatcg

SEQ ID NO: 46556 - DNA, 337 bp, Triticum aestivum
  Clone ID: PAT_TA_46556
cgtccgcggacgcgtgggcggacgcgtgggtaggattccggtcctattgtgttggccttcgggatcggagtaatgattggcaatggggcttccatctttaccacatctggtgtctcagcaaggaaatttcagacggacattgaagctggccaggtgggtatcaacgtgccgatcccagtacccctgccgttcttctccttcacgggcagcaaagcatccttcgccggagacttgaatttctacggcaaggcgggcgtgcagttcttcacccagattaagaccatcacgcagcagtggaaggagtcgtctccccagcgcgtttctctctccatgccca

SEQ ID NO: 46557 - DNA, 418 bp, Triticum aestivum
  Clone ID: PAT_TA_46557
cgtccgcggacgcgtgggcaagtacgttgatactgccctctatgtattgaatccaaggatttttttaatatatattctttttgttaatttcaagggaggaagagaactccagtactatggtaatgatcttgattctgattctccatgattgataatgttgtttaggaccctaagctttgtcatggctgatttaaataggcacagctggtttagaaggaaagcactgctactaattttagaactaggatgtcgtatttgacagctgtcaggtattgcttatttgcattgtaagatcacaattctaaggttaatctttttagttgtgtagcattgcatatttgggtccttgaattctctcctcgaagatcaacacatttggtcagatttggcttatttaataattagcaaacaataaata

SEQ ID NO: 46558 - DNA, 402 bp, Triticum aestivum
  unsure (1)..(402): unsure at all n locations
  Clone ID: PAT_TA_46558
cgtccgcggacgcgtgggttcaaatctccggaccaccagcagctaattagccctcctactgcccctccgggactgagattccatcctcttgcatcaatccgatcctcctcacacgacgaccatggtgagcgctaggggtgtcgacacgacgacggcggcgaacaagcagcagcaggccacgtgcctggcccccaaccccggcaaggccacgatcctcgccctgggccacgctttcccgcagcagctcgtcatgcaagactacgtcgtcgagggtttcatgaggaacaccaactgcaacgaccccgagctcaaggagaagctcgccaggctatgcaagacgacgacggtgaagacgaagtacgtggtgatgtcngacgagatcctcaagagctacccggagct

SEQ ID NO: 46559 - DNA, 359 bp, Triticum aestivum
  Clone ID: PAT_TA_46559
cgtccgtgtagataaggctcgtcaagagcagcaaccatcatcagttcagagctcagaggaggcaccacccagcacactccgaatctgatctgacgcccaaatgaaaccgccgccagcggcaagagccagtggatgaagccctccgtctccatggaggaagctggcggcttggatgctgcaagcctggcggaggcgctgcggctggtcctctcggcgtttcgggccatggagggactggccgccgagatccactcctgccacaggacccgtcggaaatgggagctcacgaggtgccgctccaaggtcgccgaccccgagctggaccttctcatcgcccatcttgttcagatctggagcat

SEQ ID NO: 46560 - DNA, 350 bp, Triticum aestivum
  Clone ID: PAT_TA_46560
cgtccgcccacgcgtccgcccacgcgtccgggtgattagacaaggaattcctgtttgcattcactcgctgggtagggattggcgaaaatgaggacgacgatgaatgaacgatgtggaagcgacagctgaagaatggctgactataaattggttgcatggtggttttatcttcctgttaatagtgactcggcatgttccaaatagaatgactgacatgtctgaacacctgtatcaaacagtgtctgtgactgcttcgcctccactgcgcaagttatgttgggtaagcaaaatattgacaacattgaaatcccgggtctaatcacccgtgttaatttggtcttgcgtagctt

SEQ ID NO: 46561 - DNA, 294 bp, Triticum aestivum
  Clone ID: PAT_TA_46561
gttgaggccgccaccaccacaaacgctcgctcgccggcttccccacactcgatagtggaggggataaccgcatctccgtcgagcacgatggccgcccttctcctcccagtctcctcccgcctccccaagagcacggccatcgcctccgcccgccccacaccgcgcttcctctccttccccctcacaaccgccaagccttgccgccgccgcgggggatgtagtatcctcgcctcctctgcgacgtcgccctccccggtcgggggcgaggcccaacctttccggttccttcccccc

SEQ ID NO: 46562 - DNA, 370 bp, Triticum aestivum
  Clone ID: PAT_TA_46562
cgtccgaggaagtccctctgccctcttctcttgtccaggtcgcgctccctgctcgccacgatctcctccaccctcgcccgcagtcggtcgttcgtccgcgcgatcctccggtccgccgtcccggggagtcgccggagaagcccccgcgccggcccctgcagcgccggcgcgacgaggcccagcacaatggagagggacgccgacaggtccatcttgagcgaggtggtggagtggacgtgctcggccataaactcctcggcctcgcgtccgccatgctcgcgcggcgccgagagcgcgaagtcgacgccgaacgccgcctgcccgatgacgtcggtggccagcttgagggcgaggtcggagaagtcgatgt

SEQ ID NO: 46563 - DNA, 222 bp, Triticum aestivum
  Clone ID: PAT_TA_46563
cgtccgccgccacatcgactcctccgcgtccggtgcgccgccagagcatccgtcgcgtgccggcgagctcaccagcgagcagcaaccgtcctccggccttgccttttgccgcccttcctgctcctctctaactcttttggcctacctcaaggacatcggacgcgcgcgccgaacaagcgccactggatcaccctcgcatgccgttctgcgatgtctactgat

SEQ ID NO: 46564 - DNA, 393 bp, Triticum aestivum
  Clone ID: PAT_TA_46564
cgtccggcaactttggtctagtacatgtagtagtatcttttttatttgaggtccgtacatgtattcggttggcagaaaagaaatacattgttgcactttgttgttaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaggggggggccttttaaaagaaccaaagttaacttccccgtgaatgaaaaaaaaaagtttttttatggggccaccaaaataaaattcatgggccggggtttaaaaacgtgggaatgggaaaaaccttgggttaaccaaattaaatccctttgaaaaaaatccccttttggcaaattgggaaaaaacaaaaa

SEQ ID NO: 46565 - DNA, 100 bp, Triticum aestivum
  Clone ID: PAT_TA_46565
cgtccgcccactctacatgtacgcgtggactgacacgtgtacaaccaacacgctattggataacggcctcggtccaaggagaagctacatccatcacctt

SEQ ID NO: 46566 - DNA, 358 bp, Triticum aestivum
  Clone ID: PAT_TA_46566
gcggctcgcggtacgggttcggaattcgagcacgacgtcacgcaacgctcactttttctcctttcttcacatcacaagcggcggagacgagctcctgtggggtggttgccctgcaagtgtcaccggagaccgcagcgggaggagctcgcgcagtggacgcctcggcggcgtggggaccagctcgcgcggtggatgcctcggcggcgcaaggaggagctcgcgcggtggacgcctcgtcggcgcgggaggagctcgcgcgatggaggcctcggtggtgtgcggatgaagtcgtgcccggggcggaggagctcgagaccgcggcgggaggagctcgagcggtggacgcccccgacggagg

SEQ ID NO: 46567 - DNA, 416 bp, Triticum aestivum
  unsure (1)..(416): unsure at all n locations
  Clone ID: PAT_TA_46567
cgtccgcccacgcgtccgggcgccggcccctcggaagccattgccattgctcctcctttccttctccttccccgtcgtcctcctactcttgtccatcgtattactcctctcgcacaccaccttcagcctcctcctctgccctctcctcccgcagtcaccttcgaggtcagcaaatgccacgatgaccactgatgctgctgccgccgccgctagcctagacgtctccatggacaggaccctgctcgcgttccacgtcacggcgtcgccaccgccgccggcgcctcttgctcctactccaccggttaagagtaagaagaacagcaagaaagcctccacgaagcgaaacaagggcctcttcaagcgcctgatcaggcaagctccccggacgcggcagttcgcggcgcgcgcggncgagc

SEQ ID NO: 46568 - DNA, 117 bp, Triticum aestivum
  Clone ID: PAT_TA_46568
cgtgacgccgcgtccgaagggtcgcggatctttaagggatgattaaccttttttcaaaaataacccggggccggaaccctttttttaacttgttaaaaccccttgttcccaatgggg

SEQ ID NO: 46569 - DNA, 418 bp, Triticum aestivum
  Clone ID: PAT_TA_46569
cggacgcgtggggttggcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctgcaagtacggcgacgtcatcgactccaagatcatcactgacagggagacgggccgttcccgcgggttcgggttcgtcaccttcgcgtcggacgaggcgatgcgccaggcgatcgaggccatgaacggtcaggacctggacggccgcaacatcaccgtcaacgaggcccagacccgccgctacaggggaggcgtgcggcgcttatcaggcagaggcggtggccgctacagttgccagcgccccca

SEQ ID NO: 46570 - DNA, 474 bp, Triticum aestivum
  unsure (1)..(474): unsure at all n locations
  Clone ID: PAT_TA_46570
cacgcgtcctatacttccaactgtaggtaggcgccatggagtggagctgnctntggtcgggacgccatgggtcttgtgctcgtcaagggccttgttcctccagcacgaggacaagcagcagcagcagcatcaaggtggacaaaaaggacctcgtctccgctccatggcagttgctcgccgcccgaccggccgtccatgctgccaaagatcaccggcgtcagcagggccaccaacaacatcgtattccgcttcttcctgtcctccggcatcctcgtccgctactgaagaaggtggaaccaaggaatcaggcctgtgctcctcgttgtcctcgaccaccaaggatgcaggcccccagccttggttcttctgcgactaccgcaccaacctcggcgcccaaccccctagagccaccgacagtcccgactcccaagaggcaagcgctttagtacatggtgtgatgacttgtgctcccat

SEQ ID NO: 46571 - DNA, 170 bp, Triticum aestivum
  unsure (1)..(170): unsure at all n locations
  Clone ID: PAT_TA_46571
cgtgcggaaatagatgcaccggaatgaatgaacgacncnnnatataaaataatgtgcatccccattcatttggccgggattcttcaaggagggggggggtgagtgacaaacatctttgcctacattcatacatattccttttttccacgcctactttgtcatatctaaac

SEQ ID NO: 46572 - DNA, 223 bp, Triticum aestivum
  unsure (1)..(223): unsure at all n locations
  Clone ID: PAT_TA_46572
cgtgcgatcacgcacttccaattgcaagacttctcccactnncncaccatttcnctagttctacacaccttaggggggtgttcttcttaagtgtcggtggtcctcaaccacctcacggctgataatctgtccatagggaagaacgtcactaataaggtgtccattaccttgcagttcctggctgaacactcggaggagaatactaccatataaacgcaccttt

SEQ ID NO: 46573 - DNA, 369 bp, Triticum aestivum
  unsure (1)..(369): unsure at all n locations
  Clone ID: PAT_TA_46573
ggtcggtcgggcgacgcgtccacgcttctctacacagtcaacggtacaggtaaccaaaggggcnncgagggacggcttcncatcgtggggtcccctggccaaggggggggggtacttatccatcggagcctccttccacttcgggtggaccaccccatcttcacatacaccctgtcctagcctggtgcacaaggaagggtaccggacacctcccagaggaagacgatacgggctaccatgtggacagccaacccactatttttgatggcggacagggacgatggttacgccgctcacctaatagggggcgatggaaggggcatttgtggtaggcggtctttgactgtatgggcatggaacagcgacttg

SEQ ID NO: 46574 - DNA, 285 bp, Triticum aestivum
  Clone ID: PAT_TA_46574
cgcgtcccgctccgcaccaccacgaacaccacagtggactactcgtccttctggggtcttctcctttcctccgcgggtgggatcgtaccgggggtgacgggaggtagatcacatacacaatggttgaaggctgtggctgttcttaccttcattgagggtgtcaagggctccatttgttctacccaggagggtgatggctctaccaccgattctgaaagcgtcactggactcaaggaagggctccactgcttctacgttgcgctctcatgttgacgctactaacta

SEQ ID NO: 46575 - DNA, 354 bp, Triticum aestivum
  unsure (1)..(354): unsure at all n locations
  Clone ID: PAT_TA_46575
ttcccggggcgacgccaggcgtgcgcttcgtactctcctctctcgcgcgcttccnagctttgnccttcngcctcctgcccctacctgtgggggagcttatcggaggggggggttcctccggtccgacccgccagcatgagggagggcatctcgatccacatcgggcaggccgggatccatggcgggaacgcgtgctgggagctctactggctcgagcatggcattcagcctggtggacagatgcctggtggcaagacttgtgggggaggtgaagattctttcaacaccttcttcagtggtactggggctggggatcatggcccccgggctggctttggcgtcttaagcccactg

SEQ ID NO: 46576 - DNA, 313 bp, Triticum aestivum
  unsure (1)..(313): unsure at all n locations
  Clone ID: PAT_TA_46576
cgtgcgcccacgcgtccggtccttatctactggtgcatcggaagcacatggggnntcgaagcaggaagtgggatgggggctccccagtggggtggcgtgggcggccagggagcgaatcctgccgccgccggtcagtctaggacttccgatccatcccctcgccgccgttggcagactttgccaggctaaacccgtgcagttcggcggaggcagggtcttcctcaccttcggttcaagctgaggcggtgcagaccgtccgtttctgcgtgagctcaaggcggagcttgcgtggatctgggtgggggtgggtcaa

SEQ ID NO: 46577 - DNA, 437 bp, Triticum aestivum
  unsure (1)..(437): unsure at all n locations
  Clone ID: PAT_TA_46577
cgtccgcggacgcgtgggcggacgcgtgggggactccaagacccttctcttcngtgagaaggaggttgctgtgtgttggctgcaggaaccctgaggagatcccatgggctgctgctggtgctgagtacgttgttgagtccaccggtgttttcaccgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctggaaccactaactgccttgctcctcttgctaaggttatcaatgacaggtttggcattgttgagggtttgatgaccacagttcatgccatgactgcaacccaaaagactgttgatggtccttccagcaaggactggag

SEQ ID NO: 46578 - DNA, 327 bp, Triticum aestivum
  Clone ID: PAT_TA_46578
ctcgggggcatcaacgggggaggcgacggcttagggggcggggcgcagggtatggcactcctgatgggactccgtgaggatgttctagaacaggatatactcgaggagacctacgtccagaactacatctaggacaatacctgcaacaatgccaagatcaagggcatgttggagagcctatgaatgaggacaacggtcactgcaatgtacactgagctgttggatgagctcctagaagagtacacagaatggtatacagcatggtctccaccattggcgatctggattgacatgtggcttgaacttggggttgatctaggtggtgct

SEQ ID NO: 46579 - DNA, 360 bp, Triticum aestivum
  unsure (1)..(360): unsure at all n locations
  Clone ID: PAT_TA_46579
gaattcccggggcgggccaggcgtgcgcacccacccagtccatcccccgtggccctaccctcttgngcgcggcggctccttccgggcgggtcatggcttccatgggcggatctgccgtgtccttcgccaagcccggcaaggcgatcaacacgaactcgctctctttctctgggccaagggggggcaatgcatttcttcgcctgcagccagggccgatgagatttgctggttgctggtcagcaaagcatgagacagtggagaagggttgggaaattggtaaaagcagcttgctgttcctgaaggcactgaagtttgcgggaccaccaagttctctgaccttggagctgattcactggacac

SEQ ID NO: 46580 - DNA, 269 bp, Triticum aestivum
  Clone ID: PAT_TA_46580
attgggggggggtcatcattctaccacccactgacaccggataaggggaaagtgatgggtggatctccctaacatacacaaggcctattctcgacaccatggagtctggcatgagatattgaaactagggtgtcctgaccatactactaggttaatgaccattatcagcctgaccttcttcatgggcgtattctcgatacacatgggaggggagagcttgtgtctcatggacagttctgtgggttatagaggtggcatttgtcaacctt

SEQ ID NO: 46581 - DNA, 475 bp, Triticum aestivum
  Clone ID: PAT_TA_46581
ccacgcgtccggagcacgcaacctctcctccctttttcagaaaaacaccatccttcgacctggatcggctcacgcgaccggggggccatgtcgccgccgacgccgacgcctgccagcggcggcaggctggatctggacggcgtgctcgtagcgctgctcaccatctgtgtgatctgggccgacgggttcatctcctcccacgtctgtgagaagctcatggccgaaaccccgcactccgtcctcgccgtcgaccacctcgtcgacccacccccgccccacctcgccggcggcatctcttccgctgcctcaacctcatgaacaactcccgcctggagggcctcatcaagatgtccgatctggtttggatagtgggagaaaaattgggtgaaggcattggtagtacaaggaaagaagtacaacatcaggctgcagaaatatctttaagaaatttggcaagagattatggagcgttatt

SEQ ID NO: 46582 - DNA, 270 bp, Triticum aestivum
  unsure (1)..(270): unsure at all n locations
  Clone ID: PAT_TA_46582
tcccggggggacgccaggcgtgcgggtggcttctcctccccactcagtcctcnggtcccgggccgggtcggtgtcggtanggtttagtagtngggaacatggcgagagaggtgggtgacatctattacctgtggttcntcggggggctctcctgggccaccgactaccaggccctccataacggcttntncagggacgggtacttcatcggctccaagatcatcactgacagggagacgggccggtccctcgggttcaggttcttcacct

SEQ ID NO: 46583 - DNA, 402 bp, Triticum aestivum
  unsure (1)..(402): unsure at all n locations
  Clone ID: PAT_TA_46583
taccctctctactcctcttaccctcgggacgccngcacttctcctcngtgcgcggggatggtnacctccacgaagaagacnaataattcctgggacaacatcaacaacaagctgcatcttgtcatgaatagctgcaagtacactctctggtacaagaccttcctcaggaccctcagtaactccaaggcaaatcttgtgatccttgctaacaactggcctcctctccacaaggctgaaattgagtactattctatgtttgcaaagatcactgttcaccactaccatggaaacaatttttatttgggaacttcgtgtggtaaatacttacgattctgctggctaagtatcatcaaccctggcgattcctacatcattaactcaacaccatcttgccaataaacc

SEQ ID NO: 46584 - DNA, 308 bp, Triticum aestivum
  Clone ID: PAT_TA_46584
cgtccgcccacgcgttcgtggacgcgtggggccaaaaagagctttttaggcagcgctccggctcaccgcggggtggggggtctaaaagcgcgggaggccgacgccacgtaccggagcacccaccagactcctactccggaactcagctcaggttcctcccctactctccccgcagcgagcgagcgatcgagcgatcggcgatgaagaagtgcgcgtcggatctggagctggaggccttcatccgcagggcgggggctcgccgccgagcagaagcctggttgcgccggcgtgggcgcgaatggtcccta

SEQ ID NO: 46585 - DNA, 478 bp, Triticum aestivum
  Clone ID: PAT_TA_46585
ccaggcgtccgcggacgcgtgggcggactcgtgggggcagtctggctctctccatcccaatcccggcctaccgtgggctgtggcacgccatgggcgcgcgcgggcaccggcgccaaggggaagaagggtgcggccgggcgcaagggctgcggccccaggaagaagtcggtgacgcggtccgtgaaggccgggctccagttccctgtcggccgcatcgggcgctacctcaagaagggccggtacgcccagcgcgtcggcaccggtgcccccgtctacctcgccgccgtcctcgagtacctcgccgccgagctggtggagctcgccgggaacgccgggaaggacaacaagaagagccgcatcatcccccgccacctggtgctcgccgtgcaggaacgacgaggagctctgcaagctgctggccgggtcaccatcgcgcacgggggcgtgatccccaatatcaacccggtgcttctcccca

SEQ ID NO: 46586 - DNA, 448 bp, Triticum aestivum
  unsure (1)..(448): unsure at all n locations
  Clone ID: PAT_TA_46586
cgtccggcgtcttcgtactcgcctctctccgcgcatcctagcctncggcctcctccttccccatttgggcgggggggcaggccaccagacggacccccaccctccgccatgagggaaggcatgtctatccacatcggccaggcccgcatccaggtctggaacgcgtgctgggagctctactggctcgagcatggcattcagcctgatgggcagatgcccggggacaagaccggtgggggaggggatgatgctttcaacaccttcttcancgagactggggctgggaagcatgtgccccgtgctggctttggagatctctagcccactgggattgatgaggggatgactggtgcttaccggcaggtcttccaccctgagcgagttatcattgggaagggggatagcagcaacaacttggcccgggggcattacaccattggcgagggga

SEQ ID NO: 46587 - DNA, 316 bp, Triticum aestivum
  unsure (1)..(316): unsure at all n locations
  Clone ID: PAT_TA_46587
cgtccgcacgcctcggccaaatcatactcagccaggagagaagagcccnnngncagtcccctttctcctcccgggggctcccgctcccgagagggtgctatgccatggcgccccctctctcctaatggccttgggcgatcctggtcatatacatctacttactgctgggcccgctggtgtggaaggtggcacatgagtgggcggtgcaaggtggctcgccgttctgctagccgatcttgcaccttctgacgctcttcttcgcccgtggtctgacctaccagaaatagttctactacagcaacttactctttcttac

SEQ ID NO: 46588 - DNA, 469 bp, Triticum aestivum
  unsure (1)..(469): unsure at all n locations
  Clone ID: PAT_TA_46588
ccacgcgtccgctcccatcccgagcatcgcaccctctccttgcctatatccnnaccagcgcaccaatccgcctggggggtggttcatctccgtggggggggcttgtctcctgccgccggccttcctaccggcctacctcacaacaacgtttcccgaggagcaactcgagcgagggcagcatacggaaggagcggatcgaggtcttgcacgctggctccgtcanctgcttcacaccgttctggattcgcgccgtcgcatgcgatgggtctagatcagcgcaggtcatcgccgtggaatatcaggggcggcgatttcttcacgtcaagggctggttagctggggaggggcatgatgctgacaaggcttgcaaaagagcaactaagttggcttttgggggaaaggctacctctgagctttaggcgtggcactcgttatgagtttggcgatgggggagcatcttctccggagc

SEQ ID NO: 46589 - DNA, 161 bp, Triticum aestivum
  unsure (1)..(161): unsure at all n locations
  Clone ID: PAT_TA_46589
gccgcgcgtgcgtctacatctcctcccacctcacctcctcctcgcctcttgggggcgnnncgtcaaggttccnnccgggagggcggctatgctcgcgcagctgctgaccaaggctgcgcaagcggcggaattcgcctcgaagcacggcggcgcctactaca

SEQ ID NO: 46590 - DNA, 299 bp, Triticum aestivum
  unsure (1)..(299): unsure at all n locations
  Clone ID: PAT_TA_46590
gggttcccggggcgggccgggcgtgcgctcttcgacaacatcggggggcgctacttntgcaactgcnacatccagggctccatcnattggggggtcgggaacggcaggtgggtgtgccatggctncgcctcacncngtggcgactagcgtcggcgcgagcggtgggtcgcatcggagctcatcggcgggcgaggcgggggtctcggtcgggggggggcgggtggccgggtccggcgtggtggacctgggcagggcgggggggangtgctcccgggtggggtgcggcttctggnacctcg

SEQ ID NO: 46591 - DNA, 369 bp, Triticum aestivum
  unsure (1)..(369): unsure at all n locations
  Clone ID: PAT_TA_46591
ttcccggggcgggccgggcgtgcgagaaaatgtgtgcggcgacagagnaggggaaggaaagctttnggctaggagaggagnaaacggcggggttcananatgggtggggagtgggacttcaaatcacgggaaaactgggggggcctcacactcanatggcaaggcccaaggtggcacaaggggctatatggtggttggtaaattaagggcaacattttcatcaggttcaccaggtggggctgggggatttggaaaattggagggcacaagaggctcaactttagctaaggagggatatggaattggcaaaggtgagctaaggtctaggtctagganaaaaaaggaaaaccatattagggaaggttattc

SEQ ID NO: 46592 - DNA, 354 bp, Triticum aestivum
  unsure (1)..(354): unsure at all n locations
  Clone ID: PAT_TA_46592
gggcgtccgcggacgcgtgggttctccatggccgccttccncctcgtgagggcnnctgcgttgccttngccgggggggtggacancacgtggtggtggtggcactatgtgacaaggggaangcgcagtgggattttcagggatgatggtcgcaccatcgagggcaaattcctgctccccggcaggaacaggccagtcggcggcggggacgagggccttgatcttcgggagggaggcatgggccagggcagtaccgggatcttccggcacagggcagagaccatctacgccgagaagctcaatgtggctctgggggggggcaacctcgangcgccagtgggggagcccatcttca

SEQ ID NO: 46593 - DNA, 422 bp, Triticum aestivum
  Clone ID: PAT_TA_46593
atcagcgctggggggggccatccatccgctaatcaccacggggggcggcctaatcccgtggtgggtctgctacgcgcgcgatggcggcgtctacggctccggtggaggggcccgtggcggcgccggtgaggactgtgaagggcacaaatgtttccctgagtgcaactgagcaagacattaaggagttcttttctttttcaggagacattggacatgtggatatgaaaaggggtgacgaggggtctcaagttgcatatgttacttttaaagatgcccaaggagcagagactgcgctccttctttcgggcgcaacaatagttgacctttctggtatcattgcacctgctccagaggatcaaccggcccctactggctctgctccactgatgaggggaaccagaggaccagcgggtggggacaat

SEQ ID NO: 46594 - DNA, 370 bp, Triticum aestivum
  Clone ID: PAT_TA_46594
ccgggtcgacgccaggcgtgcgcaccaaccaattccccttccctcctctcccgcgtcccgacgagcaccgggcgccagacatggacgcgtgggccaccggagccggagcggaggcgaataatggcgcggccgggcgcaagggctgcgggcccaggaagaagtcggtgacgcggtcggtcaagggcgggctccagttccccgtcgggcggatcgggcggtacctcaagaacgggcggtacgcgaagcgcgtcggcacgggcgcccccgtctacctcgccggcgtcctcgagtacctcgccgcggagctgctggagctcgccgggaacgccgccaaggacaacaagaagtctcgcatcgtgcccaggcacct

SEQ ID NO: 46595 - DNA, 471 bp, Triticum aestivum
  unsure (1)..(471): unsure at all n locations
  Clone ID: PAT_TA_46595
gccaggcgtgcgcggacacgtgggtttttttttttttttttttttttaagcaccaagaaaaggtggggtacttccagggtggggcgtgatattgggtgctaaaagactgaatgcctcacattccaaaaaaaataaagccacagaggccagcaggggggagcataaattccatggcgggcgatggtcaaattctacaccataaaggggatttcaaccataagaaaaagcaaaaactccaacaaagttcatataaaaaacagggatggggcgcanggcaacaaaatggagatgggtagcaaaacaatgcagggtgtgtgctgacatttgataagctcatatgctcagggtggcaacaacacagaccacatcaaagggggcagcattggtcctactggaggggaacatagcagcactccctacttgcaaggtgtggggtggcacgaaaactccccactccttattgaacaccat

SEQ ID NO: 46596 - DNA, 464 bp, Triticum aestivum
  unsure (1)..(464): unsure at all n locations
  Clone ID: PAT_TA_46596
aattcccggggcgggcaggcgtgcacccacgcgtgcgcatcactctctcctcncttgagtggggcttngaagcgcananananagggggggggggcttcatccggtggcgagggtcttcaccctggagggtggctccaatcacagctccaagggcgactggtgggtaggcatcggcggcaagggggacaatgggaccaaggttctcgatgaccaccctggaggggacgacgtcttggtggcttcaacaggcaatggtgcgaccggctacttctaggacgtgggggacagcacgaccggccgggcgatnatggacgagtactacgtgggcgagatctactcgaccacgatacccaccaaggggaagtacactcgcgccaaggatgcggactacaaccaggacaagacccccgaggtccgcatcaagatcctccagttcttgggccccctttggatactggggctg

SEQ ID NO: 46597 - DNA, 471 bp, Triticum aestivum
  unsure (1)..(471): unsure at all n locations
  Clone ID: PAT_TA_46597
cgtccccttcttgtgactgaccagaaccatgcaagctgcnagaagatcccatgtattcgagcatttgtatccctcggggggggctgacgatagcgaggcagacattatgtcgtacatcacgtaacgcgtggactcttacataaagcttcagatgctgcacctcgtgtgacaccatatcccaaatgagtttttcccgctatatcctgcgggcgcatcatatgcacttttttatacattttctcacacccggatgtttattatagatattccgcttttttttatagcccatatgcatgcacaacatccactcctatatatctgtgatattacaaaatggggagtgtccacttatatctcaccactgtttatttacccaatatctgcttgtcgctctttcgacaaacgaatgatttcttttgatcaattgccggctgcaatctcctctcaaataacaacaaccattctaatatc

SEQ ID NO: 46598 - DNA, 469 bp, Triticum aestivum
  Clone ID: PAT_TA_46598
cgtccgcaaccttgctgctgcctgcccccgcactcttctcaccacctcttctccccatctcccacatatacacacgattttgcatcctccacacctcaaaactaactgctgcctcacaccctgctaccctccaccaaagccatgaggggcttcccgctggccatcctactgctggcgctgctgctcgccgccggggaactgcattgcgcagcaacagcaccagcgccaccagcaaaggcatcatcgccgccaccgccgacaccaccacagcacacaccaccatcgcctccgcggcgacaccgaccatcgcacggacgagccccgcctgttccccgcaagcaggaccctccatcatcaccaccgccacaaaagcaggaccctccgcctccctcgccgccgccgcagcaggaccctccatcgccgccgccacagcagatcatgccgccaatacagctcgtgccaccaattc

SEQ ID NO: 46599 - DNA, 478 bp, Triticum aestivum
  Clone ID: PAT_TA_46599
cgtccgcccacgcgtccggtcggcgacttcatctcccaccgccgccccctctcatcccttcccctccactcagtgtgatgtcgatcaggtgcgcacacaaccggctctctcgtctcccacggcggcggcgatgaggtgcatgaacgtggcgtgcggcgcccccgccccgacggtggtgggggtgggccagtggaggaaggactagccattgcgatctggtggcttcgtcgtgctctgcgacaagtgcggagtctggaagaactcatacaaaatgagatggtgccctgccccattgacatagttaataatgctatcgacgatcacctagccaagaggctcaccaaactgtgtggttctgtgaacaaattagttgtgggaagtgctgaatataaaagaataattgaaatgaacctgggaataacctgtctttatgttgatgttccggattgttaggtcataatttggagtcagatgaatc

SEQ ID NO: 46600 - DNA, 469 bp, Triticum aestivum
  Clone ID: PAT_TA_46600
cgtgcgcccacgcgtccgcccacgcgtccgcggacgcgtgggtttttttttttttaacgaggggtaacatgcatggtactgtacttactacgacggatggccacatagattagatattacaaatgttcatcttgagtcggccggccagggacaataatcatacgggtgggtctttatttgttgagcactctaatgtgagtcaataacctatgtatatgtagtaacagacgctacagtggaccagaagggagggtcgcgtcatctgtcttctgcttggcctgcctcatcttcttgtccagactgtcggacgaattgcccacggacacgtggccgctgctcggctagtctcttcctgctctggtaccgcacctttttcccgaagttcctatctttccgcttctgcctgaatttgttcactgcagcttctcgttggctgagctgattctgacataccatgtcattgccacta

SEQ ID NO: 46601 - DNA, 465 bp, Triticum aestivum
  Clone ID: PAT_TA_46601
cgtccggccacctctcctctccccccaaatccatccgatcccatccgcccgctcgcggctccaagaaggaagcgcgcgtcaaccatgtccggccgcggcaagggcgggaaggggctgggcaagggcggcgccaagcgacaccggaaggtgctgcgcgacaacatccagggcatcaccaagccggcgatccggcggctggcgcgcaggggcggcgtgaagcgcatctcggggctcatctacgaggagacccgcggcgtgctcaagatcttccttgagaacgtcatccgcgacgccgtcacctacaccgagcacgcccgccgcaagaccgtgaccgccatggacgtcgtctacgcgctcaagcgccagggccgcaccctctacggattcggcggctagcccccctgctgcgtccaggctctgctcccgctgctccatctgtcccagtgcgtgtgtagtgtgttgttc

SEQ ID NO: 46602 - DNA, 442 bp, Triticum aestivum
  Clone ID: PAT_TA_46602
cgtccgcccacgcgtccgtgctgttggaagaccaagaggctacctgagagcaggtgatcctagtggaaatcattcaagccaagtatcatgggagaacacttctgttaccacaccagcagcacagaggacaaatgatggaagatatgggacaatatgagccatgcttagttgtgtggaatttgtcttgtaggtgtgctatttctgggtcttttccggtccacaaaacctgatctgaattaagaaggcctcttccctccactatcaacttgtaatagctgttgtcgaatttcggagggctggcaaagtctagcgggctgatgttgttatcaacctccgtgcgtgggcagactgatgccagtttgtgatagaaccttttcttcagtgtcatgttcggtttgttatctctatgctgattgaagagccgttgtttgaaactaacaca

SEQ ID NO: 46603 - DNA, 448 bp, Triticum aestivum
  unsure (1)..(448): unsure at all n locations
  Clone ID: PAT_TA_46603
cgtccgcccacgcgtccgaaaagaagcttctgtacaaaagccaaatagacctaanaatcaggaaaaagaagtctggccagaagaagattactggcttccagtttgctccaggaagctccttggaagtcctgattacttctgcagattcaagaatccgtgttgttaatggcgaccaggcttgttcacaaatttaaagggttccgcaatactagtagccaaatctcagcttctgtagctccaaatgggaaatatgtagtctgtgccagtgaggactctcatgtgtacgtctggagacatgacaacagttcccatcctagcagaagcaggagcgcagttgatgtaaccaactcgtatgaacatttccactgccgtgatgtaactgtggcaatcacatggcccggtgctgaagcccgtggatcacttgtgtgtcgtagcagcagacacagcg

SEQ ID NO: 46604 - DNA, 480 bp, Triticum aestivum
  Clone ID: PAT_TA_46604
cgtccgtattgtgtcaactactttctccagatctaaacaacattttacttgtcgattagatctggagaagggaggggacacaatagggaggcatatgctccatagcccatatggttatagccagaaaatgaaagataatacattcttcttgtgggaagttctggcacaacatcctaaacataacaggataccatcagcttagaagagagatgttcccttgcccttcttgtctacaccgatttcaaagtgcttgcacctcttgatagcgcctcctagcaagctatatacctacatagtacagccatggcccccaccgtgatggcctggtcggacacctccgtcgctcctttccaggggctcaagtccaccgccggcctccccgtcagccgccgatccaacggcgctagcctcggcagcgtcagcaacggtggaaggatcaggtgcatgcaggtgtggcccattgagggcatcaagaagttc

SEQ ID NO: 46605 - DNA, 455 bp, Triticum aestivum
  Clone ID: PAT_TA_46605
cgtccggggcatcaattttctctgtatcttcagttcggctctctctccttctttaggattattagctcaaatggcaattaagctaagacatttctttctattaggcttggcaccgaatggtgcttttctttggattcatgtgcatctcctctttgctcattttcaattggtgacgcattcatgtgcatctcctctttgctcattttcaattggtgacgcatatagtagatgcggcaggcagctttcttgatttctctagggtaaacatgaacatctcatccgctttttgttggcttgttgatcttgtaatgcatgaaataagttggttggattttatgtaatagagcaggtgggactattaattttaatctgaaattttagcacaggcacaagacttggttcctaaggcagggagagaaggagctcgggcgcgctggtgagaggagctgaagcgg

SEQ ID NO: 46606 - DNA, 481 bp, Triticum aestivum
  Clone ID: PAT_TA_46606
gtcggccgccccgcgcggcagctctacatggtgctcgacaccggcagcgacgtcacctggctgcagtgccagccctgcgccgactgctacgcccagtccgaccccgtctacgacccctccgtctccgcctcctacgccgccgtcggctgcgactccccgcgctgccgcgacctcgacgccgccgcctgccgcaactccaccggctcctgcctctacgaggtggcctacggcgacggctcctacaccgtcggcgacttcgccaccgagacgctcacgctcggcgactccgcgccggtctccaacgtggccatcgggtgcggccacgacaacgagggcctcttcgtgggcgccgccgggctgctggccctcggcggcggcccgctctccttcccgtcgcagatctccgccacctccttctcctactgcctcgtggaccgcgactcgccctcctcctccacgctgcagtttcgcgacgcggagc

SEQ ID NO: 46607 - DNA, 422 bp, Triticum aestivum
  Clone ID: PAT_TA_46607
cgtccggtgagcctctcaagaactgatggagaaacttgaagataaaggagttcatctctctccaaccatgtaaggaactcatgtcatattgcttttatatttctttctgcattatgttttaggcttttagctgtttccttgatgatccttatgaggtctaatgttgactttttgttacttccaaatttaattccttgagcaaaattgctgtgtctggtcattgtgaattattgcaagatcatctttaatgcatttacttcattctataaccagatatgaggttgcggattgggttaaatttagaagaacagttacttctccggattttggctggcaaggtgctggacccaaaagcattggctttgtccagtctattgtagacaatgaccaccttattgtgtcattttgctctggagaagctc

SEQ ID NO: 46608 - DNA, 366 bp, Triticum aestivum
  Clone ID: PAT_TA_46608
cgtccgcgctgctcttgccctcgcctgccgcggtgccgccttcccggctgccccagttcgctgtccgtcgcgctgcaggctctcctggtcgccgccccgcccccctcctcctccgcagctcggcaggtccgcgcgacgcttcttctgtgtgatgctttgtatagaaatcaagagattttttcccatcggctcccatactgtgtgatgctttcatatgagttattttttttctagtttttcaccggggtttacttcaatcttggctccgccactgccaacagctcaactcccatggcagcggcgacggcggcggcgcccgtggcgagtcaagcacacgccgtggttcttgcgcggctctgcgacccg

SEQ ID NO: 46609 - DNA, 420 bp, Triticum aestivum
  Clone ID: PAT_TA_46609
cgtccggtgaaaccaagtgggcgttcagctagttatcagaacaatggtgataaagctgcttatccatcgtatggtggtcatactcagcagaaactccctgttggaaatactacatcaactgcttctaatcctaaaaccaagggattgcttgggcaaaactctgcaatggggccacagacacctgggtacatgagttccatgtactctagtgtcatgtacaatgcaaatgcatatggacctgactattggtatggatctcacctctatggctctggtatgtatggtgggtggaatgtgctgtcagatggaaagtacaagcccagaccaaaaacctatggatcatatcgtttcggtaatgagaacatagatggcttgaatgagctgaagagagggccaagaagcactgccattaaaaatgag

SEQ ID NO: 46610 - DNA, 453 bp, Triticum aestivum
  Clone ID: PAT_TA_46610
cgtccgggcgggccgagcttcccacacctgttcgcctcgccccccttacccctcttatagccgaactccacgcgccagcgccatgtccctcgccgccgcagcctccccgtcgtgccgcttcctgtcgccctccacggccgcccgccgccggttcctccaccacctcctcgccgcgcccccgaggccgccgcagcttcgtcgctgctccccgtaccactggatggcgcaattttggactgaaggatcactggagaagaacaacgctctggttgaatacctgaaacagtatggtgttgttcgaacagataaagtggcagaagttatggaaactatcgatcgagccctatttgtaccagagggctttaccccttacattgacagtcctatgcctattggttacaatgcaacgatatctgctcctcacatgcatgcaacctgcttagaacttttgga

SEQ ID NO: 46611 - DNA, 99 bp, Triticum aestivum
  Clone ID: PAT_TA_46611
agtggtcgcggcacatggctcctctagctctgtttatgttcacagcttgtctgcttgttttaactgtttccgaagaacttgtttggccgagggtggttt

SEQ ID NO: 46612 - DNA, 426 bp, Triticum aestivum
  unsure (1)..(426): unsure at all n locations
  Clone ID: PAT_TA_46612
cgtccgcgaggacatcgtcaggcaggccgaggagtccaccctcagataccagcaaggggcgcctctgtctgccatggatggggtgctggtggcagtcaaggacgagatcgattgcctgccctaccaaaccactggatccgtacgcatgcccgcggcgctctgcggcgtcgtcggcttcaagcccaccgcggggcggctctccaactccgggcttctcccgttgaactggacggtgggggtgccggggatcttggcggcgacggtcgaggacgcacttatcgcctacgcggccatggttgatcagtccagaccagctcactcccagccccagctgaatctgccgatgctgacatccacccattgcatgcctaacatcaggctcgcaagatacggaaagtggttcaacgacagctncgacaacattcg

SEQ ID NO: 46613 - DNA, 117 bp, Triticum aestivum
  Clone ID: PAT_TA_46613
caattcccgattcgacccactcgtccgcgacgtccaacgcgtcgtcagccccctgccacgctgctgcgcaccgccatcccccgacacacacttcttgcaccatccctttcctcccca

SEQ ID NO: 46614 - DNA, 397 bp, Triticum aestivum
  Clone ID: PAT_TA_46614
cgtccgcggacgcgtgggcggacgcgtgggctcatagtacctcacattggatggaacgccctccagatcaccaaggacacgcagcttctgcaaggagctgatggccaccatgtgtacttcgttcactcctatcacgctctaccctcagatgctaacagagactggatttcatcgacatgtaactacggtgagagtttcatatcatctatctcgatgggcaacattgaggcagttcagtttcacccagagaagagtggagctactggactttccatttttgaaaaatttctcagtcctaactcttcaggggcaaaggccccagctcatagaaaagcatcaaaacttgcaaagagagtgatagcatgccttgatgttcggtccaatgataatggggatc

SEQ ID NO: 46615 - DNA, 148 bp, Triticum aestivum
  Clone ID: PAT_TA_46615
gtccgataaaggtctgggcaatacttctgcttgtgagattgaggccacaattctcattgtattgcatatgtaataaacctgttcacgcgctagagaaaacaggagaccaggacatgtatgaaccaatacgtcctgattccatccaaaa

SEQ ID NO: 46616 - DNA, 392 bp, Triticum aestivum
  Clone ID: PAT_TA_46616
cgtccgggttatcacatacttcttctacaagaatctgacatttacactaactcagttctggttcactttccaaactggcttttctggtcagcggttttatgatgactggttccagtcgctgtataatgtcattttcacagcgctgcccgtaattatggttggattatttgataaggatgtgagtgcatctctatcaaagaaatacccacaactttaccaggaaggaatcaggaatacattcttcaagtggaaagtgatagcggtgtggggtttctttgctttctaccagtcaatagtgttttattacttcactgcagctgcaagtcagcatggtcatggctcatctggcaagattcttggtcaatgggatgttagcacgatggcctttactt

SEQ ID NO: 46617 - DNA, 457 bp, Triticum aestivum
  Clone ID: PAT_TA_46617
cgtccgcggacgcgtgggcagtagctttctccctgatccaaaattcctctctcgttcaaacaccagccaatcccgaggcctccacggcttggccctcctgcctcctcgccggactcctcgcgcaacagcacctcaccaagccccgcgccgcagcctccttctccccgttcccgatggccatctcctcccatgtcctggagctcgcagtcgcgaagccctgcgccgccaagctccttccatggcgcccgaggtgcacctcgaccccgtcgtcgccccagccgctgccggcgagcagcagcaaccagcaggccgtcctcgccgtccctgctctttctgtcagccctcctcttcgatttcctcacgtggctctccctctaagctctgcccttgccctcttcttcgcaggaaatcgagccccacagcgacgccatgagccgtcggccaccagagagccgtc

SEQ ID NO: 46618 - DNA, 406 bp, Triticum aestivum
  unsure (1)..(406): unsure at all n locations
  Clone ID: PAT_TA_46618
cgtccgccgccccacgaatctgcacacacactccacattcttcgccaattccccaaacccaccgccgccgcgccgctctcctctaacccaaccacgccggcggtggccccccctcccccaagcaccggcgacctcctcgtcctccagcgccgaactccaaccttctccttctctcccaagcgaagggaaagagggaaggccccagatcgggcgaggccagatccacggcggcatcggcgcgccatcgtcgacctaggctgcgaccaccatggtcgccgtcgtcgtctcctccatggaggtccgacccgccaggatcaagccgcggcctgagcctgccatggggaatccgccccgattgcagcgtgtaggcaggcactgtangaagaggaagagggaggaggggagg

SEQ ID NO: 46619 - DNA, 230 bp, Triticum aestivum
  Clone ID: PAT_TA_46619
taaaatgatccaaacttacttacgcttccattcgacggcggagctcttttatagaggcacctaaattcaatcctctggccttttctttccacttatcattatgtaatacaaaatggcttaactattgctttatcaaccaccagaatttaagatagttgctttgttccacaattatcatcgggcacataccaaccgggttttaaattttgtgctcaacaataaagaaactt

SEQ ID NO: 46620 - DNA, 415 bp, Triticum aestivum
  Clone ID: PAT_TA_46620
cgtccgcccacgcgtccgcccacgcgtccgcccacgcgtccgcccacgcgtccgatctcgtcctcctgtggagcaactgataaataatgtccccagcactgatgcggcagttgaggttccggtgttaaaagatacaccaaatgttcagaatgaagtgccagctatggagaaaaaggttcctgccccccaggagaaaatttcagctgttgttcctaacataccttcccctgtcagggagtctccaatccttcaagaagttcctgtgctactgcatgaagaacctgctattttggcagaatctcctccccctctaaaagacgaatctcctccctctctaaaacatgaatctcctccccctataaaggattcgtctgcaattaccattgaacaactttctcctctgaaggaagagact

SEQ ID NO: 46621 - DNA, 434 bp, Triticum aestivum
  unsure (1)..(434): unsure at all n locations
  Clone ID: PAT_TA_46621
cgtccgctcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcngcggcggcggcggcggcggcggctacggcggccaacgtcttgaaagaggaggcggcggcagc

SEQ ID NO: 46622 - DNA, 197 bp, Triticum aestivum
  Clone ID: PAT_TA_46622
cgtccgcccacgcgtccgcgcgccctcgatcccccactctccctcgtctcccctctcctccacgatgccggcacgcccgcaactgccatgggggtgatcacaccagctgtccttccttgtctctggcgcacacaagggagggctggcacgctgcgctgtcgctctgacgctttttcggacaggcttactgcctgcga

SEQ ID NO: 46623 - DNA, 441 bp, Triticum aestivum
  unsure (1)..(441): unsure at all n locations
  Clone ID: PAT_TA_46623
cgtccgcccatctggccttcccgctcgcctcttccccgctccccacgcgtctcctctggtggccgccttcggcgagtggagtctgttcctcactggctcgctgcattcttcctctgcgaggtgttagtgtggggatgggatctgacaggatcgggacgaggaggcggctgtgaagtacacgttctggagctgcgcgtggatgcgctcattgccgaggccgatgccgctctttctggaggccgacaccgctctttctagaagaaatccctcggtgtcaagcggngtgacgtggacacctacgtccttcatgtttgggcgctggagggcgacgggaggcatcgattcgccgtttggctcctgcactaggggactgcggctgctacaaaagatgcagcaattggaagatgcacagtaacgactgaaactattcgaggacaaatc

SEQ ID NO: 46624 - DNA, 465 bp, Triticum aestivum
  Clone ID: PAT_TA_46624
cgtccggtcgccccggatgatgggctgtcaggggaggcagggctgctgccgctctccagggccaccgcgctcctggcgtcgttgctcggagacgcgctgaagaggagaagggagacccatgaggagggcgccgatgcttcgctggatgcattggtgcagaatttgacctgggacctgtccaggctggtgctcaagatgtttgacctcggccaagagtatcggtcttgcgccacccgggtcctcctgcagcctatgctgacttcactagcagatgtttcttgcgtcaccgtcgagttcggtgcggtccagcttaagctatctaggtctggtttcttggagtccatttggaactcctgtgtctctctgttctctcttggccgccctgagcggctggatgcgtacgctatactctctctgtacttctcggtgtgaaatcgggacatcagggtgctatccctggagctg

SEQ ID NO: 46625 - DNA, 537 bp, Triticum aestivum
  Clone ID: PAT_TA_46625
cgtccgcagctgtccaagaatccattccacccactgcacacacacacacacacacacacacagagagagagagagagagagagagagagagagagagagagaaaaccaggaagaaccaggaagcaagaagatggggcaggcgctgcgcaggctcttcgactccttcttctccaccaaggagatgagggcaaacaacctaaccacgatcccccctccctccctccctccctccccatccacccctttctccatcttcggcgctcgatctcgcggcttcttggagctttctcgatgcggcgcagttcttggaatcaattaacttcccgatgttcctgccttaatcgaatcagccacgcgcttgagccgcgggcaaatcccgacaggcgttccagtcagtgcgccaatctggacctgtgctctggcttttacgacggtccatggcgagggccgtgaatacccgtcgatccgagttcttgtgtttgcccctggaccctgagtgtggtgatgtactggtgcggcctgagatctaaattttag

SEQ ID NO: 46626 - DNA, 524 bp, Triticum aestivum
  Clone ID: PAT_TA_46626
cggtcgaccacgcgtgcggcctcctctgcctcctctgcctgccactgggcggacgcaggcacgcgcacgcgcacgcgcaatcggctccgcgcgggcggatgaaatctcgcctcctccgcggctccaaggctcggcgctcggcgaggggtacgcggtgaggaggacggtgatggggtgcctgttcgactgcttcccgcggccgggcggcgagccgcgcgccggtcgtgcccgcgcccagctcgtttcctcctccgtcgtccccagccccatagtcggcgagaggagggcgccgtcgtcaaggaacgcgctgtccgccgtgttcctgggcgaagatgagggatcgcatgccacgagctcggtgtcgacccggacgccggagcaacagggttatccggagctcaggcacgagaggcactttctcaaaatggggtgcactgcggaactcaatgaatcctaaagagctgaagctggattagttgagatgaaacatcagcgtgtaactgctgttgaacatgaatcatgag

SEQ ID NO: 46627 - DNA, 403 bp, Triticum aestivum
  Clone ID: PAT_TA_46627
cgtccgatgaagcttgcttctgaggctgcaacatactttgcaatccccctgtgaaacatacttttgtcactatgcacatatggttattcgaacagattgatttcgattagactatctttttcctaattacttgttatatgatgttctttactattcagaggttgttgaagggagatggggctcttcaggcccctttggtgcaaaagcacaagcaacaacatctacagctgaccacttatagcctaggatgtcctgcagatttgatctattttggatagagtacatggaatcaaaccacaggatacccaagcagtgcgtacaaattgtagtggtgcttgtagcttatcatcaatctgccattattatttgtatgtatgtgttcaaaatgaccacctagagattc

SEQ ID NO: 46628 - DNA, 430 bp, Triticum aestivum
  unsure (1)..(430): unsure at all n locations
  Clone ID: PAT_TA_46628
cgtccgctccacgaaggtgatattaccgaagttagcagtctcattgcagccccatgcaaagaaggcaataatagccatatgggcattgcgccacgggaagcaaaatcagacgagagcaatgtgtcgcagcatgcagagaagccaccttcagtatggggttgcagtgattgccaagttatctgtggtcgcgaatcagattttgaggtccacctgaagggtgaaaggcacttaaagaagattggagccctgctcgaagaaagcaagaccatggcgatatccgagtcacagaaagcaaacttgtacccggacagcgtgctgcagcatgcggagaaaatgaattgtgaattagactnggagaacaacctcagagatgagggacaccaactaaatgttcgctccccttgcatagaaaacagccaaatgaaaaaca

SEQ ID NO: 46629 - DNA, 381 bp, Triticum aestivum
  Clone ID: PAT_TA_46629
cgtccgcgcccccgcgacccccgacgccgcgccgccgggaccggagaagaagcggaagcgcaagagcaaggccaacgcgaagaagaacagcaagaagaagaagaagcgcgctgacggggccgcctccgcgtccgatgttgtggaggggttcagcgtgttcaagggggcggaggcgaaggaggcgacggaggagtctgtggaggtggtggttagggaggacgaggactcggccgtcgtgaggcggcggaaggaagccgagagggaaatcgagagagccgccatcctccggaagaggtacgacatccacatttcgggacataatgttccagcaccactggagagctttgaagaactggtttcaaggtatgactatgattcata

SEQ ID NO: 46630 - DNA, 433 bp, Triticum aestivum
  Clone ID: PAT_TA_46630
cgtgcgtgcatgttgtgctgtgccaacttttgttcaacataactcgatactccgaacagcgtgatgacataaaggaggtgcgtgaacattacaagcaacatggtgatattgatatggctctgaggaactttcctcgccatcttgtggctgagaaggctattcttcagtgtttgaggaaatgccctgagaactatctacaagcattaaagggtataccaagaccgttaataatgatgtatgtccattcttaccaaagttacctttggaatcatgctgtcagcatgagagttgaaaagcatttcacaggtcgtagaaggtgatctaatctataccaaataaagctcattctggagaaacaacttctgtgggtacttcaaaagttgatggccttacaaattctttcgaaattgatatttgtccttgagcaattcca

SEQ ID NO: 46631 - DNA, 222 bp, Triticum aestivum
  Clone ID: PAT_TA_46631
ccgcagcccgtccggaatcccggtcgaccgacgcggccggacgccagtcaaaaacgcacactgcaccaccgcacacagatctaaccgaaacccacccccaccggcggcgagccggcgacgagccagccatccaagaagcagtacaacaacctgtgacggccgggcctccgcagtagccagcattcctacggagcgcgggagaccctccgcaaccaactcgac

SEQ ID NO: 46632 - DNA, 238 bp, Triticum aestivum
  Clone ID: PAT_TA_46632
gggtcgacccacgcgtccgcggacgcgtgggaaaaacgcgattcccctcagccgtctcccgcccgcgattcccccctctgtccgtactcgccgccagtcgcgctgcctcgacggccactcgccgttgccggacgcccagaaggccaggacccacctgcggccagtcgccccgcccagccccgtccggccaacagcggtaccatcgggccggttagcctagccgttcagtccgcactcg

SEQ ID NO: 46633 - DNA, 271 bp, Triticum aestivum
  Clone ID: PAT_TA_46633
cggccggccaagcgaccccaagaaagtctccgatcgaatcgaactcaaagccttctcgcccaccttcaagatgcaaatctaagagaagacggtcaccggcaagaccatgacccttgaggccgagacctctgacacgatcgacaacgtcaaggcgaagatccacgacaaggagggcatacctccggaccagcagcgcctcatcttcgctgcaagcagctagaggacggccgcaccctagctgactacaacatccagaaagagtccaccctcc

SEQ ID NO: 46634 - DNA, 341 bp, Triticum aestivum
  Clone ID: PAT_TA_46634
cgtccggcgcccagagacccataagccaaattctgatgaaccgggcgcgagcaaggctaggacccttggcgtataggctcttcctacacggaaggatggtaggcaacatgcgaagacactgcttgtgaataaccaaccccctaatagcataactggacaatagcgtgagaccatagccataccttctttcaaaccaccccttagaatacactatagaaataggatgacctttcagaacccgctcccaaatcaaataaagactggaacacgatgcgccaaattccgcaagcacgatagaataagtgcacaaaataacaataacactctttagtaccctggat

SEQ ID NO: 46635 - DNA, 248 bp, Triticum aestivum
  Clone ID: PAT_TA_46635
cggacgccgggggccctacagaagcagcactcgtgcacccctggagcgagccagcacctcagcggcacaaccccagatgaggagacaggggacgagagcaccaagggagaaaagcaagtcgtcgaaatcctcaagggagccaatggacaccgtgacataaaggaggacaaggagacaatggagcttgctggaaccaacgacgagaccaccacccacaggtacgaagaccatgacaagcgctgcgccaa

SEQ ID NO: 46636 - DNA, 251 bp, Triticum aestivum
  Clone ID: PAT_TA_46636
cgtccggatgatctgctgctgtaacaagatggacgccaccactcccaagtactcaaaggcccgttacgaggaaattgttaaggaagtcgtttcgtacctgaataaggtggggtacaactctaacaaggttccctttgatcccatttctgggtttgagggtgacaacatgattgagaggtccaccaactctgactggtacaaggagcctacccttcttgaagttcttgaccagatcaatgagtccaataagt

SEQ ID NO: 46637 - DNA, 290 bp, Triticum aestivum
  Clone ID: PAT_TA_46637
cgtgcgcggacgcgtgggcagaacccgagaaccccccgctccaaagccctaaccctagccatctcctctccccccagccctagtggagcgcgcgtttttcaggagcttcaggtgccggcggcgccatggcttcagagaccgagaccttcgccttccaggccgagatcaaccagctgctctcgctcatcaataacaccttctactccaacaaggagatctttctgcgtgagctcatcttcaacgccttcgatgcgttggataaaatcaagtttgggagccttgctgacaag

SEQ ID NO: 46638 - DNA, 242 bp, Triticum aestivum
  Clone ID: PAT_TA_46638
cgtgcgcggacgcgtgggcggacgcgtgggcgagacgcgagggttgtgcctggtgtcggcggcacaagggggaaatcactcagggccgagaggaggcactcttatgacattgatcgatccaagggtcgaacgccagggcatctagcgtggggatacactgagagaggcgcttgcgaatgaacagcagcctaactcacaagctagacaggtacacctgacacacttgaacgcggaacttccta

SEQ ID NO: 46639 - DNA, 178 bp, Triticum aestivum
  Clone ID: PAT_TA_46639
cgtgcggccgggccgccgacttctcgcgcgacgtctggtccagccggtggactcggctcgccaggaacgacaagtgcgaggatgtggacgacgcctgccgttaccggtgcctggtgcctgagcatccgtgcgaggcaccgtggtgccacggtccactgggcgcatttggagagctacg

SEQ ID NO: 46640 - DNA, 389 bp, Triticum aestivum
  Clone ID: PAT_TA_46640
agcgtcgccgggcgaggagggaaagaagaaagaggagacaccgagccacgcgcgcaaggacacagcgccgagactcgacaggagcggagaggggctacgttacgaatctttcaagccggctttcgcaagaaggagatgaggatcctcaggcagactcgaagcggtggaagaccacatcctctacaagctcaagcttggagagatcgcaccaccatccccacaatcgggtttaatggcgaaactggagagtacaagaacattagtttcaccgctagggatgtcggaggtcaggacaagatcaggcccttgtggaggcactacttccagaacacccaagggctcatttttgtcgaagacaagaataacagagagcgtggtggtgaagcaag

SEQ ID NO: 46641 - DNA, 204 bp, Triticum aestivum
  Clone ID: PAT_TA_46641
ctagagtatatatacttggacgtgactgtgatcatgaacgctgaacccaaacaatataggaaatagtgtatatcatggatctagattgtaatatgagcctaataagaggtagtgatattttaataagacatgccaccaatatggtattactgttatatctgctataataatttaacctataggtgtaaaaaaaaaaaaaaggga

SEQ ID NO: 46642 - DNA, 216 bp, Triticum aestivum
  Clone ID: PAT_TA_46642
ggtgggggggtttttttttacaggggtgcagattttcagataacttttccagtgagctaaaacgcattgttggttacagtacaaatttggtttttacgtaaaatacaaatttggtaacagtgagataatagtacaaatttggtttttagctaaaatccaactagataaacagattactagtccagggagctaaaacgcattgttgggtgtgggttt

SEQ ID NO: 46643 - DNA, 129 bp, Triticum aestivum
  Clone ID: PAT_TA_46643
taggcggagaaacggggggtcactctgaagcaggttgcactgagagtaagtaacctgttgattgcacgacgcaggctatttttggctcgagcgagcatgacaagcgagcgtgtaagatatcgctacaca

SEQ ID NO: 46644 - DNA, 512 bp, Triticum aestivum
  Clone ID: PAT_TA_46644
cgtccgcccacgcgtccgcggacgcgtggggcagttcaagctgtgaagactacaaactccaagggagaagtgaagtatccaatcaagagtattaatattttgaaagctcatggtaaaagcgccaaggaaagttacctgctgaatggttatgcgctgaacactggccgtgcagctcaaggaatgcctaccagagtaacccctgctagaattgcctgtcttgatttcaaccttcagaagatgaaaatgcaaatgggtgttcaagtccttgtctctgatccaagggaactggagaagatccgtgagagagaatctgacgtaacgaaggagcgaattgagaaagttctcaaggctggtgctaatgttgtatttaccaccaagggaattgatgatatgtcattgaagtactttgttgaggctggagcaattgcagtaagacgtgtgcgtaaggaggatttgcgccatgttgccaaggcaacaggtgcaacaatggtgactacttttgctgacatgga

SEQ ID NO: 46645 - DNA, 463 bp, Triticum aestivum
  unsure (1)..(463): unsure at all n locations
  Clone ID: PAT_TA_46645
cgtccgggccaagctggaattctcgtcgtggaccacgtggtaattntgtccgccctatccgaaacaatggaggatctgcttgcaatgcaatcaagtcacgaggagttgctggaaaaaatgatgattccatggaagattcaataaaaaaatgcttagaaatgctttgaggccctgatggtgagcttcctgagaagttgaggaattgggaacctcgccttattgagcatgttagtaacgaaataatggataaagaccctaatgttcgctgggatgacatagctggttaggatcatgcaaagaagtgtgtgacagagatggttatttggcccctactgcgtccagacatctttcgtggtgtcggtctcctggaagaggactactactatttggaccttctggaacaggcaaaaccatgattggaaaagcaattgctggtgaggctaatgcaacatttttctacata

SEQ ID NO: 46646 - DNA, 591 bp, Triticum aestivum
  unsure (1)..(591): unsure at all n locations
  Clone ID: PAT_TA_46646
ccagcaacgactgcctctccgtcatcccccctcttccctccgacgacttgcgtggagccatggggcaccagtcggccgtcatcatgtgcgacccccatggggagggctaccttcttgccgagctcatcaagaaaggcgggggtctggctggggtctggctgtggaagtcgtccgccccagaaccgaaatgggtctcggtacccgggagccatccccttccacccagcagattcaccgttgactcgtgcttctcttaccggggctctaccctttgctgggtggatctgctcaaaggcatgttgctctgtgatctcaaccaagactgcgacaacaagttcagctntatcaagctgccacaagactgtccagccctggattggaacttaaaggagttcagctttgtcaagctgccacaagactgtccagccctggataggaacttagaggagtccagctatatcatcaagttctgcacccgccctgaggagttccgttccatggcctgtgtttgtgaccacatcaagcttgtctccttggatgaatctggataggaactctcgctctggactctgttgactgatcactcacact

SEQ ID NO: 46647 - DNA, 277 bp, Triticum aestivum
  Clone ID: PAT_TA_46647
cgagcggaatgcagccccctttttctactctgggtacaaaaggaacctccaggtgactcctcttaccaagacttattccgcaaagcgaggggaggctctccctctaggaaagactcgaggaaaactgggcttggagccaggttccgtgaaggctgaggcgtctgagtcagacacatacaagcattcagaccatgggcgtaggggatccaaagctacctacaactcggaggatgagcatataaactcgaagaaggaacgcttgattgcacttaaagaa

SEQ ID NO: 46648 - DNA, 300 bp, Triticum aestivum
  Clone ID: PAT_TA_46648
cgtccgccgacgcggacgggtaagggctcatgcctagcgcatgtataagagaactacaacctctacaatcacaataatgaaaagcagagagcggagattgttttcatttgacagagagtattgcacagatcactctagtttaaaactaaagaaactggccacggttgtttcaaaagcaccagggcataagaagctcaaacttacaatagcaaaacaatactgaaattactattatggagttggtgaaattactatacaagcagaaattgctgttctgtgcacaccaaagtctctgcctaa

SEQ ID NO: 46649 - DNA, 282 bp, Triticum aestivum
  unsure (1)..(282): unsure at all n locations
  Clone ID: PAT_TA_46649
cgtccgcggacgcgtgggccgaacgcggccatgctcgcccgccgctgcggccactactgatgcaggtgagttttnccctcccccgccggcgccgttatggatccggcatccgaggagctcgagcgccgcaccactacctcagctcgctcatcgcgcaccaagctaatgcccgccgcccgcactctatttaccgagcgaacaactgactgagcgacctgcatcgcgacagtaagtacgcgtccgctctctttacatacggacgaacgacgagcgcctaacaac

SEQ ID NO: 46650 - DNA, 453 bp, Triticum aestivum
  Clone ID: PAT_TA_46650
cgcgggacggccacctcatccacccctacccgcctccgtcacccggagttcaagcaaccaacctcgcatagcctcctccggcctctcccggcgtcgcaggcgggggacacctagctgcccaccagcctagctgccggcagcggcgctgaacttgggaggcaacgacctagaaacaggagtgtcagtatgcaacaaatggcgctatctgcgttcgtcacgaccccctcctcgtcatatagcaataacttaccggggttgacagcccgccggtctcaaagatggcacgcgagacgcctgcgcagcaagggtcgagcgcaggcacaacaagagttgcagtataagaagcttggagattcagaccttcttatcaacgagattactctaggaacaatgacttggggggagcaaaacacagagaaggaagcacatgatatgcttccttattcttcagat

SEQ ID NO: 46651 - DNA, 393 bp, Triticum aestivum
  unsure (1)..(393): unsure at all n locations
  Clone ID: PAT_TA_46651
cgtccgcgcgcgcgtacgcaccgattcaacgcctcgcccgctccctctcctgctcagtccggccgtctccatgccgacgaggtccaagtcctcgagctcagatgtgcgcgcgccttctaccgcgcttcaccagtttccgcggtgctgaacttctctcgtgtttgtttgtttggttagctgggacccttttccctttccgagccgagcctagtacgctccaccctgtgcccctacttacgtcgcggtcggtcgtttccactgggagccgtgagctacgaccacgaggcgccccgcccttggagttcccaaccggcctagtcctgtctgtcggtgacggagaggcccggttntaaatgccggcggaggccactagccagtggagcatctggggcg

SEQ ID NO: 46652 - DNA, 133 bp, Triticum aestivum
  Clone ID: PAT_TA_46652
cgtccgctgaatctttagcagacgcacaggacatatgcgtggatatgttccatagtgggccgatgcagattttgtatcatgcactggcagcttgatgacctaaacgctgtgagtatgtatacatattggaaag

SEQ ID NO: 46653 - DNA, 495 bp, Triticum aestivum
  Clone ID: PAT_TA_46653
cgtgcgcggacgcgtgggcttaatcaatcaaattcatatgtgctgtttagaatttctgcagtgaaacaagcccttttgattctagcgttggtgccttagaacaaataatcattctagggtttgttatgatattttgtttacagttctgcatatataggcagcaaatataagtgacataacatgggcttttgtgggtctgccgttcttgcttgttcagaaatgtggccagatgacattgtgacaattgattttgagtctgctagcatacatattttctgaaatgcagttctttagttatacttaatgccacattttgtgccctggttgtgtttgtgagatactgagatgtctttctgctttcattgcatatgtaagatggtcgggagcttgtaaaactgcatgtcatatctgatgggtggatatatgattttcgtgttcgcccccttccctgaaagtacatggttgtaataagttatctacgtttatatgacaagt

SEQ ID NO: 46654 - DNA, 167 bp, Triticum aestivum
  Clone ID: PAT_TA_46654
gtgggcggacgcgtgggtgggcctgctcaagcttttgtggtggaggcaagggtggacaggggcaggggaccacttgcaacaactatagttaagtccggcacattagtcagtggacaatacattgttgtgggtgcagagtggggaagaataagatcactgagagacac

SEQ ID NO: 46655 - DNA, 260 bp, Triticum aestivum
  Clone ID: PAT_TA_46655
caacaacatttttttgatttaaaaccaaaactgtctcagtccacaggtcgagccatttggcccaaacctcctcatctcatcacggatatcagtctacggattaattaacatgaattaaaaacaactgtcggtgccaccttctcccaggagaagtgtcttgggagaaagatgctaaaaacggttaccgactcggacgaactagtatatctctttttggctaggacctatcctctcccctcttatttgtattccctctcccc

SEQ ID NO: 46656 - DNA, 172 bp, Triticum aestivum
  Clone ID: PAT_TA_46656
cgtccgcccacgcgtccgaggggatgttccaaatataaggaaaaagcgacaaactagtgggaactgtacgcaattgtgtaattttgcgctaaggaagagcggtcactggcgtgacaaccttttgctaaataatagtcacatccatctcctttatggacaccgggccggaagg

SEQ ID NO: 46657 - DNA, 189 bp, Triticum aestivum
  Clone ID: PAT_TA_46657
gcgcacactgctctaccgcgcgacactgcttcacccgcgcagccgctcggcggccgcgctctacctcaaccgcacctcttgcagccgtcgtgccctcccaggcgccctgtcctccttcctctcggcgccgaagtgccctccttcctccccatgtcggagcgcccctgcctccttcttcccgtggcgcgc

SEQ ID NO: 46658 - DNA, 526 bp, Triticum aestivum
  Clone ID: PAT_TA_46658
cgtccgctcccgctgtgtgccgccgccgacaggcccgccacccaccccgacaaccgtcgcgccggccgcactccccgccgcccccctccccctcgccttccctccggagcccaccccgcagctcggcgacctccacggcgtacatcagccggtctgcgatgaccctcgtcgggattttcctcgcagccctcatctggtgcgccgcctacgtcgccgccgccatctcctcagtcttctagtcccccctttctccggcaactccgcccccacaagcccaaccctacccccgtcttcaatcctttggtagcccaacgcctaccatgggtttcgcgcagctcgtcatcggccccgccggcagcggcaagtcgacctattgctctgggttggatcaacattgcgagacagtgggcaagaggattcatatgggcaaatctggatccagcttgagagcacttcagctacccctgtatctacttgttttaggagagctcatatcactggatggtggcagggaggagcttgggat

SEQ ID NO: 46659 - DNA, 437 bp, Triticum aestivum
  Clone ID: PAT_TA_46659
cgtccgagcacacccaaacagaacgtcgaacactatgatgatgaaccgacccaccccaacaggaacagctgctatgcagatccagaccatggtgggcggtatatgaagacattacgcaccgatcgaaccagtactgaacacggagaaacaaagcctactagacacagatgtggacggaacccacaagggcgacatgtacattacctagctctgattgaaagacgccggctcgaagacactcaacgaccatatcgatgcactgttcaagcgggcgagacaggtaaagcaggctatcactgctgaggactaacaagcgatggaatgcatcgatgtgacaccaaactttgcaacacctattgagcttatcaaaacattgagcatcgacggctgtggaaaaatatatgtggagatagagagagctagatcgatcaaaatac

SEQ ID NO: 46660 - DNA, 393 bp, Triticum aestivum
  Clone ID: PAT_TA_46660
cgtccggcgacaacgatgactgcccgccggacaagatcagcttcagcattgtgctgccggcgctgctgcgggcaggcgagatctccgcagcgtggaagactttcaaacgcatggagcacgccgggttcgaggcggacagccgagcactggacacgctggcccggggcctatgccggcaatgtgcggcggacatctcggtcctgaaggacgccaaggaggtgttcggcaaggtggtggcggccgggcacgagccggtgtcgtacacgtactgcctgatggcgcatgcactggcgcgcggcggggaggtggactcatcccgggccatattggacgacatggtgcgcaaggggttttgcctggggaagcgcgcgtacacggacgtggtgcgcgcgc

SEQ ID NO: 46661 - DNA, 556 bp, Triticum aestivum
  Clone ID: PAT_TA_46661
cgtccgatgaccctggtgcaacaacagttatcgagagcgtattcaacttcaatctttcaattcctcttaattttctattcgattcttttggagggaacatcttagttattcagggaataaaagatccgcttataaaatccgagtcattcgtttccatgcttagagagcattgcagcaaggtccaaattagggagttaaatgcaggtcatgctccgcatgatgaagttcctgatgaagtgaactccttactgtctgaatggatgaaaacgaacaagactgaacttaagccagctttggagaagtccaaggcaatttaaggaaatgaattattttaacttatgaaaggaatcggctagtgtttttgtttcatggtggagactagggaattccatctcccaagtgcttggcctgggttcaaaacttcagtcagtcaagatcacagttggcacagggtgctttcatcgaagtgtgtatgatcatgtttaaacgtcctaaactactaatcaaggaatcgcatcatcattactattggtattgaaactcatattttattttt

SEQ ID NO: 46662 - DNA, 267 bp, Triticum aestivum
  Clone ID: PAT_TA_46662
cgtccgcggacgcgtgggctgacgcttgggtgcaggttcatatatgatcatagctgttgactcgaactccacaagattagaagaatatagaaagttgtctgtacagaaattgtgaaccaggacgatcacagacagccagtatacgaggcgctcgctgtgatgacaaatggctgaatctatcgcattaccgaatgcactatcaactgctatgctatgattcaagactatgaacgtgtacatgatggctgcagagttgatgaactagag

SEQ ID NO: 46663 - DNA, 458 bp, Triticum aestivum
  Clone ID: PAT_TA_46663
cgtccggtaccttcatccttctgtacagctaaccccggagagatcacaccatgttcggctgcggtcaccacggccaccatggtcagaaccgcccggtccactctacggacggcgtcggtggcaaccagcccacctttaagatcttctgcaaggctgacgagggctactgcctctgcgtccgggacggcggcgtcgtcctggcccactccaacccccgcgacgagcaccagcactgggtcaaggacatgcgctctagctgccagatcaaggacgaggagggcaaccccgcctttgccatcgtcaacatggacactggcctcgccgcaagcactcgctcggccagtcccacccggttgagctcgtgccattcaacccgcagtacctggacgagtccgtgatgtggacggagagcagctacgtcagcaagggctttcgctgcattgcgatggtgaacaaca

SEQ ID NO: 46664 - DNA, 496 bp, Triticum aestivum
  Clone ID: PAT_TA_46664
cgtccggccgtggcagccactggctagtgccgccgtggaagaagccatgccccccgtacctgtactgaaggccatggaacagatcaaacgcagttccagctgctgcaaggagccgccgataagcatgaaggccatggaacagatcaagcgtagctccagctgctgcaaggagccgccgataagcatgctatcacgccaattcgtggctgccaagtacaaagggatgttttccttcttgagtcagaaccaacttgcttcttgagcatatcgcggagactcctgcgctattcactgccgtgcttttggttatcagcaaggctttcatgttggatggtgtttgatctatgaacttttgtttggacatcagtgggcatggttttgaaaattctttggttgacgtatgcacgatcgttgagattattaactggcttttcttattattaaaataaaaaactgtgttggtcatttatttatggtaaatattagcatggtatgt

SEQ ID NO: 46665 - DNA, 469 bp, Triticum aestivum
  Clone ID: PAT_TA_46665
cgtccggtgcatattgctcacaccagacatgcaccattgtaatctgcctcttcgcacagtttattctagaatttcttctatcaaagccaacttgggactccctggatagcggcagccatgtggcactacgaccggtatgataggcatgtgttatactaaggtgcatattgctcacaccagacatgtaccattgtaatctgcctcttcgcacagtttattctagaattttttctatcaaagtcaaattgggaatccctggatagctgcagccatcttgcactatgataggtatgaatggcctttacctttccactagaacaggatatgctcctcgcatagatattcttccaacttctgtgtggaaataggctagctgcttttgcgccatcccttctaagccttggatgtcaattacctgaaagcactggtgtcagcttatgatgtaaaaaatgtcgctctcatgggtcct

SEQ ID NO: 46666 - DNA, 545 bp, Triticum aestivum
  unsure (1)..(545): unsure at all n locations
  Clone ID: PAT_TA_46666
cgtccgcccacgcgtccgcccacgcgtccggaaattctgcacttagggagctatcttctcctggaaagagtggaagtgtatttttcctatcacaagatgatcggttcatgattaagactctccggaaatctgaagtgcaggttcttttacgaatgcttccaaactattataatcatgtccatacttacgagaacacactcataactaagttttttggcctgcacagggtaaaaccttctagtggtcaaaagttccgttttgttgtaatgggaaatatgttctgcacagaattaagaattcaccggagatttgatttgaaaggttcatccttaggccgttctactgacaaaattgaaatcgacgagaacacaactctgaaggatttggatctgaactactccttttatcttgaaccttcctggcgagaggctctacttaagcagataaagactgatagcgaatttctgaagtcacaacggataatggattacagtctactgcttggtgtccattacagagctncgcagcacctacgaacacgtgca

SEQ ID NO: 46667 - DNA, 417 bp, Triticum aestivum
  Clone ID: PAT_TA_46667
cgtccggccgcctcctgcacagcttctcctccgatccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagccttacggacaagagcaagctcgatgcgcaacccgagctcttcatccacatcatacccgacaaggcgaccaacacgctcacgatcggcgacagcggcattggcatgaccaagactgacctcgacaacaaccttcggaccattcgcaggtcggggaccaaggagttcatggaggccctcgccgccggcgccg

SEQ ID NO: 46668 - DNA, 430 bp, Triticum aestivum
  Clone ID: PAT_TA_46668
cgtccgagccaaaccctccctccccttcgccgacgacgacgatggccgccgcggcggagaagacggccgaggagatccgccgcgagctccaagagctccagcgccagcaccgcgagatcagcgagcgcctgcgcgacccccgtggcctccgacgcggcgcccccgccaccggccccggaggcccccgcccgctccgcggcttcgcgagacaggctccggagccggtggaccaaccggagcccaagcgccggcttctgtctgccgtggttaaagtggatggccctggaactaatggggatgatgcgggggcggaggggcgtgaggatggaccaactgccgctcaaggtggtgagaggaggggggccagtaatggtggtgggttcaggagggatgggagccagtgggtgtcgagaagggagcttgattatca

SEQ ID NO: 46669 - DNA, 498 bp, Triticum aestivum
  Clone ID: PAT_TA_46669
tcgcgtccgcgagtagccgtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgcttccagcaaagatgcccccatgtttgtctgtggtgtcaatga

SEQ ID NO: 46670 - DNA, 307 bp, Triticum aestivum
  Clone ID: PAT_TA_46670
cgtccgcggacgcgtgggttttggagaaacctgctgcaatccatgggtattgagctccactacagcaccgcttaccatccgcaaaccgatggtcagagcgaacgagtaaatcaatgtttggagcagtatcttcgttgtgctgtacaagacaatcctcgtcattggcgtcgttggctatccatggcagagttctggtacaattccagttttcatactgctcttcaatgctcaccattccaagctttgtatcacattgccccaaattttggaggaatgcctaaccttaccgtgtccaatgactcgccag

SEQ ID NO: 46671 - DNA, 185 bp, Triticum aestivum
  Clone ID: PAT_TA_46671
cgtccgcgctgcaacgattccgttcgccggggcgggggtgctcgtgcgcattcaccgaagtacaggcacgggcacgagttacaggcgacgacgtacgtatatggctacaggcatacctgaaccggagacgtagacggaggtgcagggttagccttactgctttgtgccgtacaactacaaccatc

SEQ ID NO: 46672 - DNA, 367 bp, Triticum aestivum
  Clone ID: PAT_TA_46672
cgtgcgcatcactctctctctctcccatctccatctctgtcagaaggggaggccagagggggacggagaggggcaatggagctggacgagcaggccttcttggaggagctcttctcgctgaggagggacgccacggccgcgtgggagtgcaatgccatgggggacttcttctccccggcctgtgctggcgccgccgccatggactgcttccaggagcggcaccagcccaccgtcagcgtgctgcccaccttcaccgtctccttcgaccacccacagcagcaggcgggggtgaccgcggctggggggttcgactgcctcagcgaggtctacggcggcggcccctacccaatgccgtcggcggggggta

SEQ ID NO: 46673 - DNA, 209 bp, Triticum aestivum
  Clone ID: PAT_TA_46673
tccgatagatcaagtgatcgtgagacaccaatataagcttagaattcacaagtacacattaattgtaatcacttagtagttatccgcctaagcaaacacagaagtacaatgcttgagatacatgtatgcagcaagaaagacaggcaatgtgataatacacttggtagagcttgtgtatctgattggatacctggagagcccggtatttg

SEQ ID NO: 46674 - DNA, 279 bp, Triticum aestivum
  unsure (1)..(279): unsure at all n locations
  Clone ID: PAT_TA_46674
gaccgagagacatgtagtgaaccgaatcacgtgcggagattgcatatgcccaacacattatctnnttgggatcaaattcgatgctcatatcagctgtagctgtgggatgtctggcggtgaatacctgtataccacactnttccataaactngatgccagttcacctcatacagcatatgatcaagtccttgcagagcttcggttctatgggatgaacagtttcgcgaggacaacaaatgcgaccattgtggaagtctgcagaatattgatctcttttct

SEQ ID NO: 46675 - DNA, 381 bp, Triticum aestivum
  Clone ID: PAT_TA_46675
cgtgcgcggacgcgtgggcggacgcgtgggccgtctgccccctcgccgtcgccccgctgacctcaaccagccgccggcgaaatggcccctaagcgaggcggcaaggcgccggtcccggcgaagaagaaaacggagaaggtgaccaacccgctgttcgagaaaaggccgaagcaattcggcatcggcggcgccctcccgcccaagaaggacctccaccgcttcgttaagtggcccaaggttgtgcgcatccagcgccagcgccgcatcctcaagcagcgcctcaaggtgcccccggcactccaccagttcacccgcaccctcgacaagaaccttgcaacaaacttgttcaagatgcttcttaagtaccggcctgaagacaaa

SEQ ID NO: 46676 - DNA, 264 bp, Triticum aestivum
  Clone ID: PAT_TA_46676
cgtccgcggacgcgtgggccgccgcgagcttccagaaacgaaccacggaaagggggaggaggaggaggaagaagccaagccctggatcgagctgcggcggctgaatggcagcgcgtcctccctctaacattgagcccggcgaggcacccaaagctggagagacggtcgaaagcatgccaagctctgaaggtgaggcatgactcaatggaatctagcgttctgggcaatacataaaggacaattaatgtgcgaggctggtgacac

SEQ ID NO: 46677 - DNA, 386 bp, Triticum aestivum
  Clone ID: PAT_TA_46677
cgtccggtgctgttttacatgctggatttgttgttcacaagggttgcctgatctgtaggttaggttaggtctcatgatatctgactgttttgtgctttctctgggtttggcatggaggtgcattattatgataatccagcttttcgaaccagcttttgccgcggctccaagctcagcacaacacagtccatcaaccataaacagagcctaagattatctgcgtcagtacgaaccaatgtgtcataagcaccaatgtttatctcacaaaataaaattatgatttatcatattctggtgtgccaactaccgacttattttacataaagctgcatgaattaaataggctactctttgagggcaaattattttttattttaggacagttt

SEQ ID NO: 46678 - DNA, 384 bp, Triticum aestivum
  unsure (1)..(384): unsure at all n locations
  Clone ID: PAT_TA_46678
cgtccgcggacgcgtgggcggactcgtgggcggacgcgtgggtgataaggaggactctattgaggaatatgagaagatagctaagcagaaaagggagaagaagttggagcagcaggaatgagctgaagctaacttcatcaattcacttaaccatgtccagaagatagagattctgagtggcatcaatgacatgaaaaatgagcttcaatcctttatggaatcctttgatccatcaaaacctgttacatctgacgatgtaaaatctattctcaagaaccttgctaggaagaagcagaggttatcctgagcttcaattgcttcaggtcttgcttgagagggtgtgccccgctgctgctactctaanaattccaactgctatctggc

SEQ ID NO: 46679 - DNA, 330 bp, Triticum aestivum
  Clone ID: PAT_TA_46679
gcgtccggccacgcgtacgcagaaacgctcctcaagcgcaactggttagtcgtcgacgcgtaccgaatctccaacatccccagcgcgcgccggcggctacgccatcaacaaagggtgtcggggacgccaagtaccgcgtggtgatgcgccataacggcgtgtacgtaaccttcgacaaagacggagccttagatggcgaacggatgatagactacaggataaacaagagctgagagaagaacaacgatgtgaaacggaatcaagacatatcagttatggggaaaaggccgatagaggagagaagacattgaaacccaaaatgaccatgaa

SEQ ID NO: 46680 - DNA, 366 bp, Triticum aestivum
  Clone ID: PAT_TA_46680
cgtccgcacacctgctccccccaaaggaaaacccacaccttgcccctctcccgacgccgtcgccgccgccgacgccgggcgccatggcgacgggcgacatcgcctgcctcgagcacgtcatggactgctgcctcccggcctccccggtctcccccaacgcccacctctccgacgccacctcctccaccgacggtgaggaccgcatcagcccactccccgacaccctccggcgcaacgacgactcccgcctgcccgtcaaggacgccgcccgcaccggtgcgctctcgcaccgctggcgcgggctctggcgcgccaccccgctcgccctcgacgacgcccacctgctgccggaccccggccccgccg

SEQ ID NO: 46681 - DNA, 214 bp, Triticum aestivum
  Clone ID: PAT_TA_46681
cgcgcggccacgcgtacggtccgccgccgtcgacgccgactactccaacggcgcgggcaacggcatgcgcgtggggacccacaacggcaggtttcactgtgacgaggcgctcggctgatttctcatccgccttacctcccatttcgcaggcaccgacgtgatccaaacactcgactgacagatcctggatgagctggaggacgagctagacgtt

SEQ ID NO: 46682 - DNA, 369 bp, Triticum aestivum
  Clone ID: PAT_TA_46682
cgtacgcggacgcgtgggcggacgcgtgggcgcagagaccggcgaattcgtactcgcctatctcgcgcgcttccgagcttaggcctccgggctgccctccttccccgagctctccaccagcgcagcgtagcgccggcttacgacgatccgacccagccagcatgagggagtgcatctcgatccacatcggccaggccggtattcaggacgggaacgcgtgctgggagctctactgcctagagcatggcatacagcctgatggacaaatgcccggagacaagaccgttgggggaggtgatgatgcgttcaacaccaacttcagagagacaggagcaaggaaagcatggaccccgagcggcaataagaaga

SEQ ID NO: 46683 - DNA, 397 bp, Triticum aestivum
  Clone ID: PAT_TA_46683
cgtccgcccaagcggctccagtccgtcgccgcctgccctagcgacgccgccgcgccgtacctcaccgtcgacgcctcaatcccgccccacgccgcccttcccaaagcacctcatcctctcgcgcgcgtcgccgttgccgtcctcggcgctcccctttcccccttatcgcggcgaagtcaacccctcccccgcgccccatggcgacctcgaagaaggtggtgacgcgcgaggagtgggaggggaagctgcgcgacgtcaagatccgcacggaggacatgaaccggctggtcatgaacttcctcgtcaccgatggcttattacgcaccgcccgaccgttgtcgtatctagttctgcacccaaccggagattgacctggtgaccatcaccgaccggatgg

SEQ ID NO: 46684 - DNA, 354 bp, Triticum aestivum
  Clone ID: PAT_TA_46684
cgtccggaagatgcactcaaaagggtatgtccatggtgatgtaaaacctgagaactttctgcttggacccccaggcacactgcaagagaagaagctttttcttgttgaccttggattagctactaaatggaaagacactggtacaggagaactagttgagtatgatcagaggcctgatgtcttcagaggaaccgttcggtatgctagtgtgcacgcgcacttgggaagaactggaagcaggagagatgaccttgaatcccttgcctacacacttgtttttcttctgcgtggtcgccttccttggcaaggatatcagggagaaaataaaggtttccttgtttgcaagaaaaagat

SEQ ID NO: 46685 - DNA, 241 bp, Triticum aestivum
  Clone ID: PAT_TA_46685
cgtccgtgcaaagagcacgaaatctactttcaagtaaagaaagaatcacccatctgtgctgtccgaatctgagtctcagaacgtaagagacgggaaattagacatggcacaaatgttccatacctttatatgtggattgtacaaatgtccaatacacctgtaattagacatgacacaaatatctgtgaagcatttttgtcctggataatataaataaattatggcaaagtgtgcataataa

SEQ ID NO: 46686 - DNA, 263 bp, Triticum aestivum
  Clone ID: PAT_TA_46686
cgtccgggcccatcggccgacccttctgagaggaggaaacgcatagtcaaggctgaactggcggaggaagctgaagaagcaggccaggcgaccgaggtgcccatgagaagttcgaggatggccaaagccaaggaggcagtggcttcagatgcttcacaatcggccaggtcctcaaagagaaagaagaaatgacggctatatgtaacaagatcggcaatgcaatgctgcttttgtcaagatacatagcagtattggtattacca

SEQ ID NO: 46687 - DNA, 302 bp, Triticum aestivum
  Clone ID: PAT_TA_46687
cgagcgaatctcgagcactaacctgcgaattagccccgtatacaatcatataatccctctaacccattcttctaagaatccgtctactgcggatccaatctgccggtccaccaaaccaatcctcgacgaagttcgtcagtcccggcagaggcagagcacagctaagtggggactgccgatgccgcagatggagacgataggttcctccctcctactgatacgactaaaagtatagagaatataatacacgcggacagtagatctcaatggaagccaaaagcgcagagcaactatgaataccc

SEQ ID NO: 46688 - DNA, 549 bp, Triticum aestivum
  Clone ID: PAT_TA_46688
cgtccggtttactcataaatctagaagtggttggcaaggtaaatgagggtaaaactgagaatatgtcaacaatgtcaacatgcacatgcttcatgtttgaataaatgttaaaaatatactccctctgttcctacatataggaccttttagagatgtagaggccgggggtccccctccttttctaaaaaaaaagactacatacgtagcaaaatgagtgaatctacactctaaagtatgtctatatacatctgtatgtagtccatagtggaatctctaaaagatcgtatattcaggtattctgaaatagagtgactgaaggagtgtcaaactatatacatgaagatgcatatcttaagagtttattatgttactaaatactaatttacttgccagtggattactttggttagttttcacaagttttcaaattgtaggatttttttaccttaccgctttgtagcccctgtcgaggaatgtatgtagtggatcatgcactacttgaagttgatcgttgggtgaaggaagatggatggtcttaccgctctgttc

SEQ ID NO: 46689 - DNA, 160 bp, Triticum aestivum
  Clone ID: PAT_TA_46689
cgtccgcggacgcgtgggcccgcatggccgccggcatcctggtggacctcccctccaaggggtccgacagcttctaacccagacaggagagccttcaccgcgactccacgtgccggttccttgtcgacgtatacgtcgaccccgacccggacctcaacaa

SEQ ID NO: 46690 - DNA, 282 bp, Triticum aestivum
  Clone ID: PAT_TA_46690
tccggccggctcgtcccgccgcggggtcgccggcggaggcgggaagcgcggcgggggtggcggcggcggcgaggcggcgcgccgcagcccctgtatgaaggaggcggccatcgaggaggaggggctcctcatggaggacgacgacgacgccgacggccgagccggcggcttctcggcgctccccaagaaggtgcgctacgggctggccttcgtctgctccttccttgtgcttttcaccttattcgtcctcaatcctctgggtcgccagcctcaaccagaagc

SEQ ID NO: 46691 - DNA, 239 bp, Triticum aestivum
  Clone ID: PAT_TA_46691
cgtccgctgctcgctgtctgtcgctgctgagctgagcttttttctacccccaccgcaacagcagccgcagcctacggataggggaccaccgttccggtgcgtggggaggaaccccttcccttcctttggccccggatcgatctgtctcagcgagggcctggcgggtatctgatcgacccaggaccagttgggggccgagtattaaattgtattcaagaaagaaagaaattcctagaaag

SEQ ID NO: 46692 - DNA, 412 bp, Triticum aestivum
  unsure (1)..(412): unsure at all n locations
  Clone ID: PAT_TA_46692
cgtccggccacgcgtccgcccacgcgtacggcgagcggcgccctanatntttttttttgtttgtagcaacaaataattgcagttacagtactgacaacattcgtgttcacataaactagaagcaatacgagatctaccaaagaaatgtattatacaccattcattccccattactccacacatgaaccgagcctatcatatattatcatccttacagtgatgcatgcactgcattaaaaaaccaatggtggggaatgattcaacatggtataaactcctccaaggacgtatcccaactactagaatttattcggactgtccctctagttaattccaaaattgtcctagcatattcactataaatgatctgatgaggtggcctcatgagatgcatttctccctatcattttct

SEQ ID NO: 46693 - DNA, 404 bp, Triticum aestivum
  Clone ID: PAT_TA_46693
cgtccgcaactttgtatatcagcttatctaatgtaaaaagaacataggactgatgaaatggataacaagctgctcgagctttatatatatgagaagtccaggtctcctggaaggttctttgatctagtttaccatgaaaatgctcgggttcttctccatgacgagagcatatatcgatttgaacggcgctcaaatcctacgagattatctgttcagcttatggagtatgggcatgaaaagcctgaagtaactgcagtctcaattgatccaaacttttcggcatatctttatgacgagtacttgtcaagtattttggattcaaaggtgtctgaagtatgtgtccttgagaggaataagcggaaacgcgggagcagcaatggccctcaagcttccttggcggtcat

SEQ ID NO: 46694 - DNA, 398 bp, Triticum aestivum
  Clone ID: PAT_TA_46694
cgtccgcggacgcgtggggcgcgcaccacacgtcgtcgcccacgcaccaacaaatccatccacctccccgaatcgcgcccaggcgcacaccggaccggacgaaaatggcgacgctctccgtccccgccgccgtcccggccgtcgccgaggactgcgagcagctgcgcaaggcgttcgcggggtggggcaccaacgagcgcctcatcgtctccatcctggcgcaccgagacgccgcgcagcgccgcgccatccgccgcgcctacgccgaggcctacggcgaggagctgctccgcgccatcggcgacgagatccacggcaagttcgagagggcggtggcccagtggacgcttgacccggcggagcgggacgcatagctggccggcgaggaggccatgaag

SEQ ID NO: 46695 - DNA, 382 bp, Triticum aestivum
  Clone ID: PAT_TA_46695
aggcatgtgtaggatgagactggaggccttttcaggtgttaataactggtggaggctgtgtggattacagaaactgctagatagcgtgatgagaaaacttcagtttgttttctttagcagtgttcagttcttctattgtataaagatttggcgccattggaatcttgcattgtactgcactactactggataaactgtacctggagcttagttgttgtcaccgctactgtgtttgcctctcctttaaaaaagagatgatcatgggcgcgctccttcccgatgtgcccgttggagtgccttgtgttttccggcttgcggaccgtctacatggccagggccactttgattcgcgtcctgacccgagtcggcaccacatgttagc

SEQ ID NO: 46696 - DNA, 371 bp, Triticum aestivum
  Clone ID: PAT_TA_46696
cgtccgcatgaccccgccacccctatacgccgacgacccttcgtgcggcccgaactccgacgccccttcgttgcctgcacaggtgcaggtttccctccgagacgatatcctggaggagatccttcttcgcctctccaccggggacgacctcgttcgcgcctcctcctcttgctcctgatttggccacgtcgtcattccccactccttcaggcgccactaccgctcccttcacaaggtccccgtgctcggcttcctccgagcttgcttgtacgccgaccattttttgcacccgttcggcccggtcttcaacgccctcgagcaggctgccgatttcgccttcagatttctccccaacctcacctgatggagcc

SEQ ID NO: 46697 - DNA, 510 bp, Triticum aestivum
  Clone ID: PAT_TA_46697
cgtccgcccacgcgtccgcccacgcgtccgcagagataccttgtggtaacacgatcaccaattcttgggggccttgcggcaatgcgcgactcagaagtagattacacagttgaggccattatggtgaaccctcagaatgaaagcccctggagatacctcagaggtttatataaggatgataacaatttgctggtggctgataatcgcatttctgatgcttgcctcaaggtcctgaataaggattggacatgcgtatttgctttgagcttcctgcttgatcttcttcgcatgggtttgcagccttcgaatgaacttaaaggaaccatcgaagcaatggagaactctgatcctgaaacgggacatgctgatattgcagtagctgtctgctcaatcctgtagaaatgtgatcccctgcggataaactactggtcatggtaccagaccactctttcttcttagacatctgaaaattcagctgaagacagttttagcagcatgatgttaactcaa

SEQ ID NO: 46698 - DNA, 249 bp, Triticum aestivum
  Clone ID: PAT_TA_46698
cgtccgcggacgcgtgggcggacgcgtggatcgcattgtctgttaaactggagagaaacgccagctatgtggaccggtcgctgcagctggtgactgctgaagaacatgatgatatggaaatcgatgacataactagcgacgatacaggcagtcaaagtgattcagacagctgctctgggtgggagacagaaaaggaggaagggaggtatttcgatcctgccgttgagggactgagcacttgtaaagcac

SEQ ID NO: 46699 - DNA, 192 bp, Triticum aestivum
  Clone ID: PAT_TA_46699
cgtccgtggtcgcgaggggttgtggcgcacgattgtctgatctatgccttgacactactaagctccggtctggtggtttgggtgtgccatgtcatagcacgagttgctgaggaaatgttaccgattttcgctgaactcgctggctctgtaccgtaaccatggcggatgtgcgagcgctttttgccgcacttt

SEQ ID NO: 46700 - DNA, 359 bp, Triticum aestivum
  Clone ID: PAT_TA_46700
cgtccgctctgccctccggcgctaccaggcaaaccctcgcccgctcgcccgctcctcctccgttcgccgacaccgcctcgcgcagccatggccggcggcggcgaccacccgggcgccaacaagcggaagcgcgaggccgcggggaggcccaaggcgccgtccaagggggccggccccggcgacgcggtcaagcgcaagaagacctactacgcccccgccgtcaagcccaaagccgagcccgtcaccgccaaagacaagcgggtggctgccaaggaaatgtccgagtccaggaagatgaagaggaagcccaataacaacctggagaaggaactcgcaattctattgggaaaagataagat

SEQ ID NO: 46701 - DNA, 303 bp, Triticum aestivum
  Clone ID: PAT_TA_46701
cgtccgcggacgcgtgggcggacgcgtggtcgccatggccgtcttccgccttctcttcctcgtcctttcctgcatcgtcgctggctgcaacagagatgtcgctgtcgcagtcgacgaccagtcgctgccgcagcaggagttctgcatggcgtcgtcttcttcttcttgcccggaagctgccgctgacgctgagccgttcaaggaggagaccagcggtgttgtacaagtgagatggccagctcgttcttcagacatgatggtctcaccatcaaggtcgactttgtactccccgtctgcaacagc

SEQ ID NO: 46702 - DNA, 265 bp, Triticum aestivum
  Clone ID: PAT_TA_46702
cgtccgtctctcaccacgccctatgtcatgccgtccgccgggccgtccatgtcggaggcggatgggctcctcgcgctggcggtggaggccgagcgccgccggtactttaccaccgtcacctcctgcctggactcggcgcttagcccgtcccacgccgtcttgtttctcccgttcgccgaggccctggcgcggttgcgcctcgtcggcctgctgttcgcccgcttcaaggggctcgccaatgccatggtccaccttgagctgcgcg

SEQ ID NO: 46703 - DNA, 231 bp, Triticum aestivum
  Clone ID: PAT_TA_46703
cgttcgaaaaaaacacaagcatttgcccgcaactcgcgagcgcatacacaccagaccaccaccaccgccagaccagcgccaaaacaggggaggtggagtgagcaccgtacctctgctttcggcgcaccaccgaggacctccagagcgcggccagatgggcgccggcggcatttcctgccgtcttcgtctccttcttccacctcgccgtcgtactgctcggactcctggctc

SEQ ID NO: 46704 - DNA, 425 bp, Triticum aestivum
  Clone ID: PAT_TA_46704
tcgcgtccgcccacgcgtccgcccacgcgtccgctgcgcctccgttcccggtcgggcgagctgcgaaaccccaatcgcctccgcatctcccgtcctcctcccggcggcgccgtcctcagtgcgcgccgcggcggccagcgagccaccgggccgagggaggagaagggcggcggttgctgcgttggccgctcgcttcccgaggtagcattcgcgctcgccctccgctcgccggctcccgtcccgcgcgcgaccacggcagatcgacccgcgagctcgccttggacgcgcctgcttcgtgcggtgaggagggggcgctgtccggcgcggcggttgcttctcgtggaagctttggggggcgcggcacggcccgttccggtttgttctgggagcatgcggtggcaatgtctgccgtatgggaggacatt

SEQ ID NO: 46705 - DNA, 331 bp, Triticum aestivum
  Clone ID: PAT_TA_46705
cgtccgctgagacaggaggtcttaagagtgtgttagatgaagttcctgctgtagtcatcactgaagcttctcaagggcaaggatcattatatccttctgttgaggatttgctgtacacctctaattcaggagggaacaggtctggtttcaaagatatgagtgatgctcaaagaaatgggaaatttgttatgcccttttgtgaacaacctggtcgtttcacttggcccaggttaagtccaaggcatccatatgcatatttaaatgaatggttccagccactaagatcgtgtggatggatggtcccagccgtgattcatattgctacccgaaa

SEQ ID NO: 46706 - DNA, 319 bp, Triticum aestivum
  Clone ID: PAT_TA_46706
cgtccgcttatggaagcctccctgccactgtcgacgagcgcgagtgcccccacccattggtccgccgttcgagctacgcccgcagatccggtgacggcacggttcacaacgcggtcctgcgagctgtcttctacatgctaccttcagcttctcagaggtagcagtaatgttactgaggttctacttttaaaaggagtacttgttgacatacactatgattttagtacaccactccatctatttgttaccaatgtacaagataaaatacagaatattttgttggaacaccacgctgatgctaacacctgtttcacctgtt

SEQ ID NO: 46707 - DNA, 496 bp, Triticum aestivum
  Clone ID: PAT_TA_46707
cgtccgctcccagcacctggacccctccccctgctcgtccgcgccccattcacccacatccgccaccgtcctccatgccctgccccccggtgtgcctgacgacccgattcctcgccaacgaactcctcctcctcggttccacacttctcggatcctcgtcgccccggccgagcagaaaccggagccctgccgcagatccgcagggaggaggagccgaggagggggaagaatggacgccccgtcggtggcgctctacaaccagctcaaggctgtccaaccattcttcttgttagctgggcccaatgtgatcgaatcagaggaacatgtcattgaagatggccaaacacatcaaagccatcacaaccaagcttggggtgcctcttgtgttcaaatcaagctttgataaagcaaaccgtacatcgtcgaaatcctatcgcggtcctggtctggaacaaggcctatagatccttgtaaaggtgaaggctgcatatgacct

SEQ ID NO: 46708 - DNA, 353 bp, Triticum aestivum
  Clone ID: PAT_TA_46708
cgttcgaagaaaccatcacagcatccaagcttgcagcagacagcgatcatcatccatggcggcgcaccaccagcagcagcaggaaccgtatccgcaggatcaatggcagcagcaggcggtggggttcgaggactacctgccggtgatggcggatcggctgggggaggaggggctgatggaggagctggtggcggggttccggctgcttatggaccctgtcttggaccttatcacctttcacagcctactgtcgcaacgcgcctctgctgggtctaggaggcatgtactactactaccttctcggtgatgctcgccgtgggcgacttctgacatgttacttggtcgcttatgtt

SEQ ID NO: 46709 - DNA, 294 bp, Triticum aestivum
  Clone ID: PAT_TA_46709
cgttcgcccacgcgtacgcggacgcgtggggtcaggttcagttattttagaaaaagctactctagtcggaccacgagggagaagcaaggatcccgcaggcaaatggagatgagatgatcatgggagcagcttggtacctccggggggatcgacggaaaacgagcctcgtcgagaagtgtgacaccccggtgcggacaacaatgagtatacgggacatgggggctaatgctcccgcggtgaaaccaggggtaatcagatggtaataggaatgtggggagagggtgtgttatgggg

SEQ ID NO: 46710 - DNA, 221 bp, Triticum aestivum
  Clone ID: PAT_TA_46710
cgtccggtccagtgcaatgagtgctgctagacatgagatgctacggatgcttatgttgcgtggcacaaaaaaaaaaatctggggtaccacttcggatctttttggacagtaatgaaggggcagatgttatacttaatgtgagtggagagagggtgcatgcccataatttggggttggctgcacagtctactggattttgatccaaacttttggacgatgaa

SEQ ID NO: 46711 - DNA, 484 bp, Triticum aestivum
  Clone ID: PAT_TA_46711
cgtccggatgtcacaagcagtcctgaaagtgaaggtacatgcaagaaatatgaccacaacagcaaagaagatgaaacaagcggtctgaaagttgagaacacaagtaatgagtttgacaagaagaacacagcggacagcaacagtgcccttgaacatgcgaacactgccattgaatttgaaggtacaagcacaagtgagagatatgaagaaaacctaatggaacaagataatggaaaattgcatgagccatgtgctgaggatgccaatgccctaacggagagtgggtcatcaggtaatgggcgcacaaattctgggttttctcgaggttcttctgaggctggtttagatgaagatcaatcctcaactggtaagagtggggattcatcatttcttgctggttactagaagaaggggttcaaggacctgtctttatttaaccagtccatggatagtgtttagagttcaatcaatggccattcaatct

SEQ ID NO: 46712 - DNA, 301 bp, Triticum aestivum
  Clone ID: PAT_TA_46712
cgtccgacgcaccctaaacgaatcgtccctcgattgttcgatcccgagcaccgacccaaccctagatctagcaggaggagctcaaagccgacgccatgggcaagccctgtggcggcgtcggcgcctgggcgcttgacgctgaacgcgaggacgaagtgcgcgagcacgccgggggcttaccctcgctcgagcctgcccgcgtagatgggggagccattagagcggcatgctcctactctacaagggctgtcccttgcaccgtgtgatacccagacttaatgtgccacggcggttacttcac

SEQ ID NO: 46713 - DNA, 490 bp, Triticum aestivum
  Clone ID: PAT_TA_46713
cgtccgcaactgttcatccaaatggcatgatacaaactagtcagaacagttgttctgatactagcaagaaacaaactagacggaacaactgggcagatattagtaagttagatcaagcagctacttatcctgatagtagtgtgtatcagaatgtttctcagcacgagactggcaatcatttggatgatgggagaaaatataaaatgggcatcggctgtcaaattaaaaggaaagcagcacaaggcgatggtgccaaatggtttgaacaaatgcccagtttgataacaggtccaacactgctggatcaaaaaaagtcttgcagtttgctctcctgatgatggtaatgtgaaggtctgtgggtcagagtgttccaatcagtgcagtaaaactactttagaattggagaaaggaaagaagtctgtcaattgctccagtggaactgactgcagagtcataaaaatttgttccagtggaggtgattgcagagaca

SEQ ID NO: 46714 - DNA, 484 bp, Triticum aestivum
  unsure (1)..(484): unsure at all n locations
  Clone ID: PAT_TA_46714
cgtccgcggacgcgtgcgcagacacgtgggccaggcgcatgtagaacgctcnacgcaattgcactggtttctatgcacacacgcagcgacccattttatgcacatggtgcgctctagagactactcgaaagctcgaccgactaaggacgatttaagaggatgcggaacgcatgcaatgtcagacgccataagaagaattacctggtgcctgacgttaagggcgcagttcaactcccacctgccgaagttggcagtgaactcaaaaacggccgctacgtgcacagtgtttgatgggggggttcgggctacttacctgccgtggttgcgtaaattaccgctagcttatgagctgggtgaccacggaaggcgacaagaagaacatgatgagcgccggcgacctgctgctcggccggaagaacaacgactagctcatgttgctggtcaatatgatcaccatcgaggacggcgggctgatgatcaacat

SEQ ID NO: 46715 - DNA, 493 bp, Triticum aestivum
  Clone ID: PAT_TA_46715
cgtccggcgtcaacacacttcggcgctgccgcccccgccgtccctaccgcgccttcacttggccgccggggaaacgcgggagatcccctcgattgctccgccgcggcctccgtacggcagcgctccccggtgcctctgcggcggcctaagcgtcgccgccccgcgaaaccctagaacgccggagccgcgcacggctcgtggttccgggctcgctgttcgctgcctccatgtcctccccgccgccggaagccgtatgggacgctggtgccccttcatccagcggtactttgccacaggacataagtgatgtgtccaaatctacagttggtcagctgcaagcagcagatcaggaagcaagttcccagtcaagccagcatgcatggcaaccacatatgaatccatcatatcaggtggctcaaccaaaattggaaactggggtttcagaaaatgaaaactttattctacagggggacaccatttccagccagtacat

SEQ ID NO: 46716 - DNA, 465 bp, Triticum aestivum
  Clone ID: PAT_TA_46716
cgtccggtcacgcgagtccacgtgcggttccgtttgccgctggccacgaggtgcagccttggaggggcacatcggagcgtgggcctcctctgttttcgattgggtgcagcacacgttgtggggttgaggtgttctccgatgattggcttatatggtttatagacaccattgagtgactgcagctcctgtttcgtttaactacggcgaaataccaggtgatgagtcttggaccggcgcaagaataaactccgcagataccgatagatgaacatcgctttatgaacatggtgaatttagcgacaactaaagtaaatccataggcccagacttgagtctggatcaaaactacacagattctgcattgtatggctacaagcttgtaattatagcgcacagatcagtactaactccaagcccttagctccttggttcttcttctaccgaagcactttgtcacttggacaa

SEQ ID NO: 46717 - DNA, 369 bp, Triticum aestivum
  Clone ID: PAT_TA_46717
cgtccgtctaaccctagccgcctgccgcacgcttctcctccgcctcgagcagctgagggacgcgcgcagccatggcgacggagaccgagaccttcgcctttcaggccgagatcaaccagctcctctcgctcatcatcaacaccttctactccaacaaggagatcttccttcgcgagctcatcttcaactccttcgatgccttggacatgatcaggttcgagagcctcacggacaagagcaagctcgatgcgcagtccgagctcttcatccacatcatccccgacatggcgaccagcacgctcacgatcgtcgacagaggcattggcatgaccatgtcggacctcggtaacaacctcaggaccatcggca

SEQ ID NO: 46718 - DNA, 398 bp, Triticum aestivum
  unsure (1)..(398): unsure at all n locations
  Clone ID: PAT_TA_46718
tcgtccgcggacgcgtgggcggacgcgtgggccatcccattatcacacgtcgcctgcaccctcgcatctagctccgccatctgggaatgcctaagaagaaatattcatcccgcaaaaaaagaagaagaaatatccagtcttcatgtatgcttggcaaaggttgataccaattttcatagtttattctgnagtaaatgtcctctacatggtaaagagacttgtgcttgaagttcagactgaaagtaccaaacattctgcaaatattatgtaccaaatntcagacttgtgcttggacaagctgaaagtactctatggagtaaaatttcagacttttagacttgtgcttggacagtctgngaagtcttgagcttgtccaaattcatacttcagactgcagt

SEQ ID NO: 46719 - DNA, 347 bp, Triticum aestivum
  unsure (1)..(347): unsure at all n locations
  Clone ID: PAT_TA_46719
agctgaccgacgcctgcggtgcccgcggccggcgcgccggcgtctggacggacgcctgcttcgcgnctacgccgacaccaacccgtcctcgcccagttacgatgacttccgcgcgcgcgtcatcaccggcgccgacgcgctcgccaccagctcgtcccccgagctgcagagcctcgccgacctggcgtggcgcctggggccggtcgcgcccgccagcgcgaggatgctggtggccatggactggacggccgcagcgagcgactacaagaagaacagcacggtgcgcgtgctggcgcattgcgcgcaggaccgcacggcgggggattgcgcgtggtgcgtgcagtact

SEQ ID NO: 46720 - DNA, 456 bp, Triticum aestivum
  Clone ID: PAT_TA_46720
cgtccgtagcagtgacctgcgttccttgcagaaactgactcatgctaccaccaaagctgccaaccccaccgccagcgcgccccattgtccacaggggagtcatgattttggtcggcgagaacaaggtcgtgatggcggagttaatgacccttgcgggcacgaagcccaatgccgagaagcggctgccggcggacaatacggcgtccatggaggccggctgcgagggcaagacccggggccgtaagatgggcagcaaggccaagaagggcgtggagacgtacaagatctacatcttcaaggtgctgaagcacgtgcaccccagcatcgggatcttcttcaaggccatgtccatcatgaactccttcatcaacgacatcttcgagaagctcgcctgggagtcgggcaagctcgcccgctacaacaagaagcccaccatcaccttccgggagatccaga

SEQ ID NO: 46721 - DNA, 156 bp, Triticum aestivum
  Clone ID: PAT_TA_46721
cgtgcgttgcactcatgagctagctccacagcgtccactttcgcgacagctctccgagaagagccctaactagcttcatcttcatcgagcctgaccggtcggcatggaccgcatggacaagtcccgcaagtcctgctcaggagcattcatgggcgt

SEQ ID NO: 46722 - DNA, 310 bp, Triticum aestivum
  Clone ID: PAT_TA_46722
cgtgcgcgcacgcgtccgcccacgcgtcctgccacgcgtccgggcaactccggaggaggggaacgaaacgcatccggcggagctaccatggcgtgtgtcgctgagcaaggccaaggccaggtccaaggcagcggcggcggcggcgggtatgcccggtggagcagttctggtcgctgctggacaaggcggaccggcgcttcgaccgggtgcgggacctgcccctttcggccgccaggagcccgcggagtacggcaaggccttccgaatctacacccagctgtggcgcatgcagcaggagcactcggcaccg

SEQ ID NO: 46723 - DNA, 169 bp, Triticum aestivum
  Clone ID: PAT_TA_46723
cgtccgcccacgcgtccgtgcatagtttaaggcaagagtgacacattactcgtagtgctggaagacttccatagtgaatatgagaagttcgagtgcccatgtaagctactatttttggtgatgttagtccgatgaactatctctacactgtatgggattcatacattgt

SEQ ID NO: 46724 - DNA, 104 bp, Triticum aestivum
  Clone ID: PAT_TA_46724
cgtgcgcagccaccatgccctcctccctcattggagaacagaacagggatagataaatttgtccggaacatcggcgggtctttatgcagagagtcctcttctcc

SEQ ID NO: 46725 - DNA, 263 bp, Triticum aestivum
  Clone ID: PAT_TA_46725
cgtccgctactagggagtttgtgtctactggaccgtgcatgcagtatttaatacccactgctttagatgttgaatatatttttactatagttattggaactaattttcttactagtatgacagaaattgaaactgctactagtatgtaagaaattgtacgattttagtactatcagtgatctaatacatgccctacatagtctgacgacggtggtgagggctcaaccagttgcttgcaacagattaattatggaatcaaatta

SEQ ID NO: 46726 - DNA, 195 bp, Triticum aestivum
  Clone ID: PAT_TA_46726
cgtccgtggacgcgtggggccctcaaccactctcttcttgccgccacactcctcactctcactgcgctttgttgagccagctcgccagtcagagaagatgagggagatcctgctcattcagtgtgtgcagtgtggaaaccagattgtatccaattcctgggaggtggtgtgtgacaatgcattgcattgacccca

SEQ ID NO: 46727 - DNA, 397 bp, Triticum aestivum
  Clone ID: PAT_TA_46727
cgtccgccaccacctgcccctctaccaccgcccactagagccgagccgagtctgcctagagagagaaacaacgggagagagaaaagagttgttgccttgttggtgttcattgcgtgcgcgccggcctcctcgccttccctccctgttctcatccatcctcggtcaccactcaccatgggcccttttgggttttcggcaccaccatctcactcatgggtcagagcagtcccctccgctccctcccttcacacggcgcgggaagagagagagagagagagagagagagatgagagagagagagagggccgacggtgcatgcgcatgaatcttccacccacacctcccctgctttcccttgcaacctttattagtattatcttcttccttcccccctccc

SEQ ID NO: 46728 - DNA, 182 bp, Triticum aestivum
  Clone ID: PAT_TA_46728
cgtccgcggacacatggactaccacctggtgtcctagagaaggcacattcatgccttgctggtgaacagctccatccacaaaaaaatcccagcctctgatgtttgcatagaagactggaccaattgcaggctatacctgcggataaggatcatgcccaggtggccacacagatgtgcccccg

SEQ ID NO: 46729 - DNA, 184 bp, Triticum aestivum
  Clone ID: PAT_TA_46729
cgtccgggctggcggctggcggctgtctactgtgcaggaccgtcgagaagctagcggctggaaacgagggttcattgaagatggcaatcgttctgctagctggtctccgcagagcaaagcagctgaggaagaacttatggtctgcatacagaacactctcatcaggatcttttacaaaatgggt

SEQ ID NO: 46730 - DNA, 215 bp, Triticum aestivum
  Clone ID: PAT_TA_46730
cgtccggtctgccctttcgccgcgcgcggtgcggggaggaatcctttactcatttctgttccggctacttccaactcatccgacgtgccgcgcgccgtgcgttcccctgtgccttgccgccgctggattcctttccttgccttttccttcctttttccccgcgcatgcactgtgactgcctcttgtgattgattcacgcgccaatggtggacgcg

SEQ ID NO: 46731 - DNA, 329 bp, Triticum aestivum
  Clone ID: PAT_TA_46731
cgtgcgcggacgcgtgggctcccagctccaaacccaggaaaccctcgccttcccttgcctcccctcgaggcgtgctattcccgccggccgaaggggaccccagacgaggccgagctagaaggaggagcggagcaagatgcccccgaagaaggcggcggcagcgaaggccgacgacgcgaagaagcagaagggcgcggaggacaagacctacgggctcaagaacaagaacaagagcaagaacggccagaagtacgtccagacagctgaccaggccgaccaggccaagcccgacccgaccaaaaccagcgtcaagaagaagaaggaggagg

SEQ ID NO: 46732 - DNA, 412 bp, Triticum aestivum
  unsure (1)..(412): unsure at all n locations
  Clone ID: PAT_TA_46732
cgtncgccacgcgttcgccacgcgtccgttgacgcgtgggttgttaacaacatctcgtttatcttcgtgtatgtagcacgatgcacttgaagcagctgagcttatctgttcaacttctttttggcgggcagaattagaaactatactactagatctatactaccacatcgaggcagcaaagataaattcagaaacgaggagagaaagaaattagcatggattaaaaaaataggataacgagaagcaatcatggagcacgaattctgctccaagaatcacgatccccggcgtagatccacgaccacgacgctgacgttgtcggagctcccccgcgccagcgccagctttgccagcagcatggccgcgtcggagcacgcccggtcggactccgccttgttaccccctcgctcgc

SEQ ID NO: 46733 - DNA, 110 bp, Triticum aestivum
  Clone ID: PAT_TA_46733
cgtccggagtctctgagtccatgcgtccgaagactcatgggttgagcacaacatttggactatagatgaagctggagcacaaaccacttgaagcagatcttcttacttgc

SEQ ID NO: 46734 - DNA, 191 bp, Triticum aestivum
  Clone ID: PAT_TA_46734
catggccggagaaagaagagtcgccgttgtagggccgctcaagggagaggatgggctggtcaaggagaggcaccaagcgccaccggaagagtgctgttcgacatcatgcagggcatgaccaagccggccatccgccagttggctcgcctgggcgtgcgtgaacgcgcatcgtcgtggactcatcctacaca

SEQ ID NO: 46735 - DNA, 321 bp, Triticum aestivum
  Clone ID: PAT_TA_46735
cgtccgcgagcgcctcctcctttattgacctcgcccctcgtcccctcgtcggcgcgccgatctaagtcatagatgagtcgtttctgcagtgctgtggtggtcaaagttctctgggttacccgcctggagatggtgagccttcatcgcccgttgtagctccagctgagaattccgcacctgctgttaatccagcaccggtagctgctcgtgttgccaaacatattccagcttgctttccatgtatatcttctttacaactactaccgttctgttcgtcataacactggcatctttcttacggaccgttctttaaccaatgtt

SEQ ID NO: 46736 - DNA, 375 bp, Triticum aestivum
  Clone ID: PAT_TA_46736
cgtccggtcacattcacttccaaagatgatgcagtacttgagtcagcaatcttgataatgggagagctggttttgagaaatgaggtcaataggcgagatttcttaacgcagatccacagcttgagattatcttgaggctgctggctctgagaagcaatggcttgtttctgaaggcaactgcagtgctttatttgatgaagccaagagctaagcagatgctatctatggactggatgccactagtattgcacatattgtagtgtggggatgaggtgcagctcgtgtcttccctgaagtggtatccaaagatggcggcattctactttctagatcaactccttacagagtttgacatcttcagaaatattgtgaacg

SEQ ID NO: 46737 - DNA, 363 bp, Triticum aestivum
  unsure (1)..(363): unsure at all n locations
  Clone ID: PAT_TA_46737
cgtgcggtaaaatgtcgtcatatactgaaggacccatgagtcatgcacgtagagaccttgtgctcaagatccaatcagatgctcaaacttggtgggagggagcaaggttttttatgctgaacctgtctatgtacctgctggccctggtgaaaaatactttggcaattttccgtacccttacatgaatggattgctacatttggttcacgccttctcactgtccaagcttgagggcggtgctgcataccacacactccgaggctcgaatgtactnttgccgtttgcttttcattgtactgggatgcccattaaggcctcagctaattaacttgctagggagattcaacagtttggaaatccttc

SEQ ID NO: 46738 - DNA, 305 bp, Triticum aestivum
  Clone ID: PAT_TA_46738
ggctagaaaccctcaccttctggtgctcaccaataccatcagtgagcaatagtaaggtgatggaggttaagccaccatacatgccagaggagactactcctacattctatcatacacagaatagcatgatgtttctgggaatttctatgttcacagtggttaatcttcttcgtgtattacaattaaaccggtactacttggatagctaatctattatataatccagcttgagagacagacagctcttggattcaccactcactgaccaagaccttgtcgttttgatcaagtgaacacctgcgtgc

SEQ ID NO: 46739 - DNA, 563 bp, Triticum aestivum
  Clone ID: PAT_TA_46739
cgtccgctctgtggtcgcttcccgcatcgtcacacctaatcatcttcctttgcattggcatcatttcttgatcaaatatagaggaaatagcatagtttgggctgtatccatggtaacgatgtccttatctgtcagccatactataactatatccctgggacatcttcacaccttgattgatatacaatcagggcctatcgccttaaccccccctccatccttttcattgtctctttgatatcagattcatgagtcgtccgcacatagtgcgtattagtgttatcaaactagttcatccaattgtgggacatacgctcttatttacgttaagaccatatctcgtaagccaagcttaactaagatggtcctatcccctttccttcttacatccaccacaccattctttgaggctcttattaattgcaccatgagcttgatgccaatattgtgccaccttcttcaccctctgaccttttatttaatcttcttgaacgcaaagatattttgcacccctccttattgcccgattatcttatactcatttgtcaactagctaaactttt

SEQ ID NO: 46740 - DNA, 407 bp, Triticum aestivum
  Clone ID: PAT_TA_46740
tattcgtcccacgcgtgctctttaaggttaaagatgtcatgaagtaacataacgagcttccattgttcaaggagggtaatatgattatggatcatcttactgagtcactagtttaggttgtggttgtcttcttgaggtcgttgatgagtatttttgattggaactttcaccgactgagaccttcggcgtacactcaaggcctgggggccatctattttcagtctaacagtcgtatagatgttcaacaggaacccaaggacaatcatccgctgattcattggctgttgttttcatggatattatggagttaccctcttcacctgtgcatttcattccggttttcgatgacaaaaacatcaagtctttgatcatttcactgcatgagttgttttccgctggtttgtaac

SEQ ID NO: 46741 - DNA, 352 bp, Triticum aestivum
  Clone ID: PAT_TA_46741
cgtgcggactagttctagccgcctcctgtcctgtcggcttcgtcgtctccatggagtagccatcgcgtcccctggactctaggcttccggcgagatctcgaccaactagtgttgaaccaaacaccatcatgtcaccggcagtgagcaggctgcatataaacgggaggctgtacgtagatggcatggcaccaggcaccggcgactcggaccttcgtcgtcacttcggtcgctacggggacgtggccgacatctgcattcccacgcaccgtcttactggccaaccccgttgctgctcctctgtccagttctctagacctcttgacactgtgtgcgccctcgcctacccacacca

SEQ ID NO: 46742 - DNA, 410 bp, Triticum aestivum
  Clone ID: PAT_TA_46742
cgtgcgcaaagattgctcatctttggaaccatgatttgatgcagaataagcagacacagtatcatcctgaagagcaattatgctcttctgggagaaaagacctgtggattgctcagtagaacttacggaaacaacaggaattgatgtgacagatcaactttctaaggcaaaagctctgggaatccttgatcattccctgatgatgaagtagaagcagtaatgttgttcttacaagctagtctgcttgacaatgctatggttcttaagcatagatgcgaagacttaatatttaaggttgtccagaatctttcttgcgatgtggatgtttcagtaaaagaaaatgggacttcatccgtggcaatcattttcttcgtgacggtagagaagctaataaacgtatgctttaagag

SEQ ID NO: 46743 - DNA, 210 bp, Triticum aestivum
  Clone ID: PAT_TA_46743
cgtccgaagagatcggcgcttattctgcatcgcagctagtatatatataggctagaactcatccgcccaagaaggaacaggagctaggaccggatggagataatggcatccgagttctcctttgcccgatgcgtctccctccccgccgacgagcactggcgcgccttcgccttcaccttctacaggctgtggcacagagctgtttgcacc

SEQ ID NO: 46744 - DNA, 410 bp, Triticum aestivum
  Clone ID: PAT_TA_46744
acgcgtgcgggacgcgtgcgtccacacatacgtccacgcgtccgacgaaaggctgcagttctaaggtgcgtcaaagaacaaggtagcacctagcgtgcttgcctccagaaacaacggcgtgcgctactctcctcaagtctgctttccttcccacgaaggccgcatggggcgccacgcgccaggctggcggccccaagccgatgaccgtctgcatggttgtgcgcgccagcgcgtacgccgattagcttgtcaaaaccgcgaaaaccatcgcataggcaggcatgggtatcctcgccatggatgagtcgaatgccacctgatggaagagactcgccccgataggccttgataacactgaggctaaccgccaggcttaccggaccctccttgtcactccaccaggagtggga

SEQ ID NO: 46745 - DNA, 317 bp, Triticum aestivum
  Clone ID: PAT_TA_46745
cacccgggccatcaaaccctagcctgctgaccgttcctccatggccaacccctccatggcggccggcggcgggggcgggggcggagggggcccgcgccgtcggggcccatatccgcaaccgcctccgcgtggcgcccgtcgaccgccgctggctctggcgccgccccgagggccgtgccgcatccgaggccgagcgccagtggttctaccgccttcgcgccatcctgcaccgggacaaacagaatcaggggcccgaccagtagcagcaacaggagcgccccgcagacccccgactccgtcttctgcgactggagggc

SEQ ID NO: 46746 - DNA, 225 bp, Triticum aestivum
  Clone ID: PAT_TA_46746
cgtgcggatccctgtctcgaatgaaaactcccatgactggaatgcctctggtgaatccactgggaacatgccgaataatgtgtgtggttgggagatatgcctcaaggagcacctcatgaggttgccatacccggtgttccatacatgggatccagaacattgcaggacttggctaggggggaggcctgaagggcaacttccggggatatattccctggcttaaag

SEQ ID NO: 46747 - DNA, 216 bp, Triticum aestivum
  Clone ID: PAT_TA_46747
cgtgcgatgcggtctcagctagagatcgtcagtcatgtccgttcgcgttaagggaggcacggtgctcagcaagggcagtgccaagcccacaggaagtgtttttgcgacaacattcatggcattaccaagccggcgattcggctgcttgcacggctcggcggcgtgaagcgcatctcggggctcatctacgaggagacccgcggcgtgctcaagatc

SEQ ID NO: 46748 - DNA, 157 bp, Triticum aestivum
  Clone ID: PAT_TA_46748
cgtccgaggagaccaataagaatcctataagaatcgaggccggcgaagatccatggcggcggcgcttcgatccgcggcgaggaggctctgcgcggccgtggctccctgctccagcgaacgcaggcggaggggctcttctcgccaagcagaagcaggc

SEQ ID NO: 46749 - DNA, 332 bp, Triticum aestivum
  Clone ID: PAT_TA_46749
cgtccgcaaacgccggctcgctctcgctccgtctccctccctcctcccccgctccgcgccctccgtcgccagatcccgtcgagccccccgcgccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtctttgtcgatcttgagcccaccgtgattga

SEQ ID NO: 46750 - DNA, 152 bp, Triticum aestivum
  unsure (1)..(152): unsure at all n locations
  Clone ID: PAT_TA_46750
cgtccgcccacgcgtccgggagtattacagagcatattttaaaatgcttgactgggtttctactgaatactgatagacattatttcatgttcattnttctttatgaactactgataattcctgatggatgaaatatgatatgactgaatgac

SEQ ID NO: 46751 - DNA, 287 bp, Triticum aestivum
  Clone ID: PAT_TA_46751
gaccggccggaattccggtcgaccacgcgtccgctcacattttctctgggagcgtctccgttagctcatccgctagactatcgcctatactctcggctgtcggctgcgaagagcgaagggactctattagggactatacatctaaacacacactaaatcgctgagatgacagcggaggagacagcgtgggtgatgcgcaagatgaacaacatgaggaacatgtttggtatcatgcatgttgatgaccatgtggatacccttacggctacccttgcggaatctgttgt

SEQ ID NO: 46752 - DNA, 393 bp, Triticum aestivum
  Clone ID: PAT_TA_46752
cgtgcgcggacgcgtgggcggacgcgtgggctccacagctcaacttccacccactctcaaaccctgtcgccggagcccccatcagggagcatgcaagcaagatggacggctgcaaggcgaagaacgtggccgcgaacaagttcggcgggccgaggaagaagtcggtgaccaagtccatcaaggctgggctccagttccccgtcggccgcattgggcgctacctcaagaagggtcgctacgcccagcgcgtcgggtccggcgcccccgtttacctggtcgtcgtcctcgagtaccttgtatccgaggtgctggagctgtcctggaacgccttcaaggacaacaagaagacccggatcgtgcccaggcacctgctgctggccatccgcaacgacc

SEQ ID NO: 46753 - DNA, 507 bp, Triticum aestivum
  Clone ID: PAT_TA_46753
ggcggacgcgtgggcggacgcgtgggcggacacgtgggctcgtaggcgactcggctacccagaaatctaggatcgcgttctggctccgggctctgcaccgcgcgcggagcttcctctccgtcctcgtcaactccttccccagcgaggcgggcggtgtcgccgcctgggcagacgacggccacccggcgcggcagggcccgcgggtcttaccggtgggggcgctgctggcgctcggcgggggcgacagcagcatggagcatcgaacgaaaggcgactggcccccggtggcaccgtgcaagcagcagcagcccagcagcatgtggcaggcagactcgacgtgcatgggctggctggacaggcaacgtgcggcgtcagtggtgtacgtctacttcggcagctgggtggggccgatcggtcccgagaaggtccgcgagctctcgttggggctggaggccaccggccggccctttctgtgggcgcttcagaaggacccgtcttggcgcgctg

SEQ ID NO: 46754 - DNA, 334 bp, Triticum aestivum
  Clone ID: PAT_TA_46754
cgtccggctaggcagggagggacccctattccgtatctggactcacctctgtttctcgctcgcaagcacaggacagagaccactgcttccggagatatggccaccagcgtagcggagggcgcgcatcccacgatccgacccgaacgcatgatgagagatgcgtgttgatccacagtcaggcatgcactggatacaggttagggaacgcgtgctgagagctctactgtctggagcatgggattcagactgatcgacagatgcctgagacaagaccgttgcgggaggtgatgatgctaagaacacactatttaacgagactagcactgggaagcat

SEQ ID NO: 46755 - DNA, 210 bp, Triticum aestivum
  Clone ID: PAT_TA_46755
cgtgcgcgcgatcgctcgctcgtcaacagcgaccgagccaccgcttcccagcgctgtcggccatggacacctccatctactacggcacatgcttctcatctgcggtgcggttcacccagaagcctcccaacccgaggccctttctcaaccccacccctctagtctcccacgccagtgccggcctacagagagccacccgtcttcgctcca

SEQ ID NO: 46756 - DNA, 319 bp, Triticum aestivum
  Clone ID: PAT_TA_46756
cgtgcgcccacgcgtccgcggacgcgtggggcgagcttcattcgaggacaagcaccagcggtggagtggagaagaaagtacaccgggggcaggttggctcttctgcctcgttatgaccttggcgttacctggtgctgggaatggacgcactgactgtgacgcagtcttgattgcatcgctagtccaggaacaatgcaatggcgagccagtgacaggcttatgctgtgaggtgctcatgacaatcattacacccttgagggtcaagctgcattgccttaatgtggtttttgtcctgcctgagctcaagttttcgggattt

SEQ ID NO: 46757 - DNA, 164 bp, Triticum aestivum
  Clone ID: PAT_TA_46757
cgggcgggcacgcgtacgatcgccttcactccgctcgcgtctgctacacttcctctcacggcccggctagatctcacccgcaggggatgggggacgctaagcaggaggggggcggggcacccactggcgtctggaagacgatcaatccattctttaatggcggg

SEQ ID NO: 46758 - DNA, 186 bp, Triticum aestivum
  Clone ID: PAT_TA_46758
cgtccggcggatgtgttacttgtccaacggttcacgtgaccatgatgttagcaacttcactaacttcatacagaagaactctggggccacagggttagataagtattttcgtgcatattgccacaatttgtggcgcggtctacatcaatggctttatgcttatattcaatgcaggctcaaaagaat

SEQ ID NO: 46759 - DNA, 283 bp, Triticum aestivum
  Clone ID: PAT_TA_46759
cgtgcgatgcaatatacaaattctcggcatgaattatctgagaaagaaggctcttccttgcctgtctgtaatacttcatcagatggagggaggggaattcctccatgtgcagatgaaccgtgcacactctaggtgaaagttttcaggatggacctggctacactaataagcaataacagatgatggttgctccttttaaaccttccaaagacatagggtcacagatgcaacaaggaaccgaaaccctcaccgtgcaagaggtcaagactgtataatctgattc

SEQ ID NO: 46760 - DNA, 354 bp, Triticum aestivum
  Clone ID: PAT_TA_46760
cgtgcggaggcgcgctatctaatgagccagaaattccttaatcagttatgagagttgctgtactacagcaaaatcttacattatgagagtggtgggacggcatcaaaatccaacaggggaggtgactcaaggaaacattttcgcatttataattcttctgctgcaggagagttgttgtactcacgcgacacttgttccagcatcaatatgatatttacaaattgttagggcatatatcctcacacgcaatctcgtgtgataatgttgtacccacttcctgtatccaatgccacatttttgacgcttttttgcaatgtgcgcgctatgaaatatgtctagcatgcatacaactct

SEQ ID NO: 46761 - DNA, 388 bp, Triticum aestivum
  Clone ID: PAT_TA_46761
cgtgcggatacagaccaaaccagggttccgcgtacgccaacggcgaaaccaaaccactatcatcctcttcctcgacctcgagcttcgcccggtgccctccattcccctcgcacaggattccccagatcgacgcccgattccccccgaaccgcgccggaatcccccgccggattggccccgcccatggtgtaatcgagggcccgagcgcgcttgcgaatgaagggcaatggctcgcccggtacccgcaccaaggccgcgacaaccgggcgggcaagggcccccgtcttgcatgggatgccgcgccgcaacttcttcccgccccccaagggcaatcccgatggctatatttgtggggcagggaacctaaatcatacggggtaaatttcac

SEQ ID NO: 46762 - DNA, 343 bp, Triticum aestivum
  Clone ID: PAT_TA_46762
acgcgtgcgggcagcttccgcccactcgtccgcccacgcgttcggacagagacagttcaatcagttactactgtgaagctatgggggggttggggcatttcgttagggctggccgttttttaattgtttatctaaacatccgtatatgattggccttagagttagcattcatggatggggatgcaatcccatattgtgcaaaggctatttcattatgcaagtcttgtatacatatattgaaaattgccaagggagggctggtggttgtttaagatcttagagcttcttgctgcttaaggacactcacgaaaggtgacgtctggatgatgaatattcttacctt

SEQ ID NO: 46763 - DNA, 556 bp, Triticum aestivum
  Clone ID: PAT_TA_46763
gtgcggcgagccagtgccgattgccacaaaaggtatttaattgtagctcatcttttccatgaatttgttagtagaatttatgttctgttgcgaagtggcatatataattggatatttctccaggaaagatatcatggagtatggttgtaattctgtatattaaccgagggaggaccatgctgccaactggcctaagaaaatcccttgtgttaaaaatattagtaatgggagtttgtggcgggaggggtgttatttttaacatcattagtagttccatttttggtctcctgtgattgaaaccaactttacttgcagccccttgtttggttttttagatggacttttgtacccaacaaggcggttggataatcagaaacattcattctctaatttaacacacattgttaaatatggtagttacttaaatttaaaaagtttctatttggttcaagcttgccttgatctttattttggtacaaaacccttctgcatttagaggttatgataactgtgattccatttaatatgcgaatactgctctttctcgcataattgc

SEQ ID NO: 46764 - DNA, 350 bp, Triticum aestivum
  Clone ID: PAT_TA_46764
cgtgcggcgcacgcgtacctcgatccttatccttccttccagtttcagccatgggtaatgagaagactcacatgaacatcttgggggttggggatgtatactctggcagggcgaccaccactggccatctaatctacaagcttggaggtattgacaagcgtgggatctataggttacagatggaagccccttatatgaacatgaagttattcaagctccgcctgtttgcatgacaagctgaaggcatagcgtgagaggggcatcacaattaataagccctgtggaagttcgataccactaaggactactgtacctgtaattgttgtctctatggtacactgacttattat

SEQ ID NO: 46765 - DNA, 223 bp, Triticum aestivum
  Clone ID: PAT_TA_46765
cacccacgcgtgtgcgcctctaaccccactcacttgagagccttattaaaggattttttattccattctaataaccacactttcacaccggtgttcattctacaggagcgttttaataacctaactccatactatccttcatctagtgatttacccttaattctcaagtccttattactcatttagcacaatttattctattttttatcattttataattata

SEQ ID NO: 46766 - DNA, 516 bp, Triticum aestivum
  Clone ID: PAT_TA_46766
cgtccgagatagttcaacatccagggaaggccctatgttcccagttgattcttggtgctagaggcttgggcagtgctgtcgtgacaattcaggacattggcctttcttctagagtatcgactagttctctggttagagttgcaaatgttgactggattcagatattgtcagaagagcacatcagcattatggaaggaaccacaaaagattttcaaatttcagctgggacccaagatggacaagtcttcggtgattctcagttcaagtacatgggaattgaggtacatcttggtgatgaaattttggatcatgttaatccaagcgagtcgttggatggaccaaaatttttaattaaagctgcaaaaactgggacatcgtctttttatgttagtactaagcaacgctctgggcaaagagtttttagtcatgttataaatgtggaatggtacaaaccactgggaattcatttctgatacatctacctcacaccgtttgccttctttgtgacttcttgta

SEQ ID NO: 46767 - DNA, 165 bp, Triticum aestivum
  Clone ID: PAT_TA_46767
taaggatctgcgcaaatccatcatagcaccctctctgttaggaacggagggagtatcaaactcatggcgggggaggggatccgccctgcgcggctggtgttgtttcagggcacaatggtagccattgatgtggatgcatgtgcatggacagcatgctatctggag

SEQ ID NO: 46768 - DNA, 459 bp, Triticum aestivum
  Clone ID: PAT_TA_46768
cgtccgcggacgcgtgggcgactgatcaacaaaccgtctcgcccgatgtgatacgccgatactatgctgccacggaggaggggtttctgaaccttgtgaggaagcagtggcttattaagccgtatatcgcatcggtcggtacgtgctgtttgattggctttatcaacgaaggggtcctctacatagcaaacaccggtgattctagtgctgtcctcgggagagttgataggggcgtctaagacattaatgtcgttcaggtttcaaccgagcataatgcgagctttcaagaggttagggatgagctaagacagatgcacccggacgaccctcttattgtggtccttaagcacaacgtttggagcgtgaagggcattaattatgttttcagaacgatcggtgacgtctaccttaaaagttctgagtttactcgtaagcctttttggcccggttccgcatttc

SEQ ID NO: 46769 - DNA, 286 bp, Triticum aestivum
  Clone ID: PAT_TA_46769
ggccatggcgactccatgaactagaacacaggctttgttcaatgtgattgtgaggatgaatagtacacctgcgtgatcgagcgtggtcttaacccgaggagcgcgcacatcctgaatgggctactgcggatgtgcccaactggatcttttccaagagggctattttcaccattgagcccatcgaggagcaattatgggcatctatgccggctggtggggctacttttggttactgcttctactttacgaagcggcttcgtgaggacatggacaccttcattttatt

SEQ ID NO: 46770 - DNA, 310 bp, Triticum aestivum
  Clone ID: PAT_TA_46770
cgtgcgggcacgcgtcacgaccacgctgtccgcgctcgccctcgcgctgcgctagtcctctaccattttgcgttcgtcgcgtgcggctacgcgggggaggaggagatggctctctggtcgggcgcgtcgtcacaactcatgtggtgtgagataataccggccgagtgcaggtgtaaggactgtctttcaccagtgagtgaggttgtctgggtgcttaccaacactctttgagaccgtctactcgccggacatgctgttttacggttcgtctggcacggggaagaccatcactgcgcttggcattgcatac

SEQ ID NO: 46771 - DNA, 454 bp, Triticum aestivum
  Clone ID: PAT_TA_46771
cgggcgcgcgctgcggccacactcacagcccgcaccaactgagcacagacggccggagggcgagatgacggcggccagactcctgcggcgggtccaacccagatcgccgtcggcgccagagcagaaaggcaaagatcccctcgtatgcagccccaccgttctaccgcgcgactccgtgagcatgcagatgcttgcgccgactactcttcctgtgcgacccccaattccgacgctgctcacgcatacgccaccgacacggccctccattactaggtttcttcatagaccacggcggcgacagcgacagcgacgacgactgctacgacgactacagcggcgacgacgacaacgacgactgcgacgatggctacagcatcaccttcgagccagctccgggcgccccctacacgactccccgaggactctactccttggagcacgacggctgctacat

SEQ ID NO: 46772 - DNA, 529 bp, Triticum aestivum
  unsure (1)..(529): unsure at all n locations
  Clone ID: PAT_TA_46772
gactccatggacgaggaggacagaccctagagtctgaagaccttgacctctagctccggagcagcggctctgacggtatggagcatgttgcagtgtgactggcgccgttgtggagtagcagtggccagttccgcaacgagacatgggcgtccagccgacggccgtgacggtggtttaaggtgggaaggcatcccaccaatctgctagtgtcgtttggcactgatgtggaggactgacgaaggcgactattgaatgatctgtcatcaagatgctgattggaacaccgcttcatgtccggggtgaaaattcttgtcttgaccattattggtcgggctcagcagcgatgagtgtataccttcttgaaggcgctgctatggaagaagtcgacttagtcgtatgtgttaatttcatatcttgtaatgggtcggccatgattgccttcgtttngaactctgctgaataattaataaaaatgggtgtatgcattgcattgatgcagagggccggaggttttaacctctcttttgaa

SEQ ID NO: 46773 - DNA, 372 bp, Triticum aestivum
  Clone ID: PAT_TA_46773
cgtgcgttcactctccgagcgaaatacttctccctcactctcacctccgagaagctccagcggcagccatggtcccaaaggcagacatgaagcctggttgttataactaggtggagaaggcggcttttaagaccctcgcggtgtattagcccaaggccgataagcgtctttcggcaggcaagacggtgttcaaggtggccggctgcgaggggaagacctcttgcatgaagaagggcagtatggcgaatattggcgtggtgacgtacaagatctacatctttaaggtgctgaagcatgtgcactctgacatcggtatcttctttaaggccatgtccatcatgaactttttcattaacgacatcttttagaagc

SEQ ID NO: 46774 - DNA, 519 bp, Triticum aestivum
  Clone ID: PAT_TA_46774
aaaccaacatgaacttataattttatcagatcatataataacattcagcgacaggatactgtcactgtgcaaacattttatcaggtcactgctttgtgtggtagtacaacacaagggactgggcgcacaggcatccagagtcttcatcatatgttatacattaaagtgacccacagctgagcaacgaacacactacctaaagtattgtgaaatgaagatcttcacttcgatttgagtaccactcttgctgataagacgcgccgtttgatcgcattcgggcaagggatgaaactctagtgtgcctctcataatctcgtcaccacaatcagagtgcagatctatttcaattgccagtaccttgtacaatggcaccgcaagctgatgtctagccaagggaatcagctctcctgatcgtgcacatatgcccttcacatcttcgttgtagaaaagcacgcagccaatatcaaacagcttgctgcgagcgacaattctctcaaaaaggcttgatggaacttttac

SEQ ID NO: 46775 - DNA, 342 bp, Triticum aestivum
  Clone ID: PAT_TA_46775
cctttcccttcaattattccccttctaactcttcttttaacccccttcctcttctgtaagcggcgggggggacttccattatggtgggggccgctaaacggaccaaacccctttcctaaaggaaaaaaaatcaaatgggtggaccaaccccgccgcggggggggcttctcctattcttctttaagcttaggccggcaaggcgccgaccaagattaagggcttcctgaggggaaaaacaacttcccctttgtggcaaggacctaagactgtttcaaccacttgttttttaggagggccaaccgcctattctccacggtcgcaaaaaccaagaccaaggtgagg

SEQ ID NO: 46776 - DNA, 543 bp, Triticum aestivum
  Clone ID: PAT_TA_46776
cgtccgcccacgcgtccgcatctttgaggcttcacttgcatgggtataatttttctcattccatgttcagaaactggcgttatgactagtgctaatgtataccggcagtaaacaacatacatgataaacatcactttggaaagtaacttctatcaaaagggcataaaaggtcagaaaatgcagattgcccagagtctttgacacttggttatgcttgtcaatcccttgaaacatttctgaaacaatactgacaagtacctgtctggtccctctgtatctgcacatggatacgtggattagaacatctaaaatttgacaatgtatcctgttctgcgtaggcagtttttagttcagagaggcatatattctggtggtgaaatcggacatgtttgacttggattacttcaccatgttgctcttgtgtctaaatttggtcatggtgatggcaggtagttatgcccaagtttggctggaggtggttgctagcattatcatctggtccgtctttcctgctgctttggtttatgctatcacaccagagtc

SEQ ID NO: 46777 - DNA, 497 bp, Triticum aestivum
  Clone ID: PAT_TA_46777
cgtccggagcccgcctccgccgcgccgcgcccccagctcccgtccgacgccgccgctgccagacgacgtcatgcgcgagattctcctgcgcctgccggcggacgaccccgcgtgcctcgtccgcgccgccgccggctgcattagctggcggggcatggtctcggaccccagcttcgcccccgcctaccgcttgcgccgcggtgcgccgcccatgctgggcttcctctacgacgaccgcccagctggggagcactggatctcccacttcctccccaccgcgacctcccccccgctggccgcccgcgaccgccagcaccggcacgctctcgactcccggcacggcctcgccctcttctacacccctagaagccacgcgcacttccttgtctgcgacctcgtcaccggcgagcactgggaaattcgcgccgaccccaagtgctacaagatcatttggtcgaatttgctgcaagaaatgcactccctgcgcgagaatgagc

SEQ ID NO: 46778 - DNA, 363 bp, Triticum aestivum
  Clone ID: PAT_TA_46778
cgtccggaggaggactatcatcatctcaggcggctgttccagtgacacacaatcgctgtcagacgtcttaatgcgctagattctacagaacatgacggaggacgaccccgctttagaggatcgaaccttacccacctgtattagctacctgataatggttttataccgcaacttaaattcaatctactgctcgcgcctttacaagccgccgattctgaaatccctgtactaccacaactcaattgggtagcactgcatctcccacttgctagctagcgtaatatcgaagaggctggcaccgatcgaccttcagaacaggtgcgcagtctgaatggggaacgggacgcgccttttatacaccca

SEQ ID NO: 46779 - DNA, 240 bp, Triticum aestivum
  Clone ID: PAT_TA_46779
cgacccacgcgtccacgcgtgcggggcaacgcacccacgcatgtgttatacactcgcagaaatatacagttgcgcaccgcgactaacagctgcggctgcggcgccgatggggtacatgctgacagtggaggcgagggtgctggagcatccgaccgcgttgggcgcggcctgcgagatggcgctgctcgcggggacaatctgggcggcagacctcgtcggactcctgctcggatgggcctg

SEQ ID NO: 46780 - DNA, 196 bp, Triticum aestivum
  Clone ID: PAT_TA_46780
cgtccgcggacgcgtggggcgctcctccctgctcaaccttccggcgcatctccgacgacatggcccgcaccaagcagacgcaggaagtcacggggaggcccgggaagcagctgccaccagcgccgagtcgcccggcaccgggggtaagagccacgttcgccggaccgcgctcgagacgagccaagagcgctgtatc

SEQ ID NO: 46781 - DNA, 339 bp, Triticum aestivum
  Clone ID: PAT_TA_46781
cgtccgcatccctctagtttataggcctcgccttttgatgtgtggcgttgagggtgttggactggatcatgttgggccagctgttttgcatgagcttgagaaatttcctgtgcactccttggggctgccatctcttctctctgatccaagtgcaaagacacctgaagaagctctcgtgcatatttttggggaagcaaggagaacaacaccgtccatactatacttgccacagttccatctttggtgggatacggcacatgaacagcttagggcagtgttattgactcttctgaatgaattggcattcaaccttccagtattgttgctaggaacattatt

SEQ ID NO: 46782 - DNA, 302 bp, Triticum aestivum
  Clone ID: PAT_TA_46782
gaaagccaacccttcgacgatgaaggataacaggcgccaccatcctactcagtggaggaagcatttcccacaactgcaggttcccctttttaagaaaaggcgtctgcatcacgtccgtctttgggtgccaatttgagagtatcccggaggtttctattggtctcttgtgtagaattcaaatattatttcgtttcatggtttgcatcgtgtaggcgaagggtgcatgttttattgctcctgttcgtatctagggttgttgcagatgtatggagacatttgcgactcattttatttgaaaatca

SEQ ID NO: 46783 - DNA, 447 bp, Triticum aestivum
  Clone ID: PAT_TA_46783
cgtccgacagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaaagaa

SEQ ID NO: 46784 - DNA, 467 bp, Triticum aestivum
  Clone ID: PAT_TA_46784
cgtccggagcctgcgacacgtctctcggtgtgctcggccagtgagcggggagtggaaggagaagccggccggcgggacaagcacggacggccagcaatgctccctcgcccgcctccccacctcctgccatggcggtaccttgtgcttctcttcctggccttggcggtcagcagcaatggcgtctctgcgactgccaagccaaaggccaaggcgcccacgccggccgggttcgggtacaagctggtgtccctcgtccagcgccccaacggcggcggcctcgtcggctgcctccaggtgaagcggcgcacctccacctacggccctgacatcccccgcctcaggctcttcgtcaagcacgagaccaaggacagggtgcgggtgcagataacggacgcggagaagcagaggtgggaggcccctacgacctgctcccgcgggagccatccccgccctcgggcagcacgggc

SEQ ID NO: 46785 - DNA, 304 bp, Triticum aestivum
  Clone ID: PAT_TA_46785
acttctttcggtttgctcggtcagtacatcaacagtgtaaagatactcttgtcgctggaccaaacactcattggcagcgaatgcgtgcctcgcccgcctccccacctcctgtcatcgaactaccttgtgctcttattactggccttgacgagtcactaccaatggcgtctctccgactgccaaaccaaaggccaaagcgcccacgccatccgcattcggttacaaactgacgttcttcgtacagcgccccaacagcttccagactccacagttgccttcaactgaagccgagcacctacaccta

SEQ ID NO: 46786 - DNA, 283 bp, Triticum aestivum
  Clone ID: PAT_TA_46786
cgtccggaagagaacgagacgggctggctttgattcattctcccatctctgtatcgaccctgctgtattttccttgcaccagatgctaccctagtaggagtactacactaggtattactgctcgtgtgtcaaaaggtgttgcagctggctagctaaccagtccccaagctgtgctggatcaggggtctcgattttggtaggctacggcgatgttttgtgacagacggcatatgcctgatggtgtgctctgcaatgatatggtcgttaccgtttcttttcaaaa

SEQ ID NO: 46787 - DNA, 271 bp, Triticum aestivum
  unsure (1)..(271): unsure at all n locations
  Clone ID: PAT_TA_46787
ttccccttctcttttttttttctagatctctcctccctcnccatatcgtcggtttccggccgtccttttccgctctcccggcgggcctggatatttacagacaattttccttttaccatccatcaaccaactacactttatgtacacattctatttgaggaggtgttcactctcaactaactgtaaaactctttttaccattcttttccctccaatttacctgtacgaaactattccactgctaatgcatatgcacgcatccctatgcctt

SEQ ID NO: 46788 - DNA, 356 bp, Triticum aestivum
  Clone ID: PAT_TA_46788
cgtccggaacgcgctctgcctctccgcctatcacctctcaaacacgtccactcgtttcaaaaacaagtccacccgtttcaaacttctggggcggctccacggccgcgatcagggatgggagggtgcttttccggcgacctccgccgccgcaaggaggccgtctgtggcggctcgaggggggcggctgccacaagtgcacggccaggtccatggcgtgcctaacgaggcggaccgccacttcttccagggtcaggcgctgcgcctatacacccctgtagagctattcttttcatctcccaagttgagagatatggctgctcattctaagagtgaccctctgttggtgctttacacaa

SEQ ID NO: 46789 - DNA, 345 bp, Triticum aestivum
  Clone ID: PAT_TA_46789
cgcgtgcgggccatcttctccccactcagtcctcggttcccggaccggtcccgtcccgttcagttagggtttagctacctccttgggacaaggaaggaatggcgtacgtctagtaccgctgcttcgtcggcggcctcacctgggccaccgacgaccagtccctccagaacgccttatgcaagtacagggacatcatcgactccaagatcatcactgacagggagacgggccgatcccgcgggttcgggttcgtcacgacgacggcagaccaggctactccatgtgcggtcgaggacaggaacgcccaggacctgttctgccgcaacatcaccgtcaacgaggcgc

SEQ ID NO: 46790 - DNA, 500 bp, Triticum aestivum
  unsure (1)..(500): unsure at all n locations
  Clone ID: PAT_TA_46790
cgtccgcattatgcaaggcaaaaaaaataacttgctagacagttctagtcagaaatcacttcatagagggaaaactccacggacgagggtcataagcagcaagaacgttcccaaagatgaggatgatctcccctctagcactactggtggttcagaccgcaatacatctggctgtggaccagcaccaaagcctgaccaggagactgttctaaccaccttaaaagataggcttcggaagcttgggcaacgcctacatgagaaggaaaatgagggcaggaaactagagggacatttggaaaagaaagcagcagctgaggcagtgtcctcatcatcctcatccagttctttggataagactcctaatgttgtgaacagaccagagcaaccttccgtgactagtnctgatgcaagtatgtatgcaccacctcattctcaacctgtaatcaccaatggtgtaacggagccatccagcaacgcccaaaaccaccgtaagcacaaaa

SEQ ID NO: 46791 - DNA, 508 bp, Triticum aestivum
  Clone ID: PAT_TA_46791
cgtccgctcccgccgccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacacagcgtgtcatctagaggttcgagaaggaagccgctgtaatgaacaagaggtctttcaagtacgcctgggtgctcgacaagctcaaggccagcgtgagagaggtatcaccatcaatattgctctctggaagtgctagaccaccaagaactactgcaccgccattgatgcccctggtgaccgcgacttcatcaagaacatgatgactgacacctcctatgctgactgcgcgtgctctatcattgactgccccaccgttggatgggatgctggcatggttaaggaagggcagacacgtgagcatgctctccttgctttcactcttgga

SEQ ID NO: 46792 - DNA, 562 bp, Triticum aestivum
  unsure (1)..(562): unsure at all n locations
  Clone ID: PAT_TA_46792
cgtccgcggacgcgtgggtttttactggcatcgttcgttcgatcctcttccacccccctgatccatccattccggccatggactccaacgccaacggcgggcgcagcacgatggtaggggagatggagagcaccttggagcgggtcaggcggcagctctcctccagctccacccgccatatccttcagggccctctcttaaagcgatccgatacactcaggaaatggaatgagcggtgggttatacttgatccagctactggaaagatggaatacaaggttcgtagaagtgatacaactgtgaggggaataattgtgttcgattcaacaagcaccgtcactttgtcacctaccaacttttatggactgccaaaatatgaaggatgttgtgtatatattgggactccacaaaaaaaggagtactttctttgtgcagaaactcccagcgctgcaagagcatgggtatctactttacatgcaactcaattggttctacaggctcataaacaggcggtggattcgatgggtggaaatggtttgcaaaattgggaacagtngctact

SEQ ID NO: 46793 - DNA, 519 bp, Triticum aestivum
  Clone ID: PAT_TA_46793
cgtccgcggacgcgtgggcggacgcgtggggcgatggacgccgcctcccgtccggcgccgtcgcaccccacttccggcgcttgatcccacgcccgctgtcgcccccactcctgcagcgccgtctccctccccgccgtcgtccagccactcgagtgcgccgccaacatccccaatcgaccagcgcctcccgtcaaacgctgcccggtcgccgtccagccacttcagcgccgcttccttccccatcgaccgtcacctcctcgtcgttccagggctaacccttcgacgtccagcagcccccctcaccgtcgagcactccagcgccgtctcgctccccgtcgaccggcgcagggcctccctcgtctgccggatctgcctcacggcctcgtgctcctgtttcctcccagtccagcgcctccaaacaacacagaaaaggtcgcaagtaccgtgcgccggcccccaaggaagatcgatggagacgctgccggacgacgttgtcgtggagatcctggtccgcgtgac

SEQ ID NO: 46794 - DNA, 328 bp, Triticum aestivum
  Clone ID: PAT_TA_46794
cgtccgcaggagctgagccacactactagcagtaccatataagtctccaatgtttgtttaattagctagctagctaatcatggagtgtcagcttagctaggacgtatctatggtttttgtttctttctctttatgccttttgtaataaagtagttgtagcggctgttgtttttttgtttctttgtcatttttgggtaatgtagtagacgctcgatttgtaaatgtaagtcgtcggtcgttagtctttatgattatggacgcacagaacatgtcatgtgctacccattttatgctcctgccaagtttaatttttgctttcgggattgct

SEQ ID NO: 46795 - DNA, 300 bp, Triticum aestivum
  Clone ID: PAT_TA_46795
cgtccgcccacgcgtccgcggacgcgtggggccatcccattccagattcccaatatcaattttcccatgctggttgtgaagacagagccgcggatcatccagctccgacgctatgcatgcgtgcagcctgctgtatttgtttcgcatagctgcaatacttatatgtttaataatagtactagggagtagtaggttattgaggctgtagcggaagttggaacctaccttaatgtaagtgaaaggggacagttgcccattgtcgaattgttgttatcaatacatagttgattttcgtagctc

SEQ ID NO: 46796 - DNA, 481 bp, Triticum aestivum
  Clone ID: PAT_TA_46796
cgtccgcggacgcgtgggtcaaaaggaggctgacaaatgcagttcaagcatggatacatgtgaagaagctagggagaagtcagcagagtcgctgctcggtcaaaggaaattaactgctttgtgggaggaaagggctcgggaactcggatggaaacccgggaatgtcaatctacaccggaatcagtaataaacaatggaggatggtgatggatatagcatgccaaccaatagagatctcatcacaaacacccttctatagggatagaggtaaggaaaaagggttccaattctggtgaccttgtctcactttgcaccatgacgggctccctcgtccatagttaatttatactgggtttgtagtatacgtccatagctgtttgtcagcattatgtaaagatggccatagaatatcactcgtcacctataagtctagaaaaggtgatcagtttcttagttgtgtttatgaatgatgttagtgaag

SEQ ID NO: 46797 - DNA, 292 bp, Triticum aestivum
  Clone ID: PAT_TA_46797
cgtccggggcggtccaattccaacccccgcatgcgcgcatccctctccctcgccgtcaaggtcgggtcggtggtggaggaggaggaccagcgcgggggggcgcatattgtggagcacctcgccttcagcgcaacgttacgctacaccaatcacgacatcgttaggttccttgagagcattggcgcagagtctggtgcctgccagaacgctctcactttctctgacgaaaccatctatgagctgttcgtgccttgggacaagccctggctgttcttccaggcaatcttcgtcc

SEQ ID NO: 46798 - DNA, 471 bp, Triticum aestivum
  Clone ID: PAT_TA_46798
ccgaactgcaaaccctagtatcgccgccgccgccaggtaagaggcgagatggtgtccggctccggcgtgtgcgccaagcgcgtggtggtggacgcccgtcaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagccctcccacggtcccatccacttccgcgccccggccaagatcctctggcgcaccatccgcggtattattccgcacaagaccgcgaggggcgaggccgcgctcgccaggctcaaggcgtacgagggcgtgccggcgtcgtacgacaggaccaagcgcatggtcatcctccgacgcgctcaaagttctgaggctgcaagcttgggcacaggtact

SEQ ID NO: 46799 - DNA, 450 bp, Triticum aestivum
  Clone ID: PAT_TA_46799
cgtccggcaagtgtattttggtctacaatatatcagcttcctagtaaggccttactgcaaaaagataataccaactacaatgctgcagtcctacagttttattcatcaaactttgtttctatggttactatttttattatttcaacaactggtagtgaagttaaggcgagcattggaacattttgatagcttagtctttttggatggtcctctatctgtatagcattacaagcaacaaacactgagccttattcaccttcttaatcaatatacttggagtccacatccaagatcaaagcatgtagctctgttcactcaggttctcaggagtatctcacaaatgagtccatcttaggtgagagatgactcatccagccatacgatattattgaccatttagtagcagttgaccaacagttttggtaattagagaagaagacaattccacag

SEQ ID NO: 46800 - DNA, 399 bp, Triticum aestivum
  Clone ID: PAT_TA_46800
cgcagacccgtccccgtcaccaaaccctagccccccgccccgccgcccgcagatgtcggtcgcggccgtcgagcctagcccaccggaggcgttctcgtcggcgcccccgccgtcctacctcgcagtgcccttcatcctcttcgcctagaactactactacctctactagtctcttaagttcctttagtttcacatggagttcgtcgagatccattgatgagacgtcatggacgagtagaagaaccttaagtgcaagctgttgctttcgcaggagtaagtcaattggattcaattagtgtcaattgttatttttcagttcatttagattgtttactgcaataacggtaattttggtttcatcactcgcagttacttctatcgacgtattttcagtacatt

SEQ ID NO: 46801 - DNA, 364 bp, Triticum aestivum
  Clone ID: PAT_TA_46801
cgttcgcaaagcccctgagattgcagcattatggaaaaaagatctccaaaaggtaaacttaaaagcagcagagtcattggcagatgcggaggagtacccaaactgagttgaagactggcagatcgctctcaatgtagaagctactgtcgcccccaaaaggggtatctatccacctgttgaggaatacatgatgcattcttgaaggcccaatgagacggttgttgaagctttcacgatcaagctctgttcaatacgaggaaggtgtctactaagattgtcaaaacggacagtgacagcgatgatgacagttctgatgaaagctctgatgatgagcctaaaaagaaagttacaactgcctcaaaat

SEQ ID NO: 46802 - DNA, 350 bp, Triticum aestivum
  Clone ID: PAT_TA_46802
aggcgaattcgacctacgcgtccggggaacatatagatacatccatttcaatgacacgtgttttagttggtaagggcttgttgctgttggctactacactagggattaaatccccatgtacataaacctagtccctgcagtgcacattctgattcagtcagatatagatcttgtcaaatgacaaaatttattagatcccctagctagtaagtagtcgatgaatctaatgcctgcagggattgggtgccacctttttgtcaagcgttgctgtcaacattcatattcatttagtgatgttcacactcagatccagcgatgtactcatcattcaaatagtacaaatctgaaaa

SEQ ID NO: 46803 - DNA, 137 bp, Triticum aestivum
  Clone ID: PAT_TA_46803
cgaaccacgcgttcgaatcatcgtgcgcgccttcaagaagggccagctgccgccgaatatcggagccctgcttcgcgacagctacggcattcctgtcttcaagggcgctaccggagatcagatctttcgcctgctca

SEQ ID NO: 46804 - DNA, 331 bp, Triticum aestivum
  Clone ID: PAT_TA_46804
cgtacggcctgcgagcgctccgcggcgggggcggcgatggcgggaccacctgcgccgagacccgcgactgctacctctccatgtacctcgagaagaagcccgacaaggccgatcccaacgaggcccgcctttcccggttcacctgctgggcgctctcgggggagcctctcgccgcgcccgctgtcgtggatcgcctgggcaacctgttcaacaaggaggccctcgtggaggcgctcaaccacaagcgcctgcccaaggcgctctcgcacattcgcgggctcaaggacatgaaccccatacacctgcaccccaaggccaacgcggcgggcca

SEQ ID NO: 46805 - DNA, 390 bp, Triticum aestivum
  unsure (1)..(390): unsure at all n locations
  Clone ID: PAT_TA_46805
cgtgcgcccacgcgtncgcggacgcgtgggtcttcccacacgctccaaccaccagcacccatgggacccaaggcggcggaaaagaagccggtggccacggccgataagacgacggcggtgaagaagcccaaggcggagaagcgggcgccggcctccaaggaggccggcggcgaggggaagcagcggtgcatgaagaatggcagcaaggccaagaagggcgtggagacgtacaagatctacatcttcaaggtgcttaagcaggagcaccccgtcgtgggcatcttcttcaaggccatgtacatcatgaacttcttgatcaacaacatcttttagaagctcgtcggcgagtccgtcaagctggcgaggtacaacaagaaggccaccatcacg

SEQ ID NO: 46806 - DNA, 406 bp, Triticum aestivum
  Clone ID: PAT_TA_46806
cgtccggtgaccatcagcgaagacaggtcgatattcaattgcgagtgcgggcaatttgaacacacagggatgcttggcagccatgtgttgagggttacggaaattcttcaccttgaagacattccaaaacaccatatcctaaaacgttggaccagggatgcaagggatatactccccgatcacctggtgcaataccaaaaagacaattcacaaaatttgtcatttacgtttaggcatgcgacgctgtacttcaaagccatggaagttgtgaggatgggggacgcaagcgctgcatgctattgaacacgtcaatgccaacctggatttgctgtttcagagtgcggcgcctttagcagagaaaagggatggcctcccttttgaggaccgggtgatttcaaatgaagat

SEQ ID NO: 46807 - DNA, 266 bp, Triticum aestivum
  Clone ID: PAT_TA_46807
cgtccgcggacgcgtgggcgaaaatttcacgcgcgctcagcacaagtagcagattcagtttcagagctccgcttgggttagccacaaggcctgtcctcgtcaagcccgccgtcgcggtaccgaagccgaagccctacggcgccaagccgaagaaggccgtcgtcggtcccgcccacccggtctacttcaagatgatcaaggaggcgatcgcggagctcaaggtcaggactggatccagctttggacggcattgtctagtacattga

SEQ ID NO: 46808 - DNA, 143 bp, Triticum aestivum
  Clone ID: PAT_TA_46808
cgtccgctcaccagtaatataattaggtacttgcatttttgaattgcattctcaaaattgcatagaggttgttgggcctatacatactttgctgatgagtgatgatgcaacacccttgttgcaatcttcattttaagcggttt

SEQ ID NO: 46809 - DNA, 470 bp, Triticum aestivum
  Clone ID: PAT_TA_46809
cgtccgcggacgcgtgggcggacgcgtgggcggacgcgtgagaattttttgatatcatgaacccgtactacagtggcgatatatttctaccaacaattagtgccgttatctacaacttcaaggttttgtttgctgctacatacggaaattctagttctttcaacataggaacatttgaatcaagatttgtaccagctcccaaggtcaatttcaggtgtgttttccatagaactctccccttttacaagatttgtacatgccaccagcaactttttggttctttctcctaaaaaggcagattaaaagtattttaaatccacaataattttcatcctaagtatggaactgattgtgctattatttttgtttcacaagtatgactcaagaattttccttctttaatatgttagcatgtacaaaagtctcgatttggaggggttctctaatgtaagcgatagacatattttttc

SEQ ID NO: 46810 - DNA, 127 bp, Triticum aestivum
  Clone ID: PAT_TA_46810
ccggaccgaaatcccgggacgacaccacgcgtccgcagaaaacagagcacacaattgtgcgcaccggtcaccatactccttagactttcctagaaaccccacccaaggcgcgaatctgattcgacgc

SEQ ID NO: 46811 - DNA, 117 bp, Triticum aestivum
  Clone ID: PAT_TA_46811
cgaacggtgacgataaaacaaatcagattttgatcccagctttcccccaccttagctgtcctagaaatcgaatcgtactttacccgagttttgtcgccgtagatttcgatccctaga

SEQ ID NO: 46812 - DNA, 120 bp, Triticum aestivum
  Clone ID: PAT_TA_46812
cgttcggggcatcgacctagtatagagggcaccgggtttcgtagaccgaccgccgggcagcatttgggacgggccaaaaaggctcaaaacgacccggaagggcgaataccacgacgctgg

SEQ ID NO: 46813 - DNA, 198 bp, Triticum aestivum
  Clone ID: PAT_TA_46813
cgtccgggaggagaccgacgaggtggtggtgatcggctcctgcatgacctccgccgataccatctacaacgagtcggacgagtgcctagagagcgtgcttacggagattcgtactaacacccgtaccggcgagttcacgcggcgtcaacattctggcgctttcggagcaggtgaacctggaggtagtcatggtgaact

SEQ ID NO: 46814 - DNA, 220 bp, Triticum aestivum
  Clone ID: PAT_TA_46814
cgtccggagcgcccccgatcaaggcgcggatcaagggtccgatgggccgtagggcccacacgagaaggatcaacctaacatagagttgacaatgtcacgaaccgcatttatttaccaagttactaagctccatagggatgttgggccgtagtggcttgggaccttgtgggtcttatgtgggaagctctttataagagtgggttctctgctcgaggaggaa

SEQ ID NO: 46815 - DNA, 397 bp, Triticum aestivum
  Clone ID: PAT_TA_46815
cgtccgagccatcctactcgctgccctcctcagctactcagatagttattccttctcattatcagtgaataagttggttacagaacatggttgaaagattgtagtacatacagattgcctggcagactaaaataattaggagcttctgattggacccttcaagcaatagtgttgtcaatatattaaatattggattatgttaactatactctttagaacagctttctgatatatgtatttataggaaactatgatatctgatgcaaaatatttgatggtctggttgaatgcagtggactcatcgagatagagggctccaacagcatatgccgagggcgttcatagacaaccctgccaatgttcggatcaccgaggagtacagtttgagacactatta

SEQ ID NO: 46816 - DNA, 214 bp, Triticum aestivum
  Clone ID: PAT_TA_46816
cgtccggccgccagcgccattacgcacgagagcacgcgtgcacgcgacccgtgccttctgccgtcttccgccggtcccggcctgttgcgacgtgagcccgccgaccaccaccatgccttcttctttccttatctttctgtctattacttctattccgtcttaagggcgcgggcccctacgggttacggtcatggacgccgccttgagcacaagt

SEQ ID NO: 46817 - DNA, 320 bp, Triticum aestivum
  Clone ID: PAT_TA_46817
cgtccgctctactcgtcgctccccacctatcctcccttcctgcctctgtgagctccggcctctccccagcccgcgacgacccttaccctccccagccggggacgaccactcatatccgacgagccgcggtggcgtgccctttcctcctgcttgagtcaaatccagacaccccggcctcgcatctggcctccacctgccacctggagcccttctcagccgaaggacaccacaagcaggcgggggtactatgcattcacgcgtggaggacacgctaggacaccaccaacccgaggaggaagaggttcgttactctccctggg

SEQ ID NO: 46818 - DNA, 278 bp, Triticum aestivum
  Clone ID: PAT_TA_46818
ccgcgtgcctccagtggaagggttgcaatcaagggagtgtttgctgtcttccaagacttatatttctcatttattgagatgaacccattcaccatggtgaatggggagccatatcctttggacatgagaggagaattggatgacactgcatctttcaagaacttcaataagtggggaaatttagaattccctctaccattcggcagagttttcagttctacataaagttctattcatgagcttgactattagaccagcgcgtctttgaagtttacagt

SEQ ID NO: 46819 - DNA, 172 bp, Triticum aestivum
  Clone ID: PAT_TA_46819
cgtccgcccacgcgttcggaacaagtagctacatctgctgcatgatgaaagaagacggacgtggtcgcagggagtgtgacgctttctgcaataaggattaatctccaaatttccttatctccccttatgagtctcatacttccttcctagtgctatttgcgcaagtaacctt

SEQ ID NO: 46820 - DNA, 275 bp, Triticum aestivum
  Clone ID: PAT_TA_46820
cgttcgtccacgcgttcgcccacgcgttcgcggacgcgtgggcgagtggaagcgcctctcactgatgaggagcttgcgtgtgcgtctgaaggggcttaccatggtgatctacttgttaaacactcatgttacatgggaaggctctggctgttgacgggagttcccaaataggaggaggcagctgtcattctgtatgttctagttgcaggttcttcttctggtggattgtcgtgcaacgatctctacaatagttttgagtttgattttgtgtgatt

SEQ ID NO: 46821 - DNA, 352 bp, Triticum aestivum
  Clone ID: PAT_TA_46821
ccgggcagacctaataacatcatctgtagaaatgccagctcggcgcgtgatatgaatattgccatcgtaaactgcagaagaggagaggaaaagctcaggattgtagctttctcgcagcgctatcagaatccacaagcccgggggggtgagaactcagggaaacaaaaggctccaccgccgctctagttgctccgagacacggactggcaagtcaaagcatgcatgccagccaaggaagaaacaaagatagatcactctgtgtgactgaagttccaaggcagatcttagaagagttgacataagatgtcagtgttagttctgtagagatcatggacattaatccgcgcaccat

SEQ ID NO: 46822 - DNA, 303 bp, Triticum aestivum
  Clone ID: PAT_TA_46822
cgtccgcccacgcgtccgaagtgatcagtaaagaagatcgacagagagaagggttcttgtggatcagctaacaagagggtagccggactgcccaagaagcagagcctcgcctcgacgacgccggacaaggacaacaaggttgacgacgatgtacaggtcggtgacgaccacaaggtcaagttgttacgtcccaataacaggagcgctagactctgatacagtgtgaacggttggcgtactcgacgaggtagatcttgcaataaacttcattattcaaaccaagcacgggagaaccatctaaag

SEQ ID NO: 46823 - DNA, 295 bp, Triticum aestivum
  Clone ID: PAT_TA_46823
cgtccgcccacgcgttcgcccacgcgtccgggcatgtttagacgcagttggcttagatctgaagaggcttctaatggaagaaacaagatacggaaactactgctgaaagagtgtgaaagtgcgagggctgacgatgttatgacggtggcatatacagctgatggctctgatgatgactgtttgaagaatgaaggtgaagcagaggcgccgacagctgatggctcttatgaagactgtgagacgatggaaggggaatcaaaggtggttataccccgcgccagaggaaacatgggcg

SEQ ID NO: 46824 - DNA, 331 bp, Triticum aestivum
  unsure (1)..(331): unsure at all n locations
  Clone ID: PAT_TA_46824
cgtccgcgacgccgtagccacgactttttctgctaaaaaaacaacaacttcctcttccgctcgccgccgcggttcccctccgcgcgccgccggtacgaccgccgctgcggcgccccacctccctgtcgcgtcgcgttcatctcttctcatccgcctaggttactcctcggtcgagcggccccgcccccacgtcgctccctcaactgcttccctctcccatctgctggtttcccggcatgccttagcgccactcactggccgccgncgtcactgcggcgtcacgggtgcagatttggttgcaatctacctatgctttctgatatttgatctg

SEQ ID NO: 46825 - DNA, 466 bp, Triticum aestivum
  Clone ID: PAT_TA_46825
cgtccgcggacgcgtgggaataaaacaaggccaagtataaaaattatacaagggtctggccatgaactttagaatccctaggtctgaagttagtcctctcttccaactgagcaatatgcagagcctctagtacgcgcatccatgctctgtcgccgccacctgctacttcaagttcgccaacagcctcgccggaaactggggcttatccatagcccaactcaatctctgcgtcgctctcctcacctgtatacatgcatctcgttcatctgttcgttgtacaacttgtagtggattttaggtgtacaaccatattattgtggattttaggaattcacagaaaaaaatgcttatctgtattcaggtgtacaaccatactgttgtggattttaggttggatgctcacataagaggtgatctgattttgttatcgctcgtctctctttgtagattttgcttatgcttggat

SEQ ID NO: 46826 - DNA, 231 bp, Triticum aestivum
  Clone ID: PAT_TA_46826
cgtccgcggacgcgtgggcggacgcgtggggttattatgcgtactttcctggcaatgcaagttgttacaatggcagaacatgattttattcaaagggaaatcgtaccccgatcaaccacccatccatggccaaggatgacaacccaacagaacccgttgtaccagccaaaccagactttttagtgatcacttataatttacctgtccaaaacttctttagggacttttaaa

SEQ ID NO: 46827 - DNA, 394 bp, Triticum aestivum
  Clone ID: PAT_TA_46827
cgtccggagagcgaatgttcaggatggtcagatctatggcatatgaatcgaagatcctcgatgcaatgacttatccagggaaggtactttctctcaagatggcaaagcctccaggttttcgctatcaaagtggaatgtatgtctttgtccaatgtccacaagtatcgaagtttgaatggcacccattttcttttacctctgcaccagatgatgatcatttgagcatccacatcagatctctgggtgactggagctaccatgtgtatgatatgttccatgaggcactgtggtgcagcaaccttgacctggcaaaagtatccattgatggcccatacggggcagtatcacaagatcactcgaaatatgaaattatcttgctaatagggcttggaat

SEQ ID NO: 46828 - DNA, 359 bp, Triticum aestivum
  Clone ID: PAT_TA_46828
cgtccgtaagcgagacacttgttccacgaagtactaatgatgcagttcaacagcgacatagaaagcaccgacggcttaacaacccaacacccagacacaagtttccaaaacaggacagcacagcaacatgtagttaaagataggcagcagaggagacagatcctccgtcgagcggacgagcagatcagtagtcgtcgtcctcctcgccatcctcatcatcgccgccctcggcgccgacctcctcgtagtccttcttcagggcggtcaggtcctcacgggccttggagaactcggcctccttcatgcccttgcccacgtaccagtgcacgaaggcgcgcttggcgtacatgaggtcgaac

SEQ ID NO: 46829 - DNA, 161 bp, Triticum aestivum
  unsure (1)..(161): unsure at all n locations
  Clone ID: PAT_TA_46829
cgtncggctcaccttcggctttagcctgtaggacctccaacatcttgggtaccaggaaccacaacatgctcaagcttggcctgagcattgacgaggacgatgaggcgcctgataacgacaccgacatgccgtccctggaggattactcttgtgagagcaag

SEQ ID NO: 46830 - DNA, 289 bp, Triticum aestivum
  Clone ID: PAT_TA_46830
ttccccacgcgtccgctcgggtattcttcactgtagctcaaagttctgatgcaaacattgaacaccgcggtctgactacaaacggagtggggcatgtgcaaagaatgagccaaatactagtagagaaaggccgcaacaatctcttttgctaatcccaaagtcatataaggagaagcaggcactgactgctcgacagaagtacaaacaagctgttatatcagctcagttacctgatggagttattctccagggtgtattacttccagcggaagctactgggttactatat

SEQ ID NO: 46831 - DNA, 313 bp, Triticum aestivum
  Clone ID: PAT_TA_46831
ccacgcgtccggctgggccgaggcgcacgccgccgtctagtccggcgccaccatgggcaacaacgcccacaccatggatggagggggtgcgtgcatgctgcgcgcggttgtgcaaggacgccaggactaaaggccaagggcgcgcaaccagagccagtcccttgcgcgacaaaccctagggacgactaccagaactggatcaaggacatgaggcacagaaacaagaagaccggtcaaagaacgtggcccccgttttggggcagacaacaaggtaaccgaaaaatgaataacgcagtgacaacggcagggacac

SEQ ID NO: 46832 - DNA, 245 bp, Triticum aestivum
  Clone ID: PAT_TA_46832
cgtccgtgccttttggaatcagctgtacacctaaactacataatcaatcttgctgcgaataaacgtcataccgagtgcgtccgtggattagctgctgttgtttcaggtgcttgcgtgctcaataatgcacgccgtgagaagggccgtgatgcctttgctgtttcagatgctattagccaaaagattggccttactacataacttttgagggtctaagagcttcggaaaactttttttacctacca

SEQ ID NO: 46833 - DNA, 364 bp, Triticum aestivum
  Clone ID: PAT_TA_46833
tcgtccggaaaaacactactgcattctcctgtgctcgacaaccttcgtcctccttccatgctcttcgttgccatgagcacccgtcccgtggtcttccgccgcccgcaccttctagcacgagctgctaaatcgaccccatcctcctcacctgctacagagaatcagtaagccaggcggtcgatcctcctgccgcgcctgatcgagctgacataatgggccgtggggagtaaggttgctgctggggccgagaaagctggctgatcaagagatattatgttaggaacatcgggacttttatttgtagacttaggcatcggaaattggacttgtagggttattttacatagtctgggaatcaagctaa

SEQ ID NO: 46834 - DNA, 409 bp, Triticum aestivum
  unsure (1)..(409): unsure at all n locations
  Clone ID: PAT_TA_46834
cgtccggtttaattaatagggaatctacttttgcctaaacattgtacccttgcatagcaagggacgtgtctctctttccaaccgttgcatccctgtaattagcaaccgacctaggatatgacaccttgaaccgtcgagtctgttcgacgcatctctttcagtcatatataagttgtactctttctaccaatacaagttgatctttcgcttaaacacgttatcagcacgctctctaccgagagcctcgccgacggtgagaatgcccggccttgtcaacttcnttctctgctcatccgtgaggacggccgccgtcgccgtttcgcggtccgtggccatcacgaagtaggcgggcgccgtcgacttcaccgggcactgcaccgtcttcgccgagtcggacgacaaggtcacc

SEQ ID NO: 46835 - DNA, 390 bp, Triticum aestivum
  Clone ID: PAT_TA_46835
cgtccgcccacccgatctagggttaatgcagtgctgatgtgaagcaccgcaatcactactctctgccatcaccggcaccatgtccgacaccaggagctcctcgagccacaaggaaaaggtaatacctaccaccactactaccggaatccccatgcccactggaacaacatattctatcaatggtattagagccagattggtttaggattttcggtaggaaaaggaaacgggtgttctaatcccggaaaagaaaccccctgccctggaaccctaatcgacaggggaaagaacgaatccaaaccggaaaaagtagcgccgccatcatggccgccccgttcctttcgatccggccgcgcatcggcaagccgaggcgccggacgaagaaccacc

SEQ ID NO: 46836 - DNA, 229 bp, Triticum aestivum
  unsure (1)..(229): unsure at all n locations
  Clone ID: PAT_TA_46836
cacgcggccganaacaccagaaccccaaaaccccggacgcgccggcgaccgaggacctagacgccgatacgggagcgcaggcgggaggccaaaccaaagccaacaggcacctgaccggaagaagcagcgggaccaagaaagcccacaaggcagaccccagaccaggcggagagcaaggccaaaagcgaccaaagcgcctgccaggcggccaggccgcgcgcgaatcccc

SEQ ID NO: 46837 - DNA, 386 bp, Triticum aestivum
  Clone ID: PAT_TA_46837
cgtccggcctcccctccccgccgcctctgaccccgccccgccggagcgccgccgggatctctaccggagatgccgataccaccgcccccgccccctcctccgccgccggagcccccgcagctccacggcgtggtcatcatcaccctcccgccccccgaccagccctccaagggcaagaccatcaccgccttcacctacaccgacgagccgggcgctggcgctccggccctgccgccgtatcgggggcctccgatggctaccgcggggagggaggccaggcgatcgaggcgggcggtcttgcggcgggcgggggcgatggtccttgtgctgggcgcgctcgcgctcgcggcctactacagtttctactcggacgtggccgtgcagtt

SEQ ID NO: 46838 - DNA, 367 bp, Triticum aestivum
  Clone ID: PAT_TA_46838
cgtccgcccacgcgtccgggagaagaagaaagagtgcatgcttgctctgctgcacgagtgctttggcgaagggatcataaccatcaaccagatgaccaaggggttctccagggtcagggacgggcttgacgatctggctctcgacatacctgatgccagggagaagttcctctcctacgtggagcatgggaagaagaacggatggctcgtaccctctttcggcgttgctgcttcgacttgaaccgatgacccagcgagcaggaagcatcaagcttggaccgcgaaggcgcaagctgccgtagtgtggtgcagcccacctagttggtgggcatttgcggttgcgtttctgatgcacgtcccttgactt

SEQ ID NO: 46839 - DNA, 379 bp, Triticum aestivum
  Clone ID: PAT_TA_46839
cgtccgcccatccctgcacgtgctccctgcttcgctccactcgtcacgctccagctgccggccggccccccaccagcacgcgatctccactcgctccgtccggccggatccccttcctcccctccgcagcgaacagccatgtcttcctcgtcggacaaccccaacacggtcaccgaccgcggcctcttcagcaagagcagcaaggacgagaagaagaagcaggaggagaagaaagaggaggaggagggcggcggcgggttcatcgacaaggtcaaggacttcatccacgacatcggcgagaagatcgaggaggcggtggggttcggcaagccgagcgcggacgtggcccggatccacgtgccccacattgggcttcacc

SEQ ID NO: 46840 - DNA, 483 bp, Triticum aestivum
  Clone ID: PAT_TA_46840
gtacgctggagcagatgcagttgtgaagaaggatcgatcctttcgaacagttgggaaaacgtcaagtggtgtcgatctcaaatcaaaagccacatccaattctcgcaataatgttaggggttcatctggtagggacgaagctggctctacagaatctgaagttcatgatgctagctcgcggcggaaaagtctaccacggaaggtagaggatgtgcggagaaaggttgctgttgggtctgaaatactgcctcaatcggattattctagtcgccagggatcaaatttgagcagacaatcatctaatgctgagcaggaattgagtttgctgggaggtaaagttaaatcagtaaatgatgcaaatgctattcccttggagcagactagggtgacgaaaccggcaaaggggaatcaagatcggcatgatgaactgcaaatgaaggcccatgggttggagaaactatttgctgcacacaagctaaccac

SEQ ID NO: 46841 - DNA, 384 bp, Triticum aestivum
  Clone ID: PAT_TA_46841
cgtccgatccgcacatccctctccctccctcgtctgccgccgccaccaccaccaccggcgacctcctccatggttgccaccccacccccttctctcctcccttaccttctcctcatcagcgacctccttccctccccctcaccggatccgaggcgtgcgggcgcggaggcgagcttcttcagcggtgtccgcctccctctcatctcctctgctactgctccgcctctccaaccgccccgggtcgcagccgcaccgcacgacggcaggccaggcgagctgcaccgcaccaggtgggctagggcgatctccaacgcgagcgcgcgcacccgttgcccacgccagcgtggtccccggccccgagcaacaggaacacatggttcctac

SEQ ID NO: 46842 - DNA, 409 bp, Triticum aestivum
  Clone ID: PAT_TA_46842
cgtccggcagggcagcttgatccctccttcagtgcctgcgaaaccaaacacctcttcggacatccgcaggagctcactgaagaccaccgtgcggaggtatgccaatggcacctcaaaccttcttccatcagtggtgtacatgacacagtggccctctcctgccactgctgttgagcactcttcaacttctgttgttgccgtcatggtaagccgcttcctcccgagagctgctaccctctgccacctctttgctagttgagcaattctcctggcgttgatcatggttggttcttttttgctgggagttggaaactctagttgagttgcaaatgctttgtttgtggatgaagtgatgctgttttgaggccactggaccaagaatttatagctcaagatacaagcccctgtc

SEQ ID NO: 46843 - DNA, 369 bp, Triticum aestivum
  unsure (1)..(369): unsure at all n locations
  Clone ID: PAT_TA_46843
cgtccgcgagcagcaacagcagcgacagcgacagccgattcgccggccgaattcgtgcgacctccggcggaatctgacgcggcggcgcgtaggtctgcgcgatttgggattgaacctggtcaggaatcggcggtcggagcgaatgacggtaccggaggcggtagcactagacataccggcggaggagggttcgccggtggccagggtgccgcggcggatcaggaggaggctcctccaggcgcgcgagtcaagcgccgacgcgccggcaaccgccgaagagatcgaggccaaacttcgtgacgcccaactccggaggcaagcaatccatgaaaaattatcatgcaaagcaaggcatgcngtcaggagcac

SEQ ID NO: 46844 - DNA, 388 bp, Triticum aestivum
  Clone ID: PAT_TA_46844
cgtccgcattgcgccaaagcgactttgaaaacctcaatcataatattagttactgataaccataataaaaatccagccatgctggctattaaacatttgaataacccggtttgaaacctcagtcattcaatatcatagtgaaaatccagccaagtttggctatttaaggattcaaataccttatctgttgacaagtaaatccggaggttaaatacccggcgactcttggctgatggcaatttattacgcctccattgtaagccggaaattttataacccggcggcttatagcctttgagaaaaccaagaattgacaacccttttgagacaccaatttcaatctttgatgatgggcttgaacttaatcatttatgtaagtcatagccct

SEQ ID NO: 46845 - DNA, 419 bp, Triticum aestivum
  Clone ID: PAT_TA_46845
cgtccgaaactgagatgcaaaaagcacaatgtttgacaccaaaatgggaggctgagccaaccaacctgatatttgtttgggtcaacgatgacaattccatcttggccttctcagctgcttctgtaagacgctggagagcttgcttgtcttttagcaggtcaataccctcatcattcttgaagcttccagccagccaatcaacaattctctggcaacagaattatttgtcagaacatataaatcatgcagaaccataaaaaaagtgctgaagactctttgggaacaagggcaaaggttatcagtaagcgtgagataaggatgttatttcatctctttggctgtcaaaaatgcacatacatactgcctaatgcagattctagtaactgaaagacacacgacctcactggtaacgacctcac

SEQ ID NO: 46846 - DNA, 370 bp, Triticum aestivum
  Clone ID: PAT_TA_46846
cgtccggcccagtgactgttctattgcaaggataactaacaacctacgtatcctgagctcctaggattgcaaacttggggccgtaacagacattcctctctgtgttctcgtctaaatttgattgaaatagaatatgttttgccagagagaataggctctgtgaggtaaaagtgtgttatccagatcatgagcttagcacttgtactagcttaattcagaggcattgatgttctggtggtttgtgctctcattgaaatattaacgtggtggtctgattgttcttttggaattttttaggcccctgtgtaagataaaagtatcattctgtgaaagttcttgtcacgaaattacttctcctcggtttgcaaaa

SEQ ID NO: 46847 - DNA, 399 bp, Triticum aestivum
  unsure (1)..(399): unsure at all n locations
  Clone ID: PAT_TA_46847
cgtccggatctctaccactcgatctatcgcctcaggaacaccaatatcatggccagacagtaatctcttcatggcacaggctgctacgcgcacgcgctttgcaggattaaacaaggagaaagagaaaggttgtgcaactaccttgtcagcatgctcatcttcaagctcccgctctctgcatctgaccgtgtcgagcaagtagcggccctggtacactgtgtcgttgagctccgaaagccactcgagggtgccatagtttgtgatctgcctccctttggcctcctctactgcactataaactntgacgagcacatggcaaatcttgcgtagtttggcttcggaacactgttggtccttgaactggccgggcaagaagagatatcaccatgccaaccatgt

SEQ ID NO: 46848 - DNA, 414 bp, Triticum aestivum
  Clone ID: PAT_TA_46848
cgtccgccgcttgctgctactttccgccagccggggaaaaggcagccgcagccgcagccagcgacgcctcacctcacctgaccccccctcctcgccccgccccccgccgcaccgcccgccggaaggttctagagaaggagggacacgccatggcggaggagaaggagtcgacgtcggtcccgctcagccaggcggcggaggccgtcgaccccgaggacccggccaagtcgccgccgcgccccagctcgcccaccacctccacccgcaaggcatgctgtgctgttcttcagagttgggtgtcgagaaaatttatgaccggatgttctttttcctgtggctttcacgttcttcatcacatggtggttcgttcaatttggtgatggatttttcagcccactatatgcaaaactcgga

SEQ ID NO: 46849 - DNA, 232 bp, Triticum aestivum
  Clone ID: PAT_TA_46849
cgtccgcccacgcgtccgcggacgcgtggggaagattagtttaattaatcttcttgtagatatataagcagtcgtagtactaacaagtaagtgatgactgatccatggtacgctaacaacaagctgtggggagaggtaaaagcagccaactgtctccggctccgcaccgtcatgcatgccctaactcaggatgcgcccatcgttaatcacgctctactgatcctcgttgccg

SEQ ID NO: 46850 - DNA, 436 bp, Triticum aestivum
  Clone ID: PAT_TA_46850
ccggccgtttttaaggtttccccacgcgtccgcccacgcgtccgacagcagccacccacagcctctgatttatatttcaagaagcggaaaaatcagattattttgagttcatcttcctctgatggtcagaatacaaaagagattgcacctgctgagagcttaaattcaggtgagagtaatgtacaaattgcatcctcgaacaacagtatcaatggtttaaaggagagaccacataaagctcttcggacaaataatatgggaacttcctcgcacgtgtggacactcagtgggcaacaaccacagaggaaaggatctgcgggaactagttatgcgaaggccttcccacgtattcttccatggaaaagaaaaatatactgcaagaattttagaaacagtcacactcagaatgtgaggctcttacgaatagtcagaaaac

SEQ ID NO: 46851 - DNA, 396 bp, Triticum aestivum
  Clone ID: PAT_TA_46851
cgtccgggaggacccgctcatgcgaatacggccgcatttcagcgagacattcctcgctccgcaaggtgacggcaatgaggcatcaactgctgaagagacgtcattcagagtgatctggatggtccagtgcgaagctagggtcgtgggctttgtcttctcttccagcaccaggcaatggcgagccattccatcccagagttgggccaatttgttggctggcttcgtgtcatcgactgggttggcactcttctacgggcgccaatgtacgtgtgactacttttactggctgccaaactgtcagtacgatttgaaaatgttggtgctcgacaccctgaggatggagttctccgttgatgaacccccaactgaagccaaaaatgccttatttcttggtat

SEQ ID NO: 46852 - DNA, 247 bp, Triticum aestivum
  Clone ID: PAT_TA_46852
cacgcgttcgtctactcttggagacatataagtagacctgcacactgaacctggaagtccatttttaggcagtggtcatgtagcaacattatatgctgcgtggcattgcaggttatttttccgtcctggtctatccatgctctgaatttgatgttagagtgcatgggagggccaagaggccatctttgtgtggtgcagttactaggcctaacacctaacatcggtctccttactgtgtggaggagat

SEQ ID NO: 46853 - DNA, 432 bp, Triticum aestivum
  Clone ID: PAT_TA_46853
cgtccgcggacgcgtggggcgtacgccccgcgcccgattccttctctccttcgaccccctcgtcccggcgcccacacctccttcccgccggccgcctacgccgctgacctgcccacacccctgctggccctcctccgccttcatcacagttccgccgccttccccactccaaaggggccaccagccaccagagcctccaagccggcgagccccttcctcatcgggcctcctttgcttctcctcgtgtgcgagctgcaccgcgccgagccactcggccccctcctccgacctcatcctcgcgagcacaaccaccggggcgccacttcgccagtccccgtcgctccgccactccaggagccagcaggcgcaccaccgccgtccaggatctccatggcgctgccttggctgcttctccagcgcccaagtctacct

SEQ ID NO: 46854 - DNA, 369 bp, Triticum aestivum
  Clone ID: PAT_TA_46854
cgtgcggggagactgagcaagcctgcagaactcatcagcagcgggctagagagctggagaatgaattagctaatgagaagagctgcgagggatacgggtaaatccacgaagccatcatttgccgctcctgtgaggcagagaccaccacttgctcctatgaggcagagaccaccaagcaacaacatgccacaaccttcaggcccttccagagtgaggttcgctggtaagggatcttcagttcagaacaaagagaacatccctacgacgaacaaaaccattgtggacaagactgctggcaaagcacggcgtgtatctttggttcccatgatgcgacagatcccttttcagcctaagaggcgatccttgatc

SEQ ID NO: 46855 - DNA, 404 bp, Triticum aestivum
  Clone ID: PAT_TA_46855
cgtccggatctaactcattttgaattaaatttttgttcttagcattatgacatatggcttttttctttaaagaaaagagcgagtcaagaaccattttaggatgcgttgcatctgggcttgaaggacagtaagtgttgtctttttgtgatcatctggttttgagacccttctttgaacttgctcttactaggttggatctagtgaggatggagaaccatctgatgcagagatcaaaagcgctatatgggaggtgtgcggtgatcatggagcgctgggattgcttgtggatcttcttagggtgaaaatggctgaacttgaagaaggaactggaacataagcttctgacagtcaactgctggagaaatttgatttaaccgttcaaatgacttcttgagtgcaaccgt

SEQ ID NO: 46856 - DNA, 297 bp, Triticum aestivum
  Clone ID: PAT_TA_46856
cgtccgcggacgcgtgggccccgcggtccgagaagatggcgaggaggaggaggacatggagcggctcttcggggcaggggcggccggccgacgctgagggagcggaacaggggcagggacgaggacggctccctgtcgccgccgccgccgcgccaggcgtgctgctttcccttctcgcccaagaaggccccgcagagggccccggcggcgaggagcaggaaggaccgtgtcggaggagcgccgggcgactacttactcggcatcttctctcgtgagtggggcgactagaacaggagg

SEQ ID NO: 46857 - DNA, 262 bp, Triticum aestivum
  Clone ID: PAT_TA_46857
agtaccgatccccgagtcgacccacgcgtccggaaggtagatgtacagatatttccatacgacgctcgtcgtctcgcctacgttaccaccttatcttgataagagaaaaatcatagaggggaactcgttatgagggctcgtgatctgtgttcggagaggggaattctttgggtctgaattgtgaacaagctggcgcgctcggaatcggtagataccatacaaattttcccaggaacctttaatgtatgtgctaatggagtta

SEQ ID NO: 46858 - DNA, 256 bp, Triticum aestivum
  Clone ID: PAT_TA_46858
cgtccggcgaaagggaagcaagatgtacaccgccaggaagaagatccagaaggacaagggcgtcgagccctccagttcgaggacaccgttgcgcaggctttctttgacctggagaatggcaaccaggagctcaagagcgacctcaaggacctgtacatcaacactgcaatccagatggatgttgttggcacaggaaggccgggtgatccatggccgacccgttgcgcaagccctaaggaagatcaagtaggctcgt

SEQ ID NO: 46859 - DNA, 497 bp, Triticum aestivum
  Clone ID: PAT_TA_46859
cgtccgcggacgcgtgggcacggagttgggttcactctctgtgtgtatatagtattacaactcactactcacccaaggggtctcctgtgattgtgtctctggactcaccaaagtcaccactgctgcccggccatggcttcacctccatgggttcgccttgtgctgctactcctagctgccgtccccgcatgccatggccgcccactttttgacggcgatgccgtcatcgatgagacgcagcccttgcggccatccatgatctcatgctcaactgtcggcaactacaccgacggaagcaagtaccatgtgaacctcgaccggctcctgtcggccatccccgtggccgctgactccaatggcttcttcaatggcacatttggcgcggtgggcgacgaggtctttggcatgttcatgtgctacgctgacgacgccgactctgagtgccaggactgcctcacccgcgcccttgaggtattatgaaggtgtgtcctcacagt

SEQ ID NO: 46860 - DNA, 426 bp, Triticum aestivum
  Clone ID: PAT_TA_46860
cgtccgcccacgcgtgcgcccacgcgtccggtcctccatgctgtaagagagcaatgccgggcgatgagcaatgtctatgttatccagttccttaaggcaaatggattgctaggtcagtaccgggactactataatatagtcatgctgagcgacaaagtatttatggagaggttcatatgccctcacaagaaggctgcaccacaccttgctaaagactatgcaactgcttgcaaaggggaagtgccagctaatttcagatttacatgaaccaagaagaggctatggaaacttgtaacatgtgtatggcgcaacaaagttttcactctgcattgtatgctgtgaactctatgctcagtattcattgcctaactcgatgtcggctatattttatagtatatccatgacatgccagtttcctcattgctc

SEQ ID NO: 46861 - DNA, 346 bp, Triticum aestivum
  unsure (1)..(346): unsure at all n locations
  Clone ID: PAT_TA_46861
cgtccgcgaggagagacggaggaggggcgaccgtctgtaggagcgtgaggtcctcatctccancttgagctcaccctgaagaagaagaagagggccttcttcccttcccccgagctcaagcctagagcaaagcttacttatgtctgcacatggagtcatttacagcttatgccggtgacaagcatctggggagcaacctgacattgagtttgacagtatcacatttaaagaaaggggatactaatgtttcaatgtgcctgtcgcttattgccacatatttggtcagttctgttcataagattgtagaatttctatttaccttatggaataaatgggtcgttcactc

SEQ ID NO: 46862 - DNA, 144 bp, Triticum aestivum
  Clone ID: PAT_TA_46862
gcgatcgtcacacctcctgttggccaacagacacaacacaaaccaagccacagatggtggcaggcagggagcgtacccaacggggctgcggaggactggtcagctcagtgaggacccacaggtggcgggaggtcgtatggtgtg

SEQ ID NO: 46863 - DNA, 244 bp, Triticum aestivum
  Clone ID: PAT_TA_46863
cgtccgctgacgcgagcgagaagaggagacacgaccatactgaaccaccgagctggctatgggctgggtatcgctaccaaccaacattgagaggagtgaccactattcgcatctcctgtttgtatcaagtgctaactacctaaccgcccttaagtccataaaccctagatgatgtggcactcatatcacaacgagtagacggacgtcatggccaataccgtcaactacaagctcgaatacttcc

SEQ ID NO: 46864 - DNA, 333 bp, Triticum aestivum
  Clone ID: PAT_TA_46864
cgtccgctcactcctcctccagcgatctgggggaccctccggacgctcgagtcccccaccaaccatggcaacacacatgaagaggcccagcgggcactggcccaaaaggagcagacacatacagatgatgctggccaacgacctgcacctatagaccaagaactgcgactttcatattgagcgctacacctacaagcgccggtccgactgcatatacattagcaatctgggcatgacaaggaacaagctccatctcgcgacgagggttatggacagcatccagaacccgcacgacatgaaagatcagtccgcccgaccttacggtcaacgcac

SEQ ID NO: 46865 - DNA, 276 bp, Triticum aestivum
  Clone ID: PAT_TA_46865
cgtgcggaagctgccacagcacaatcatcggagtcgcgagagccaaggtagaaagcaatctttggatcagcacacacatgcggcacttgggactcccgcgggttgtcccagcgtgtccgagctggtcgtgcagggccgggactccgccgccgtcctcgaggccctgctccggggcgcgtcgtcccccgacaacgccgggatccgggagctcgccgcggagatccttcgttgctgcgaccgcgcgctcgccgcgctccacggtggttaaggcgccgt

SEQ ID NO: 46866 - DNA, 249 bp, Triticum aestivum
  Clone ID: PAT_TA_46866
tgcgtgcgcgcacgcgtacgatcagatttggatggcagttcagcgccgggcctgcctagttttactctgaacgattatctcatggaaatgcgggagtatatgccaacaaggacagaagaattgccttacgcactgtagctgaaagctctatattaagtcaatggcggggttctgacaaggatgattcctgttcagagcttgattagcgtgacctttaactaagtcttattgggctgttgatacttgtat

SEQ ID NO: 46867 - DNA, 377 bp, Triticum aestivum
  Clone ID: PAT_TA_46867
cgtccggactacaagcctacgcaaactgctaatgataggagaatctaacttgtgtcacataagcatgggcaataatcccgttatgcacagaggtcactaacaacaacctataatcacacatctcgctactggtcactgtcatggctagagtgatctgagacaggagaataatggccccatgtaagacatgtccaaggttgctttatccaactgaagatatcacacctcacatgctgggttcaaatgacatgtataacagaacctttggacttcaattgccttcgaaggtgaatattaactcatccgcatctatccggggtcgtgtcttttgatctgaatgtaactggtatcacaattcaggtctaatggttgacatt

SEQ ID NO: 46868 - DNA, 252 bp, Triticum aestivum
  Clone ID: PAT_TA_46868
cgtccgcggacgcgtggtttttttttcaatgccttcatcactataaattaatcaaaacttatgtctgataaataaatatgtgggtggagtgttcacctaaattcacatgctttttgaaataattagtttaaaaatgttattataacagtggctttccggatcacaagtttactgcttatacctgagttttctaaagaggttttattattattacctagatcaacgtgtatttgttaccgatttatttttgtt

SEQ ID NO: 46869 - DNA, 278 bp, Triticum aestivum
  Clone ID: PAT_TA_46869
accggaaacccgggacgacccagcgtccggcacaccctagccagacccaaaaccacgaagcgcagaccgaagagcagaacaccgaggcggcgaaggacggagcccgagaaggggaacctaaagaggaggagggaagaggccaagaccgccgagaaaaagcaaaaggaagacgacgagcagataaaggacgaggagaacaccaagggaaaagacgccaaggcggagcaggacaccagggagtaagaggcccaagacaaggagctggagcaacaaaagcg

SEQ ID NO: 46870 - DNA, 200 bp, Triticum aestivum
  Clone ID: PAT_TA_46870
cgtccggaaaaagctactcttatctttctaatcgcacgtcctacgaggaagatatagcaccttgcacttgcagctgattcatggggcggagcatcaacatgctgctggccttgctgtacacatgggttctttttctcgcccatgatgatcttatcgtcggtctctcgcttaaccaccgttccaataccaccgactgtgag

SEQ ID NO: 46871 - DNA, 256 bp, Triticum aestivum
  Clone ID: PAT_TA_46871
cgtccgtctctcccctcgctttcccgccgcaatgtcgaccgacgccgctgccgccgacatcccggtgcctcaagtggagtgaccgccggccccgtggcgtagaccaccgctgccgccgcctccggcgactctaagcctgtcaaggcgaccaaggccaaggccgccaagacctccaaggcgcccaaggcgaagaagtcctccgtctttgggaagtctaatgccaccctcttccacccgacctactctgagatggtgt

SEQ ID NO: 46872 - DNA, 140 bp, Triticum aestivum
  Clone ID: PAT_TA_46872
cgtccgcagcacacctacggccacacgagcgcccacgcatctgatgtccctggggaggattatgtttccactttgatcaaccaaatgataaacatttttaataaacatcttaaccgttagatgcaatatgatagcttgtt

SEQ ID NO: 46873 - DNA, 242 bp, Triticum aestivum
  Clone ID: PAT_TA_46873
cgtccgtggacctccggctgatccatcgagttcaggacaactgcctatcacggcactctcatgagacactcatccacttgttaccgcacgggttgctgtggccttaggcggactgggaccagagcttcatactgtagcatacattaccacaaccgcaaataacttacgcatatataatcctggttggatagttaatgagatgcgctctcaatacaacagagttttaggttctcctccagatc

SEQ ID NO: 46874 - DNA, 175 bp, Triticum aestivum
  Clone ID: PAT_TA_46874
cgtgcgtccagcgaacggcacgcgcgcgctcgccttccacactacaggcacaggcagcgagcgcacaggagacaacgaggggggtggggggcgcatcaacgacaccggcgtaacggactccccaacagagggcgggacagcacccggagctataatcatgaagcagccgggaagg

SEQ ID NO: 46875 - DNA, 130 bp, Triticum aestivum
  Clone ID: PAT_TA_46875
cgtgcgcggacgcgtgggtttcaacagtatagtgtgatttctctgtctataagtgccatgattatagcataaaggactaccgtgcgagggtgactccaagaatgggacaatttgctcaatcattttcaaa

SEQ ID NO: 46876 - DNA, 352 bp, Triticum aestivum
  Clone ID: PAT_TA_46876
ttttgcacagtaaaaagacacataatataatttcagaatttacgagatcaaggggacagttacgctaatatcacaagtcgcataaaaccaccatcaacatacataagacagtgcaaaaaatatcgattctccgaagcagcaaaagcatttataagtggtatcaaccacttaaagaattattcgaaccacaagcactaccaaattgacagcaattgtgaacacaaggcatatctagcatacagtaggacaaccggatgagcgacaggtggcttaggcatactatacctactacttgacatactcttcctacttattggcagtggcatacttggactagctggtctcagcgaca

SEQ ID NO: 46877 - DNA, 355 bp, Triticum aestivum
  Clone ID: PAT_TA_46877
cgtccgctcacgcgtccgcctacgcttccgtccacgcgttcgtccacgcgtgcgggaggacatgctgtatcatgagtctgaatggagatgactgagactgtcctcagtgttgcatgcgaagaggatttctgtgaggaagaagtaacctgcacagctgttttagatggtgaaatttatgactgcggtgcttttgctttgttgtgtgctggaatctcaacaccagcaacagagggtggctttgaacaagatgtgtacacggtggtagacgcttttggtcagtatgactgcgccgtgaacaactttgttgtgcatgtgtatcactgcagaggacacattggttgtcattgatgatgct

SEQ ID NO: 46878 - DNA, 259 bp, Triticum aestivum
  Clone ID: PAT_TA_46878
cgtccgctcctccttgctgcaatggaggccaagcgcccatggcatcacccgagctcacctcccagccgttgttccttcaaattcggcgggatccggttggatccggatgccagcgccccgttccgacctccccgcctcgcttgggtcgacggtcacctcgacgacttaataccgcttgcgggatccaactgccaccggtggcctgacactttctctcctggaggagactcccccacatcatcaccttgcaacattagca

SEQ ID NO: 46879 - DNA, 216 bp, Triticum aestivum
  Clone ID: PAT_TA_46879
gtcgccacgcgtccaaaagagcgcgacagctagggtcctagccgccgtcgcgtcgccctgcctgtcgaagcctatgctgccccgccggtacaggagccgagtagcgtcaaccttcgtcgagcagccgctcccaccagcagtgcctccctccctgcggtggttcgggatctagccatgtcgaccaacatgggcggatgtgtagggaagatgaagatg

SEQ ID NO: 46880 - DNA, 433 bp, Triticum aestivum
  Clone ID: PAT_TA_46880
cgtccggcggaggaatggcattcctagtgacattgtcataaataaatctacttatactaataaaagcacgagtttggtgatccaaatgatctgagccatccaaccacctatatccaacgtctcacgctgctccaatgatgtatctatcacatcatcaataatttggaaaagacattaattgcattaaacacaattaatattgaaatcaacattaattatggttaattttggaaagacattatatatatatatatatatatatatatatattaatataccggctaatatcaacatgtactgcacgtatgcatttaccagttgtcataaatattccataactaaaatgtatgcatgtgtggggcttaagaccccagtacaaccaccgaaaacacaaagctcaaggctgtataaaattaacaaggtagggtcttag

SEQ ID NO: 46881 - DNA, 383 bp, Triticum aestivum
  Clone ID: PAT_TA_46881
tcgttcgctagaacccaaaccctagcggccatggattcgggcggaccaacgagctaacttattttcatgggggtgaataatccacccagggctgaccaagtaacctgggcttagatcattaaactagtacctgaccttaattaatcataggccactcatgtgctcgccagactgtgtgctccttctcccttagcacgggtcctggacgccttcaagaaacaacccgattcttattttggggacgcttattaactcgacttgcaaggtggcaccagaccatcaagtttcagcaagcgggccaaagccatgcataagtgcggctgaccaaactttgtccattgtgagcaccggggtccccaacttatgcttggtccattccttca

SEQ ID NO: 46882 - DNA, 436 bp, Triticum aestivum
  Clone ID: PAT_TA_46882
cgtccgcggacgcgtgggcctcgagaagctgaggctacagacggcacagagacagggacaactcccttcgctgtcattcatgcctccaagctggtatagttttaccgatgaagccgcaaactttgcacaagagatagagaagcatatggttactgacttctttgctttggagctacatctgagaacaacaggtcatgtttttggagaatttgtgttgcattttcttggattgaatcggatccgcagtgttatacgaagacttaaggtcgtccgagtccgacagggatcatggggggatgaagcatgccctgcaaattgtccttgtgacactatgaactggaggacccaaactatctccttgactgcccttgtagatttagaaatcaatggcttctaagcagaggatcatgaacttggttttttgaaactgattctc

SEQ ID NO: 46883 - DNA, 309 bp, Triticum aestivum
  Clone ID: PAT_TA_46883
cggaagacccgagccgacccacgcgcgcgagaggcagccaaggctcccctgcatgcaagagctacgacaacctcgctcaacagcagctacgcttcctcgggcgaggaggaccgcgactcgaagagacacggcgggcggtgagcacagcacagcaggtgggccgcgcggagaagcccccatggagaccgggaagcgcgaaccaagccaggcacaggggagcactggcacgcgccaacggaacggcgcccagagatccagggcgaggggcagggggcccctacggaagcggagaggcgcaacacgagaacg

SEQ ID NO: 46884 - DNA, 462 bp, Triticum aestivum
  Clone ID: PAT_TA_46884
cgtccgcccacgcgtccgaagggccggagcttcaatgacaaatccactatattcagcacatagcccaactcagcaggcacgagccatgtcgacagtcggggtggcactcgggtgcatgctcgccttgacagtcatcaaggtcgcaatagagtcggtggaggctgtgctcggcgacgctgagagagagtctatcaagcataagtccatgctgttgtggctgaagtgacttatggatgccgacatgcttgaagattttgaagatgaaaccgacctcaacctgtgcagccacgatgaagaagaataagatgccacataacatgagatcgatgcaaaagcgcatagaaaagataaaagaggaccgtgaggagcggcaaggtcccgacatccaggatacagcaggatatgtggaggaggcagaaatcatctggaggactgatgattgcatatcttggagcagcagag

SEQ ID NO: 46885 - DNA, 490 bp, Triticum aestivum
  unsure (1)..(490): unsure at all n locations
  Clone ID: PAT_TA_46885
cgtccggctgctgctacagcttccaatccccacctctccggcgagcgccagccttttccggcgagggtttgctccgatcggagctctcgggcggcagatcggccgggtcctccgcccgcgctcccgtgcctgcgctgaagagactaccaaatatcttcgtgaagaggacttgaacacaggttgggtgcaatggcgaatatgaacataaccggcatcttggagaagatgacagggaaagataaagactacagatatatggccacctcagatctgcttagtgagttgaacaaagagagtttcaaagcagaccaagaccttgaatcaaagttgactaatattgttcttcaacaactggaagatgcttcaggagatgtttctggtttagctgtgaaatgcttggctccactngttaaagaagtaagcgaggatagagtagtggagatgactgacaaggcttgtgataaattactcaaatggaaggagcagcatc

SEQ ID NO: 46886 - DNA, 199 bp, Triticum aestivum
  Clone ID: PAT_TA_46886
cgggcgcgcacgcgtgcgcatcgatgaggggcagcgtgtggagtggaagcagctgaatgacaagatgaagaaatgggtgcatggcgtcaaggcggggggccggtccctgctgacaggcgagcgccggctctgtgaacaggggctcgcagaggccgaagggctgggggacgaggggctacggtgaatccaccaagggggg

SEQ ID NO: 46887 - DNA, 475 bp, Triticum aestivum
  unsure (1)..(475): unsure at all n locations
  Clone ID: PAT_TA_46887
cgtgcgggccctgtaccgaagtttatcagacagaccgacaccgagccgcccggagcaacgatggagcagaggtcaaagaggacaagaggtgcatggatctatctagaaggtaaaagccaggacgacacggatttcattaccagaggtagaaggaggctggccatggactcgaatcgtcgctgtggccaggacgagcagcggtgccaggatccatgtcagttttgtactcgccgagctgatgatcgccatggcactcttggatttttgcaaggcgttgcaagcgagaggcatccacagagcaacctgtgcacttatatggcagatgaaaccagctaacgcggccggtttagtggtatttttagtgactcaagctcaatcggcgcggtgtgataataaagaaaacgaaagctttgtccatcagtaggtgaactgctacttgcattagtctaaaggtaagactngccatggggttcag

SEQ ID NO: 46888 - DNA, 219 bp, Triticum aestivum
  Clone ID: PAT_TA_46888
cggaatcccggtcgactacgcgtccgtcgctccgagatatcgactgactactggccactggcgagaccaatacagaggactcgccgtttttttacggagcggagacacaaccgaagacgcgcgctcgccgctcttcgtcctctccgcgttgtgcaccctgcagcatgtaatcttcgagtacaacggagcgccgtgggactatggtattatataacttgt

SEQ ID NO: 46889 - DNA, 373 bp, Triticum aestivum
  unsure (1)..(373): unsure at all n locations
  Clone ID: PAT_TA_46889
cgtccgcccacgcgtccgcccacgcgtccggngcagccccgcccgagccggcgcccccatcgctcatcgttgtcgcccgtctccctcctcccgcgagccctgcttgccgcgacgcccccgcctctgcatcgaccaaggtgaacgccgccggcgccgcgccgttcaccactaccctcatcgaccctgcggccaccggcgaccccgagctgcgccatggcgtccaggcggtccgccgccgtcgtcttcttcctctacggccctcggatcgtctncaggccgccgtcagcgctcgccaccggaccacattcccggagcaccgtcgccttgacctcgcccgtccttgtcctccttcccgagcgcggttatgcacatt

SEQ ID NO: 46890 - DNA, 267 bp, Triticum aestivum
  Clone ID: PAT_TA_46890
caccatatacaacgacaaggccaagacccaggacaaggagggcattcccccggaccagcaacatcggatcatggggggcaagcagctggaggatggccggacccttgctaactacaacatccagaaggagtccaccctccaccttgccctgcgtctgcgtgggggcatgcaaatcatcgggaagaccctcaccggcaagaccatcactctggagggggagagctccgacaccatccacaacagaaagggcaagaaccaggacaagga

SEQ ID NO: 46891 - DNA, 236 bp, Triticum aestivum
  Clone ID: PAT_TA_46891
cgtccgcgcacgcgtccgcaccccacccatggacaccgacctcgacctggacgccctcctcgcctccttcgccggcgagtccgcggcaggcggggagctcctcgccccgcgctccgctcgatgcggcagaagctgagtcaccggagtcggtgacctcccggaccagccacgccggcgaggaggtgctgccggagatcgagaggttcctgatgcacgaggactaggctgggggggcg

SEQ ID NO: 46892 - DNA, 219 bp, Triticum aestivum
  Clone ID: PAT_TA_46892
cgggcgcggacgcgtgggggcagctggaaccaagccgctgttcgacgacgacttcttctaaccgggccgcgggacgagggcctccaactcgagggacgacagtgacggcgtgtgcgggacgggggacggcggatgctcccgcgtacaacgtgttcacgagcagcaatcgctcggctccgccttcctatgacgacttgctagggggcttcggcgggaagc

SEQ ID NO: 46893 - DNA, 221 bp, Triticum aestivum
  Clone ID: PAT_TA_46893
ctagcggcatcaccaaggtcagcggccacgccgattgggtccagagcggtaagagcagcgtttaccgggccagcggtggcagtgatgttagtgatgataggcacctgtagcattatatgcagcatcgctagcaagcctcacaagttcaatgattcaaggtgggaggcgattcaggtgatcctgaccaaagaaggatcgcttggattgagttacttcatgct

SEQ ID NO: 46894 - DNA, 349 bp, Triticum aestivum
  Clone ID: PAT_TA_46894
cgtccggtgatctgtgccttgaccgtatcaggaagctttcagacaactgcactggtctccagggattccttggcttcaacgctgggggaggtggaactggctctggcctgggttctcttctgctggagcgcctctctgttgactatggaaagaagtccaagcttgggttcacagtgtacccatcacctcaggtctacacctatgttgttgggccatacaacagggtcctgtccacccactccctacttgagcacactgatgtgtcgatccttctttgacaatgaggtcatctatgacatctgccggcgcttccttgacattgaggcgcgaacatataccaacctgaaca

SEQ ID NO: 46895 - DNA, 352 bp, Triticum aestivum
  unsure (1)..(352): unsure at all n locations
  Clone ID: PAT_TA_46895
gcagaccgtccgattccggtcaccacgcgtgcggcaccttcgtctctctgccaccgatcccgaaccaggaggaacccggcgcgaggaggncaaaggagagaagaggagatgggcggcccagtgcgcgcacaggacagtatgcgccgtgatctctcacaggagcggagatggggctcacgttcacgaagctgttcagccggttcttcgccaagaaggagatgaggatcctcatggtcggtctcgatgcggctggtaagaccactatcctctacatgctctagcttggagagatcggcaccaccatccctatattcgggtttaatgtctaaactgtattggtcaagatcattag

SEQ ID NO: 46896 - DNA, 347 bp, Triticum aestivum
  Clone ID: PAT_TA_46896
cgtccggaaaagcttgttggatgaagctgtctctcagctaaaagcaaacacacgaagacttgttcgacgccaaactgcaaatctctgccggagagacggaggctacaccggctgaataaagacttcgggtggaatttgcatcacatcgatgcaacagaagcattccaatgtaagtccatttgtatgtatttgcccagagtgttgaattggcctgctttgatgtgttcttttccttcatatgcaatgtatattttactaggtaccactggtgactcttggcatgtcaaggttataaaaccttgcgcagatactgtcaaaagattcttgtctaacgatacaactttggc

SEQ ID NO: 46897 - DNA, 296 bp, Triticum aestivum
  unsure (1)..(296): unsure at all n locations
  Clone ID: PAT_TA_46897
cgtccgcggacgcgtgggcggacgcgtgggcttctctaaactgtgcaatccattccaattctgaattacttcatggcaccaccaagatttttatctttgttatatctactatcatgtgtcagccgtctaacctcatataatgtcccaccaagttggactctgcctacctgtgcagacgagctcttgattgaacaagtcaaacatttaaattcaatgggaantttaaggaaaatggttagtactttgagtgaggttactgtctttcacagcacaaccatctctacttcttaaagttc

SEQ ID NO: 46898 - DNA, 215 bp, Triticum aestivum
  Clone ID: PAT_TA_46898
ctggtgctctgctccggctcttctctcctcctcctgcgcacgcagaggcacgcttgttctctcgctcatggcagctatcctccgctgctgcctcctgctggccctggtggccggcctgcttctcggcaatgccgccgccctgccgcaccacggccccgccaagcacgactaccgggacgcgctcaccaagtccatcctcttcttcgagggccagc

SEQ ID NO: 46899 - DNA, 232 bp, Triticum aestivum
  Clone ID: PAT_TA_46899
cgtccgcatggcgctcgccacctcccaccaccgacacctcgttcgttccgccgccgcggcctctcgtgtgtcgatagcgtaacgtccgtatcggcggcgcggggtctgagcaccccgtctgtacccgccggcggtcatggaggcgggggtggtcgactcggtgtccaagctgctgaagggcggcatcgcgctgcccgaccaggcccccgggctggtgatgcccttgaagatg

SEQ ID NO: 46900 - DNA, 333 bp, Triticum aestivum
  Clone ID: PAT_TA_46900
cgtgcgaggagatcaagaacggccgcctcgccatgttctccatgttcggcttcttcgtgcaggccatcgtcaccggcaagggccccctcgagaacctcgccgaccacctctccgaccccgtcaacaacaacgcctgggccttcgccaccaacttcgtgcccggcaagtaagctgctaggtgttgtgtctggaaaccgaccgtgcacgtgcgtacgtacgcgatcaagtgtgcgcatgcatgcatgcagctgggtttcgtttgtactacaaccatgcatgatgtaaagtacgaaggttgaatgcaaaagactgttgttgggaaaaaaaatttat

SEQ ID NO: 46901 - DNA, 192 bp, Triticum aestivum
  unsure (1)..(192): unsure at all n locations
  Clone ID: PAT_TA_46901
cgtccgctcttgcaccgggcgccggcaatctcctgcggcgtgtttcttgctggctggcattgctggtgcgcgatggggaactgcgcggcgaggggggacacggcagtcacggcggccggcgcgggcggcgaggacgggaagaggcggcggaggaggtggaaggcgccncgggaggaccagcttgggacggtc

SEQ ID NO: 46902 - DNA, 367 bp, Triticum aestivum
  Clone ID: PAT_TA_46902
cgtccgcccacgcgtccgagctgtcttgagcatatatttttgcctgcctttatgacatcttcagatttctctcctgatgcctatgcactgcctattgttatctgtcatgttcccttaaaaacctatcagtcatctcataacatatccaagtctactcctcgtttaaataacctttaagatcatcggcttattggtgtatgacttatggaaatactattgtcgattgtattgaagctaagctatatagacggggtgattcgctactatatgtcacttttgaactatgtatttatgactaaaagatataagacggcgctttatgagattgttaaagcgcgttatgtggatatacaatcattgcagtcgt

SEQ ID NO: 46903 - DNA, 146 bp, Triticum aestivum
  Clone ID: PAT_TA_46903
cgtccggggtgtttttagagcatacaattatattgcacgctgcgcgcgcatagcacgttcgacacatcatatgctatatcacgggaacaatgggttactaacagtcgggatcacaatatatctttattagtaggaataacatgcta

SEQ ID NO: 46904 - DNA, 309 bp, Triticum aestivum
  Clone ID: PAT_TA_46904
cgtgcgggagtttatcacacacgctttccttgccgccaagatgttcgggttcggccaccaccacaaggaccaggcgccggcggcgtgggggggcaaccagatcttcaagatctactgccgggcctcggaggactactgcctcgccgtccgcgacggcgaggtggtgctcgcccccgataactccaaggacgggacccatcattggctcaaggacatgcgcttcagcaccaccgtcaaggactaggagtgttatgccgccattcgcgcttgtcaacaaggccatcgagcacttgttgctaaaaggagtgt

SEQ ID NO: 46905 - DNA, 287 bp, Triticum aestivum
  unsure (1)..(287): unsure at all n locations
  Clone ID: PAT_TA_46905
tcgaccacgcgtccgacaccccacgggtgaatcgaaacaaagcgtcgcatcggcggtgacggcgaaactttggatcccatccaccccttctccgctcctctttaaagccgccgcccgtccccctctgcgttccaccgcactaccgccagcgcagcgacaccagagctcgttcgatagcttanagcggaggcgaggaggaggagatgaggatgtcgctgctgagatccgcgtngcagcacctgcgccgccgccgcggctactcgtcgacgcccgcgcagccggagcgg

SEQ ID NO: 46906 - DNA, 477 bp, Triticum aestivum
  Clone ID: PAT_TA_46906
cgtccgcccacgcgtccgcccacgcgtccgcggacgcgtgggctaaaacagtataaagctctctcttggtgatgcaagggcacactacctttcaaatgccaagaatgaacttggagttgttttttcccaaagtatagctggagtacctactgctgatccggaggctgaggaggaagatggagctgcacttgaagatccgggggcaagaggaggaagaagatggtgcaacacttgatccgaaggcggaggaggaagaaaatgaggcatccatcactggcgcggacaaggagagggaagcggagtcgttgccgcgagttctgaaggtgcgagctcggaggcataggataaatcggaggcgtggaggagcagctggccttgctcggagaagaggctcttcatccggcaggcgagttgctggcttgctgctgagggcaatctaaagtgacctgcaactactgccgagggcgatctggaact

SEQ ID NO: 46907 - DNA, 462 bp, Triticum aestivum
  Clone ID: PAT_TA_46907
cgtccgcaggtgcccaagctcatgacggaggccgagctggccgccatgttccgcgacgtcgccgtcgtcgacgaggtcaccgtcatccgcgacaaggccaccaaggcgtcccgaggctgctgcttcctgatctgcccatcaagggaggaggctgacaaggcagtgaatgcatttcacaacaaacgcacgcttcctggggccccaagtccattgcaagtaaaatatgccgatggagagttggaaaggctggagcacaaacttttcatcggaatgctccccaaaaatgtaacagatgctgaaatgactgatttattttcacaatatggaaatatcaaagatttgcagattttgagaggttcacaacagacgagcaaaggtaaaaatttcttgtgggaccagttgattttcttatgacttcaaatgaacattacttttcttctacacttgcttgcacatttaact

SEQ ID NO: 46908 - DNA, 161 bp, Triticum aestivum
  Clone ID: PAT_TA_46908
gggggcccaaaacgccgccacgtttttacggtttacctggcgccggccgggaaactacagccgggtcctttttttgatgataggtttcaaggttgacaaaaacacaaagcatgtaacatagcttggtcgacacttggggcggggcggccgatcaggcgggg

SEQ ID NO: 46909 - DNA, 400 bp, Triticum aestivum
  unsure (1)..(400): unsure at all n locations
  Clone ID: PAT_TA_46909
cgtccgcccacgcgtccgcccacgcgtccgcggacgcgtgggccgccggccgccgccgttctgcctggtctgccccagccgcttcggtcaaccgcgacctgccgccgttccccggcccctcgccagtccgccttctcgcccgtcatttttggccccgtccgccgggctcctgccgccgtgccaggtgccacctggtaccaggactgccgccctgctaccgccggccaggcaccgacacccgaccccgaggaacgccgggtagagcacgctgctcgcctcctgccgccgtcccacctgatcgttgagcattgaagttaaattctacatccatccacgacctangcatggcagctgccaagccggaggtggccgccatggcgcagcgtcaggtgggttcggc

SEQ ID NO: 46910 - DNA, 246 bp, Triticum aestivum
  Clone ID: PAT_TA_46910
cgtgcgcgcactcccagcccacgctgcccacgaaaggggcggacgcgtcgcactaccagccgacgaagcccgcggcgccgccgtccggcgaggtggccactgtcctgacggtcgagggcgcactgctagcttccttccttatcaatgacgacccgacagcgcacctttgtttaccgataattgataaacgatatttgcatccttaatatatttacaattgtacattgtgtataatgtttttttata

SEQ ID NO: 46911 - DNA, 141 bp, Triticum aestivum
  Clone ID: PAT_TA_46911
cgtccgctagaactagtccgatcccgctcggctctcttcttgcaaaaagaaaacatccagcatcgcctacgatcccaatggcccacgtcctcgcgcgcgacccctaccctctagcgcccgcgcgaaacgacgttgggcaca

SEQ ID NO: 46912 - DNA, 415 bp, Triticum aestivum
  Clone ID: PAT_TA_46912
cgtccgattggattgcaatttatccagaatgtgacttgattttctcactgtgggccgggaggatatcacactgatgtgctatatatggattgtcgacaagtcaaagtgatatgcaatcttgaagaaggcaaaccgccatattttccaaatgtgccgctttatgtagaactacagtcgttgcacaagtgatgtcttattcgtgctatggagcagtgggcatggtatgtctgctttaatttggtcctcttttctctgatgtatgcatgtttttaagaagcaatggtggttcgctctgggggcactgcggctgattttttttggactagttattcaaagtttcgatgtagtttaaaacacaaaaaatttaaacccaagggaaaaaattaaaacagaaattccctacgcctgaagcttc

SEQ ID NO: 46913 - DNA, 415 bp, Triticum aestivum
  Clone ID: PAT_TA_46913
cgtccgcggacgcgtgggcggccccactaccaagtcctgctgctggagctcgccttcgtcccgacttcggccggatcaggtcccgccggatccgccctcgcctgacccggatctgccgctgccgctcatccatggcgccatggactctgactctgttggccgacccgttgctgccgtgcacaacttctgtcgtgccctgtgtgcgtgctctccgctgcctagcactgttgacttcaagaccgcggccgcacaacctagattgcaagctctcttcgaagcataggtggcgggcctcagtcactcacgtggccgaagactaataccattcgattaccagcacacgtggtctcagtgagtgactccagtccggcgaaccgagaaacgagtcttcgcgacatctcagcgaccgacatct

SEQ ID NO: 46914 - DNA, 284 bp, Triticum aestivum
  Clone ID: PAT_TA_46914
cgtccgtccaccaccctccagaccaaacttccccgtccaagcaaacaatcgaaaaaagggagggcgaatttcgcgcgccgacgacctccccccgccgccgtgttgacatcacatggcctcgtcgcccccggcgctcttgtccgactgccgcctccgcttctccgccgcctcgcctagcaccgtccgcagcctgcatcagcctcctcctcctcccccgccacagcagcctcgactcgtcgtcgtcctctgctaggtctctcgccagccgcgctttaacccccccc

SEQ ID NO: 46915 - DNA, 407 bp, Triticum aestivum
  Clone ID: PAT_TA_46915
cgtccgctcgacctctccacccagctcagcctcgccgtcgccagggagcggggcagcctgctccaccactccggccggcgaccgcgcggcatcctgcagcgaggtctgaattggtcattatggtgaggaaaagtgcagagaaaagttatggtcgtatggctgcatgcacatcaagtcctgaaccctcagaaaataacccaaggcagaatttctgtttaggagatataacatgggttaagcatgatggctcctcatggtggccagcccaggtcattgatgaagcatgtgccagtagcaaggccaagaagaagaccagccatgacgctctggttcgactgtatggcacatgcctagacttgtatgttgacccttggaagtctaacatggaattcgaaatgtttctgaag

SEQ ID NO: 46916 - DNA, 99 bp, Triticum aestivum
  Clone ID: PAT_TA_46916
accggacggaatcccggtcgaccacgcgtgcggatgatgacattgctaccagttacggaatggtgaatatatatcacacacatagaatccctttcaaaa

SEQ ID NO: 46917 - DNA, 490 bp, Triticum aestivum
  Clone ID: PAT_TA_46917
cgtccgcccacgcgtccgtgttcatatgcaaaagcatagtatatcctctgttcatgaaatgaatatgcaaaatttccaatcattgtgtcatgaaatgaatatgcaagagtactagattatcaaacattgttttgacataaactgatcctactgtgcataatggagtactccagatcatgagctttgttagcatacatttaaatattcacactagatcatgagcacttcattactcttggagcagttttgttgatgtcaaattcgtgcaaacaattcaagcagtatttctgtcaatgtagctactcatggagtaaattgtaatattggtgataattgctgtcaattaaatttcctggagtaccttgtctttgtaatcttcctacagcagcatgaaccaagcctctctcataggaacaggaacctgttgatttctctgctgtcaattctctgtgtctttgtaatcttcttgctgtcaattttctctcttctc

SEQ ID NO: 46918 - DNA, 437 bp, Triticum aestivum
  Clone ID: PAT_TA_46918
cgtccgcaagggccctacccttcttgaggctcttgaccagatcaacgagcccaagaggccctcagacaagcccctccgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggcaacggctacgccccagtgttggactgccacaccttcc

SEQ ID NO: 46919 - DNA, 497 bp, Triticum aestivum
  Clone ID: PAT_TA_46919
cgtccgcccacgcgtccgcggacgcgtgggcggacgcgtgggcggcgaagcccacgccccgtgcctagcttggaccatccagaaggcaaccaacgggagcgagacgaggaacgtcttctccggcccggcgttccaccgcttgtatgggcagctttcttccccaacaccggtcgccgcgctcagccgccgggttctccttccttgtttgccatgggtttctttgcaagtcttgtagtgttcatgctgctgatagccccttccagacaacaagcattggatcagccatcgtatgcaagaacgttcgaactggaaacaaccaattacattgaggtgcctatttggttggaccaaacggcagacctcacaagagcatcacaaatagtttttcacccggtattaccgccacaacaacttcacctgccgccacatgcatggatcttccagcttctaaggggccttccactacctggaggaaatggtcatgaagccatcgcgat

SEQ ID NO: 46920 - DNA, 418 bp, Triticum aestivum
  unsure (1)..(418): unsure at all n locations
  Clone ID: PAT_TA_46920
cgtccggcgccgtctgcaccatgcacgccaactgctgcgtcggcctccgccgcaagatcgccgacctcaccctcatcctccacgactggaggaatttcatgtctctcagggccccggacaagcgctccgcctcatggagcgcgccacggaactgcagcctggataaagtggaggagtaggacacgctgaggaccatttgttactagacatgaggtgattagccgctgactgaggagacatggaggtgtgtaaagattgtgttctgacaatatcggtgctagcttgtttgcaccgtagcccatatattcacatacactcactcactangtggcagttgccaacctagctagtgaccctgctcaaatggattgattgcaaccgaatgtaatcaagcgctaatggaactgtttccgattcc

SEQ ID NO: 46921 - DNA, 100 bp, Triticum aestivum
  Clone ID: PAT_TA_46921
cgtccgctcgtttacaaatggtatgatactaagcggctgtgttatggcgcgctcatgtgcgcttgaattgctgtgaggtcacatcactaattgctacgtg

SEQ ID NO: 46922 - DNA, 383 bp, Triticum aestivum
  Clone ID: PAT_TA_46922
cgtccgcggacgcgtgggcggtacatctacaaccgtgtgattttggaaaatcccactgttcgtgctagtgctgtcagtacattggcaaagtttggtgccttagtcgatgaattgaagcctcggatatttgttctcctgcgccggtgcctgtttgacactgatgatgaggtccgcgaccgtgctacactttacctccaaactctgaatggtgaaagtggttgtaggtaactctgagaaggacgtgaaggaatttctatttggatcctttgatgtgcctcttgccaacttggaagcaagtctaagaacctatgaaccatctgaggagccctttgatatttccttggtgtcaagagaagccagatcacagccacttcacgaataaa

SEQ ID NO: 46923 - DNA, 180 bp, Triticum aestivum
  unsure (1)..(180): unsure at all n locations
  Clone ID: PAT_TA_46923
ctcgtgagagcacacaacgggaggagggatcgtgagacggagagcacagatggggggaggcctgacgtaatacttggactatctgncaccagcanaccancaacaagcgctggaggttatgacgaaaaaaataagggacttttacaaaccagctatttttgcgatgtcaaatcctactaa

SEQ ID NO: 46924 - DNA, 551 bp, Triticum aestivum
  Clone ID: PAT_TA_46924
cgtccgcccacgcgtccgaaactactgaacaaacatggttcattagaaaacctacttaatacagctgcagttagaacggtaggcaaggagtatgcccaggatgttctagtcaagcatgcagattacttgcggaaaaactatgaagttctcagcttgaagagggatgtaaatgttcagcttgatgacagatggttatcagcgagggacacttgtaatgacaccagtgtgttatctgacttcattcttaaattcagcaaaggatagaagctaaatggcaggtttcagagctggaacgagcagagaccgtgtctaaccaacccacgctgctttcatctcgtcgaacgagaaggtgatgctggctacaagatgcggagatgtggtccaggagcaagccagtactagtacgtgtgcagcgtcacagtgacccatcgtctcacccgaagacgggcaccggacatgctatctcagctttttgtcatgtagtacatatcttaaggagccacaaagatcaattcaagagggagagcattgaggcagagactgatctgact

SEQ ID NO: 46925 - DNA, 548 bp, Triticum aestivum
  Clone ID: PAT_TA_46925
cgtacgcccacgcgtccgcccacgcgtccggcgcgcgaggactgccgcctccgcccaggcgcttcgccggcgccgtcagggcctccgaggactttgtgcactcgctgggcatccagaagaggaggctgcagaagcacaaaggtgctgtcaacaccataagcttcaacagtagcgggagcttgctcctgtctgcctcggacgatgatttctctctgaactccaacaatggcgctcgcggtgccacctgacatgttcagtctcatcatgcctggctacttgacaaggagaagaaggagcacgcccaggagaagaaggagcaagctaaggagaaaaacaacgagcaggagaagaggggagcaagcccaacttaaactattgttgtttatgttgttacacgcttgttgatccgtgagactccacggctgctccgcatcgtccacacataggacaagggcgtcatggccaaccaaggcgcatggtgctcgcaaacgacgagcagaggttgttgacatcggcacggagggagaggacgggcacggacggaggac

SEQ ID NO: 46926 - DNA, 395 bp, Triticum aestivum
  Clone ID: PAT_TA_46926
cgtccggcagcacccctgcccttctgctcctgctggcgaccgcaaccctctggcggcagcaacaccgctctcgtgtgctggccttgctgtctcatctcctctctctctcatgtttgggtatgatgttagcgttatgtgtgtgtggatggatatgatgctaccatggtgtgtgtaaaaatctatttttggtttatttctctttggagtattgctgttggagatgagcttaagaggcgaaagagtaaagatctggtaagctgtttgtattgcttcaggagaatcttttatcactgtttttgggactgtatttatgtcaaagaggcatgtagggagctggaacaaatttgttacttctcatggccacttttttgaacatgattattgagcttgacaaa

SEQ ID NO: 46927 - DNA, 211 bp, Triticum aestivum
  Clone ID: PAT_TA_46927
cgtccgctagctagtacacgtgttcctccatctatccatctatccaagtcgccggaaactagctagctaatggcggctggaggtgacgactatggcgatgacctgggccggcggttcgccaaccggtacacggactcgagggcgaacaaccgctcgccgccgacccgtgaggagtagtacagatatctcgatgacagccagacgcatgtgt

SEQ ID NO: 46928 - DNA, 337 bp, Triticum aestivum
  Clone ID: PAT_TA_46928
cgtccgcccacgcgtacacctgtctcctcccttagctgggtgggcaggttggctgtaacgatactctctgtcctctcttctatcggacggccatggcgacgacgatggagaggaaggagggcgcggagaagatggaggagggggaggacaaccactcgccgacgacccgcgaggagtgagacagatatctcgatgacagccagacgcatgcgtgcacccggcttgctgctcaacactacaacagaaatgatggcgttgacctcatggagaacactccgggcgacagccacgcttactgctgccggatctgcttccacctcaacttcaagggctatgc

SEQ ID NO: 46929 - DNA, 206 bp, Triticum aestivum
  Clone ID: PAT_TA_46929
cgtccgtagtctcccaaaacccaacactgtcggcggcgatggctgactcggcagcggctgctgcggcggcggcggggcaaccggcgacagtgggccaagccgtgatcccgctcgtcaataggctgcaagacatcatggcgcggctggacggtgacgccgacgccggcgtggagctgccacaagttgcggcgatcggcgggcacagc

SEQ ID NO: 46930 - DNA, 280 bp, Triticum aestivum
  unsure (1)..(280): unsure at all n locations
  Clone ID: PAT_TA_46930
cgtncgnacactcgtacgaaacaccactgaatgtattctagggcgtatctgcttattctgttggtgatgcgtaagagatcttgccaacaaacattacctgtgtaattaatgagatgtttgaactaacagaccacgttgagaagaatgtcagcatcgacgccactcacggagtattatcgctactcatgtgaagatcttagcattgcaagatggcgactgagaagaaaataatccttcttactggcaaagttggcttgaggctgcttgcaatatgcattct

SEQ ID NO: 46931 - DNA, 356 bp, Triticum aestivum
  Clone ID: PAT_TA_46931
cgtccggtcacccgtgccgtgccatagcgcttattccttatctgcctcccctaccagccgtctatgaaggccacgaccatccagtctactattcacaaatgcagagccagcccactgacatatacgcggaaaatcttctacaacagatcgatgcgaacgccatctagtccttctacataagatgcacatctttgcgaagacgctcactggcaagaccataacccttgaggctgagtgctcagacactatccacaacgtgaaggctaagatccatgacacggagggcatgccttcaaaccagcagcgactgatcttcgctggcaagcagctctaggatggccgcaccctggctgact

SEQ ID NO: 46932 - DNA, 305 bp, Triticum aestivum
  Clone ID: PAT_TA_46932
cgtccggctgcatagccaacctaatgctggaagctccaaaatttgtgcaggagttccatgtcctgcaaattgcaggaccggcaatcatgcaagcgatatatcccatcaggctccctgtatatgtgataaaacggccaatggacacaatacttttgagtgtgtagacgactcatgcacgcacagaagttcgatagttgccaaaatcatctgccattgtcgaaattcctgctcttcatctagggagtttctacctagttttggccaacatgatcaatcaatgttagaaaaatcaatacatcgatgct

SEQ ID NO: 46933 - DNA, 274 bp, Triticum aestivum
  Clone ID: PAT_TA_46933
aaatggccacaaaccaaatttaatttttgggcctaaaaacattaggacatttgtttccgttttacccaaaaggaaaatttttttttaaaaaaaaataaaaaaaaaaatttgcagtaaataagggaacatttttgcttatgccgtgcccgtaccgcacccctaacaaaatttacttgccaataatgccccgttttctttaacccacggtgcaaaagcacccttagcgttttgtttttagcaggaaacaaaacaaaacacattttttttgaaaaat

SEQ ID NO: 46934 - DNA, 276 bp, Triticum aestivum
  Clone ID: PAT_TA_46934
cgtccgaatacgcaacgccgcttctcccgcgctgctcattgacttctcgccctcgcctacttctgtgcggtgggcgaccgcttcatacaccaatgaaaatttctgacttgcttgctgactgccgccaatgcaagattgtggagatatggtcccttacaggtggctgtgattggagccaacaatgggaaaattgccctcaagcgccctgacaatgaagtcgaagctgaaaagattaccaagtctacgattgattcctggaacaccgtcacactggca

SEQ ID NO: 46935 - DNA, 107 bp, Triticum aestivum
  Clone ID: PAT_TA_46935
cgtccgaaacacgaaaccccaaatcgacggccgtcgtcgacctcattcggcgctcgccggcaacacgcgcgctggtttcgacggccctgtgctcccgactacccgac

SEQ ID NO: 46936 - DNA, 248 bp, Triticum aestivum
  Clone ID: PAT_TA_46936
cgtccgaaacacgaaacaacaaaatgatagtcagcgatgccctgcttccatattcgcccccaacattcactatggggtcgtcggccctctactcttgactagtttactacaaacccgactactcactcctcgggccggaaccgacattgattaacccccccaacaccaataccttgtcgatctcaatatttactcctgctccccgacgtccagacccacctgcgtgctacaaaatatttctctaaacc

SEQ ID NO: 46937 - DNA, 321 bp, Triticum aestivum
  Clone ID: PAT_TA_46937
cgtccgcccacgcgtacgcccatgcgtacgcccacgcgtacggccaaggtcttctttcttctaattttcaagccttctaaccttgttgggttggacccaccaggcactcgagctggggtccatcctatccaagaagattattctaacaccggagcaccccattggcttgggccccaaggtgtctcccgtgggcggcgttgccgttctctcctcgatctcacaagggaggcggagggggatggggattgggagggctaaaggccatcgggtggatcctcttcgccggcgtctccttccgtctgctctgctccttcttttcct

SEQ ID NO: 46938 - DNA, 443 bp, Triticum aestivum
  Clone ID: PAT_TA_46938
cgtccgcccacgcgtccgcccacgcgtccgcccacgcgtccgggcgaagacgggaagagagtcaggggttgaggagattgggattgagattgcgatggcgagcgggcggttcatggaggagatgatgagggagcacgagcagagcctgctagaggcgacgtgcggcggcctgttcgaccacatcgaggacctgctcgacttccccaaggaggactcggcggaggacgtgctgctcctcgacgcgccggtgcctgacagccccctcgccgcgcgcgtgctcgccggcggcgcgcccccgccggcgccggcctcgctggagcagcaacagcagcaggcgtcgctcatggtgcccccgcccccgcccgccggggaccactccgcggcctttctcggcgcccttggagacacccacattggcacgtgcgacgagctggacatggaca

SEQ ID NO: 46939 - DNA, 179 bp, Triticum aestivum
  Clone ID: PAT_TA_46939
cgtccgcccaagcgtccatgctgccgtacaaccatgccatcggccacatatgcttacactccctgcgcatgccgaggttgacctaaacaatcctatacccatcgggctgttaggggacgtcatctctgaccagctcactgcgactcgactcctcacttatcgtgtacgtggcctagacc

SEQ ID NO: 46940 - DNA, 325 bp, Triticum aestivum
  Clone ID: PAT_TA_46940
gaagggccccaaaccaaatttaatttttgggcctaaaaacattaggacatttgttgccgttttacccaaaaagaaaatttttttttaaaaaaaaatgaaaaaaaaaatttgcagtgaataaggaaacatttgtgcttattccgtgcccgtaccgaacccctaacaaaatttacatcccaatgatcccccgttttcttttacccccggtgcaaaaccaccctttggttgtttttttttatcataaaacaaaacaaaacacattttttttgaaaaatccccccacttcagtttaggttttagggggcgcataataaacccttttttt

SEQ ID NO: 46941 - DNA, 466 bp, Triticum aestivum
  unsure (1)..(466): unsure at all n locations
  Clone ID: PAT_TA_46941
cgtccgcggacgcgtgggattcaacccaaacgaataccggacggggattaaattgccgaaaggacgaggcaaggatggctagggcggtgcccatcctccccgtgtccaaaccgtttcctctccctgtaatcgccccggcgtcacgcccacgggctgggccccttcacctgcatcgccgacgcctgcttccactctcgccgtcgtcgtcatgcaacaccagcaccagcgcacttttctactcctcgtcgccggacttgctgcgggacgacgagctggaccaccnagaggagcccccgcccgctttggaggccgacttgcggtcccgccgcatcgcgctcttgggcgagccctcccacttcgactacggntacggctacaagaaccgcttgcaaaacttcatcaagtacctccgggagacgggcgacgaggtcatcgtcatgaccacccacgaaggcgtgcccgacga

SEQ ID NO: 46942 - DNA, 145 bp, Triticum aestivum
  Clone ID: PAT_TA_46942
cgtccgctagaacacgagggagaaaattctggttgcaccgcgtaccatacgtagttaaatctcgcaaggtgacggaaacgctggtacgcgcgttcgtgcgctccttccttggattcgcacgcgggtagtgagcgatggcggacgc

SEQ ID NO: 46943 - DNA, 435 bp, Triticum aestivum
  Clone ID: PAT_TA_46943
cgtccggcagatcaaagcttagaaattctctttggagctgtgtatattcatgaatttacagtgagacattgggcgacactaatgtcaatttacaatctcaaatccacctaacgctattgcccatttttttacttatatggatctatagcccgaataataactggcagcctatgagttttctaaaaccactgcacgaagacaccaatctaacttacgggaggctaaccaacatctatacgctcactggttacaaatcatatttggttggaccgacaacacacaaaagcgaatgcgacgtaagtacagaagacagacgaggcgtcatccggttccactctatacagctctacgtcctaccggttctctacccttacaaggacgacgcgatacttaacttttcgcgccactttagctccatgccgaacccgatgagcg

SEQ ID NO: 46944 - DNA, 307 bp, Triticum aestivum
  Clone ID: PAT_TA_46944
cgtgcgcggacgcgtggggtccccccagcccacaccttccaaccaagcaccaagctccaccgccgacgaagcagggatggcacccaaggcggagaagaagccggcgccggacaagaccccggcggggaagaagcccgcggcggagaagaggcccgcggccggtaagacagtgttcaatgagggcggcggcgacaagaaggggaagaacacggcctcgtggagcgtggtgacctacaccatctacattttcaatgtgctcaagcaggagcacttggacatgggtttattctccgcgcccccccccccc

SEQ ID NO: 46945 - DNA, 458 bp, Triticum aestivum
  Clone ID: PAT_TA_46945
cgtccgcccacgcgtccgatgtattcacataagaacaaagatcctcttatcatggaggttgttgatgatctgcggacctgtgacgtctctcctaatacaacaatgaatgtgttgacccattttcatggcaactatgagatcatgccaatgaatgatcgtgacatgcgaaatagaagagcagccaatgtacttaagaagcgagctgatgatgtaaaaaaacttagggccttcttcaatgagttcagagcacataacagtaaattctattatgatgtagaggatgactctgagggtgttacgaagaatatattctggagtcatgctagctgccaagcaaactatgctgagtttggtgatgtggttacttttgatacaacatataagtgtaatttttacaaaatgccgttggcgatgtttgttgggagcaaccaccacttgcaaaatgtcatttttgggtt

SEQ ID NO: 46946 - DNA, 427 bp, Triticum aestivum
  Clone ID: PAT_TA_46946
cgtccgcggacgcgtgggcgaccaccataattcccagcacccacggctgatcgtcgaggccagccgagtggtcgtcgtcacatcgaacgaacgctactcaaagaccaggccaaccacggaaggtcgtgcaagcgcaaactatggagagcacaggggtagcgagacggacgtcgacggtgcaggagctcgccagcgccctcggcaaaccagacgtgccggcccagtacgtttcacgcggacaccacgaaaacgaccagcagcccgccgcggtgccggtccctgtcatcgacatcgggcgacttttcaaccatgacggcgccgacgcagctgacgacgaggcggtgaagcttcggcaggcgctcgagtcgtggggcctcttactggtgactaaccacggcgtggacacctcggtgatggacggtatgat

SEQ ID NO: 46947 - DNA, 430 bp, Triticum aestivum
  Clone ID: PAT_TA_46947
cgtccgctgacgtgtgggcggacgcgtggatcaccatagggaatcatggccaaatgctacttcgactgggctgccctacaccatcttcatgcatcgagaagatcgaagcccaacacctgcgtctgcacgatcaagcggcagctagcgttcttcgtcctgcactgctcccgctcctgcgcttcccccgatcttgagcccaagaatttgcccggtgagctacatgttctttacgctccggcgtcgcccgtcaaggcggagccggtgcatacgcttccggatgctgagaagctcggcatctacaacaagctcatacggggcctctgcagcgaccggcagaccgagacgctcgtcttggagtgctactggagggcgctggagcagaccgagttccggacgcacaagaagacgatgaatgccctcaccgtgcaga

SEQ ID NO: 46948 - DNA, 472 bp, Triticum aestivum
  Clone ID: PAT_TA_46948
cgtccgcccaccggcgcggtcctacagcagagccttgggactcaacggactgattggagcgtccgccgtggactgtgccgcctcgccaccgccgacgaggagacgttgaggtgatggctcgtgggagacagctcctcccacgtggtcaaagggaccttccctcagacaggcctgcgcacacccgcagaacaagacccatcgagatccgtgaagttacagctgatgggatcgtcatggcctctgaagtgccattctatgatgtcttgcctaaggcccgcaccaagcaccagctgaagtggcgtcgtcgtatacagaagctgggcacctatggcaacgcaacaattgtctatcctctggcagcaatcgaacaggagattcttaatgcaatgggagcattggccgttcagcagtttgaggactgaagatcggaacccacattttttgcttacgtgatggtactctcattttgctc

SEQ ID NO: 46949 - DNA, 334 bp, Triticum aestivum
  unsure (1)..(334): unsure at all n locations
  Clone ID: PAT_TA_46949
cgtccgggccggtgcggcgtcggttgccaagaagacggcctctgcggctgcggctgcatcggccaagaaagctgtgaagaatgaggggaaggaggcgggcgcggcgtcngcgaagagagcttccatgtcggccgaagagcangagttggagacgaggaagaagaagcgggatgttgctgccatgaaagagaagctggcggacctggaggctctggaggcccagcaggaagaagaagaggagggcgagagggccagcgacgaggagggcgggagcgaagagactgagggaggggagccggagtgcancgagtcgctcgacatggagcgcgactcg

SEQ ID NO: 46950 - DNA, 389 bp, Triticum aestivum
  Clone ID: PAT_TA_46950
cgtccggaggaagacgaagggagtagctacagagactggatggagtcctacgtctgcaaagggctcccgcgatgtggctaatactcgctctatgataagcactctcagagaatggaggcgtttgataagacgattacacaaatctttaaagactcagggtcattcaacatctgaaaaaagccgcctagatcagcatcaaaatttgcatcaaccttgcgcacactatcatacaaaaagagggatgagcttgacgaggactgtgagaatcttcaccaacagactaacgaggatgacccttaccaaatactggagactgcttatgatgcacacgcttatataaactacgaggctattcatggtacctacatgcacctgaggctgatactggc

SEQ ID NO: 46951 - DNA, 433 bp, Triticum aestivum
  Clone ID: PAT_TA_46951
cgtccggccaaacgtgcggtagaattagggtagggatcctgagaaacagctaccaaaaccaatgccagatgcaaggacgcaaattaccgaacaattaaaccaatcgtgactcgcaatggataacactaccaatcacattaccggctgcatattggactgagtactatattgagtcctaaataaagatctttacgagggtacatttgagggcaacagtcgcggcaatatccgctgcaattgcagctataatagcggatatttaaaaaaatgtagttaataaactttgagccggatcttgcgccacgtctgacggtgagcatcaaggtaatcaaccatttactcgacatttcgctcgtaatcttacttgtacgcttaattggtccggcatcgttactttgatcaaatcttagaacacataagaaggcttaaatct

SEQ ID NO: 46952 - DNA, 330 bp, Triticum aestivum
  Clone ID: PAT_TA_46952
atgagtgttgagtcaaccttggtcttccggggcacacaacgggagcagcagcatttacgtgtcacatgcatgcatggctgtatgtcggcatggcagcaagtaaaaatgtttttactagcaagagcagcaggcgtgccttattagctaaatagtaagaggtcagcagtgacgtagttcacttgtttgacgtcacgactatgcgtagtatacgcggttgattacactatatatagggccgatgcccatcgctagaagcatggccatttcatttatatgcagccaaggttgaagtgttgctctaatacaaaataaggagaatgagctagtgca

SEQ ID NO: 46953 - DNA, 435 bp, Triticum aestivum
  Clone ID: PAT_TA_46953
cgtccgggctcctctcacaggccgactaagctgattgtaactgaatgtgtgtgtgtggccgtgaagtagactttatcttggtctgagtatcagttcccttcaatggtacaattttggatactattttcttctagatgtataggtttctgctggtcccattggctgctacattttagtgatacgatagctcaatgtcatgctcacctattgttctgtaaaaatgaaaaatcgacttgactgtattttgtacctgttttagtaattacatgatgtgattattttcattctagatatggaaatattctaaggattaagctttttgagatgttaaggtgtctgatgattaattagcctttgtaagatttatgcactcatgtcatacaacctagataattcttcttggatcttcataatttctaactggatatagatgta

SEQ ID NO: 46954 - DNA, 241 bp, Triticum aestivum
  Clone ID: PAT_TA_46954
cgtccgcccacgcgtccgcagcaatatccatgagttatttgtcaatgaaaaaaaagtaggccaagaagtaggctttatcttggtctgagtatcagttgcccttcaatggtacaagggcgggctactatttggttctacatttattactttttgttgggaccatttacttctacattagtggcgccgcaatagattaaagtgatgctcacttatagacctggaaatggaaaaaccatggggg

SEQ ID NO: 46955 - DNA, 418 bp, Triticum aestivum
  Clone ID: PAT_TA_46955
cgtccggctccacaatatctgcaagatgctgctcaagggacggtcgcaactccccctggtaaaagaggtgggggggtgtggtctctaaatgtgcatccacacaacacagttgctccaacttatatgaagaccttgagatggaatcaagggcacttcaaacttgaccccattcgtaatcttgctttcttaaaacctgttccaagtgatccctttgtgatgaagctctctcatcatgatatgaaaaccgactctataatgacaaaccacgctgcaggtcaacgttgcatagccagcacactaattccacataaacctgtgatgagtgtgcaaactagacttatgagacatgaagcgccgcaacataagatccatgctgaagacataagatccaccaaatggtttgctattccccacacac

SEQ ID NO: 46956 - DNA, 201 bp, Triticum aestivum
  unsure (1)..(201): unsure at all n locations
  Clone ID: PAT_TA_46956
cgtacgcggacgcgtgggttgaaaattttcagagaagattctgcaaggttttatgctgcggangttgtaagtggtctcgagtatcttcattgtcttggtattatataccgngatttgaaaccagaaaacattttgctccaagccgatgggcacattgtgctgactgattttgacctctcatttttgacttcttcgaaaccc

SEQ ID NO: 46957 - DNA, 337 bp, Triticum aestivum
  unsure (1)..(337): unsure at all n locations
  Clone ID: PAT_TA_46957
cgtccgggtggcacacgactacacaagtggcaatggcaccacgtccactgcgcttttaatcatggagcggtgaagatgtctgagcgatgcatcgaanaaggtactcatacaccgtttttgggtgatggctctgaagcttccaagaaagcaactattgaatgtctcgagacattcaacacagcagtcgttatcagcgatcaacctgactgagagatcttgaaacacgtagcaagatcaactcttacgacaaaactgtatgaatcattggctgatcatactcaccgatattgctgcgaatgccgtcctatgcattcgacagagtgatcaacctattgat

SEQ ID NO: 46958 - DNA, 446 bp, Triticum aestivum
  Clone ID: PAT_TA_46958
cgtccgctgatgttgacatgagggacaagctcactacattcatcctgaagaacccgccagaacagaagagggaggcaaagacaagatgctatgcgaagagctgagaaagagcggatgaaagaaggtgaagctgctgatgaggagatgaagaaactcaaaaaggatgcaaagaagaaaggtgcttcttccaaggatacaaagaaaaaggctgctgggggaggttcggatgaagaacatgcaacctcaccaactcacagtcaaggtgctgacattgcagctgctggagatgatgatgacgatgacgatgatgatgtgcagtggcagactgacacatcagcggaagctgcgagaaagcgcatggaggagcagctgagtgcagcaactgctgaaatggttatgcttgccaccgaggagacggagaagaagaagaaacaggccctgcacaa

SEQ ID NO: 46959 - DNA, 453 bp, Triticum aestivum
  Clone ID: PAT_TA_46959
cgtccgaggtaagaagctgccggagtctcgatacttgtttgctatatcatgctttcgaatgaacctactgcgggaagctgaagaaactctgtgtccagtcaatgaaccaaatgttgaggttccgagtggtgcgacaggacattaccttcttggactaatttacaggtacactgacagagtggcagctgcagccgagcaatttacacaagctttgactctagatcctcttttgtgggcggcatatgaggaaatgtgcatactatgagttgctgaagatgcaaatgaatgttttaccgaagcaactgctctacgtctccagcaggaacaaacatctacatgaaatctggagaagtcaaactttgtcaatgaaaatcgagttctatctcctaatgtatcagcaagccttgtggatatcagccctaagcacataaaacaattgcctgctaacaacat

SEQ ID NO: 46960 - DNA, 313 bp, Triticum aestivum
  Clone ID: PAT_TA_46960
ccgtccgcggacccttggggccgccgaagtttcttccctgccggaacaatgccgtcgaacaaaacgttccggttcaggcggaacttgcccaaaaagcaccgccagaaccgcccattcccttattggatccgcttgaggcccgacaccacaatcaggtaaaacgccaaccgcaggccttggcgccgaaccaagttcgaattttaagcgggggatgacaacaataaaacccgttgccgccaccggaagaagggtctagggaccttagggtttatgacgtttcggtgtttttgcaagctagcatgtgactccggga

SEQ ID NO: 46961 - DNA, 433 bp, Triticum aestivum
  Clone ID: PAT_TA_46961
cgtccggccaccatactccaaccccgtgctcttctccggccggcgcgccaccgccttccagcccgcccctcgtttcttccggccggcgggcgcaccccacttccactcgacgcatctgcttggctcgccgttggatccagcgggcagacgaggcggcgcgctccccgtcgtcgtagcagggtgagctggcgccccaccccgcccccagttcctctgctcgggcgtccagacgcaggagctgtccatctctcgtcggtcctcctcttctaccaccggctggttctctccaacagctcatcctagctgctgcttcatactgtacatggcacttagattgatacggagatgaagctacgaggagctcctggtgtgaagaggcaatgctctgctcatagtctcagccacgcgctgctgttcgtacgctcttgatctt

SEQ ID NO: 46962 - DNA, 434 bp, Triticum aestivum
  unsure (1)..(434): unsure at all n locations
  Clone ID: PAT_TA_46962
cgtccggatcaagatggtgcctttctttgggtctgcatttcgtctactacttctcccacccagcaggtgtgcttggtctgcagtgacgacctttgggccaacaacacatggacatttcacagataaactattgcatcaggctaaaacaacagagtttggtttgaggtgctctcacaagatatcagaaatttgcttggcgaagatctgggacactcgggtacattagacccacgaggcaacgcgacggaggccatgcactcaagtgggaggcggagctcgcctcccccaatgacgacggcttcgacctcaagtggaagtgggaggccaagtccaagccatgcgctgccggcaaggtcgaaaccaagtggggcgccgaggaagccaacaaggatgacaataatccggcaagaaagtgcgtncagatcaaggagatc

SEQ ID NO: 46963 - DNA, 192 bp, Triticum aestivum
  Clone ID: PAT_TA_46963
tgcgctcgcgcccctgctgctgctccctcgcccgcctccgctgccgtcccacgagatcaacccctccgccatggctggagaagctgatgggaaggcggtaccatgtgtcaagggatgccccctgcttctctcaatcatcccatcctttctttcatgtctcaaaagcatttttctgctcacccatggcacgac

SEQ ID NO: 46964 - DNA, 500 bp, Triticum aestivum
  Clone ID: PAT_TA_46964
cgtccgcagatacccatgaagtatcgttaaaatacattttgttgagttctttaaagaggaacctttgtatagaatttacaagattacaggttgcattgacaagtcgcatgttggttcgatggtttacatggataaggggaaatattagagtagatttcagcttagggcaaagaagatggcaagagtatgaaatgtgtttctttgcaacaactaaaactgacaatatggacccaatgttttcttagcatggtacagttttgaggatcggatttttatttcgctgacattttcttctctttgccctgtataaagtcaatttgagaaaaaccttgactggagttacaagatgtttaagcctggttgaaaggacatcttctgaatgaatcaaagtgagctcgaggccgagatataaaaggtttctcaagattctactcttggcccaaggatgaaagcatatgtaagcagggtggctatctttgacatcgacggagccctcccta

SEQ ID NO: 46965 - DNA, 481 bp, Triticum aestivum
  unsure (1)..(481): unsure at all n locations
  Clone ID: PAT_TA_46965
cgtccgccagatccaggcacctccacttccatcttctccccgtcctcttctccgtggttccccttgggggggtcggtggccgtggaaatcggtgcggtggctctgccccgccagatcgggctcaatctgctctcccttgccaccactctagtgtacagtggctgcaggcggcggattcgcccacaaggagatgacatgcccctggtcgccgtcggatttgcttcatctccccgtggcaaatctgcctttctatgcaagctaggatgtgcaagctaggatatgaagggatgtagtaattggtggaagaaaggagagatggaaacatggaaaggggtgctacacttgttcgttctgctgctggtccaaccagcangttctttcttcgttcttttctttgattgttactttatgttaacttgggtcatgttttttatcctcataatttcgtgaggtccttccctacttcgacctgagaatcttt

SEQ ID NO: 46966 - DNA, 449 bp, Triticum aestivum
  unsure (1)..(449): unsure at all n locations
  Clone ID: PAT_TA_46966
cgtgcgcgcatccagttaagtcgcctttcgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccgcaagctgcctttccagcgcctggtccgcgagatcgcgcaggacttcaagacggacctcangttccagagccacgccgtgctggccctccaggaagcggccgaggcgtacctggtggggctgttcgaggacaccaacctgtgcgccatccacgccaagcgcgtgaccatcatgccc

SEQ ID NO: 46967 - DNA, 351 bp, Triticum aestivum
  Clone ID: PAT_TA_46967
cgtgcgatgccacagtaggtcctgacgtggttagccctgcagttacaaaggctgagatgggcacttctggaaatgcttacgagaatgcgcggagaacagcgaactgctgaacaagatgcccttctggagccaagtaggttgcaagaagctgacgatgttgctgatatgcacacgtgttctgaggacattgatcaagacatgcattgtctgattggtagcaaaagacagcgaaccgctggacaagatgcccctctgcagccaagtaggttgcaagaagctgatgatgtagtcgatatgcacacgtgttctgtggacaatgatcaagacatgcatcgtctgattggtatacct

SEQ ID NO: 46968 - DNA, 361 bp, Triticum aestivum
  Clone ID: PAT_TA_46968
aaatctctagctttttttctatcatatccaatttttttttctctcccaaaccccaaaccccctttttgtcgtgacaactctaacctccccttaaatagaacatattaacttttttatattgcaacacaaatttaaatttccttctctgcacacctcatcttaagacatttatcaacacatgcattgtctgatttgtagcaaaaaacaacgaaccccttaacaaaattcccctttacaaccaaatttgtcccaccaatcttattttccaataaatctcacccttatttttttaccaaacatccactcattcatattattaatccccctacccttttgctccttacccaaaactcccctcttt

SEQ ID NO: 46969 - DNA, 303 bp, Triticum aestivum
  unsure (1)..(303): unsure at all n locations
  Clone ID: PAT_TA_46969
cgtccgcggacgcgtgggccggtcgctcgctcggtgcgccccgaccaaacccaacccaacctaggcacgggcaacccgacccaacgcacggacgcggcggcgagctctccgagtgcgagagcggccgtgggactgtccacaccgcgggagggaccgtgagctaactagtgctggcctgcccactctctcactagtcactccccacaccggcgccgcgccacctnccccctacttctcatatggtctcccgccgcgcgccccacacccaccggtagcgagcctgcccactccaacccacccatg

SEQ ID NO: 46970 - DNA, 393 bp, Triticum aestivum
  unsure (1)..(393): unsure at all n locations
  Clone ID: PAT_TA_46970
cgtgcgcgatcctcgatctgttctcaaccctccctccgtccgtcgcagctccagatttccttccccatggctccgatcaaaatccgcatgaatgggttccgccggatcggcaggcttggggccagggttgcgctccaaagccccgatgtcgagctcgtcgccgttaacgaccccttcattaccaccgactacatgacctacatgttcaagtgtgacactgtccacggacaggggaagcaccatgaagttaaggtgaaggactccaagacccttctcttcggtgagaaggaggttgcggtgtttggctgcaagaacccanaggagatcccatgggctgctgctggtgctgagtacgttgttgagtacaccggtgttttcactgacaaggacaag

SEQ ID NO: 46971 - DNA, 432 bp, Triticum aestivum
  unsure (1)..(432): unsure at all n locations
  Clone ID: PAT_TA_46971
cgtccgcccacgcgtccgatacgccacccacacttgctgatgctcctgggagcctgtccagacaggggctgcttggtgtacgagtacatggagaacggcagccttgcggatcgtctgcagcgcanaaagggcacaccgccgatcccatggtttgatcgcttccgcattgcctgggaaattgggtcagccctggtgttcctgcacagcacaaagcccagcccaatcatccaccgtgacctgaagcctgagaacgtcctcctcgaccgcaacctagtgagcaagattggcgacgtgggcctgtcgaccctgatgccacccaaggagactctgtcgaaccgcacggtgtacaagaagacgggcctggcgggcacactgttctacctggacccggagtaccagaggaccgggcaggtgtcggtgaagtcggacacg

SEQ ID NO: 46972 - DNA, 310 bp, Triticum aestivum
  unsure (1)..(310): unsure at all n locations
  Clone ID: PAT_TA_46972
cgtgcgcctccttcccctccggccttctagggcttctcgctcagatccggtagaaattctcggaactcctccgggaggcgactccttcgctatccggcggcgcggcgtgccctgtcggtcggtcggcgcttctaagccacgggaggtcgggagggaaagggattccgctgccttccaatccactccaccctgcccccccgtcccgagaaagctcccttttccccacccaccacctgctgcacctgcacctncatcactggcgaggggaggagagacccgccactctccgctagtagtattaacccctaat

SEQ ID NO: 46973 - DNA, 453 bp, Triticum aestivum
  Clone ID: PAT_TA_46973
cgtgcgctggacaccttcccacggggatcagttggacaaccatgacctctttgtgattatatcttgctgtccctctctaaccgatctcacactaagtttctgttcacaaatcgatgacaccggtcttggttatctatgctacagcgagaaattgacttccctcaggctgaactctgcaactgaaataacttcttgtggacttctctcggttgcagttggttgcaagagtctgtcttccctccaccttatcaactgtgagaaagtaggcagtaccgagtggctggagtatctaggcttgaatggatcattggaagaatttgtactcaagaattgcaatggaatcagcctgtatgacctcataatgcttggtccaggatggatgaagctacgcaggtttgaatttcgaatgggagggatatgggatgttcatgagggatatgatcatatggaaat

SEQ ID NO: 46974 - DNA, 372 bp, Triticum aestivum
  Clone ID: PAT_TA_46974
cgtccgcggacgcgtgggcggacgcgtgggcgcgacccaaaaacgctgaggaggctagcccacaacagggaggccgcaaggaagagcaggctgaggaagaacgcctatatccagcagctcgagtccagcatgatcaggctggctcagatcgagcaagaactccacagcgcaagagctcacggagtgctctaccccggcagcagcctcctcgccgagcaaggcatcgccggaaaaggtctcggcggcatcgacggcctcagctcagaggcggcgatgttcgacgtggagtactcgcggtggcaagaggagcacaaccggctgatgtacgacctgcgggcagcgctgcaacaacacctgccggaaggggagctg

SEQ ID NO: 46975 - DNA, 392 bp, Triticum aestivum
  Clone ID: PAT_TA_46975
cgtccgggtatacattgaggagatcattacattgttgatttcactaaaaaggctcaacctaaaacttgcttaattgctaaatcttctaaaggcgtggttgtggcatagaaggctaggccatgtgggcatgcgaaaccttgacaaactcattaaaggaaatcatatccttggcgttaacgatgtcatatttgacaaggatagacattgtagtgcttgtcaagcatggaaacaagttggaggaagtcatcgcgctaagaacatcatgaccacaagaagaccactcgagctacttcacatggatctctttggtcgaaatgcctacaagagtctcggtggtaactatttggctgatcatagttgattattttcaagattacgtggtgtctttttga

SEQ ID NO: 46976 - DNA, 120 bp, Triticum aestivum
  Clone ID: PAT_TA_46976
cgtccgcggactcgtggggcgggccaccttttttacatttactgggagctctgcgggcgggatcctcgccatgctccacgagcgcgcggaggagctcaagctgcacgcactcgccagcct

SEQ ID NO: 46977 - DNA, 270 bp, Triticum aestivum
  Clone ID: PAT_TA_46977
taggggctccacgcttacatacaccaaccttccacaccctagcttgcgggtggggagatctaatataaagtcactgaaattcaattcacaacccggcgacttacaaaaccctgactggaaaaaccttaacgttacccaactaaatccccttttagcaaattccctttttaccaaatagcctaataccgaacagccttccaaacatctccctacccaacatttgcacagcctcaatccctaatgggacgcatcatgcaccgccgcattaat

SEQ ID NO: 46978 - DNA, 523 bp, Triticum aestivum
  unsure (1)..(523): unsure at all n locations
  Clone ID: PAT_TA_46978
cgtccggtcggtagacgggtagcgggagcatatgcatatcccaggcacggcacgcatggcaggctgctgcagcgtccacttctatttttggggcatcagattctacctcatccggcgccccctcccaggtcgatggagattgctctaaccagacggattcccccactcgaatccaacaacccacatcaacaaaaaccctcgattccacctcgcaagggcagcacaggaatcatctgtctgcgctgcagctgcggccttcaggtctggggtgtgatctctctcccaagagatggggggcacggcgtcgaggctcgccgccccgataaagcaccggcgggtggagagggagctggacaacaaggtggcggaggcgctgcgggagcgggccaaggcgaggacgaagacgttccggtcggtgaacagcatcaccatgcgcctncctcgcttcaaggacggcctcaaggacatccgggacgtcttcgaccactacgacacggactncaacgggactatcgacaacgag

SEQ ID NO: 46979 - DNA, 273 bp, Triticum aestivum
  Clone ID: PAT_TA_46979
cgtgcggccatggacgcctgagatcctctgctacgacccacaacccggcggacttgccgacgtggtcgccctggtgagccgcaacctcgatggaggtacggcttgggatgcgagccgcatgcacccacccgacgctttcgtgcttacgctcctgctacgtcgttgtcacgcgaccatattgacttcctgccggatgcacgagcagcacgaagatgcggatcttcgacaagacctgatagggtgatgagggaagatataccatatatattcact

SEQ ID NO: 46980 - DNA, 274 bp, Triticum aestivum
  Clone ID: PAT_TA_46980
gtaccgtccgaattcccggttttttttttcgttctgggacgcgatttaactttttttttcttttttttttttttttttttttatttttttttttttttttttttcccacaaaaagggggggcccaaccaaacaaaggagcagccaactttgaggaaccaacaattgttattgctttataaaccggctttaaaaatttcacccccctgggcttcccaacccttttttccccttaaacaaagtccggcccttccggctttcctttttacccctacc

SEQ ID NO: 46981 - DNA, 240 bp, Triticum aestivum
  Clone ID: PAT_TA_46981
acgcgtacgcgtacgcatcctgttaggtcgactgttgcacataccatcgataaaggaaacctatatgcaacgatggatgacaaccattacaacgatgcactgaatggtagatatagctatgtccacgcatgtaagcagtaggttgccatggagctatcgagataatataagcactctagcacgagttgaataagcacgaacggcttcatggtcctgtacacagtcgtacggagggcacct

SEQ ID NO: 46982 - DNA, 345 bp, Triticum aestivum
  Clone ID: PAT_TA_46982
cgtgcgtgcactgatgcacccaactctcgccaagaagaggagaaacaagatgcccgcagcagcatacttcgccaacccagccgagatacgggtgaaaatcttggacggtaccatggtccacacacaaggatgagctgctctaagagtgaacccaggtttgaagtcctggaggagtcacagtgcgacatatcagaagagcgccgagacgctcgcgtggtgtttgagaagagcaccgaggcggaggccgtctacaccaatgcggagataccacgcatcttccgtcaatacaggcccacctgggccaccctggggctcaactacctgcaggcgatcacgcttgcacct

SEQ ID NO: 46983 - DNA, 210 bp, Triticum aestivum
  Clone ID: PAT_TA_46983
cgcaatgtcgacctacacgtacgcgtacgcgtcctgatacgcgtaactctacgcatacgtcgacacatacgaatctccttcaccgtgacacacacacataccaagcctgctggaacaataagaggatgcgatgatgagagccaccaacaaggacataatataccaattgctcactagccatgcaatctaccatgcctaatgcatcctatt

SEQ ID NO: 46984 - DNA, 229 bp, Triticum aestivum
  Clone ID: PAT_TA_46984
cgtccgcccacgcgtccggtaattacatgcctaagatcttttaattacaaaaccaatgtgtttgtgttgaatgttatgtttgatcacttgggcaaccaagttcttcttgatatatgtacaccaattttaaagcaaatgtagagtagctgaaacaaccattcaacacaaacacattggttttgtaattacatgcctaagatcttttaattttgcattaaattgtttgatt

SEQ ID NO: 46985 - DNA, 187 bp, Triticum aestivum
  unsure (1)..(187): unsure at all n locations
  Clone ID: PAT_TA_46985
cgtccgccctctgctcctcctgctgctagtgccggcggcggttgcgcagtactgttcggttggtcgccggggccggagggatgtggcggctgaagatcgcggagggcggngccgacccctggctgcccaccaagaacgcgcacgtcggccgccaggtctgggagttcgacgccgccgtcgacgaccc

SEQ ID NO: 46986 - DNA, 324 bp, Triticum aestivum
  Clone ID: PAT_TA_46986
cgattcggcaaccaaacccacctgttacttctaaccagaagctaaataaatccataaatccgccggaagagagaacccaccgaacaatcgcggcggcggcgagaggcaggcgaccggcggagcaatgccttactgcgaggtggatcggtaccaggccggcgacaagtgggagggcgtccgcctcttctaccgccgctacggccgcggcgccaccaaggtgctcctcgtcatcggtttggcggggacgcacgactcgtggggcccgcagatacgggggctgaccgggtccatggagccgggcgacggaggagacgagcccaccgt

SEQ ID NO: 46987 - DNA, 263 bp, Triticum aestivum
  Clone ID: PAT_TA_46987
cgtccggtcgcaactaacaaacaaacgctgctttcagaagaagggttcttccttctccacttcttctatcccgtcacacgagtcctgcgacggcgacgacgacgactacttgagggagaaggcaaacagtaaggcggactccataggttcgacggtgattatgttgctctgtgcggccgattacaagcgatcgagctgactctgcctgctgatggggcaggcagtccgcatactgatctatgccttcttcggcaacagcgaga

SEQ ID NO: 46988 - DNA, 332 bp, Triticum aestivum
  unsure (1)..(332): unsure at all n locations
  Clone ID: PAT_TA_46988
gacccacgcgtccgnccacgcgtccgcccacgcgtccgcagtcattgaaattaaacctttctcaaactgctcttttgtgtagtttatcagtctgtcttgtcattgtgctgatgctttttactgcagatttcaagttgtcacctgcttgtatgtttatctcttccacctttctgacctgaccttttccttgtgcaatacccatgtcttgcaccttttactataatcatctgccagtagctagccatgaatggtttgtttttaactatagggacagatttgtgtgctcctcagtttattggtcctttctggtattcttcattttttttcagcat

SEQ ID NO: 46989 - DNA, 398 bp, Triticum aestivum
  Clone ID: PAT_TA_46989
cgtccgctgaaagagtttgaaaatgcgagggttgatgatgttatgtctgaggcagctacagctgatggctctgatgatgactgtttcatgaaggaaggagaatcagaggcacctacagctgatggctctcatgaagactgtgtgatgatggagggagaatcagaggcggttatacctgaggcagctacagctgatggctctgatgatgttaagccaggggcagcaacatctgatggctctgatggaatcttatggaaaggaaaatcagaagcagttgcatctcgtgacagtttagaaatggtggtcggaggtggagacacatttgaaggaacaccttggagcacccgcaaaagtgatggaaggaacacagtatgtgttctttctgaagaggctacatt

SEQ ID NO: 46990 - DNA, 447 bp, Triticum aestivum
  Clone ID: PAT_TA_46990
cgtccgcccacgcgtacgatcacgtttagcttgacgccagggtcagcccgccaaccacgaatggaagaagactaaaaaccgactatccatggtgcgtggtgctcctcatgtactcattcctaccgaagacggccgaatgatgcttaccgcgccagtgctcatttcttgagggagaccatgcacgcccacgccgaagcttaccacggtgagctaccaccgaccgtgaaaactcattgtgtctccggtgcgcgtcattctggccattgacgagtacaacgccacctgctggaagcgcctcgactcgatcggtctggacaacacaaaggcgaaccgtcatgcgtgtacaacactgctggtcttcggacctggcctcggcaaccacatctacggatccatactctgttaggagacactctaccattccaccgtcaacggcaagaacatcgt

SEQ ID NO: 46991 - DNA, 506 bp, Triticum aestivum
  unsure (1)..(506): unsure at all n locations
  Clone ID: PAT_TA_46991
cgtccgcccacgcgttcgggtaccatgacctctcagacggaactgcaaaagccagcattgactggcggccctgaggtttccgaggaacctgtccagcccaagccagcaatggaaatttctcttgacctgcttgagaacatggatgacagcgatgtctcgacgcccatgggaccaggtgggaagcaaaagaggtcttttttcaaaagccccgttgatcgcacgagtgaaaggctggctctgtccgaggttaggcagaatatagacaccttccgctgcaaagcaaacctcctgattattcaggctgataggtgctggagggaagagggagccgaggttatgctggaactgtcaaactccaacgggtggtgcgtggctgtaagttacatgggtcaccagagctctctcngccttagagcagggttctatgggcaaccggacacgcatgcctactntggcagcaagatgatggagctgagtcctgcaatggactggcttgtcaagactga

SEQ ID NO: 46992 - DNA, 421 bp, Triticum aestivum
  unsure (1)..(421): unsure at all n locations
  Clone ID: PAT_TA_46992
ccgatccggtcgaccaccgtcggccgccaatcctgactgttctaacctcccctccgtccgtcgcagctccagatttccttccccatggctccgatcaagatcggatcaatggtttcgccggatcncaggcttgtggccagggttgcgctccagagccccgatgtcgagctcgtcgccgtcaacgaccccttcatcaccaccgactacatgacctacatgttcaagtatgacactgtccatggacagtggaagccccatgaagttaaggtgaaggactccaagacccttctcttcggccagaaggaggtagctgtgtttggctgcaggaaccctgaggagatcccatgggctgctgctggtgctgagtacgttgttgagtcccaccggtgttttcactgacaaggacaaggctgcagctcac

SEQ ID NO: 46993 - DNA, 428 bp, Triticum aestivum
  unsure (1)..(428): unsure at all n locations
  Clone ID: PAT_TA_46993
cgtccgcgatcattcccacttctaaaccctaaacccagccgccgccatggccgccgccgtccgactattcctgcgccgccgactcgccacggccaccgccacgcctccgaccccagcctccatcctcaacccttcctccccgaccaccccgctcacctcgcggcagaagacccgcctcgccatctacctcctcaagtgctncccagcgccgcccataccagagctatcatctgcgcgccgcgactctcccgagaccactcgacgtgtgtcttcctcgcactcaggtatcacgcccgatcctcagactacgtctttgtatcncacagcgaacgcatggctttgcaggcgctctccgagcattactcaggtcctcacgtctacgcctttactgatggcgacatcagcgtgattcaactccagcacggagc

SEQ ID NO: 46994 - DNA, 466 bp, Triticum aestivum
  Clone ID: PAT_TA_46994
cgtccgcccacgcgtccggctaactcgcttcagtcatagttcatcaagaatcctaatttggtaatggtagattgtagcttaattaagaagatttcctagaagtcatgttaggttctttagaaaaattaaagtttccaacccaattcagtgatttgtgcatgctaacagggattcatgcaagcatgctaacagagattcatgtcggcatgctaacagaggaacatgttttatgatgagaaccaatcaagttataggtgcatattatcagtggaaaaaattcctttattgaaacactatgaattattttttgatacaatgctcaaggttgggtgtatatttgtaaaattgatggttattcattcagcttagacaacagtatattgtcatatttttttaatcccttcgttgctatattctgccttacttctaataatgttcatctttttggggtactcatatattagtt

SEQ ID NO: 46995 - DNA, 461 bp, Triticum aestivum
  Clone ID: PAT_TA_46995
cgtccggtaaatttgaggggtttgggaaggagcacaattggatagctataagtggtttgtggcagctagagtattttcagaagttgctgcttcgccataacattgatgtaatgcacaatgagaaaaatgtatctgaggctttaccaaaaacatgccttgatattcctgagaaaactaaggatagcaacaaagcacgccttgatgttgctttgtattgtgatcgaccaaagctacacctgaacaagaattcaaggggtgtgtggaagaaacctagagcgaaatattgtgtcagcaaggaagatagaatgaccatccttaagtggtttaaagaagtgaagttttctgatgggtttgctgctaatttgagtaaaactgtcaacttgagtaaaaacaaattcattgggctgaaaagccatgaccaccacatcatcatggagcgcctccttgcagttgccctatga

SEQ ID NO: 46996 - DNA, 305 bp, Triticum aestivum
  unsure (1)..(305): unsure at all n locations
  Clone ID: PAT_TA_46996
cgtccgcccacgcgtccgactacacccacaccacctgctcctcgccgcctgcctcccgccgcctccccctctctcgcggatggcatccaccgcgccgccgccgccgccgccgtttccggacgcggtggtgatgtccgccttttctccgacgctgtggagctcacggcacacccctctccctgcctacaagacgccgttcgctccacctctctccacccagcctggtttgcctccgaccggcgggttcgtcgtcgtcacccgcgccttacctctccccgacgaggagatggngcatcggccacctt

SEQ ID NO: 46997 - DNA, 424 bp, Triticum aestivum
  Clone ID: PAT_TA_46997
cgtccgcggacgcgtgggtgatggttgtgaggactcgggatatgtgtcaagcgtcttgccaatgagatgagagtttagaagaagctgaaactgaaagaagatagatgctgggacaagttagggatcgaggtacaatcaatagagctctgaccaagacatgtagcatatggtttatagcgatcatagcggcatttacatagcccaattgttgtcccatttcagtttcttttaaagacatcatggaaaatacggaacacatgtgagatatgacaaagaaagatggatcgcatgcacatgaggatagacgcagtagagagagagagtgcccatgcagctgaaattaattgctgaatttcgtgacaaccttgtaccaatgagatgaacttatattggttttttttgctggccaaattaaggtttgcag

SEQ ID NO: 46998 - DNA, 376 bp, Triticum aestivum
  unsure (1)..(376): unsure at all n locations
  Clone ID: PAT_TA_46998
cgtccgcgcgcgtgtacgcctntctgtctcccaccctcctgctccctcgacgacgatagccatttcacccctctctctctctctcccccacagctctgctctatgtggaacagccttcgcggccgaccgagcgctgcacggcctgcggcgccgtgcgggaggcaggatgccggcgtggtggaaggggcagggcaggagcaagagcaaggcggcggcgccggcggnggacgccggcacaattccggccgggagggacggtgagaaggacaggaagaacaagaaggcgagcagcttcgacgaggcgctnattggcagggaaggccgcgggaagcagctgcaacagccggcgccggccgtcgggcacccgctgccgcgg

SEQ ID NO: 46999 - DNA, 395 bp, Triticum aestivum
  unsure (1)..(395): unsure at all n locations
  Clone ID: PAT_TA_46999
cgtccggagccgcacacgcacccgccgccgccgccatctcccttcgcaggcacgtctcttccttcactcgattcccttgatccccttctcttacgttgcctcctcccaatccttccccccttactcgcacggaggtggctgcaggagaggcgtggcaaaggaggctcgtgcagggggtggtggtggtggagtggggaantaagaaagagcatggaggcggcggcggcagctaggaagagcgtgtgcgtgaccggcacatgaggctttatcgcctcatggctcatcaagctgctcctatgcaagggccactaaatggtacggggcaccatgcgagatcccgcctgcggaggacggcgacgaggaccgggtggagatgtggatcgcttactttggat

SEQ ID NO: 47000 - DNA, 287 bp, Triticum aestivum
  unsure (1)..(287): unsure at all n locations
  Clone ID: PAT_TA_47000
cgtccgcccacgcgtccggcagcagctccagcttcccccaggagccaaaatattcgcgccaattgggaggcatgggcgccaacgggcacccgccgcccgccagcgccgccgcccagaacgggtcccactctagcggcggcggcggcggcggaggaggaggtggcggcgggggagggttntcnaaccctagctcggggtcggcgctggctccgacgaccggcctgtccggagggacccgagagcagcatctgacggctgtcaagatgcattagcccgatcgatcaaat

SEQ ID NO: 47001 - DNA, 193 bp, Triticum aestivum
  unsure (1)..(193): unsure at all n locations
  Clone ID: PAT_TA_47001
cgtccgcgccctctnttcttacaagatgtcgaagcgaggtcgcggaggttccgctggaaacaagtgccgcatgtcgctggctctgccagcggcagacactgtcaactgcgctgacaacactggtgccaagaacctgaaaatcattttcgtgaagggaatgaaggtgcgccataacacgcttccttctgcctgt

SEQ ID NO: 47002 - DNA, 505 bp, Triticum aestivum
  Clone ID: PAT_TA_47002
cgtccgttaaaatctaagtgcaggtctctcttctctggcgagtcattccaatcattccgttggggctctgcatcccatctgaatgggtacattacccatccagaatcagccatcagctctgctccggtagaacctgttgctcattccacgatcaaatattataacattttgctcactccatgatttgatggtacacattttgtagataccaacaaaagcagtgtggtagtccatcgctgaattgtattgtcctttgcttctgggtatagaactacatatcacatggacctctccctggaagcaagcaatcatctttgactcgtgaggtctaacttcccatttctcttagaattttagaaatggtaccatgcttacaagttaatgtaggagagttaatccgaactatacaaatgaagtcagagtttagttaaacttgttaaacatttttcatagataatggaatttggcctatgtactatatgttatcacgttttttaatgaatat

SEQ ID NO: 47003 - DNA, 188 bp, Triticum aestivum
  Clone ID: PAT_TA_47003
cgtccgaaaaaaacacaaaaggacaaggtttctgaagtcaggacgcctactgaagaaaaatgtgaaatgtttcctgtgtgccaaatggtacagtgaccgatccacgcgatccatctggaaggtggtacacctgttggcaaggttaaactgggggatcttgaaaagaaacctggtcttgactccgtgag

SEQ ID NO: 47004 - DNA, 450 bp, Triticum aestivum
  Clone ID: PAT_TA_47004
cgtccgcccacgcgtccgctagccgccagcgcccgcccgccgtcgatcccctcgcgctaccccgccgccgggcccctccttcttcaacccccggtcgtcgtgttgaaggtgtacgtcgccgccgccccgcccgtacgcctggccggtcctcgactcgtcgccgccccgcccctgctcctggccgtcctcaactcgccaccgccaccgtgctgaaggctaccaaacacagtctcagctcagcatgcatcagtacatacattgctaccaaacagctgcagttgcatgtatttagcatgtctagactaagcatgtctcaaaggggaacacctatgctagggtgggaatagctaccaaacacacccttagcagctggttaagcactgggaccgtccatgctttcaaaccagaaaaaccggtcgaaccgtccggttttggcaaaccaaaccggtg

SEQ ID NO: 47005 - DNA, 319 bp, Triticum aestivum
  Clone ID: PAT_TA_47005
cgtccgcgcccctcgagtcgtccctccaaatcatagcatccggccggatctatccgacgaccatttttggttcgattccggagaaggtccggggctccttgaagcgatggatcagcgggcgaggtatcctcccggcatcggcaacggccgcggcgggaatcctaactattacggccgtggcccgccgccgacgcagcagcatcagcatcagcagccgccgcagcagcagcagcaggcgcaggggcagcggcagtcgcagcactcgcagcaccacagccagcagcttcagcatcagcagtggcttcggcggaatcagacc

SEQ ID NO: 47006 - DNA, 310 bp, Triticum aestivum
  Clone ID: PAT_TA_47006
cgtccgctcgccccctccccttctccctattcgcgccgccgctcacatccctcccctcctcctccccttcgcggcgccacccggacgctcgagcccccgaccaaccatggcggcagcggctggagaggcccctcgggcgctgtcccagaaggagcaggacatacagatgatgctcgccgccgacgtccacctcggcaccaagaactgcgacttccagatggagcgctacgcctacaagcgccgctccgacggcatctacatcatcaatctgggcaagacatgggagaagctccaactcgcggcgagggtc

SEQ ID NO: 47007 - DNA, 406 bp, Triticum aestivum
  Clone ID: PAT_TA_47007
cgtccgcccacgcgtccggtccagcaagaagacaaactctcctgatgatagtaaagataattctgcacagaaaggaaggaagcctgacagagtaggggtcatctgttttgatatggaaggaacttacctaccaaatctcgaactgatttcttgccattgtgccccttgtaagggacaaaagtttttgttcaatgaatgggaaaggcacgctggctgcagaagtaaaaattggaaatctagtattaaaatgaaggaaacacttatgccatttggaaaatggatagatcaacatcaaccaagcgtgtgttccacatatccttcaaaacgctcctcccagaaactgaaaaaacagcagttacttgatttgttaaatgaaccttatgatcatgtacaagtgaaatggaca

SEQ ID NO: 47008 - DNA, 350 bp, Triticum aestivum
  unsure (1)..(350): unsure at all n locations
  Clone ID: PAT_TA_47008
gaccacgcgtgcgagcttatatgacgcatatgggccgccggcggcactgaagaaccagcacgcgaaaatccggcgtgtccgacgggcgagagatggagcggagccggcggcggccggaggagcagcgccggataggcagcgggcggcggcctgatcaccggcgacggcggagggccttctcgggggtggcctggcaggaaggaagggccggcgccctgngcgaggtgatacccgcgatctccctggaggatactatatctatcaaccataattggttcaatgcctacaaccttcatgggggggtgagtagacgtggatatgtcaagtttatttcacaggactaacataat

SEQ ID NO: 47009 - DNA, 268 bp, Triticum aestivum
  Clone ID: PAT_TA_47009
gcacgcgtacgcgaccgagttgatgaaccaaatagtggagaagacatgcggaaggcagcacacgatgaactgttatgcaacacagcaatgcatataaaggcttcagtactcaagaaggacgagataaataagcatctgcagaaagaagcaaatgtgcaggaggagatacaagaaactcattctgtggttaatagaattgaggaccctgaggcacatcaaattgacagtcacgcaacgaatacgatcccaatccacccggcagaaaact

SEQ ID NO: 47010 - DNA, 127 bp, Triticum aestivum
  Clone ID: PAT_TA_47010
cgtccgaaaaaaaatacaaatacgcgtgtggtgattccggaggctctgttgaaggatcagattaagaacaaaggcagtatatgggcgtacgggatggggggccatgttgggtcccaagatgctcccg

SEQ ID NO: 47011 - DNA, 368 bp, Triticum aestivum
  Clone ID: PAT_TA_47011
cgtccgaccacccttctgttcaaactaaagaagcaaagagatgaggagtgcattataaactgtctcccaggacaactcattgagcggatattttttaagcttacagagagcactttgttgaggtgcactggtgtttgcgagcaatgccacaaaatcatgcgaggtccacagtttgtcacatcacacgtgcagcatgcaccccattatgcgcttgtgctcttaccacacgagtaggtctcaggcgagctccatcctgctgatgctatactgattgatgaagactggtcgctgtcgacatatgcattgccagtgatcgggcctgatgagtccctctgtggatcattcaatgcgctattttgcttatacac

SEQ ID NO: 47012 - DNA, 390 bp, Triticum aestivum
  unsure (1)..(390): unsure at all n locations
  Clone ID: PAT_TA_47012
ccgtccgnattcccggtcgaccccgcgtccgctcactcgtccttaaacaactaccaatacacacttcttctcccctacactaccaactccataccggcccggcgtttccttaaacaatatcataaactctttcctctatcataaataacctatattatactacccccccatcacctactaataatatttttgagatgcccaattccaactttctattaacttctatacaaacgcatacacttttataattttctattaacctacttatatcgctatcctctacaacctttataaccttctatatatcaaaacgaacattaccttctttataatatcctctatattatcttttcttaattttaaaaaattatcatcacttattaccctata

SEQ ID NO: 47013 - DNA, 479 bp, Triticum aestivum
  Clone ID: PAT_TA_47013
cgtccgcccacgcgtccgcccacgcgtccgctttcctccctgccaccctttgacccctgtgcggctgcgccccgcccgccgccacccacccacctcactccactgcacgctcgtcactcttactgagaggagggcacagtgggcagccccgtcggtggtaggagtttgcgcgtgttgacgacagaggctggaaatgaagatgtcgtctcccgccgccctctgcgtcttcgtcctcctcgcctccctcctcgcggcggccagggccgaggacccctaccggttctacacctggaacgtcaccttcggcgacatctacccgctcggcgtcaagcagcaggggatcctgatcaacgggcagttcccggggccgcagatcgacgccgtcaccaacgacaacatcatcatcaacgtcttcaacaacctgcccgcaccatttctcctctcatggcaggggattcagcagaggaggagctcatggc

SEQ ID NO: 47014 - DNA, 486 bp, Triticum aestivum
  Clone ID: PAT_TA_47014
cgtccgcgcgcataactagctagccctgccactccgcccccccagccatacggccactcgctgtcactgagccggcagccgcagcgagcagcgagcggccatccgcgcgcgagagccaaagcggagcccgagaaaccaaccaggaactcactccccagtccccattaaggcgcacttcactccgctgcccaccagttgcaacagcgccacgcgagcttcgcacgccgtactcgctcgccgtcccccctccccggcgtctcccccgtaaatgccactgcccggacggtgattcttcgcagcttcgtaccaccggccatggcgacgacggcggctccggcggcggcgtacggcaccctcattgccttcctcctcgtggccggcgccgccgcggacgacggggcggcgctgctggaggtggagaagtcgttccgcaacgtcggcaacgtgctctacgactggtccggcgacgaccactgctcctggcgc

SEQ ID NO: 47015 - DNA, 489 bp, Triticum aestivum
  unsure (1)..(489): unsure at all n locations
  Clone ID: PAT_TA_47015
cgcgactgtgcttagtgcagtttgagtggggtagaagaccgggctcgacgacaagggcgccgtggtcttcccacccacatccggatggtacagctacgtggccggcatgtacggagagccgtgagcccttctgcaactaccatctggttctggctgcccaggatgccagaccggcgggcgcgtgggattggcctcgacacggcggtgcgagaagttgacggggagagaaggaggccggtgacgccgtcgcggggagaggtgtgcgggcggagctgtggcgtggaggagagatggcggggcaacgcccttgcggggagaggaagggtcgggcaacgccgtcgatgggaggggcgccatcgactggagtggctgtgagagggagagagtgagaggaactagccgctgtcctgtgcatcgaggataagagcatctncagccgcaccccaacaagccccccaaggcgaacttttcggccgccggcaccaaaaa

SEQ ID NO: 47016 - DNA, 446 bp, Triticum aestivum
  unsure (1)..(446): unsure at all n locations
  Clone ID: PAT_TA_47016
cgtccgcctccctcctcctgctgacccgacccgacctaccaacccgccttccccaccgcagcagctcggaatctcccctcgccgtccgcccgccccacggccgccgccgacgcccccgtcccgtgccgcctcctccaagcacccccggcccggcccctcacggcgcgtccccgccgtccccccctttcgctcgtcggggcgccgcgttcctgctgcctccgccccgtcagcggtccccggccgccggtttccgaggcttttgagggattatagccgcagaagaaacctggcgggtggtatgagcgccgaggcaggcaacgggaaggaggaagccaggaagacaggtttggagggcaccggactgccccttccaggtggctcccatggcagcgtgcgatgcgctggcagcgacccgcagttgagacagatgctngattccctcaaat

SEQ ID NO: 47017 - DNA, 418 bp, Triticum aestivum
  Clone ID: PAT_TA_47017
cgtccgcccacgcgtccgctcggttcccggtccggtcccgttccgttcgttagggtttagtagtagcggggaagaggaagggatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggtcgcaacatcaccgtcaacgaggcgcagtcccgtcgctccgtcggaggaggcggcagataattccgcggctactgtggtggttatagaggtcgaaaactcgcacatggcatatag

SEQ ID NO: 47018 - DNA, 484 bp, Triticum aestivum
  unsure (1)..(484): unsure at all n locations
  Clone ID: PAT_TA_47018
cgtccgggtctccaacaagtaaaaaaatgcatcgaaataggactggaatgtgttgagattgatcggctgaagagaccatccatagaaacaattcttgacaagctaaacggacgatgtgcatccataagaaactaaaatgccatgccagtttcatgccgaatggacnnngcatgaatnaccctaacatagtgaagctcaaggaggtcataagggaaaatgatatattatacttcataatggaatacatggagtgcaatctctaccaacttatgaaagacagagtcaagcctttcgcggagtcagatgttcgtaattggtgctttcagattttccaggctcttgcttatatgcaccagaggggatacttttatcgtgacctcaaaccagagaatttgctggttagcaaagatgtcctaaagctagcagactttggtttagcaagagaagtttcatctgcaccaccatacacaaaatatgtgtcaac

SEQ ID NO: 47019 - DNA, 503 bp, Triticum aestivum
  Clone ID: PAT_TA_47019
cgtccgtcctcctcctctggattgcggcgcgacggcggccgtgagcgagcggtgctcctactcctcctccacgccctcgcgcccagatccgctccccaatggcgcggaacccggcctccagcgtctacgtaggcaacttggatgagaaggtgcctgaaagagtcttgtatgagattcttattcaggctggtcatgtagtagacctgcacataccatgtgacaaagaaactgggcgtcccaaaggttttgcttttgctgagtatgagacagacgcaattgctcagtatgctgttagacttttttcaggacttgttaggcttaatggtaaaacacttaaatttgcgctttctggacaagacaagccctcatcaaatggcaataatccagtaatgcctaaactcaaccctataccattaccaaagcagcctcaagttgtgcattctagtgatacgctggtgtcgcataaaccagcatatcccgtggtaaatggtgggattccacat

SEQ ID NO: 47020 - DNA, 470 bp, Triticum aestivum
  Clone ID: PAT_TA_47020
cgtccgcggacgcgtgggcggacgcgtgggcggacgcgtgggttttttggaccaacagtcacagatacaagtagctaaatagctaaaacaagcataacaccatttttgcttacaaacaatcgttaagcaaatggagatcgatttaacaactaacaactaggggaatgtaggcaacataagaatatccttgaaacacaaccatgccttcacttccttgtcttcttcaatcttgggtgccagataacacctattgtaggcaagatcagcatatccttgaaacacaatcatgccttcatttcctcatcctcttcaatcttgggtgccagataaaacctaatgtagcccatctcgccaatcttgtactcaacaaccaccggcagttcagatgagaggctgatggtgacttggtccgacagtgggcttgccttggtgaaggaattcatgtacctcagagcaaaggtaagtgacac

SEQ ID NO: 47021 - DNA, 496 bp, Triticum aestivum
  Clone ID: PAT_TA_47021
cgtccgcatggcccgaagtttggtgggggatttgattgtcggtactgccccctaatcactagaggaggaggtgcaacccgctttagggagcaccttggaggtataccaggtgatgtgagggagtgccctaatgttccaagaaatattcgtgctgcaatgagggaatcccgggatgactcaatgcggaagaagagggaaaagaaaaatcgtagatttcgtttggaaagggatatcatggaagggttgtaccacggagaaggggtgataaatattgaagatgatgaggaagagatccaggccgcacttcgggagacactaagagacaagaatgtctcttgcgcagttgagaggaggcgtgggagtggcagtggtgttcgtgtgtgtcttgggaaacagagtatcacagcatactttgacaaggaattgtcgagcaacaaagtatcaatgcagccaaagatcagcactgcttttgaatgttgagtcaaaagatgtactt

SEQ ID NO: 47022 - DNA, 362 bp, Triticum aestivum
  Clone ID: PAT_TA_47022
cgtccgacgcaagatgatcaaatacgtaaggagccaagtctgcggcaactactacaggcctgaactgaccaatccggcccttgcacggctgagcgccatgtaccgaagacatcaggtatatacaggtcatggaatcaaccaagaagacacaggctgccgactaaggctgtaaactcattgagattgcttctcagcgcacatgttgccatgtttgtctcgacagatacgagtgataagctagaccctaggaggaactatgttacaaacacgccctagttagtaccctgacagagctagaaggatggcatgagtcgatctataattattgttgcgatttgcactggagaaaaaaaaatatagag

SEQ ID NO: 47023 - DNA, 409 bp, Triticum aestivum
  Clone ID: PAT_TA_47023
cgtccgcacttaagcaacatatatacaggacacgagtatcagggaggaagactaggaaacgttgatggccgtcggggagaggggtgaatctgctggggtggtgctcacccattgtgagtccctacatgctgctcgcccagatggctctcgccataaatgggctgaactacgactacttccccgaggaccgctggtccacgagcgaccttctcatcacgtccaaccccgtgtacaagaaggtgccctttctcattcacaacggcaggcccgtcttcgagtctctgctcatcctgtagtacctttacgactccgtctgccttgccggctaactgtaagtccattcttcccgcatacccttacatccgcactctcgtctcttcttggccaactatgttatcgacatgctgtt

SEQ ID NO: 47024 - DNA, 456 bp, Triticum aestivum
  Clone ID: PAT_TA_47024
tggtacgcctgcagtactcgtccgtgatcccgttcgaccccgcgtccgcccactttttcggggtctcgtgcgcggacacctagccttgatcgagcgattctccctatcacgtggggggatccttgatgaatagcacctacgctgaacgagaggaaatgggtttcacgttcaccaagctgttcagccgactgttctctaagaacgaaatgtggatcctgattttgggtatcgactcctccggaaagaccaccatcctttacaagttcaagttctgttagatcgttaccaccatccctaccattacctttcaatgtttaaactcttaagttcaagaacataatcttcactgtctggcatatcagttgatatttcaagatcaggccactgtggacgctttatttactgaacacacagtgtctcatcattgctgtggtcagccactattgggacctgttt

SEQ ID NO: 47025 - DNA, 498 bp, Triticum aestivum
  Clone ID: PAT_TA_47025
cgtccgcctcctcactctcgcgggcgacttgtggcggcggctggcgaacgagagcgtcgaaggcggcagaggagtctgcggaggttgttcaggaggtactatcgcaaggaatcaaggagttcacgttggcggagatcatagctgccaccaaaaacttcgcccatgacacaatgatgggttacggcagccatggaagggtgtacagggggaggcttcacgatggacgagaggtggccatcaaacgcatgtcagaaaacatacagctggaggacttccgcacggagcttgacgtcgtagcacagctacaacacaagcatatcatccacctccttggatggtgtgtgagcagtaagggcaagcgcctgctaacccggcgaacaaaggagttagaaaggctgatcgtgtacgagtacatggagaatggcacgctcttcgaccacctgcaccgaaatcaggccggctcctctatgccgtcaccggtggacatgtctttgaaga

SEQ ID NO: 47026 - DNA, 507 bp, Triticum aestivum
  unsure (1)..(507): unsure at all n locations
  Clone ID: PAT_TA_47026
cacgagatgccgcccgccgaggacgcctccgctgccgcccccccgcaggcgccgactccgcctcccgcccgtgggatggcggtcggctcgaggctgctgctgcagtcgccgccgcctgcgttcccgctcggctcgaggctgctgctgcagtcgccgccgcctgcgttcccgctcggctccaacgacgaccagctcgagcgcgctcgcgctcgcgccatggcccgcgcggcctccgtccgtcgacgctcccttgccgcatctctcgcgcccaagacctcgcatcccaacctcctcaaccgggacgaggtcatggacctattccataactgcatcaaactcgcctcggagaacaaaatcaaccagaagaatacgtgggagctggggctcatcgaccacctcagcgagatcantccatgccggggaggaggaggacgacgagaccaacttccagaaagctagctgcacgctagaggctggcgtcaagatctattctctgcgtgtggatcg

SEQ ID NO: 47027 - DNA, 319 bp, Triticum aestivum
  Clone ID: PAT_TA_47027
cgtccgctgacaccaggccggacacagtggggtgaatagccaagactttaactgctgccacgctcagcctggagggcgtgctatggatgatgaagcatgccaagtgtttctataacaccctgcatatgcaatgaccgagcgtggatcagtgtgggctatgggactctgaaggtgacagtcatgcataggcgtgatgctactgcttagcttggcggtggtctaatatcttaaactaggtcgcctccaagaaatttgctgagacgctgtggtactatgcaaaccgaggacatacgtgcacacatacacatgtggaactatg

SEQ ID NO: 47028 - DNA, 297 bp, Triticum aestivum
  Clone ID: PAT_TA_47028
ttttctttttttttctttttttgttgattttgggcccaatcaaacggaattcatatggctctggattattttctccccacctaacgcacaaggaacaaaccccttgggtcccgacacaactgatcagacctcccacagaaacaaaaaaaggggaaagcggcaagagagcggcaccctaattccaatttcttactcccacgggggcaccctcgtgcaatgatcagcgaaatcttgccaccgggagggcgcaacttataagccatttgcccatcaagaagggccaggccacgacagggt

SEQ ID NO: 47029 - DNA, 460 bp, Triticum aestivum
  Clone ID: PAT_TA_47029
cgtccgcggacgcgtgggctggtatataagcgaatacagaccgggtaacaatcatgcactcactgatatgctctgggagaaaaaataccttcataatctgttgccggagagatgaatgtttctactagcacaaggttgctaccaaaatcaaggtgccgctatggtcggagctgcttcaattcatgcagtgacgcccaccgaaggtggcgcacagccaaacatttgtactaaaggacctccgccagcaaatgaacatgccactgctgttgtagccgtttctattcacagaaaacccaaacggaggtgctgctgctacaagcacactgctttctccgtacacatgcataccaagaactgaagaggctgctgctgcagctgtgtgtgctattgttgcagaagcaaccccgggtgctggtcctagcacgtggcagaaccaagcaaaacatgtgtaaaccatcag

SEQ ID NO: 47030 - DNA, 496 bp, Triticum aestivum
  Clone ID: PAT_TA_47030
cgtccgcccacgcgtccgagagcccatggtgtagctgcagttgctagctatggagtctaccagaaccaggaagtcccagtgtcgtttaatgccttcctctacactgataagatggctgctctcgaggcacaacttggaactgtaaatggcgagaagatcgattccaaaaatgactggccacatgttactctttggacagcccctggtgttgcaccaaaggaagcaaacatgctgccgcagctgttttcatcaggacaagcggaacgtgtactgatcgaccctccgatcaccatcacaggagtgcttgacttctactgattcctgtcttggttttagaatttgatgtagacttgagcacagaatcaggagtcttcggttaattgctaggggcaacagctttgtaaatatggagttccatgccacgaacttttcaagggattactgaagggtcttaggagtcatggcaacagctttgtaaaaatgtgaggttccaaaa

SEQ ID NO: 47031 - DNA, 526 bp, Triticum aestivum
  Clone ID: PAT_TA_47031
cgatccggggttcccggcgacgacccacgcgtccgagatcacgaaaaaaaaaagaggaaagtcactggaatataagtagaataaagtagttggcattcatataaacaaatctaaataaggatataaaataaatcataacatcaaattgcaggaacaaacgtgactttgcttgagagacagagtgaattcaccttattcttcttcaccaaactcttccttggtattcttcctcttctactctttctcagatctgcacacattgtgcttaggaaaaaaaataagaaatcaaaatcagattactggagaactgggggaatcaaaagggagaggaagatggagaggatttatatgtgcagcctggattctccggactcgcagtccttcccccacctccgtcctcctcaccttcccaagatccttcacacccaccataaaaactacacacccaaatcctaaattaatttagagaggaaggaatcaggaggaggaagttacatagggtggagttccaaggaggcattgagcc

SEQ ID NO: 47032 - DNA, 457 bp, Triticum aestivum
  Clone ID: PAT_TA_47032
cgtccgcggacgcgtgggcggacgcgtgggcaaatttccctcctaatcctccagatcggcgaacgaatgtctaaatcgctgcgccgcttcccccccaaaccttcgaatccaaaagccaatggcggactcctctccctccatttcaatccccctcgcgcctgcgcctactacataatcggctctgcccgagcctgccacactcctcctcctcctgctgccctacgacgacgaccgcatacccctgaccccgccgagcccggagtccgaggaggagcagccgcgcgatggccgacaaggagaactccgactacgccgacggcgccgccgtcgagccccgcatgacccgcgcatccaccaagcgcgccgacgtcgtcaccgtcgtcgacgtcgccgccaagcgcaagcgcgtcgcgctcagagagatccccacgctccgcaacggcgcccaccagccgca

SEQ ID NO: 47033 - DNA, 364 bp, Triticum aestivum
  unsure (1)..(364): unsure at all n locations
  Clone ID: PAT_TA_47033
cgtccgcccacgcgtccgcccacgcgtccgaaacctttctccttctgtcccgcaaacccccgagagatcacagcatgttcggcttcggtcaccacggccaccatggccacgcggcatccggaccacgctccggccgccgccggaggcaaccatgggcaaggttaggagcgtgtgtacggccgacgagggctactggctgtgccgacgtgacggcaacgtcgtcctggtcccgtccaaccctcgtgacgagcaccagcactggttcaaggacatgcgcttcagcgcccagatcaaggacgaggagggtaaccccgcccncgccatcgtcaacaaggccactggcctcgccgtcaagcactcgctc

SEQ ID NO: 47034 - DNA, 196 bp, Triticum aestivum
  unsure (1)..(196): unsure at all n locations
  Clone ID: PAT_TA_47034
acccacgcgtccgcccacgcgtccgcggacgcgtgggtccagccctccccgnccnnttnnnncttttgccgcggaccccattcgccccccgccgccggcgncgncggcgttgacactacccgcgaatctccttcttccgagtggcggagaggaggcatggcactcctgaggctgttttaggggattgttctaccgc

SEQ ID NO: 47035 - DNA, 106 bp, Triticum aestivum
  Clone ID: PAT_TA_47035
ccgtgttttgggatcggatcgatcgaccaccacccggacctcctccagatcatcgtccaccgcgtttagacctgccccgtgttggtcaactaactcactcctcgct

SEQ ID NO: 47036 - DNA, 238 bp, Triticum aestivum
  Clone ID: PAT_TA_47036
cgtgcggcgcagcttgcttaatgcaactcttgtgatcccaatatttcatttgaataacgtttggcgtgatcctagcaaatttagtgatatggttgatgaagatcgttttatcgggacactcaggcaacatgtaagagttgtgaaagaactcccaaaagatgttctgctgcgtttcaatcataatataagccgcataccaaatatgcgaactaaagcctactcattcccagatcattat

SEQ ID NO: 47037 - DNA, 246 bp, Triticum aestivum
  Clone ID: PAT_TA_47037
cgtccgagattgcaacgaattccagcccgcaagctactctagctgatgcgtcttccctgtgtgcagtaatggcatgggcgggcgatgatggaccactggtggtgcttgtgtcccttggcccttcaccgtgcaagtggtcatgattgttcgccatcgttgtaaatcgacgttagatgcatcagctagaggtgcttgcgggctggaattcgttgaatactattgacatgctagtatatttttgtactg

SEQ ID NO: 47038 - DNA, 501 bp, Triticum aestivum
  Clone ID: PAT_TA_47038
cgtccgccgaccgccaccgccgacgccgcctcctcctctcggttccctctccttccttcgagagcttcacccatgggtaaggagaagactgacatcaacatcgtggtcattggccacttcgactctggcaagtcgacgaccactggccacctgatctataagcttggaggcattgacaagcgtgtgatcgagaggctcgagaaggaagccgcttaaatgaacaacaggtctttcaagtacgcctgggtgcttgacaagctcaaggccgagcgtgagaggggtatcaccatcgatattgccctctggaagttcgagaccaccaagtactactgcaccgccattgatgcccctggtcaccgtgacttcatcaagaacatgatcaccggtacctcccaggctgactgtgctgttcttatcatcgactccaccactggtggttttgaggctggtatcttcaaggatgggcagacacgtgagcaccctctccttgctttcactctt

SEQ ID NO: 47039 - DNA, 409 bp, Triticum aestivum
  unsure (1)..(409): unsure at all n locations
  Clone ID: PAT_TA_47039
attaaattatacctttaattaatcacttgtatttacacctctgaatattgagacaaactatccttatgtggtgtcaatgttcattctcagagatgtcaatnnttcatatctcctcacatcaatctttttcttgctacaagctaacaatccatttcacatcttttattaacgatctacataaaccatccctccataaaatcatatttcataatgttatctgtctgttctctaatgtatcctataaatattctctatttatttttatcaacaccttatctttactattatcctctacctcatttattctcattgacctattcatttttaattaccaattataaatatttcattttaatcataatactcataaattacattctccttcttaatttttacacattttattttt

SEQ ID NO: 47040 - DNA, 241 bp, Triticum aestivum
  Clone ID: PAT_TA_47040
atactatctatatctacaaccctactacatctatctatctatctacttacactttatcttaacatactcacatacattacccaccaacaacttccttatactagctattctcactttactcttatatctatataataatataatacttatcttaattatacaaacttatcctttttaccttcctcttttcacacaactcattctgccttatatacttacttatttttcttacctttatata

SEQ ID NO: 47041 - DNA, 432 bp, Triticum aestivum
  Clone ID: PAT_TA_47041
cgtccgcggacgcgtgggtgcggcatcatcatcagcttatgccgagaatctcataagcaggatgaggttgcaaggaaagaaggggagaagaggatcttcccaatagattagcatcagttgcgactaatttgcctccagcggacaagtacgagagctgcatttgcattagcacaggtgatgtgctgtcagcggaatatgtcagctctgcacctacatcagatcagaggcctaacgacgcaccgactcggagctaagttcacatctcgaccaactgaatgttacaggaaacggaaatgctttcagaaccatgcttcgaccaaagactgcaaggctgaagaacctttaagaggtaactgttcattgaccagaagctgagctcaagttactcttcacacttatctgcagatctcaatgccctggtcatgttatcta

SEQ ID NO: 47042 - DNA, 358 bp, Triticum aestivum
  Clone ID: PAT_TA_47042
cgtgcgcgtcccctccctgtttggccgccgcccctcacctcctcctcgtctgccgactttccaagggctgatggcactcgaatccaattgctcgtcaaggtgtaccacggagacggcgaagggaacgcatgtcttggagatcatcgggtacagcctcaagaagggcctgggaatcgacaagttcgtccagtcggccatcttcaccgtcggcggctacgactggaccatccgtttctaccctgacggagccaacatgtcatacgccgattgcgtttgcgtgtcggtctcgcgtgagcccacgggcagggggttggcgcgggcatcctgtgatctgagactgtgtaacaaggatactggg

SEQ ID NO: 47043 - DNA, 274 bp, Triticum aestivum
  Clone ID: PAT_TA_47043
cgtgcgtttttttttacagaaacgaaaaacagactcaaaacaaacaatacctttacaacagtttcatgggcaaatgattacagcccagtggtaatcaatgtacaagtttcgtgtgcctgtgatgtcctacataacgtgttcgtagaaatcttgcaatcaccacacttcgaaatcccacggctcataattggtacgagcaacggccaccacgatgaagacgaacaccgagagcatgaaggacaccttcactgcatcgctgtacagatcaggctta

SEQ ID NO: 47044 - DNA, 229 bp, Triticum aestivum
  Clone ID: PAT_TA_47044
cgtccgcggacacgtggtgtcggccacctccccgctgccggcgtcggcgtcggcttctccttctgttacatctacatcctggcactagggaccatcttccactctctacttctctacaataacacttaatccacctatactaactcactcttttcccactattattcatttaccaactcagtatcatttcactatactttatcctccttattatcaattaataattaac

SEQ ID NO: 47045 - DNA, 221 bp, Triticum aestivum
  Clone ID: PAT_TA_47045
gacgcgtgggtgctggcgcgccgcgccgtctccggtcttctccgctccgtcaccagccccggcctccttcgcgccggcgcggtgtctgtggtgctgcaggctcaaggcctgtggtaccgcgcagcatgaggtgacccgtcgccgtcgttttacgagccgtcttcgacctcggctaacctgggtctgagcatcgttctggagaagaaggcgttcgtggtgga

SEQ ID NO: 47046 - DNA, 479 bp, Triticum aestivum
  Clone ID: PAT_TA_47046
cgtccgccggcgtcttcgtactcgcctctctctcgcgcttccgagctttggcctccctcccctcctccccgcaatctccccaccagcggagcgcagcgcgcgcctccgccgctccgacccgcagccatgagggagtgcatctcgatccacatcggccaggccggcatccaggtcgggaacgcgtgctgggagctctactgcctcgagcatggcattcagcctgatggacagatgcctggtgacaagaccgttgggggaggtgatgatgctttcaacaccttcttcagtgagactggtgctgggaagcatgttccccgtgctgtctttgttgatcttgagcccactgtgattgatgaggtgaggactggcacctatcgccagctcttccaccctgagcagcttatcagtggcaaggaggatgcagccaacaactttgcccgtggtcactacaccattggcaaggagattgttgacctatg

SEQ ID NO: 47047 - DNA, 350 bp, Triticum aestivum
  Clone ID: PAT_TA_47047
cgtccgcgcgtctcaggttcctccgcacaccgctccgccacagtcgacggatcggaaccgcagacccgcccccgccaccaaaccctagcggggccgccccgccgcccgcgatgtcggccgcggccgtcgcgccgagccctgcggcgccgctcccgtcggcgcccccgtcgtcctaccccgcggcgccccccgcccccttcgtcgaggacgacgacgacctctacggtcgcctgaagtcccttcagcgccacatggagttcgttgagatccatgaggagtatcttaagggcgagcagaagaacctgaagcgcgagctgctgcgcgcgcaagaggaggtttagcggatccag

SEQ ID NO: 47048 - DNA, 200 bp, Triticum aestivum
  unsure (1)..(200): unsure at all n locations
  Clone ID: PAT_TA_47048
gcacgcgtccgcccactcgtccgcccacgcatccgcccacgcgtccgtggacgcgtgggcgcccgctgaggtatactccacaatcgcntttgatccgcactctctatctaagattttaaatctaacaaaacctacatattctgtcacatttctctctataatcattcgtcattttaacaaataccttaatcactattctt

SEQ ID NO: 47049 - DNA, 431 bp, Triticum aestivum
  Clone ID: PAT_TA_47049
cgtccggaactgtgtgtttccgattggtgcttgtgttgttagtttgattgatgacgggaagaaccccgatgagttcaccagggacgtggggaacagctgcatcgccaagaaccagatcaccaagggcaagaccgacgctttcaaggtacagatggcttaaactgttgttcaaaatatgccaaagtttcgctattaaccaaacatgcccatagatatatgctagatacagtttgtagcatggtacagtacaatggatcaaaaccagtgagaaagtttgccagtctatttttaggggaacttttgatgaaatcttcaattggtactgctgttcgtgtagaaaagaatgatataatatgacattggttatttgatgaaggggatacactctcttgtatgccctgggaaaaggaaccaacatggagcttttttta

SEQ ID NO: 47050 - DNA, 271 bp, Triticum aestivum
  Clone ID: PAT_TA_47050
cgtccgtgtacgcgtgctccgactcatgctctgactcgtgtgctgactcttgggttcatgtgctgttgacccatcataaagtctgatgcgtgaagactactgcacgtagtctttataaaccacctactaccacatctcctgtaaccgaggcacattcatcacattaaagcaccctctcctgcttcgttcgcccttctcattcaccgctccattaccatctctttcagctattatcccatcactagcctctccacattttctcatacctatt

SEQ ID NO: 47051 - DNA, 397 bp, Triticum aestivum
  Clone ID: PAT_TA_47051
cgtgcgatgatggttcagcaagtggcaatgttgagaagaccgtctcagattctgaaattaaaccaaaagaagtacaaaagaaatccgaggaaagaagcacatggaatccactgaacttgattaaagttggaggagatattgttacttctacaactggggaagctggggatgcaaatgtgcctggtttgacagagcaaccaatagcaaaaggaaggattattgtatacacaaaactgggatgtgaagattggcaaaatggttcggttgttcatgcatcagcaaaggctcaagtatgttgagattaacattgatatattccctagtaggaagttggagttggaaaagaatactgggtcatccatagtaccaaaagtgtatttcaatgacctgctgattg

SEQ ID NO: 47052 - DNA, 419 bp, Triticum aestivum
  unsure (1)..(419): unsure at all n locations
  Clone ID: PAT_TA_47052
cgtccgcagaaggtgacattcttagtttggctgccggagtggaatcaaatacaaaccacccacttggaaaagcgatcatggaagctgcccaggctgccaattgcatcaatatgaaggcaaaggatgggtcctttatggaagaaccagggtctggtgctgtggctacgattggtgagaaacaggtttcggttgggacagtagactggattaggaggcatggtgttgttcgtgacccatttcctgaagcagaaagttttggtcagtctgttgcatatgtagcagttgacggtactctagctggtcttatntgttttgaggacaagatcagagaagattctcatcaagttatcagtgctctgtctaagcaaggaattagtgtgtatatgttatctggggacaaggagagtgctgctatggat

SEQ ID NO: 47053 - DNA, 205 bp, Triticum aestivum
  unsure (1)..(205): unsure at all n locations
  Clone ID: PAT_TA_47053
cgtccgcgcttcgtcagttacatgacatgatagcaccacgttgttgctgatttccgttcttgctctggcacgatgtttgtttgctcaaaattgtgtgcacaagtcatgagtgtgatgatggcatggtgttaattgagcggttccnaannaaaaaaaaaaaaaataataaaaaaaaaaaattaaaaaaaatataaaaatataaaaa

SEQ ID NO: 47054 - DNA, 347 bp, Triticum aestivum
  Clone ID: PAT_TA_47054
cgtccgcggacgcgtgggcgcagtcccccttacactctaccccaccacacgcttgaatcactaccaccagcagtacccatggcgcccaaggcttcatatattaagcctgtgtcctacttctataatactactgtctttaataagtctaatgctgataatctgtcgctcttgttcaatgagtccttttgctaggctaatcatcgttgcatgaagaatgtcattatgtctaagaatagtcgtttgacgtacatgatctatatctttaatgtgttgaagcaggtgcacctcggacttgggcatcttcttcaaggtcattttcatcatgaactctttcatcaactacattt

SEQ ID NO: 47055 - DNA, 243 bp, Triticum aestivum
  Clone ID: PAT_TA_47055
cgtccgcccactcgtacgtttacacatgcgcaaaaactatccgtacacatgtccttgaacacacacacacatctataggactatgcacgggtggaccgtcgcatatctgtgcaagtcgcaccgatgccgtctacacgactccccaccatactatatagcggcggtggtctagaaaatgcaactaatccattggagatattcatttgatcatctgagcaagctggcacacatgtgatttaacat

SEQ ID NO: 47056 - DNA, 389 bp, Triticum aestivum
  unsure (1)..(389): unsure at all n locations
  Clone ID: PAT_TA_47056
cgtgcgctggactctgaagcatcctctttcttcttccggtcttctccctcttactgtatccagcagcacgagatctcaagcatcgaatcatgaacggaggaggtagcgcgacgcccttctnccgcaccaccaccaccctcagcaccacttcttctaccttgcaagcaggtgattcgggacaaggggatagggaagctgctattcaagccgagaatggccagggttaacaacctggccagccaataagttcctacgcgaatcaccgcattaaggtgctgaacaaacttcgccatcttttatctataaagaggaccacatcgcangatgaggagctngaactccttttctcaagcctttcgatttgaagttatcctcagtatctacatgta

SEQ ID NO: 47057 - DNA, 374 bp, Triticum aestivum
  Clone ID: PAT_TA_47057
cgtccgcggacgcgtgggttctccttctgtcccgcaaacccccgagagatcacaggatgttcggcttcggtgaccacgggcaccatggccagaaccccgggggccacgctccggccgtcgtcggaggcaaccagcccaccttcaagatcttctgcaaggccgacgagggctactgcctctccgtgcgtgacggcaacgtctgtctcgccccgtacaacccccgtgacgagcaccagcactggttcaaggacatgcgcttcagcgcccaaatcaaggacgaggagggtaaccccgccttcttcatcgagaacaaggccactggcctcgccgtcaagcactcgctcggacagtcccacccggtgaagctcgtgcca

SEQ ID NO: 47058 - DNA, 384 bp, Triticum aestivum
  unsure (1)..(384): unsure at all n locations
  Clone ID: PAT_TA_47058
cgtccgcggacgcgtgggcggacacgtgggcggacgcgtgggcggacgcgtgggctcgccggccaccacctcacccagctcgccggccacggcaccacatcggccaggaggccaccatctctccccgtcgccgccatctttcttccgcctccactcacacccgtcgtccactcgcaccccaccccacattcgagggtcaagctttgatgcgcctacctctggatctggcgacggaggcgggagatggggaggaggccgtcgcggtggtgtgcctggaccacgtcctcaagcacgccggtggcgccacggaggaggccgagcgcatncgccgntgtcacaacgccgacggcgccatggagtactggctcgagccggacgagctcg

SEQ ID NO: 47059 - DNA, 419 bp, Triticum aestivum
  Clone ID: PAT_TA_47059
ttcttacactcttctccctcttactgtatccagcatcacaagatctcaaccatataatcggcaacttaggagttatctcgacgcccttttacctcaccaccacctcccttatcaccacttcttttaccttgcaagcaagttatatagtacaaggaaatagttaaacttctattcaaacctacattatcatagttaacaacctcccaacctaaatatattctaccccattcacctctataaagaacttaacaaactatcccatcttttatttataaaaaatgaccatcattcctctgatttagtatctttgaactccattttctcaatcactttctatttaaatatttatcctcattattctacaatgttctatcgtgaagccactatattacatactatacttattcatctatataatc

SEQ ID NO: 47060 - DNA, 571 bp, Triticum aestivum
  Clone ID: PAT_TA_47060
cgtccgcggacgcgtgggcggacgcgtgggctccagtccaccgccgctgtgccctagaactgccgccgcgcccgccctctggccctcacgcgcctcgtcgccggcgccctccctgtttcgtagagtccctgctctcttcccccccacgcgcaatcttggacttcggttttgaggtttgcagagggctcgtcgacatgtcttgggcgccaatcgagaatgaccctggtgtttttacggagctgttgcaacagttgcaattgaagggtctccaagtaagtaatcacataccatgagttcactttttctttcctaagtcagctgggcactaatcactcgatgaattagtacaagggtaagaacaattttgcattcagcgctcccatacgataaaaaaaacttgctattttgaccaagtaggaaaattaagcatgcttttctatttcattattctggtgacttataagcttctcgattcacccaggctcgcaaatactaaaactatgtttttgagcacatcgacacttttcttttaaaatgttgcacacatctggttagtttaggagctaatatt

SEQ ID NO: 47061 - DNA, 517 bp, Triticum aestivum
  Clone ID: PAT_TA_47061
cgtccgcagggaactgcaaaggaagtatgctgtccagaatcaggcgcagcgaaatgcatctgccgctgcgaagaacagcatcatcgaggaatgagagattccaacaacctgccaaggcggtgagtttgcgagtgaggagggaacatcgtcggtgatggagtggcgttttaacccaagaaaagattcgtgcctcccgtgtgattgtttcacggaacagccgatgctgaagattgtgcagatggggtatcctccgaccgcaacttctggcagcaaagattagagtagtgagtgagccgaggctggcgcttttggggttctacattccgtggcgatgcatgactaacacgtgatcggattgatcgggcttgcatttgtaacacggagaggacggtgttgctgtgtagattgttctgatgacaaattgtacacgagtcgccaatcatcaagaaccttgtaagattcatacttgtgtttttttttttggctccttgccttcttctgcttttcaatttccttt

SEQ ID NO: 47062 - DNA, 280 bp, Triticum aestivum
  Clone ID: PAT_TA_47062
acgtcgcgctgcatttctctcctcctcctgccaccgatccctaaccacggaggaaccctgctctaggagggcaaaggaagataataataaattagctagcgcggctctcactcaggacagtatacgccacgaacattcactacagcggagatggggctcacgttcacgaagctgttcagcctgctcttttcaataaagagatagatcctatggtcttctcatacgtggtaaccacatcttacaacaaagtttaatactctccctcccattgttattcaac

SEQ ID NO: 47063 - DNA, 462 bp, Triticum aestivum
  unsure (1)..(462): unsure at all n locations
  Clone ID: PAT_TA_47063
cgtccgcccacgcgtccggttagatagcagaacgaaaaggagaacagtatcaccagcttgtacttctcatcatgtctcggtcgccacatcttgcggcccgctgcccgcctctgggtcctcaaatcataggaagagatgacagcttgttcacacagagctgcaggtttccatcagaggatcctttctttggtgaaccaccctgttggctagatgatctccttgcagattctgggaaaatgccaaaccttccacttcttaggagagcttgtagcgactctgatgctatcttggatgcactgaggacaattcagagcccaatttttccgattgaggagggggatctgcaaccagcaggtgagaccggggactcgttggatgctgctgtaaggggtgaaagtgatntcgggggtcgagttagctgtgtgtatggtccaaattcgccaaagacaagagtgtaggctg

SEQ ID NO: 47064 - DNA, 420 bp, Triticum aestivum
  unsure (1)..(420): unsure at all n locations
  Clone ID: PAT_TA_47064
cgtgcggcgagcagggtgcgccagaaccggatcgggcgcggtggacgaggggggacggcgatgatgcacagagtggagcaatctgacgacgcggcggccgcacaggacatgaagctcancaatctttctcagaagcggagatggggctcacgttcacgaagctgttcaaccggctctttgtcaagaaggagatgaggatcctcatggtcggtctcgatgcggctggtaagaccaccatcctctacaagctcaagctcggagagatcgttaccaccatccccacaatcgggtttaatgtcgaaactgtatagtacaaaaacattatttttaccgttttggatttctgtggttaagacaagaacatgcccctgtggaggcacttctttcaaaacacccagggttttatttttttcgtggaca

SEQ ID NO: 47065 - DNA, 339 bp, Triticum aestivum
  Clone ID: PAT_TA_47065
cgtccggtccttgctgattatggtgtccatactgcagctggggaagtcctctcatcttccccaccctattgacagcgactcatatgacaggattatgttctgtgttaggttgctttgtaggactggtaataatgcaaggaaagttcagttgctgtcatcctgtcagagcttcacaaagatgcttgcggagaagcaattcaggaagaatgagaagatgagggttgagtcacagaattcccatgcatatcctgatgattccattgatttcgaccacctgaagagcaggaagggaatgtgccaacttgagttggaagatgaagtccgagattatttaaaggc

SEQ ID NO: 47066 - DNA, 481 bp, Triticum aestivum
  Clone ID: PAT_TA_47066
cgtccgtgatcatccacacagcacattattatctggttacttcagtaaggtatttcattttatttggattatttatatccgcatcatggcataaattcgttgtagaagttccctgctgaggcttggtcttgccttttgttaatctgatgttgagatttcatcttgtagttgctgtcatatttattacaaggctgaagtctgtttgattacttatttgttgtaggtggtaatttgtttgatgctgcggaagactgccccactaatgaattatgttcaggagcatccagagattgttgtccaacttgttgacctgattggcatcacatctgtaatggaggtgctgatacgcctgattggtgctgatgagaccatatattcaaactatgctgatacaatgcagtggttagaaaatacagatgttcttggaatgatcgcaaataaatttagctcatcggactcttctgaagtgcatgccaatgct

SEQ ID NO: 47067 - DNA, 144 bp, Triticum aestivum
  Clone ID: PAT_TA_47067
cgtgcgctgactcgtggagcacagctgtgcggccgagggcgtgttatgtgcagtgcacgacctggcacggctttgcatggatgcgggcgaggtggtgcatggatgctgtcgagggccccaccctccttcactcaagcatatcta

SEQ ID NO: 47068 - DNA, 573 bp, Triticum aestivum
  unsure (1)..(573): unsure at all n locations
  Clone ID: PAT_TA_47068
cgtgcgcaagatatacaacatgtcaatgttgcaccaaaaacgccagtgtgttcatctaaccgtgcaactagtcttcacaacattgatagagacatgagaagatgaccgagatggcacgacgggcacgtttaaatttaaagctctgccactggataaaaagatattggcaagcagaggagacatcggtgtatttcaaactgccaaaagaaatcctacagtgcctaaggaattcaacttgtcaacaagccggaagagcaagcagcctccattatccgaactctttaacaagctttctttaagtaccgaagcctgccgtaccatgggccaccagaccagtgaacgcccaaattatatcactaccaaggactgcaaagagaacatgattggtgccattcattgctagctctagtaagcggtatctttaactacctgaccgactttagtcaggaaaaatatcatacagttctctttgacagcctgcacaaaggttaaagcgtctaattttgnagagtagngttccgacttctaagtctaacaagatggatgaagcgaaacataatttcgcgttaagct

SEQ ID NO: 47069 - DNA, 461 bp, Triticum aestivum
  unsure (1)..(461): unsure at all n locations
  Clone ID: PAT_TA_47069
cgtccgcggacgcgtgggcggacgcgtgggctgccgccctttttttttttttttttaaatatcaaaagatcctttcaagtttcgttgggtacggaaggaaaagaagatcacttctagctgattcangacagcacacaaacaacacaaagcttcaccggctcgtagattctagcgacttaaaactaagggtagcagcagagggcagcaagactgttcgattatacactcaggagttcacaaaaaggcaaggaccgagacgtccgaaatgtgaaggtcctaagacctagcctatgtctcccttctcgaccttctgcgtggtgcggtggtgtcgtcctctttctcctccttgtcgccgctgcttccagcggcatcagcttccgtggcattgggcttcttgacctcggcaacgggcttcacaggtgccactggcttcttgccaccgaaaatgtgtctgaagagca

SEQ ID NO: 47070 - DNA, 583 bp, Triticum aestivum
  unsure (1)..(583): unsure at all n locations
  Clone ID: PAT_TA_47070
cgtccgcacggagcgttatatatacaggggcgatcaaatgttcctgaacccagccgaaccgatatgacagagaaaaaaaacaggggccgcactgacccagtccttccctaacctgcagattccctcccatccattgcgccgccggcctctctcttcgttcttccgccgcgccgccagcctccgtccccatgcttccaccgcggcaacggcctcccaccccgtgctttcgccgcagcgccaccttcctccccgtgcttccaccccgcgctgggctcccttaccctgcttccaccccctcgccggcctccctccccctacttccaccccggccacgaccaacctcccctgcttccactccggggatggcctctctcccctgcttccggcggcccgcccctcctctatgcgccatcctccaccatcgtcgttgccaaaacagatcccgccactgtttgccaggacctcgtcgatgatctgtcgtgagggccagcgccccatcgttcgacgcgcctagctagcccgcttccgccgaccctttgcccttcctcaccacgcgacctgcgtgcttncccctacgaccact

SEQ ID NO: 47071 - DNA, 566 bp, Triticum aestivum
  Clone ID: PAT_TA_47071
cgtccggtccaccaaccttgactggtacaagggcccaaccctgcttgaggcgcttgaccagatcaatgagcccaagaggccctcagacaagccgctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtga

SEQ ID NO: 47072 - DNA, 466 bp, Triticum aestivum
  Clone ID: PAT_TA_47072
cgtccgcccacgcgtccgcccacgcgtccgcggacgcgtgggggacaatatagcttatgataatgtacgatgctctagttgtctaacattatttcatgctataagcgaacggtcttcattttgtatttttgctaaaatgttccttctgacctcttgaattgtgcatcttagcaaatgcttgcatcattttgaccactcaaagtactactcccttaggtcacaaatataagatgttttggatacatatgaactgaaatgagtgaacaaacacactaaaaggtgtcgatatacatctgattcagaaaaagttcgaaaatctgatatttatgaacagagggagtagtattcatacagcactatttttatgattgtttatatgatccagtttacagttagaacatgacagaagtgggtatggcagcattatcttaatcgtgattgtttatacctcttgatgatattgaca

SEQ ID NO: 47073 - DNA, 501 bp, Triticum aestivum
  Clone ID: PAT_TA_47073
cgtccgggaggctgcattgtctagtgacccaaagtttgagcatatcgacatatcggagaaacagaaggttgttaatgagtgctctggagcggagacttggctgcatgagaaaaaacagcagcaggatgctttaccaaagcatgctgaccctgctctccttgtttccgacattaagaagaaggcggaagcacttgacagattttgcaaatcgatcatgacaaagccaaagccagcaccgaagccacagacaccacccccggccgaaacttcaccaccagaggctcaaacaccagagcagcagccagatggtgccactgaagctagtgagccggccagtgagggaagggcgtgggagcaacctgcagccgagcagatggacaccgacgaacctgatcctaactcggcataagcttattgttgatcgaagcagttttttttctctgctattgactgcgtttcacggtgttggtagcgcggcaagcgtttgggtctcggcacgca

SEQ ID NO: 47074 - DNA, 472 bp, Triticum aestivum
  Clone ID: PAT_TA_47074
cgtccggccctctctctcttccccggcctctctttcttaacttctcctatttgctattgttgtgtctgaactgatggatatcatggattgctgccttcaagttatgtttccccgttataaggactccattgaattgattattttttatggctggagatgtagaatgttctcactatcaactctggaataactagcaagtagtggtgtcaatggcatccgtgggagccattttggtggcacatggacatcacgttctggaataaagtaagtctcacaatcaacttgggaagatgaggtaggctgccttcaattttctatctgggtagcagcaacaaattcatgaatctaccgcttgttgcctttgttattgtgatctatacaaaaagtaaattttgcttgaagattgcagcacacacagaatgcttggcagactaaaataagtaggagcttctgattggacccttcaagcaat

SEQ ID NO: 47075 - DNA, 447 bp, Triticum aestivum
  Clone ID: PAT_TA_47075
cgtccgggcgtattctcttctctttcctgatccaaggtctgactgagatccagtcctcaccccacagcggggcccttcctcccacccagcgtcggcgctctcgtgctagctacccaccgcccacctagtccctcccttcactcaccatctctccctaccctctgcctgcttcccctgcctcatccccagatccaatcgacacaaccccgttgcccccgcaccccgtactgtccaccatggccgcctcctgcttcttcccgcaccaacccatcaccccgtcgtgggggcgcgtccgtggcggctacccttccacgccgtcttcgtacgcccctgccgctccacagtctcctccgaatccgcatactccccgcagcatgcgcctgcaccggtcggcggcgacgacgccaacgggcccaccggcgtgcccgggccactaattcgtgccct

SEQ ID NO: 47076 - DNA, 557 bp, Triticum aestivum
  unsure (1)..(557): unsure at all n locations
  Clone ID: PAT_TA_47076
cgtccggggagacgccggacgacgggcggctgtgcatcgcgaccgtggaggaccagctgctgcgggtgtgggtgcgtggggagaccaggtggagcgacgatgggtggtatctggagagggagatgaatctcaccaaggtgtacgacacggtgccgggcctgcccaaggacaagtgcctcaggatcttcagtgtttggctcagcgacatggacgcggggcgtaccggcaagctgttcatcagaacgatggggtatgggagctactccttacatctggacaccgccaagatcgagcgcatgcacaccaaacatggcaaggagtacggccacccgatgtgcgcctacttcctcgcgtggccacctgccttcctcgctccagacaactgactttctgatgattggttcctgacttccgagatgtggaatcagcacagtttttgtttgaagtcagctcacatcatatcacccctaggctcactgatgccatctgcagcttcactcancgcanggacgaagaagcgctcctgntaccttatttattagactatctaagcaatg

SEQ ID NO: 47077 - DNA, 528 bp, Triticum aestivum
  Clone ID: PAT_TA_47077
cgtgcgcggacgcgtgggcagatctccccgtcctcccaacccccgcgagctaccacaacactgcacatcgcctctgctctccccccggatctgtagatctctcgcgcacccacccctcgcccgctacgtcgccgccgccgcacgcggtggccacggcgagatgctccgcctcagggctttccggccgacgagcgacaaggtggtgaagatccagctccaccccactcacccctggcttgtcaccgccgacgccaatgaccgcgtctcggtctgggactgggagcaccgccaggtgatctatgagctgaaggctggtggcgtcgatgaacggaggctggttggtgtgaagcttgagaagctcgccgagggagaaactgattctaaaggaaagcccactgaggcaatccgaggcggaagtgtaaagcaggtttctttttatgatgacgatgtacgcttttggcaacattggcgcaattgctctgctgctagcgaggcttcaactgcagtaatcaacaatcgtccggtttc

SEQ ID NO: 47078 - DNA, 285 bp, Triticum aestivum
  unsure (1)..(285): unsure at all n locations
  Clone ID: PAT_TA_47078
cgtccgcggacgcgtgggttcgcgcaccggcggttgccaacacgattccactacaggtctcctcctccggtgccctccgcgctaaacctcggcgtccccaacgaggccacgcgctccatcgccgagctgagcagagctcgcatgatcccgcgagagccccgccactgagggagcgagcgatgtccgtcgccccgtcggcacgcggcggctgcggtgccgccaaggccgcgcggcgccaccaggcggngcgcgttggcggagggagggcgtcgcgccgcgtggtcc

SEQ ID NO: 47079 - DNA, 356 bp, Triticum aestivum
  Clone ID: PAT_TA_47079
cgtccgcacccattcccctcgccgccgccgccactccgccgccgccgccgccgagatgggtcgcgtgatccgcgctcagcgtaagggtgcgggctccgtgttcaagtcccacacccaccaccgcaagggccccgcccgcttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccggcgagggtatgtacaccggccagttcgtctacttgggacgccgcgccatcccttttcgttggtaac

SEQ ID NO: 47080 - DNA, 529 bp, Triticum aestivum
  unsure (1)..(529): unsure at all n locations
  Clone ID: PAT_TA_47080
cgtccgatgcgaggaaatatgatgacttcgggatcaagatctgatgcattcaatcagacccatgtgtctgaccatgaacgaaggttgagatgagctgaattatagagagtcagagaacttaatctgccacaaatggaatgcattgatgttatcaaacaaattaaaacagaagcttcaaacagggataaattaaaacacttcactatgaattccacaactgaagaagatgttgacttaaggatccatgagggaagtggtgatgaaactgaatcagaagatggagaagatgacgatgaacatggtgatgaaactgaatcagaagatgaagaaggtgagtctgaacaagaagatgaacatgaacaagaagaaaagttcgacaagaacaggagcaaacacatgaagttgctgagaagattagaagaggacctactcacatgaggcgcttctagaaagaacatgatgttgataacaagatccattttgaggtcaacagatttggtcagccatgtggnttgaagacatgcaagct

SEQ ID NO: 47081 - DNA, 514 bp, Triticum aestivum
  unsure (1)..(514): unsure at all n locations
  Clone ID: PAT_TA_47081
cgtccgcccacgcgtccgctttaatgcatctttcattataattctcagtgggcatgatagaaattaatgtggtttttagtgaattttacactgtatttgtcaatgtattttttaggtgacatggtcttggtgttttttctccctttattagcctagtgatcatggaaaagctttgggtgtatcgttgtggttctttcaattcttggttgtcattctgtccgggttggaaaagttggggtgtggacccgttaatttgtttaaaagcggggcagaaaagaaaacatgggacaggggatagttggcatactgtggttggctgaaaatctggataaaagctaattgaattttcatccgatgtagaatagacagtccctaaataattcctcatcccagtcgatccacccagccatccgacacgtgactggacttcatntnacccacccggccgcaccgttcaccagacgaggtaatttattcactaccaactgttttttacgatgggagcagaccccac

SEQ ID NO: 47082 - DNA, 553 bp, Triticum aestivum
  unsure (1)..(553): unsure at all n locations
  Clone ID: PAT_TA_47082
cgtccgcccacgcgtccgcggacgcgtgggctcccgcaggccgcagcctgcaatcccgcacccacggcgtgacctcctaccaaatcgccgggcgtgccaaatggcctcctgccaaaatcatggcacagatctcccagaatttatccttgccctccccatgagcgcaagtcttgctgcgccgcctgcccgcccaaatccctggcctttggccatggcaccattaggtttatttatgcatggggagaagatagtaggctgccttcaaaccgaacagagccgaagcggctggaaaaattctgcatcgaacgatgtcgctttcctgcaaaatttcttccgagacagaggagtgtcatactngagaacatangtcatgataagcaagtagtgatgaaagttaatcatggatgaagcttgaagaataagcaataaatcttgaagtttagaagaaagggagatggtaatggtagctgcaccgcactactgaatctgtgtggtctgctacttgccttcttctattcgtcttctcaaacttaagtggacttgtaaatgtgtc

SEQ ID NO: 47083 - DNA, 254 bp, Triticum aestivum
  unsure (1)..(254): unsure at all n locations
  Clone ID: PAT_TA_47083
gccgcgtaccgtcccgagtcccggtcgaccccgcgtacggaattcgtaggcgagcgagcgagatggcgaccgccgggaaggtgatcaagtgcaaagccgcggtggcgtgggaggcggggaagccgctgtccatggaggaggtggaggtggcgccgccgcatgccatggaggtgcgcgtcaagatcctnttcacctncctctgccacaccgacgtttacttntgggaggccaagggccagacccccatgttccct

SEQ ID NO: 47084 - DNA, 476 bp, Triticum aestivum
  Clone ID: PAT_TA_47084
cgtccgcccacgcgtccgcggacgcgtgggagaaagttcatgcaaaatttatttttcacatggatggcaagaaactccactatacaagcttgagaatttgggttatggacatgtcttggagggccctgtggttattatgaatgggaatagtacagtcatagtagaaaaagactgcaaggctgtcatcactaagtatggcaacataagaattgagattggtgcatctctgagtactgtagaaatatcagaaacagtggctgacgtagttcaactttctatctttaatcaccgattcatgggtattgctgaacagatgggtaggacacttcaaagaacttccatttctacaaacataaaggaacggctggacttctcttgtgctttatttggttcagatggtggccttgttgcaaatgcccctcatgttcctgtacatttgggagccatgtctagcacttgttgctggcaacttaaat

SEQ ID NO: 47085 - DNA, 597 bp, Triticum aestivum
  unsure (1)..(597): unsure at all n locations
  Clone ID: PAT_TA_47085
cgtgcgactaggcgacccccgcttcccgtcccctctctcctccacacgcctctctccctctcccctcgtccgccgccgccgccgccgccaccatgggcaggggcaagttcaagggcaagccaaccggccgccgcaacttctccaccccggaggagatcgcttctggaacttctgggcgtccacgctcgtttaagaagaatgtagctgaagcagaagaggaagaggaagaagtagaagaatctgaggaggaagaatccgaagacgacggtgaagagaagaaacataaaggaactgaaggtgttattcaaatcgaaaatccaaacctggtgaaagcaaagaatataaaagccaaagaagctgatgtaagtgtgttacaaccaaaagcatttatgactttactggtggtagctaaatatcataaaataccatgccacactggtgatagtattaagtttcctcgtcttttcctacattgccttttctatgttgtcatacaaatggcgttgcccagctantttcaatcaggaaaagtgaagtggagctcttacgagctttaaaatctcctttacacgttgatacaaaatattgccatacata

SEQ ID NO: 47086 - DNA, 286 bp, Triticum aestivum
  Clone ID: PAT_TA_47086
atcatatctgggcataactgtgccaaggaagattcatgaggagaattccctgtgtcagagtcgccatccaaaaggaatcggttgattagttgttgccagaaaaagcatgcaactgtaccagatattttctttattttcttgaattgaacgtagcgctagctatttttattggctcttggatattggctaggctggtcgccgggcaataagcctagcttatatgcgtttaagcaaatgtatacaatcgcatcagtgggttgttacaagttatgcggatcagtacgat

SEQ ID NO: 47087 - DNA, 480 bp, Triticum aestivum
  unsure (1)..(480): unsure at all n locations
  Clone ID: PAT_TA_47087
cgtccgccactaatggtttacatttccagggttacataactgcggaactcatatctaaactgccagtgagtgtccactaagacaatagtcctctccactgatgcgtatctaactgaccatcgggatatagacgcgtgtgcagaagcgagacgcactacgaatgctggctggcatacgttttgcgctctaaacatcacacttggcgactggaggntgcgtggtcagagtctgcagggtgagggattctccatcgcagctgtgacatcaacagtctcgccgtgcatttgcttctcctcgtgtgcaattccctctcagtgcccaggttcccctttgttgagctcggagctgcatgttggcagtgctctggtttggtcttcccggtggcaacggtggcggttactcatcttagctcttgggagaacatctgtatcttccgacggatcggcgcctcgtgccaggcgagggggcggggagcccttt

SEQ ID NO: 47088 - DNA, 338 bp, Triticum aestivum
  Clone ID: PAT_TA_47088
cgtccgtgccatttggatgccgtagggagtttagcgactccgatgatgaggaggaagctgaggctaagctaagagatatgtatgagggccttgatgagccagactttctggagaaactcttcacatttcccacttatgtaactctgaggaaagacaggaagggaacctgaagctgaaagaccggactcgagggcctcagagtgaaacagcattgcctgttttagcttcttgtggttcagttatagtaattttgtaagggcctcttcaatcttttagagtttgagaatggccaaattataacaggctacagttaaaaaaaaatcaattttgtacaaaaa

SEQ ID NO: 47089 - DNA, 464 bp, Triticum aestivum
  unsure (1)..(464): unsure at all n locations
  Clone ID: PAT_TA_47089
cgcgtccgacagtgtggcttgaagatgttcactcgatcggttcgggtgctggttcggaccacgttcggctcgagagagaggccnagtggctagcctagtctagggtttcggcagagaggaagggacatccatggccgatacggagtaccgctgcttcgtgggcgggctcgactgagccaccgacgacaacaacctccagcaggccttcagccagtacggcgagatcctctacgccaatatcaataacgaccgggagacatagaggtcccgcgggttcagcttagtcacgttatgccatgatgcgtctatgcgccacgccatcgtggagatgaacggtaaggagctcgacggccgcatcatgaccgcgaactaggcccagcccccacgctacggcagaggtggcgtatagtgccacctaaattgaaatcactggcgcgtggtttacaacgtctggactgggaaaa

SEQ ID NO: 47090 - DNA, 260 bp, Triticum aestivum
  Clone ID: PAT_TA_47090
cgtccgcggacgcgtgggttccaatgaaagaaaccataccttaaaatgcagccactatgttcctgccgtcatcccagaaaacattgcccttccatgtgggatctactgccaacggattagagcttgcagagcagacgcctacgaagctggtgtcatccttttggctccaaacatcacacgttgggcactggatttcgctggattagggctatcagggggagagtatgtcagccttggttggcacgagaaacaggatctca

SEQ ID NO: 47091 - DNA, 424 bp, Triticum aestivum
  unsure (1)..(424): unsure at all n locations
  Clone ID: PAT_TA_47091
gtcgcccgcgtctcgccgcccgcgcctcgcccggccgctcgcttgccgccgctcctctcctcccccgcgccccgctcctcccacctcgacgccgnctgctctcccctcccgcgccccctcgccctgcccatccaagctcagggtcgaggggcgaaccgggtccgggcgcggcggctcgatggtgagcgcgatggatttcgagatagctctagcgtgtggacacgttggtgagcgcgccagcggccgtggcgagctcgaacccgggataaacctagcatcatggtctccatggacgccggcgctgcacctgcgccgctggttggtcctccctgacaccgtccaggccctcctgcactgtattacccttctaccgggcctactagacctacaggaagtgctcatgtattaaattccagttggtact

SEQ ID NO: 47092 - DNA, 324 bp, Triticum aestivum
  Clone ID: PAT_TA_47092
cgtccgcttatctccaccgttatggtttaactagcatatgtggaggacgatgggaagacgagctggacgccagaagcaatattgcaacaccatgcgtgaggaaataacactgagagcttaattatctttgatgcaaccagtccggccaagtatgcaaatatccgatgcatgtgcaatcagtacttttgcatgtctgatgcatgtagaaagatccgaatttggccattaatttcccttttagtacttactaatgttcttattgatgtgggtgatccagagttgatttgggatgtagagattgaagaacagaaaaatcttaagcca

SEQ ID NO: 47093 - DNA, 212 bp, Triticum aestivum
  Clone ID: PAT_TA_47093
cgtccgcggacgcgtgggcacaccgcccaccagcgagccagcccagatgtttctcaccgacaagtaccacgccctgctccccctgcagcgctggcccgtcacccgtgggcctcgcaaggctttataaccttacactaccttcagtttcgaccaacaccttgacgtgcgccttgcgagacttcttgctttgcctgcctgccctgttggacctt

SEQ ID NO: 47094 - DNA, 159 bp, Triticum aestivum
  Clone ID: PAT_TA_47094
ttcgtggaaatgacagcgatggggccacggccgagcctccccatcttcaacgccatgatcctagggttatgccacatggggctcatccctgtagctgcgggattgcttggtgtcatgttggaagttccatgttacccctgaagcgtgcagctataacat

SEQ ID NO: 47095 - DNA, 192 bp, Triticum aestivum
  Clone ID: PAT_TA_47095
cgtccgaaacaatacaatcctctttctctttctctttctccctgcgacgcgacgtcctccgctccctgccctgtcttctcgcgcacactaaccaatccgagcgtccggcgccgcggtccaaatcgcacgcaccgatcggcccgggtactggcgtcccggccatgcccatcggaggcttattgccccgtgcct

SEQ ID NO: 47096 - DNA, 348 bp, Triticum aestivum
  Clone ID: PAT_TA_47096
cgtccggccgtgctccaccttctgctccccctccggctacggcggcgctgatctccgagatctctagcttttctgcgggggcgcgaatccggggggcggcgccatggccgagcacctcgcgtcgatcttcggcacggagaaggaccgcgtgaactgcccgttctacttcaagatcggcgcgtgccggcacggcgaccgctgctcccgcctgcacaacaagccgtccgtctcgcccacgctgctgctctgcaacatgtaccagcgccccgacatgatcaccccgggcgtggacgcgcagggcaaccccatcgaccccgtcaagatccagggcgacttcgaggacttcta

SEQ ID NO: 47097 - DNA, 199 bp, Triticum aestivum
  Clone ID: PAT_TA_47097
cgtccgatcgggctactgatcactcttggccatacccatgggatcatgtaaaattcacctacttctttaattttttcaaaacccagggcttagaattagccaatccaaaccgcggaggccaaattaaacctaaccatattaccctccccaaacattttaaacttaagtacccaaaaacctaaaaggaggcttttggggg

SEQ ID NO: 47098 - DNA, 286 bp, Triticum aestivum
  unsure (1)..(286): unsure at all n locations
  Clone ID: PAT_TA_47098
cgtccgatcacgcgtgtgctgactcttgtgcgaacacatgggcacccgcagacatccctacttccttcactctttacacacacgtggcagtggactagccnanncccacccatgtcgctaattataacttcaacgatttgacctacttcaaacatgtttataacgtatacatcgtctccatctaaatattgtaatatctaactgcacctaacaacttttacattctagttccaaattgatatgtataacattacctttgctctctaaaagtttatctaaggttaat

SEQ ID NO: 47099 - DNA, 421 bp, Triticum aestivum
  unsure (1)..(421): unsure at all n locations
  Clone ID: PAT_TA_47099
cgtccgcggacgcgtgggcgagcagaggtacttcgattgcaaggagtttccggccaacgacgaccacccgtcgcacgacgtcgccaggggccagaggtttgtcaaggaggtctacgagacactgcgggcgagcccgcagtggaacgagacggctctcatcatcacctatgatgagcatggtggcttctatgaccatgttcccacgcctgtcaaagtgcctcagcctgatgggatcattggccctgacccttactacttcaagtttgatcggctcggggtgcgcgtgcccagcttnctcatctcgccctgggttgagaagggcaccgtgatccatgaaccaaatggtcctgaagaaacctcacaatatgagcattcatccatccctgcgacagtaaaagagctaattaattacgtgctacta

SEQ ID NO: 47100 - DNA, 558 bp, Triticum aestivum
  unsure (1)..(558): unsure at all n locations
  Clone ID: PAT_TA_47100
cgtccgcccacgcgtccgcccacgcgtccgagaaaatcaggatttctcgaaaaatgcataatgaatgggaagtacaagactctaattctgaggtctagttcacttgatgggcctgaagagatcatagctgctgtatcatatcagatagtgccagctgacacacaatatgctgaaatacccctggcagccgtgacatcgccttttcaatgtgtgggttttggtcatatgttgtataaggaacttagccagcgtcttcacaatgttggtgttaccaatatattctgttgggcagataaggtctctgaaggattttggcttaaacagggttttgtgtctgttggagaggtggatactaaaggtaagattcgcagaattccagtaagggctgatatcaagagagcattatgctttccaggcagttcaacacttatggttacacatattaagaaggatttgccaactgcgtncaaaaaaccatgctttgcagaattgcaaacttctcagctccatgccgtggaccagatagcatctctcctgatgatatgaatactgcgttcc

SEQ ID NO: 47101 - DNA, 469 bp, Triticum aestivum
  Clone ID: PAT_TA_47101
cgtccgcggacgcgtgggcggacgcgtgggagctgatgctacatgaggaaaaggcggcagccatcaaaagattaaagaagaagggacaattgcctacagaactaacagaagaggatgaggatggtaaccgctggccaactaaggaagctttaatttctgcaaagagagttgactttggtacagacgttggttggcgtctactatgtgagcactggagtatactgaatttgagggttatctttaaccaacaagaggaacagacttgctaatggggacacggtcttccattgtagtggtgctagaaatgttgtcgccacacgtcaatttctgaaactcaaaaccgggaaagatcctggaatttttggtgcttggcttcacacgcacaaattgcatcgagggactgatgaaaagcagatatgcagtcaaagaacttgtgatcattggggggattttgataggcaatgaaaaa

SEQ ID NO: 47102 - DNA, 313 bp, Triticum aestivum
  unsure (1)..(313): unsure at all n locations
  Clone ID: PAT_TA_47102
cgtccgcagcatttatgatcttagccttgctaccaagcaaacccatgcagacattaatatgtacagacttgactgggacaacagtgtgcatgttgagtgcatgagcccgaccactacaaagcatgtcttgaacacctgggatgcttatgaagccaccaaggatgcctatggcattttcataatgactgactgtgatgagcacaagactctggactacaaaaagatctacgacagcatgcaaaatcccgcttttgtttttgatggnctcaacatttgtgactctgacaagctcatggagattgcttcattgtct

SEQ ID NO: 47103 - DNA, 548 bp, Triticum aestivum
  Clone ID: PAT_TA_47103
cgtccgagggaagcaaaggtaagaagagcgggcatgaaactgatgtacatggtgaggaggatgtttccacttctgatcaaccaaatgataaacattcagaagaaacatctcaaccgtcagatgcaataggagagcatgtttccgaggagagcactggagatacaggccgcgggcgtggcagaggccgagggcgtggaggtagaggcagagggcgtggctaccataacaaccataacaacaaccaataccaccataacaaccatccgcagcagcagcagcactatcagaacagcaacaatcaaggtaacaacaaccggagtggcgcccatcctgtcggaaccccgccttccagccacccagtgaaggccgagcagcagcagacacagtcatcgcctcccgcgggagcgaacaagcagcttccagggccgcgtatgccagacggcacccgtgggttctcaatgggcagaggaatgccgcaaacatcgacgcccagcatatcgactagtgaaccttgaacttgattcgtggccacaggagagacgagacac

SEQ ID NO: 47104 - DNA, 318 bp, Triticum aestivum
  unsure (1)..(318): unsure at all n locations
  Clone ID: PAT_TA_47104
cgattccnggtcgaccacgcgtccgctggtattaatctagtggggatagatatatgtggatgggaatctgtacgtcgattctagtctctaatctcgggttttgatgtcctgggctgcgcgtgggggccgggtaaattttgagctctcacctcacctcgccttagcaggttgaggttaccactgattcttgtgaattattactggatgccattagcagtgagtatataaatcagtcgccatggttcttcttccatggccgttgcttaaaaaaaaaaaaaaaaaaaaaaatattaaatatattaatattcaaattttntg

SEQ ID NO: 47105 - DNA, 401 bp, Triticum aestivum
  Clone ID: PAT_TA_47105
cgtccggagaattcctccaagacacaaggtacttcatcataattgatgatatatgggagttaggaacatgggaaactttgaaatgtgcatttgtcaagaatacattgggcagcagaataattatcacaacacgtatagttgatgttgccaaatcttgctctccttctagtgaagatcttgtctatgagatgaaaccactcagtgaggctgactcaaagaaattgtttttcaagaggatatttggctgtgaagaaagctgtcctgatagcttgaaagaagctgccaatgatattttgaaaaaatgccgtggtctacctctggccatcaatgccatttctagcttgttggccacaacaagggaaacaaaaagagagtgggatcgggtgcgacattcattacac

SEQ ID NO: 47106 - DNA, 476 bp, Triticum aestivum
  Clone ID: PAT_TA_47106
cgtccgattctatgcacgctcgcttcccccacttgctgcccgctctcttcgtcgcatcgcttcatcccgttcgaatgctctgtcctccggctctgcaccatggccatccgttccttcattggtgatgttggttgagcttccttggatttcgcgttggctccttcgtaggagcgtgggtcgttccgtccttgctgtccagattgttataggaatttccgtttagctcgtcgccgcgtctccattctgctcgctgaagtcaagaaatccaggagatggctcgtgtgccaatggttgacaggattgctccaccagaacttacccagcttattggatagaagtacaagctccttgtgtccattgcaagcagaaactttaatgtcaacaggacggctggagcatcagcgcctacttcactggttggcagtccagtgtcttcttggatgtttacaccaaacacactaaacatctataatgca

SEQ ID NO: 47107 - DNA, 460 bp, Triticum aestivum
  Clone ID: PAT_TA_47107
cgtccgcattcgttagctgccgccccctcaccccttctttgcttcgtcttcatcttcatcattatcaacaacccaccatcatcctcaacacttgtcggctcgtcgtcgtcgcgagggattggaggagtgccgttcattgcggattgaggaacgtgcattgccgcggccatgatgcagctccacctcccgccgccggcgtgggtgccgtcgggctacagtagccacggaccacgcccgcgcgccctcgccgtcaaaggtccatgccgtttcagcggcaaaggagatgccacccttgtggaaaccgccggctcacgcgtcgctctccagattgcgcaggccaccagcgtatcaagtgctaaagtgttgcaaacaaaccttgtcagaaatgatattcagattctagaacggaccgaggaaccatgtgacctcacgactactgtgtgattcctggggcggagtt

SEQ ID NO: 47108 - DNA, 381 bp, Triticum aestivum
  Clone ID: PAT_TA_47108
cgtccgatgacgcgaggctatgccaactatagtagcaaacaagttgacaggaacgataaagtgttttgtctacatatctcctgtcaatcgcgaatggcgcaaggctctacctaagaacattgacatcgcaacaagtgctcaactacacggcacagatcatgacccactcatcgaccaaacaagagacgatcgactggacatccccagaggaggaagactgtctgaggtacctacagccataacagcaggcggctgcaccagcgatgatactcacgccagaatcctacagctacagagagagctttgtaagaccgactccacatatgattctgcaaagctggcagaccgaataggacagctctctggccgagttgccgcgat

SEQ ID NO: 47109 - DNA, 408 bp, Triticum aestivum
  unsure (1)..(408): unsure at all n locations
  Clone ID: PAT_TA_47109
cgtacgcaactctcatcgcaattcacaacccgcgaagcgcgcgcacgctcgcccacgccaggtgctgctgagctgaaccggcggccgggcatggacgacacggcggcgacgctggcgacggagctggacgggctgctggccatggcgagggagctggaggtgcgcctcgaatgcgaccagggcgcgccgggcaccgacagggagctctgcgccgctctggccgcgttcgtcgaccgggccatgcgcctcgtcgggagcagcccgcgcggcggcgagcactgcgaaggcaatgccaccggcagggccagcgtgagcggcaggaaggccgccgcggggaaggtgaggaggcangtgcgggcggcgtctgtgacggacgcagggccgctcaacgacgggctcagctggcgc

SEQ ID NO: 47110 - DNA, 455 bp, Triticum aestivum
  unsure (1)..(455): unsure at all n locations
  Clone ID: PAT_TA_47110
cgtccgctttcatctcatccccgagaggagccgccgccgccgccgagaggaaacgccccagccccgagaggagccgccgccgctgccggggaacgagaggagccgccacctccaggtcgccgccgtcacacaccgnctncttcatgtcgccgctgtcacacaccgtctnctccaggtcaccgncgttgcacactacctcaggtctgttgatctctctcctcgccactcctcactgccagccccacacagctctgcctccatggcggggattcgctctatggcgttcaagagaggtggctgcatccaccatgccggcgatccggtccttgctgctggatccatacctctccacccctnctnctggtctgatccaatggcgttcgcacaatgtcgatctcccggatagcgtgaggtcctagcggcaacgtcaggccccttgcgaatggggtcaattt

SEQ ID NO: 47111 - DNA, 287 bp, Triticum aestivum
  unsure (1)..(287): unsure at all n locations
  Clone ID: PAT_TA_47111
cgtccgcccacgcgtccgcccacgcgtncgcggacgcgtggggcgagattgggtgtcgccgactggccgccccgtcggttcgagctccgatccacaacatcaaccagccccgcgagcactccgctctattctccccctgatttgtcgcgaccggcgacggcggattgaaggaggccgccccaccagcggagctcagatccaccggatcaacccgcgcgtgagcctttccccaccgactacaggaaccgggtcaccaagatacaaggaaggggattgggggagaaaag

SEQ ID NO: 47112 - DNA, 204 bp, Triticum aestivum
  Clone ID: PAT_TA_47112
tcttgttaaaatatacacaaagaccgtatcttactgtgaaatactggcacatgcctagtacacatatgcagactagactgcacgtacacaaacaccggtccttgcagggtttgtacacatttcagaccgaatcagatgtagcttagccatacagccaaacacgtcgatacgatacatcgtggtggctcatcaatgatgcacagc

SEQ ID NO: 47113 - DNA, 434 bp, Triticum aestivum
  Clone ID: PAT_TA_47113
cgtccgcggacgcgtgggcggacgcgtgggcggacgcgtgggccgaggttcaccaggatggtggtttagaaaatgtatcctcggtagcagatgctctaactttgatgtcgctgtattttgctctgtgtaccaagaagcactcccttctccggcgtgtatttgaaatatatggcagtcttccacaggctgccaaacaggcagttcacagacaagtacccattctgattcgcacgatacgttcctctcctgaccttcttggtatcatctcagatccaccagctcactgtcgggacctactcatgcaggttttacagactctcactgatgtagcagtgccatctcaagatctgatttcttccataaagaacttatattcaaaaactaaggatactgagttccttttcccaatcatggctcatctgccaaaagatgag

SEQ ID NO: 47114 - DNA, 321 bp, Triticum aestivum
  Clone ID: PAT_TA_47114
cgccgcagtaccgtccgaatcccggtcgactccacgcgtacgccacacgcgtacggaaaaacataagaagaagctgaagaaagaatatggtgttgagccatggacttttgagcagaagcttggcgacgcagttctcattcctgccgggtgtcctcaccaagtcaggaatttgaagtcttgcaccaaggttgcgatggactttgtttcccctgaaaatgtgggtgagtgtgttaagctgacagacgagttcagggcaacttcatctgtccacaaggctaaaggagataagctagagatcaagaagatgggcttatattgcgt

SEQ ID NO: 47115 - DNA, 523 bp, Triticum aestivum
  Clone ID: PAT_TA_47115
cgtccgcggacgcgtgggtcgagggtctttggccaagaacaaacccgattgtacacacaaacagttgtgggatcatatgggtacatggctccagaatatctatacagaggtgaaatttcggcccagtcagacatatatagtttaggcttattaatactcgagatcagtactggagagcagaactgcaaagacaaaaaccaaccctcagcaagaaactttattgataaagtacgcgaagagtggacactcgagcacatagcatccaagtatgcatccttagatacagaaggcctccatcaagtgaaaataagcattgaacttgggctaaaatgtgctgagattgatcggcgagtcaggcctcccatagaagaaattgttgacacactcaacggactacgtgcaaacgaaatggcaaacgaggtccctcatgcatctccagtgagcaagaagatgggttttctaggtggttcaagaagaaataaaacgttcgctattattggtggaagactcaaaatttggtttg

SEQ ID NO: 47116 - DNA, 380 bp, Triticum aestivum
  Clone ID: PAT_TA_47116
cgtccgcccacgcgtccggcgctgccggggcctccttccaggcggacgtggatcctctgactttacaatccctgccataccctgcctttgagtcactgacaggtgggccccatgctttgtggatcctctgactttgcagtcccttccaggcgcaatgtcggtcgtcgccgctgccgcctccattcaccccagcgccaccgccgacgggtccccgccgcagatggcgacgacgcgtctcgagcgcgggtccctgctggtcggcgggcgcgagctcctctcccagtgcccgcccgaggtcaccctacgcgcggccgtcgctgacgccgccccgggcgccgcgttcctcggcgccagcgcggcggcgccgtccagccgccacg

SEQ ID NO: 47117 - DNA, 471 bp, Triticum aestivum
  Clone ID: PAT_TA_47117
cgtccgcggacgcgtgggcgcgccgccgcggcggggccgggcctcctcctggccctgctcctgctcgccggcgcggccgtcgcctcggccgccgacatgtccatcatcgcctacaacgcggagcacggggcgcgcgggctggagcgcacggaggcggaggcccgggccgtctacgacctctggctggccgagcacggcgggggctcctaccccaacgccaactccatccccgagcgggagcgccggttccgggccttctgggacaacctccgcttcgtcgacgcccacaacgcgcgcgccgcggccggcgaggaggggtaccgcctcggcatgaaccgcttcgccgatctcaccaacgacgagttccgcgccgcctacctcggggtcaagggcaccgccgagaggaacagggccgcccgcgtcgtcggcgagaggtaccgccacgatgggtcggacaagctgccggaggcc

SEQ ID NO: 47118 - DNA, 469 bp, Triticum aestivum
  Clone ID: PAT_TA_47118
cgtccggccatgcctccgccgtcactgctgcgccctccgctctcgctcctcctccgccgctcccagactcggtgtcctctccgacgaatccccagcttcactccatcccatctacccgtcccgcccaagcggcggcacctctccgccgccgccgcgcagctcgccgacccgctctccgccgcaggggtggaggaggcagtggtgggcttcgtcgccggcaagcgcaaggccaccgaggtagcccacgcggtgtggaggagcatcgttcagaaaggagacacggtggtcgatgccacctgtgggaacggaaatgatacgtttgctctgcttaagatggtgtccgatgaaactgggcgagggcgtgtttatgggatggacatccaatattccgcgatcgatagcacctcctcttttctgaaaatggcctgcgacagtcgcgagatggagctagtcaagttggttacaaaat

SEQ ID NO: 47119 - DNA, 467 bp, Triticum aestivum
  Clone ID: PAT_TA_47119
cgtccgcttttgtttgagttgtcaaggacccatgcatgtcgagacatatgaaattcatgcttcatgtctttgattctcatatgaaacttgtgagttagacggcggtctatctgtgattttttttattttagcaaaaaagaaagagaaagaaaaaaaatacctgggccacggtcttggctttggcggcggcgacgtcgtgcatgacgccgctgtgcatgacggcgtccgagccccagaaggcgccgtacgcgcccagcggcgagtaggcggccacgaccacgccgtgcctcgcgcacacctcccgcaccttctcctgcctccaccccacgttcagctccacctggttcacggccggcggcacggcggcgagcgccagcagccgctccatcttggcggccgagaagttgctgacgccgacggagcgcgccaggcccaggcggcggcactccttcatgccgcgccacacg

SEQ ID NO: 47120 - DNA, 263 bp, Triticum aestivum
  Clone ID: PAT_TA_47120
cgtccgctttcgcttgagctgttacggggctatgcatgtcaacacatatgcggtcgctactatatttattagcaagtgcgatcaatgctcacagcgtcgacccctgctcttgctacaatcattgttcatacttgcatggtcagtttgtgaggtaaatgcttaccacccctcggtacttgtactgtggggcaaacaataacacagttctccagtggaagaaaccactctgtatcactacttgcttaatcctaacacgttcattt

SEQ ID NO: 47121 - DNA, 472 bp, Triticum aestivum
  Clone ID: PAT_TA_47121
cgtccgcggacgcgtgggcggacgcgtgggtttttttttttttttttttttggaaattggcatgctggaaccaaagtggcagctttcttatactatatcactcctggcatcagaaattgcataagaagatgcaaaagcgaacacaaaattactgataaccggggatttcaaatcaaagcacaaatcttgtgcaaacatccagacaacacctgaagctacaggactgcagactgttctcagaacagaacattatgattattaattaactttaagtattcactgcctcatataaacgcagcaagccacctcatctctgagccgtttccatttgacaaatagtatatctttttccacttctcttctgaaaaactttcacgtggaataatcttttgcctcatataatagtggcacacagtctctgcttcatctacggtgtaccgtggaaaaagcagacgagcatcagaaggaacat

SEQ ID NO: 47122 - DNA, 377 bp, Triticum aestivum
  Clone ID: PAT_TA_47122
cgtccggccacgcttcctgcctcccttgctaactccaaagctaacctcgaacgtcgcatctctcgaggccggtctgagcatcgaccatggcgtcctactgcggaaagtactggggtgagctcatggataacgctgtctacatcggtacctatagcaggggtattcgcgctggtgttgagtctactggtgccatcagcaagcgctttggcaggatctatgtcaagaacgatgaggacaaccgtgaggacctccgtgaggtcctcttctggatccttggtggcatccatggcgtcatcgaggtgatcatgtgtgaggagaccctggacgagaccatgaacggtggcacgccctttggcaagatcttcaaggaggtcaat

SEQ ID NO: 47123 - DNA, 382 bp, Triticum aestivum
  Clone ID: PAT_TA_47123
cgtgcgaaatcacaagattgctaacataattcgctgtatatatacagagaatagcgagcatacaatgctcggggaagggaacaatggttacgctgcccttccagcaactgtcactggggtcgtcatttgtggatgctctgacatatgcatcggcaccactgactctatcctgctgcggtaaagccttggacacgcattcacatcaatctaactatcaaggaagacgtccaaccggatcacagggaactactcctttgccattgaatataacatcttatcgatctatgcatgcttttaaactctgttaagatgaacctctttttaaatcacgtcagggttggcttggactcgaatgcccttttattaagatattgaatcatct

SEQ ID NO: 47124 - DNA, 476 bp, Triticum aestivum
  Clone ID: PAT_TA_47124
cgtccgaccacgtgtactgggccgcttggaccaccacgggcgcgcctacggccgactctatcgtcacagcaggagcgggcaccatgtacggttcggcgaccgcggactccttcacgcatggaccaccaccagcgccgacccgccccacgccgaaccgccttctatactgacggcgcgacacaacttacgtttgacaggctggtcaaccaccgccccccggtgatgatcaccggcgccccttcaccgacagagcgcgccacaacaactactagcgttgaagccgcccaagcatgacttttctcggttcgatggcactacaccttgcatctgggtcgagcattgcgtgtactacttcgagctctattgcgtgccgcctaacagctgggtgaccagcgcacgtctatacatggacagcctagcaggctatgtggctgcatgcgtacagatacaaacacgctgtagtcaattgggcaaca

SEQ ID NO: 47125 - DNA, 390 bp, Triticum aestivum
  Clone ID: PAT_TA_47125
tatgttgacttcttgcaagcagatagaggaggaggaggaggaggatgatgacaccagggggtggtccagtgggggggtcgctaccctgcacgaggtctccaagcacacctccaaggactaccgctggctcgtcatcgaaggcaaggtgtacattgtgaccaatttccttgatgaccacctctggaggcgacgacgctttgctgtcttaaactgccaaggacgctaccgacgacttcaaggacatgatacacaacacaaccgtctgcactatgattgacgagtactactttggcgagatctacgctaccaccaatcccatcatagtcaaggacactcctcccagatcagtcgcactacaactaggacaagacctctcgatttcgtctttaa

SEQ ID NO: 47126 - DNA, 476 bp, Triticum aestivum
  Clone ID: PAT_TA_47126
cgtccggccccggcgacggcggaggcgcacaacggcgagcgccccaccgacgacgcccccggcccctccgcgtccacctcttccgcctcagataacggaaacctccatagatcaagcactatgccgggggtgatcaaggataccgagataactactgaaactacgggaccatcaaatctggaaaggtcaaaaactgagaggcgcaaacaaaataatccagctgatgaccctactaaacagttattggatgataagatttccataaagaaaaagctcaaaatgttaaatcgaatagctacagtgaaggatgatggaactgtggttgttaatgtaccaagtactctagaagcgactccaattgacgctggagcagtggatggctatgaggatgttgttgttgaagaatcattagatggatcagatataccatacagacctccaatacaaattgttatacttatcgtgggtacaagggg

SEQ ID NO: 47127 - DNA, 472 bp, Triticum aestivum
  Clone ID: PAT_TA_47127
cgtccggcctcaaccccctcccctctgcttctatcccgccgacccgctcccgttagaaccctgtctaaacccgcaaaatcatcccaggattactctcctcctcgccccgatccgtccggagcagccgagaggcgccccccccccccccccccctgcccaaatccggagcttcgtctctggttgcgaggtatcccgctggggattcctggcgcggcgcctttgcttgtttgacccgtttcttggagtgtgagctcgctcacttggagcggcagatctcagcgctgcaccccagcaaaggctgcaagcccccccacccaagccttttctcggcccttcttcgctggttctggcaagtatttgcaaggggaaagtttggagaagcttttccgtcctgtgttttccccaaattggaagaggctttcttggatgagatttgtggtggaatctcagtagcgctggtggagatggggat

SEQ ID NO: 47128 - DNA, 181 bp, Triticum aestivum
  Clone ID: PAT_TA_47128
cgtccgcccacgcgtccgcccacacgtacgtggactcgtggtcggacgcatgtgatgatacaatataactcggagaaggtgtatctatgtaagaggcattcttaaaaatttttattatttaaatcatatactatttttttatcaaacaagatattatctatttatactgtatattaaccat

SEQ ID NO: 47129 - DNA, 465 bp, Triticum aestivum
  Clone ID: PAT_TA_47129
cgtccgcttgcccgtgaacaccacgagtaccaagcaccgagaaactaagagaggaaggaggaggaggaagaaggttctctgtactgatcgagagcggggggttttgatcttggctagcgagaatgcggcagatctcgtcgatgctgcaggggctggcccgctccatgtctctggggaaggagaggaaggaggcggaggagccgcaggggacggtgctgcggtcgtcggggacgctctggggcgagggctccgagaccttcgccgcggtgtgctcccgccgcggcgagaagggcaccaaccaggacacctccatcgtctgggagggatacgggtgccaggacgacaccatcttctgcggcgtcttcgacgggcacggccagtggggccactacgtcgccaaagccgtccgggagtcgctgccgcagtcgcttctgtgccactggcaggaagccgtcgcgctgacgt

SEQ ID NO: 47130 - DNA, 462 bp, Triticum aestivum
  Clone ID: PAT_TA_47130
cgtccgcttttgtgtgcaggatggctgccccggatctggacgcacgacctgcagctgctgcagcagctggacgacccaacgcacgagccctcccccctccctcatggctctgcttcctcctaccctgcccccctcacgtggacgtggtgagcttcttaccccccgtgcacatctcatctcatctcatcaaatccagattgctctggacgtatttattgttctggacacaacttggttcgcttcagtttgatgtcactcctttcctgccggagtgagttagtcaaatactcctactagcagtagaagatgtttgctgactttacaaatgatgagatagtaaaaaaactctaatgatgggtcagggccttccaaattatgggtatttagatctgccctccaagttaccacttgatgttatgagatgagccaacttgtagattttttgaaagggatcctgaattc

SEQ ID NO: 47131 - DNA, 469 bp, Triticum aestivum
  Clone ID: PAT_TA_47131
cgtccgattcatcaaccacgtctccccttctcctcctctcctccctctcccgagcccccgctccatgccctgccgcccctaaccacccatggccctctcctcgcgcgccgccgctttcccgcacgtctccctcccctccccccgcccgcgcccggccgccgtgtcgctccggcccccgcctcccccgcgctcggtgcggctcgaccacgtcatccccgccgacgccgccgagctcggcctcgccggcggcgggctcctggccgccgccatcgaacacctcgagcgggagcccgccgtcgtggtcgacgacaaggtcccgctctccgacctctcggcgagggagctccatctcgtgctcttttacttctcgcaggagggccgtgacgcctactgcgcgctcgaggtcttatactggttgtgtccggccgaccgctatgattgcgagaccatgggactcatgacagccatc

SEQ ID NO: 47132 - DNA, 244 bp, Triticum aestivum
  unsure (1)..(244): unsure at all n locations
  Clone ID: PAT_TA_47132
cgtccggcatcctctcctctcccttttcccctcgctcacttcctcctccctcaccggcagaaccctagccgccttctcttgcagcacctcagccgcctcctctccctaccgcctnctntccctatccacccagcccgcccctccctgacaggctccaccttctccctttcgcccaaagcaaggcgggccgggcgccccggccgaacaccttccccggaaggaacccggccggaaacaacaaggt

SEQ ID NO: 47133 - DNA, 463 bp, Triticum aestivum
  Clone ID: PAT_TA_47133
cgttcgccaacccaaaccctaccccgcgcgcgtcgcgaccacgcgcggaggcacctcccaccggcgcaagatgcagatcttggaagaccctgcggcaagaccatacgctggaggtggagtcctctgacaccatcgacaacgtcaaggccaagatccagacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgactgcggcgccggcaccttcatg

SEQ ID NO: 47134 - DNA, 288 bp, Triticum aestivum
  Clone ID: PAT_TA_47134
cgtccggagacacatagccggacgcttggacagacgcaaagctcggacatcgtgcacaccctcgtgtgcatgagcagactgtattagggtgaccatcatccagaccttgctagctctctcgccactaggttcaccgtgaggactatttcaacatagatcgaggcctgacgtcagcgctcactccttgaactgatacccagacccatctgtgggagcacgttacctcacctggtgcacgcctgcaccgtctgaggcatcaaggctggctcccaagcatcactttatggt

SEQ ID NO: 47135 - DNA, 163 bp, Triticum aestivum
  Clone ID: PAT_TA_47135
cgtccgcgcacgcgtaactggaaatttgcaaacaacatagctacctacaaatgctgttctctcggtgatcgtggccattcggttggtgtcaaacgccatatatgtctgtctctgatcctaaaaaagaagaaccaaaccaaagacaaaaaaaggtcgcgcacgg

SEQ ID NO: 47136 - DNA, 477 bp, Triticum aestivum
  unsure (1)..(477): unsure at all n locations
  Clone ID: PAT_TA_47136
cgtccggtcctgttgcacctggtactggtaatttgcgaagaagcacaaggaggtcatgtgcatacactgatggtggagcgaggaatgctatctctcatgtgaaaaattcttcccatgaagcatcaactagtgggagacaaattggtgcagacgtgcatgagtggggttcaccatcaaagactgctggtttaaggtctactaggaacagagttcctgatacacattcattggcagaaaagcctcaagtatcctcgaattgttggttgatgttgttggagcatgaagatatttaccgttatattcctcaacatggtgatgaggttatgtacttgcgacagggccatgaagaatatcttaatggaatgcgattatcggatagttgcccatggaatcggatcaaaggccttaaagctgtagagctttccaaaattcaggatctttgttatacaacttataaagggtcntgggaaagctgct

SEQ ID NO: 47137 - DNA, 463 bp, Triticum aestivum
  Clone ID: PAT_TA_47137
cgtccgcccacgcgtccgcccacgcgtccgtccccccttagatctcgcccacgtcgccgccgtccacatcggcgccgcagaaaggtccgccgcgcctcgctgctgtggagttcccttgcaccccaggtttcagagttatggcgagatttccaagagcccgaaacctcccagctcgtcgaggtaggtcatcttcatctgatgcgcgttccagctgttggaagacaaaagaagcagacgaacagagtgatttgccattggcctgtgagaaaagagaatggaaaggtgcaacttgcccagtttgcttggagcatccacatgatgccgtcctcctcctctgtacttctcaccacaagggttgccggccttatatgtgtggcaccaactaccatcactctaactgtcttgaacacttcaaagaagcttatgcgaaagagaaattggcccttggtgattccgccgagtc

SEQ ID NO: 47138 - DNA, 462 bp, Triticum aestivum
  Clone ID: PAT_TA_47138
cgtccgcccacgcgtccgctcttcgtccttgccggagtctcgcgccgccgaaaaccctcctcctcctcgccgataactctcccgccggagcccacctgccatctcgggccgagggaactcttcctcctcccacccatccacccggacgcggttcctctcgctggtaaggcagccctagccggctagccccgcgccaagccgatggacgaaaccctagccgccgaagccggtgccgccgccgcgacggaggagaaggcggtcccggagagggagcaggagacgcttgaggaggtcatctcaaggcataggaaggagaaatccaaactccaggataaggaaacaagtctgaagaaagcagctgccaaaggcagcaaagctgagcagaaggccaagaaaaagcaggtcgaggaagagatatcgcgcctctcagctgcattagaggcgaaacatgctgcagagctt

SEQ ID NO: 47139 - DNA, 477 bp, Triticum aestivum
  Clone ID: PAT_TA_47139
ccgacgcgtccggcggcgttgtataaatccggccgggaaaattccaccggacgccacgccacagaacgctcccggcctgtctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacgtagatggttgcatcaccaccaaggagctgggaacagtcatgcgttcgctggggcagaacccaacggaggctgagctccaggacatgatcaatgaagtcgacactgatggcaatggcaccattgacttcccagaagtcctcaacctgatggcccgcaagatgaaggacaccgactcagaggaggagctcaaggaggccttcagggtgttcgacaaggaccaa

SEQ ID NO: 47140 - DNA, 474 bp, Triticum aestivum
  Clone ID: PAT_TA_47140
cgtccgcgctgcgccatggcgggagaggagcagcccctgacggagtacgagaagcagcgactggcgcggatacgggagaacgaggcccgcctccaggccctcggcatccgccgcctagcggcgtcccccatcctcaaccagccgtcctccgcggcggcggcggcggccaccaagagaaaacagaagaaacgatccgacgatgcggacgacgagtacctcccgtcggacgggggtggcggcgaggaagaggaggaggaggaggacagctcgtcggccggtgaccaagactccgaggaggagttcaaggcttcctctaggtctaaccaaaagggaaaggcaaagaagaaaatgaacttgggaagctcttctaaaagtaccgttagagaagaaggtgctcccttcaccgattttatggatgacgatgcagccttacaacaagcgattgcgctctccctggcagaaccttcaaaaagg

SEQ ID NO: 47141 - DNA, 517 bp, Triticum aestivum
  unsure (1)..(517): unsure at all n locations
  Clone ID: PAT_TA_47141
cgtgcgttgacgcacggtcaaatcgtccattttattaacgcgtcgagatcgacagcagcagcaggacatgacagactggacaaacgaaaactacgacggcgatgaagaggcagccgcaacaacggcagaatgacaaccttcattattagtcactctgacttgcatcgtttcttcgttccgcctcaagccgagcagttgactcgtccctggtgaagactatactcattctgcgcatgctcctcctccattccacccacccccaccagctgtttccatgtggggaactgcaggttatatggcagctccgcctccttataatccttatgctggctatcctgtgccggcggtaccaatggcttcaccttctcctttgccaggcccaacagcatatgctcctgtgcagaacatgaaagataaccctccctgtaatanccctttcattggaaatcttggtgaaactgttgttgaagaggaattgcggggcctcttcagtctacaacctggtttcaaacaaatg

SEQ ID NO: 47142 - DNA, 464 bp, Triticum aestivum
  Clone ID: PAT_TA_47142
cgtgcggatcaactgcaccgcccttcccccgcgccatgcagtccagtacgtgggtgcacgcagcacgccccaccggcgtcgtggccgtgcaatccaaactgtgcatgcagtactctaggtgtagtgcatcgaccgcacggcttgcggttcaggcatcacgcgagttgccgttcggtgccttttccggcgaggagcagtggcagtagtagctactagagcagagtagtgggtggcggtctggcatggaggctgtttgatccattgctcatggcctctgctggctccgccgctactcttctctcatttcttctgctcattgactgcaggttgcctctgtccagccgctagcaagctggttccttccttctgaactgattcctctctgctgtatatttcctcctctgagccaactactgctgtcgcatgaaggcatctattattgagctttttttctcctctgattt

SEQ ID NO: 47143 - DNA, 569 bp, Triticum aestivum
  unsure (1)..(569): unsure at all n locations
  Clone ID: PAT_TA_47143
cgtccgcccacgcgtccgcggacgcgtgggcgacccctaccgcacctggcttccttcctgactaccttggcgggctagggtttgacgccgccgtgcctcctggtcgtcctccggttggtctctagaggaaacggcttctaccctccttccgaaccctgtgagcacggatatggctcctcccaccgctcctccctctcctgcttggagccgcctgtgaccacggatctggctctcctccaccagcggcggatgggatggcgcggttccacctcttctccacaagcgccggctgagacgacgtggattcgcatctcctcctccctcctttccacggccgcctttatccgttgcgcccccgccttgcagttccgcttctggacggagatttggaggagtacccgccgctcacggtggcttcaagccttgttcccaactggccctagaggcacaattttatggctcatttatatatggnggcagggggcttcaagcctttttcccaacccgccgctcacggtggcttaaacccttcttcactaagggtgcaagctcgactgattcaacggtct

SEQ ID NO: 47144 - DNA, 524 bp, Triticum aestivum
  Clone ID: PAT_TA_47144
cgtgcgaaatttcgaccaatatttgaagctctcagcaccatgttccctcagatacatcactttgctgtcgaagaatcttctgcgacgcctagtttgttttcaagatatggtgtccgtggcttcccagccattcttctggcaagtgagactacaatggttcgttacaggggcacaaaagatctgaagtctctggttcagttctatcaagagactacaggcctcaacccaattacatatattgatgttgatcagcaagagagcactggaagtttaggatcagccatgccaggaggccgctctctgcgcaaaatggcgaaagacgagccctttctgtttcttggagccctttttataatcatgaagatcgcggcacacttcgtccccactgtcatctcccaactgagagccttcttgattgtgcgtgttcagaacttgaacttaagaatccgtaggggatcaagccaacttatggaacgggcattgactgtgcttgatgttcagaggctctggagcaagcttagact

SEQ ID NO: 47145 - DNA, 721 bp, Triticum aestivum
  unsure (1)..(721): unsure at all n locations
  Clone ID: PAT_TA_47145
ngtggaatgcaaccggagccgcaaattggcgccatctcaggacctgaagaggaagagggaagtatattctgtgaataaggcacaatgtgaggcaagggcggtcgtgaagcctgttaaggggcaatgggagtacacatcagttcggagtgagcacaaccatccgttatgtccaagcccgtcactcacaaaattcttccttagctgcaaatacatgtcagctgaagaaaaatcgtttttaagagctctgcaacaaagtagtatacatcccaagaaagctatgaagatcttcaagagaatgagaggtattttggggagcttaccattcaacacaaaagatgcgaatacgtcacagtgtgcagaacaacagggaaaaccaaactcggacgtagaaacaacagtgaagcatttgaaggaactggagctgcaaaacccatgtgtttccatcaccatgcaaacagatgaagatagcatagtcaggagtcttttctggactgatgcaaggtcgaggcttgattatgagatcttcggagatgtcttatcatttgataccacctatagcacaattagtcacaatatgcttttcacttctatcagtggaatgaatgaacatggaagaactctcgtgtttggatacgccttgctacaggatcagaaagctgaaaccttcaaatggatgttccaaacatttctncatgtaatgggagggaaaatggcaagagca

SEQ ID NO: 47146 - DNA, 503 bp, Triticum aestivum
  Clone ID: PAT_TA_47146
tcgaccacgcgtccgcccaatcgccgccgccgccttctccctcccagatccaatcctgcgcgcgtcggccacctccctccggcggagctcgacccccacgccgcgccgctgctccaccctctcccgcgagggtctctgctacccgcgcgcgcacaaccttcgtcccctgttgctccaatccggccagcgcgccctccacctcgtctcccccgatcccgaccgtcgtactccgtcccctgtagcagtcgtactccaccctagcagtcgatcccgaccgtcgctgcttcaccagcctcctcctctggcgtctccgcgagggcagccgatgccagacaggccgtcgacgcgccggacctcaaggccggtcgtgctgctccttctgcctgcgtctcctcggcgcagacgacggcgacaaggacgctggcgcccgccttcttcctcccccagctcgtcttctccccggtcgctgccttgcatgccgccacccaatccatctatcaatc

SEQ ID NO: 47147 - DNA, 608 bp, Triticum aestivum
  Clone ID: PAT_TA_47147
cgtccgcacggaaccaacaaatccccacccaatctcgtctccgatcgactccacgctcgtcgaatactcctcccccaccgcctcaagatgcagatgtttgtgaagaccctcactggcaagaccatcaccctagaggttgagagctgcgacaccatagacaacgttgaggccacaagccaggacacggagggcatatcatggaacaaatcgcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttcacctggtgctccgccttcgtggtggtatgcaaaatttttgtgaagaccctcaccggcaagaccatcacccttgaggttgagagctctgaca

SEQ ID NO: 47148 - DNA, 529 bp, Triticum aestivum
  unsure (1)..(529): unsure at all n locations
  Clone ID: PAT_TA_47148
acgcgtccgcggacgcgtgggtcgccgcgccgggacccaatcccagacccaatcccctaaacccggccccaaaccctagcgccgccgccatgctgcgcggcctcgcctccgccgccgccccgcgggccttcttctcgccctccccggcggcaggccacgccccgcgccgcgagtacgggctggtccccatggtgatcgagcacacctcccgcggggagcgcgcctacgacatcttctcgcgcctcctcaaggagcgcatcgtctgcatccacgggcccatcgccgacgacacggcctcgctcgtcgtcgcccagctgctcttcctcgagtccgagaaccccgccaagccgatccacctctacatcaactcccccggcggggtcgtcaccgcgggcctcgcgatctacgacaccatgcagtacatccgctccccggtcaccacgctctgcatcggccaggccgcctccatgggctcgctgctgctcgccgcgggcgcgccccggnaagcgccgcgcgctgccgaacgccc

SEQ ID NO: 47149 - DNA, 461 bp, Triticum aestivum
  Clone ID: PAT_TA_47149
cgtccgcccacgcgtccggcaccgccgtcctctcctacgtcctctccatcgccccctccgaggccgcccgcgcctccgcctccgacggcgcgaccccgctcctcctcgcccacgccggccgcgcaccctccgcgccccacgccgcccgcctcctcctcaccgccggagcgtccgccgactccctcctcgctctcgaccaccgccatcaaaccaccagactccccgccagccccaccaagaaacaacaacatcccgattcctcctcgccgccggaggccaccaccaggaagaccaccaccaacaaggactattcggacttggcccagacggaggacatcaacgcgggcgtcttcgccaccgacgacttccgcatgtacagcttcaaggtcaacccatgctcccgcgcctacacgcacgactggaccgagtgccccttcgcccacccgggcgaagaacgcgcg

SEQ ID NO: 47150 - DNA, 339 bp, Triticum aestivum
  Clone ID: PAT_TA_47150
ccgaaaaaaaaaaaaaataaaaactaattatacaaaaaaaaaatgacatataaacaaaatattatcttttacactacttctttaccggcggcgggtagacccgcaaaaaaaaaaacctcctccaatttaaatacttttctacttaacccccccactccatttggtgcccctcttttttattttttcaacactcaacgccgccctacttctttgtttcatgaccttttttttgactttaaatcactctctaccccccccgttttttccaaaagccttacctttattaccttcactacccccaaataaaatctccttaaacacacttgttttttccctttt

SEQ ID NO: 47151 - DNA, 502 bp, Triticum aestivum
  Clone ID: PAT_TA_47151
cgtccggccacgcgtccgggcaccccttcgtcttggtcttgctattgctaccgcgattaccaccaccgacaatcgcagacattatctccgacatggattctgtcatgcatcctttctcctcggcttcatgggtgggtgctaggctaggtgctaggcgaggggcaagtggtgaggacgaggaggaggaccgtgatggagtgcatgtgtgactgctgctactcggccagcaactcgtgcggcaccgcgtgcgcccgctcctatctacgctcggatctacgctcatcagaaccacgatcaagatcacggtccaggccgtgctcaaagccaccgacggatgcacctacagctgctgctacagctgcgagcaggtcttcctggccctcgcgctggacaacaccaactacgtcatgcacttgcgctgattccggcacggagccatacactagttcatcatcatcgtcgcccagaccatccagcatggcacacagcctggccaacagca

SEQ ID NO: 47152 - DNA, 542 bp, Triticum aestivum
  Clone ID: PAT_TA_47152
cgtccggcccgatcccctcgatctctctctcaccatctccctcccgcatcaccgcagtctccctcgtccactcctcctcgagcgggggcgctagacccgcgcccggatctcctcctccccgttcgtccttctcaccgggagcccgagctccgctggatccccctcgccctcgccgttcagcaccggcgccgccctactgcttcgtccatgacctccgccagacctctcctgcacctccgccgtcgccggagttccccgtgagcctcccctcgcttgcgtccacaaccgcgaggcagtgcctcctcacgcgcccgtggtcctccccttcttcgtcttgagcggtaacaggagcgtcgccgagccctcgtgcccgcgaccctacagccgcgctgaccatcagctccggccgctgagctccctactgcgcgtgtcccgtctccgacccctgcgcctcgcccgctggctagtcccttctccggcgttccttgttcccctctccctgctcacctcgccatgctcctatcccgcggtctgcctcccac

SEQ ID NO: 47153 - DNA, 492 bp, Triticum aestivum
  Clone ID: PAT_TA_47153
cgtccgcggacgcgtgggcggacgcgtgggcaaacccccaacccgcttctatcctccgctccttgcacacaggcagcggcgcgccgcgccggggcgtcgccgcgcgcgtgcaagatgaacctaggacgcaccacggtccagattcacaggatgcagcagcctataagaacacccggcgcccccgccgtcgctcggttagttgcgagcgcccaccgaaagcactgcgaggaagcaagaagtagcggcgggcctcctcgccgcattccaccaaatttccctgtaggtaggtctccattggagtcgattagagccttgaatcggaacggttttcttgagcctgcgagttcttgcctttcctcaccaatttggtcgcttcccagctcctggaagaggcccaagcgaagcctgaagtttccaccgtgattagcagctaatcagcgtctttcgctagttatctgaattctgaagaagcggattgagcaaacaagaact

SEQ ID NO: 47154 - DNA, 515 bp, Triticum aestivum
  unsure (1)..(515): unsure at all n locations
  Clone ID: PAT_TA_47154
cgtccgcgtgcgcgtgggagcagcagagcccctgcttgccgacgaccctccatccctgatggtccgcacgaagcatacggcgcgcaagtgcaccggcggtaaggcaccgaggaagcagctggcgaccaaggcggcgcgcatgttcgacccggccaccggctgcgtgaagaaccccgaccaggttcgcccgggcacctgtgccctctgtgagatccgcaagtaccagatgagcacggagctgctcatgcgcaagctcccctttcagcgcctagtgcgggaggtcgctcaggacttcaagaccgacctccgcttacagtcctccgccgtctacggcctgcatgaggccgccgaggcgtacctcgtcgtgctctttgaggacaccaacctatgcgccattcacgcctagcgcgtaatcatcatgcccaaggacattcagctcgcgcgccgtatacgaagagagcgcgcctatgctctgtacgcgccccgttcgccgngcttgggtgctagctgtttta

SEQ ID NO: 47155 - DNA, 459 bp, Triticum aestivum
  Clone ID: PAT_TA_47155
cgtccgcacgcatctctctcggctccggcaagcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgaagccggccaaggagaccaaggccaaggcggccaaggccaagaagccctccgccccgaggaagccccgcgccacccccgcccacccgacctacgccgagatggtgtcggaggccatcaccgccctgaaggagcggacggggtcgagccagtacgccatcgccaagttcgtcgaggacaagcacaaggcgcacctcccggccaacttccgcaagattctgtcggtgcagctcaagaagctggtcgcctccggcaagctgaccaaggtcaaggcctcgtacaagctgtc

SEQ ID NO: 47156 - DNA, 349 bp, Triticum aestivum
  Clone ID: PAT_TA_47156
cgtccgcggagacccagcgaagcctggccagaagtggcacatctactatgccaccgagcaacctgagcagcccatggtcaccctggagatgtgcatgactgggctggacaagaagaaggcctctgtcttcttcaagactcaagctgatggccacgtttcctgtgccaaggagatgaccaagctctctggaatctctgacattatccctgagatggaggtctgtgacttcgacttcgagccctgcggctactccatgaacgccatcaacggatctgccgtctccaccatccatgtgacccccgaggacggcttcagctacgcgagctacgaggtcatgggcatggacgcc

SEQ ID NO: 47157 - DNA, 463 bp, Triticum aestivum
  unsure (1)..(463): unsure at all n locations
  Clone ID: PAT_TA_47157
cgtccgcccacgcgtccgctgtttcgccgctcctcccagatccgcgcgtgcgttcctgttcccgttctcatccggcggcgtcgtcttgccggagactcgactgccccttccgactcgaatctcggcgatttcccaagcgatgatggcggaggtaagcgctcgccccttccccttcactcccaattcgttgttggttgttgttgttcggcgcgccgccctcgcaatcgatcgaattggtccgggattcccgagatctgacgctgattgcttgattgttgcggacggcaggaggggcacaaggtggcgctcaacgtgtacgacctcagcaacggcctggcgcgccagctctccacctncttcctcggcaagcccatcgaggccatctggcacacgggcgtggtggtgtacggcaacgagtacttcttcgggggcgggatccaggcggcgccggcgggggcgacgc

SEQ ID NO: 47158 - DNA, 448 bp, Triticum aestivum
  unsure (1)..(448): unsure at all n locations
  Clone ID: PAT_TA_47158
cgtccgcggacgcgtgggtggcgccaagtgagccgccccacacctatcgccccgagccggccacctcctccgctccgctcccgaccggacgatccctcctggacccggtccaccacacttgacccccagcgccatctcccccctctccgtgcccgcccgcttccattccctcccaccactccacccatcatccccgacgccgcgacgaggggcgcggctctcccccagcccaccccgcccttccttccttccttcctccccgaagcttcggggagcctcccgagcaatggcgaggctgctcgtgctccgctcggcgccttaccaccggtccagcctctccgccgccgccgccgccacctnctnccgctccgcgtncttcccccgcctctcccgccgccacctgccatcgctcctccgcgtgccggtccgcgccgtcgagtcgtcttca

SEQ ID NO: 47159 - DNA, 253 bp, Triticum aestivum
  Clone ID: PAT_TA_47159
cgtgcggccaaaccagttgccaatctcgccctctccaccccaacccccaccccccgaatcgaatcaccgaccaaaccaagcaacggaacgtagcgatggaggaggcctgcgagatcgcgcgcctgccggaggagctcgtctcggcggcgctggcccgcacgtccccgcgcgacgcctgccgggccgacgtggtgttcccggtcttccgcgccgcggccgactccgacaccgtctgggcccgcttcctgccccc

SEQ ID NO: 47160 - DNA, 526 bp, Triticum aestivum
  unsure (1)..(526): unsure at all n locations
  Clone ID: PAT_TA_47160
cgtccgcggacgcgtgggcccaccgtccgcaaccgagctaaatgaagtcgacanagctagcagcgacctgacgttcagaacgtgcccggcgatgttctcgacgttggaagacggcacggtggtacggngactcgccggggtgcccgaggacggaccagtgctgctggtaggcaaccacatgttgctggggatcgagctcatctctcttgccgcggagttcatgcggcacaagaaggctgtcgtccgtggcattgcacacccgctgctgttcccaaagaagacgaagacgtggtcggagggacacgacttcttcgacttcctcaacctgtggggcggcgtgcccatgacctacaagtacatatacgagttgctggcagctggggagttcgtgctcctctacccaggtggttacagggaggcaatccactgcaagggtgaagagcacaggattttctggccagaccagactgaatttgttaggatggcagctcagttgaatgccacaatcgtgccgtttggagtcgtc

SEQ ID NO: 47161 - DNA, 432 bp, Triticum aestivum
  Clone ID: PAT_TA_47161
cgtcgcgcccacgcgtccgacgcaaaccagattccacttgccagtgttcatcctgccatattccagctctggtgttgcaaggcggaaagagggagacaaatcgtggctcctggaagacaatggatcggtattcttctgtggcaacaacggccatttcatccatcaaagcacgccactctggttttggtgcgattggtggatgcataccatgttcaagagtagcagctgtaaaacgttgaagcgttctaaagcataaatgctcctccccaaaggactgctcaatgacttcaccttggacggttacccgaagtgattcatggaagaggagggactgtcgtaagagagagtcgtcctatccatgatgctatactgtcacagctgccagtgtgcctagatgacacactgaagcgtatccgatacggtagctggcat

SEQ ID NO: 47162 - DNA, 419 bp, Triticum aestivum
  Clone ID: PAT_TA_47162
cgtgcgatcaaagcatactttggtttatctggaggatacaacatccataatttggttgaccatttccatcagcgtggtctgaaccgttcaatatttctcagtataatggatggagaagaatcattgtcacgttattctcctgaaattgttgtcaaggagtcaagtgcccggaccatagctctactgcctcgtatattccttatgcatggaacagatgattattcaataccatcatctgccagtcaaacttttgtagacgtccttcaacaagttggtgcccaggccaaattattattgtacgaagggaaaacacatacagatatatttatacaggatcctcttaggggtggaagggatcctttggttgaagatgtcttctctattatttacgccgatgatgcaactcgccgaaatacagc

SEQ ID NO: 47163 - DNA, 502 bp, Triticum aestivum
  Clone ID: PAT_TA_47163
cgcaggcctgctccatggtcgccgatttcatgacgctgtcgcgaggagccggcgcgagctacccgaggctgaggacgtttgatctctggaagctgcattcgtgggccgggggcctgacggagttcggcgacgggcgcaaccaggagagcaccagcgaggccgtgaacgcctactactccgccgcgctcctcgggctgagctacggggacaaacacctcgtctccgccgcggccacgctcaccgcgctcgagatgctggcggcgcagacatggtggcacatccgtgagggcgacgcgatctacgaggacgacttcaccagcaacaaccgcctcgtcggcgtcgtgtgggccaacaaaagggacagcggcctctggttcgcgccgccggagtggaaggagtgcaggctgggcatccagctcctgccgatcgtgcccatcagcgaggccctcttcccggacgccggcttcgtcaagggagctggtgaagctgaccgcgcccggcg

SEQ ID NO: 47164 - DNA, 268 bp, Triticum aestivum
  Clone ID: PAT_TA_47164
gcacgggaccatgactagcgcggctcggacttgttgaaaggcggcgagacgatacagtccctcacgctctcagacctatatgacactcagggacggcgccggcatgcccaagctcaagggcgtcgacccgtcggtgcgcgcaaacatgctctacctggacaccacgcacgccgccagagatagaaaggccgtgaaggaaggattgtttcattcacctgataaaacgtatctggttacaaaagttgagcatgtatcactttaggatgtt

SEQ ID NO: 47165 - DNA, 400 bp, Triticum aestivum
  Clone ID: PAT_TA_47165
atttttactactcttcgagcttttgaagtggcttgttacatcaattttcccggcatgcatcaaaccaagctcttggtctttatgagaattggacattccatacttaggagagccacttttacttctgtgacgtgttccaagatgaataaccaacttggtacctttccctgtggcaccctaggcattattttcctcgccctatatctttgaaatgcaggctcggcaccttactgcctttagatttgacttttgggatcatatctgcactggttggtgcagcttttgcagatgtggatatcagatccttcttctgaacttcgagttgaagattaaacaaacacattctcattatacttggaagcaaacctctcatgattaacatttccaggatgacctccca

SEQ ID NO: 47166 - DNA, 443 bp, Triticum aestivum
  Clone ID: PAT_TA_47166
cgtccggttacttgtctccatctctcccgcgtctcgattccccaacccaacacccgagcaaaccctccccaccgtccgcgccatgggcggggagatgcccggcaccgacggcgagggccactccgcccccgcccctgcctccgcctccggattcccgccgtcggcgccgccgtattatcaacagcagcagcaccagtacggcaccttcggagccccgtccgcgtctggcgagttcccgcagccggcggtcgggttcccccagcctgctccgccgcctgggttccggaactacccgccgccgcctccgccgtcctacgcggtctaccctcctctgcaggcttattcggacgccgcgccctactacgcccagggctaccaggccgtgcaagggtatatacctgttgttgaaggaagacctgtgaggaggcgacgtcttccatgct

SEQ ID NO: 47167 - DNA, 500 bp, Triticum aestivum
  Clone ID: PAT_TA_47167
cgtccgagttattgccatatgctatccaatcccccctgctcggatctgacatgggtgtcagtgaccgcgacctcttctggcggctctgggcgatctgctgtcctgatcggcctggtgcgctcggcggtgggagcctagtgggctgaggtccatcatggctcacggtttttaggtcggcggccgtttgtgatggtccttcagctattcttggtgcaagaggatggttgtggtggtcatccatggtgatgattaggccgacggcgtctagtcttcacaacggcaaggggctcgacatcgacggtgagtttggtggactagcctgcttagggattggaaggtgagaacgccggcgaaagtcgatgacgatggcgcttgcgagcgtcgttaccttcatgaaggcatcagagttgtgggtctttccttttactccctccggtcctattttgctccgtatgtagtccatattgaaatctctaaaaagacttatatttagaaacaaa

SEQ ID NO: 47168 - DNA, 461 bp, Triticum aestivum
  Clone ID: PAT_TA_47168
cggccccattgccgccacggtcacggttactcccattcgcccaccccaactcctcccggccgcctcctgctccccgtcgcctcctgggcggagcgggatactggcttctggagccctcgacgaagagggtttcgtccccgccggagacccacctctcatcaccaccaccaccgtcgttcacgaggtcaccttcctgacgctcgtgtggagggttcttctgaacaaagaatacaaaatgaagtgcaacgcttgctggcgggagttggaagggcaagccataacaacaacttgtggtcatcttttatgtacagaggatgcaaagaaaatactcagtaacgatggtgcatgtccaatttgtgaccaagtactttccaaaaaccatattaagccttactgcataaatccaagcgatgaaatggacaaaatatgtcaaaagacgtggaggttttctccaccatttt

SEQ ID NO: 47169 - DNA, 462 bp, Triticum aestivum
  Clone ID: PAT_TA_47169
gcatgcaacttgcaaccaagaggttcatggttcaaaaccacaccctacaatggacggtgctgtcactacaacagttaacaacagttttccaaatatattcttggagttaaacacaacacagaatcattcagcccaaacgtaggaccactatcttcaaacggttacccgagttaagtaccatataagttatatttaaatatggcgtgcaaaagataatatgtccggttatgtctatgtctcaactaattccttcgtagtaagttgacgctactgagtaagccttgtgtccgcagcaactcctggtagagcagaagtggccgaacaggggcgcaaaaagctggtaacagtatgccatttagcggcgccttctcggatgatcatcaccatcatcatcactgtcccttgactggctccttgacctgagccgccctcggcgctcccagtcatcgtgctcagcgtact

SEQ ID NO: 47170 - DNA, 545 bp, Triticum aestivum
  unsure (1)..(545): unsure at all n locations
  Clone ID: PAT_TA_47170
cggacgcgtgggcgatcccaccgccgccactcacttcctcggattccatgccgaaccaatccctgcatccctctcgatccaaatcctcctcgttttcctgtgctgccagatccaaccagcgccttgcctcttctacgaaccggggagcagagacccaaggccgcctcgagctccatcgctgtgctacgccacctcctcctgggatccttgccgtttcccgctccccgcgctttccttcttgccggagccaagccaccgttgccgccacgcaatccccgtcgctgcctcgtctgctcgttctcgaagacgttgaccgagccatccccaacctccatggagcgccgcctgctccagccgaagatccctgcagcctcgcgcggtcaaggcctcgagcaggagcgccgttcctgtctcctcgcgaccttgagcatgaccttgctcgcgcctcctttggttcccgaggctgagccgccccgtgctcgcaatcctgcatcggcttctttccgtgttgcctcgccggtcattgacgctacctntcgacctcg

SEQ ID NO: 47171 - DNA, 536 bp, Triticum aestivum
  Clone ID: PAT_TA_47171
cgtccgattcaaacacatgcatgacacaagggccttgcggctgtggtcttcctgtactatatctgataagacacaacatatgctgattggccctgatctttcaccacacactaataacttcttttcttccaacaaatcactatttgttttcctcatctgtccaggtgtttgtttgatcttataggcttcttcatatcttgcatttatatttgggttattgttattcatcaagacgtggcagtctactcccctattttgggtgtcaagacgtgccacttgtgtttacattttgtctaaaactcatgaagactgaaggtgtgcctggaaaatcttcagttttatggatcaaaggatcatctggcaactgatagagtgatagtcagtgttttgatgctgatcatgtttgcagttttgacatccaggattttcaagagaataaaccggctaccatatcagtgcacatgtggagccagttcagatcataagcagtagtagtagtctcatggtaatgcattgcaaggcaatgtgcaattttg

SEQ ID NO: 47172 - DNA, 499 bp, Triticum aestivum
  unsure (1)..(499): unsure at all n locations
  Clone ID: PAT_TA_47172
cgtccggcgcttttggctttcgcatctcaaccgtgcgacgacgcgaggaatcaacacgggcgccatggagaggaccggttccggcgctgacggcacgggtcctagcacctcctcctactccaccgctgtctcaggatgcgaggaggcggaggcggagcgtcgagaggctccccaagatggatgaggtggaggaggagaggacgcatcctgtggagatggagactctcgctacgccggcgaggagcaggacctggagccccgaggagctggacgctacgctgttggggatggcgtccgcaccaccactacctgccccaccgccgcagcctcgccgtcgccgacgcagcctcgagaggcttcccgagatggtggaggtggaggaggagaggacncntcccacggagactcgcgctacgccggcgaggagcaggacgtggagcccggaggagctgggcgctacgctattggagatggcgtccgcagaaccaccacctgcccc

SEQ ID NO: 47173 - DNA, 473 bp, Triticum aestivum
  Clone ID: PAT_TA_47173
cgtccgctggttcttaaagcccacatgcacgctttgaagaaaagggagaggaaggacaggaagaagacggtcgaggcagagaagatacctgagaaggaaccgaagaagcagaagaaatcatcttcgaagaaatccgcagggtctaagtagtgaggtacttgcagaatttaccgagacctttttcgcccacatgtgcggtcaagacgttcttacccgttttacccttaattcatgtccgcgagatgaagcctgtgaatacctatatagagacgcgtctttggctggcatttttgaagcagcgttttgttctggttgtaagcccgacccttgcctctagaaaaggcatgctttcttgaactgctagatctggctattgaagcctagtaagtacaatttgcaatggttcgtcggtttgatggttttagacccatgatatgaatgaagaatctgtagctttgtttgttggaaaggca

SEQ ID NO: 47174 - DNA, 422 bp, Triticum aestivum
  Clone ID: PAT_TA_47174
tttttatccagttgcaaggaacccactatcaatggtgcaaatgtacatcactacgtatctccagttctccacgcatataatgtatacatttttcttttttgcggaagaggaatggcatgtctctactctgaatagttaacagtttctaagctctaactagcagaaaccacaaagaaacagctagtggaaccatccaggcaagtcgatgccttctagggtctacgcagaagagagtaaacgatactgttcagtcctcaccatttcagggtggctgccaactccaagagagcttccacttgacgtatagtccgcagcttctcttgctgtttcaacatggtcgcaacagactccgggtcgtatccagtgtgcagcttactcttttcttgctcagcttcaacttctttcagcagctcatcgacttt

SEQ ID NO: 47175 - DNA, 499 bp, Triticum aestivum
  Clone ID: PAT_TA_47175
cgtccgcctccctcccatttttattgcaccaaaaacccaccgcgaaagtctctccagattcgctccacgttccccgcgacgctcccgcctggccgaatcgagcccccaatgcgcgcgccagcagcgcgggcgggtgctgcgagtgcgagatccgggagcgccgtttgacctgggcagagcagacggctccgactccgactccgagcgccgccgcattcgggcgagggttggcgctctggggtgagaattacttatcgatgactcgggcatcaactcttgattttcggcggaagacgcagggtcagaacaactggtctgggccgttgcgcccagtaaatgtcatcagaaataaatttcctacctacaagaatggttcgaatgggatagtcatcaaatttgcagatgagccagaaacgccatcacttaaggagtctgttgccaaagagacagcagatctgcttgatcggcgtcagcgtctttcagtccgcgagctcgcaat

SEQ ID NO: 47176 - DNA, 585 bp, Triticum aestivum
  Clone ID: PAT_TA_47176
cgtccggcggaaggtcaacattgagcctacagatgtcacatccattggtgcactcatagcttgcagccacagttgcttacacagaggagggaggcgggcattttgatagtatgacccataattatagcatccatccaaggattgagcactatggcgtgatggatgatctgatgggacagccaggtttgattgatgaggcgcaccattttatcaagaatatgccaattgagccaaatgcagttgtctggacggcactgttttctgctcgcacagttgacaaaactgttgaaatcggagaagaagcgctgaagcaaatcaccccactagataccaatcacagtggtaactacatacttctatagaacacctactcgtaaacgggacaatggaaagacccatctatgattccgaaggaaatgaatgagagagggatcaagaaaattcctgagtgcagtcttattgagctggataggacaatctttgagttatttgctgaagacagtgaccaccaccagtcccgggagatatatgagaaagtgtatgagatgattgatgacatcatgatggctgtgtacgtgccaaata

SEQ ID NO: 47177 - DNA, 650 bp, Triticum aestivum
  unsure (1)..(650): unsure at all n locations
  Clone ID: PAT_TA_47177
accgcccggattcccggtcgaccacgcgtccgcctcgcgccgccgccccaaaccccctctaaaaccctcgccgccggcgcatcctcccgccccgctccagaccagagaagccctagacgtgcgccgcggccggnggagggatggggatcttcgagccgttccgcgcgatcgggtacatcaccaccggcggcgtgcccttctccctgcagcgcctcggcaccgagaccttcgtcaccgtcagcgtcggcaaggccttccacgtctacaactgtgccaagctcactttggtccttgccggacctcaactgcccaagaagatccgcgctctggcatccttcaaggaatacacatttgctgcatacggaagcgacatcgcggttttcaaacggaccgatctggtggttacctttactaaacatgaagaaaaggtcaacatgctgtacctgtttggagaatacattctcagtgcagatattaaaggtgatttatttatctgggccttcagaggagcttaacccaagcagtgagccctgtgggaacatatcactgggagacaagtttactccaacctgcattatgcatccggatacttacctaaataaggtcattattggtagtgaagaaggacccttgcagctgtggaatatcag

SEQ ID NO: 47178 - DNA, 483 bp, Triticum aestivum
  Clone ID: PAT_TA_47178
cgtccgggtggcacctatctgttatgcccaccttgcagcagcgcagatgagccagttcataaaattcgagtttgctgatacttcatctgggagtggtgtcccttcgtcgtcaacagcagcaacagtcccggaactgccacggctgcatgctgatgtgtgcagttcgatgttcttctgttgacgtgggctttcagtcagatcgttgtgcagcaggggttgactttttgtgagtgaagaaacctgatattggataggtgacaacaggtttggctgggagcaattttttggatggtatagtgtccgtggttaggatagtagtgttcggatagtagtagcagttgacacttgatcgctagaaggcttatggatgtgaattccagattcaaactttgctgcatttgtaagccgtacttttggcatatcccaaactctttcggggtttgactacaagctgcccttttaattgagatatcttgtttaaaa

SEQ ID NO: 47179 - DNA, 396 bp, Triticum aestivum
  Clone ID: PAT_TA_47179
cgtgcgcggacgcgtgagaaaaggctgacgaccggaaaaaaattgacggaggagggcgagggggagggaacctaccagcctgagacgggaccaccactaccggcggagagagcacggcacggcacggagagggctgaggcggcgcatggcgggcggatcagacggcaccgacgtgccggccggcggcgagatctggggcacgctggaggagctgctgctggcgttcgccgtgtgccggcacggcacggccagctgggactcggtggccacggaggtgcaggcgcggtgcccgctggccggccgcccccgcctcacgcccggcaggtgccgcctccgcttccaccagctccaccgacgcttctccgccggcggcggggcggaggaggaggagcagga

SEQ ID NO: 47180 - DNA, 113 bp, Triticum aestivum
  Clone ID: PAT_TA_47180
tgcctaagtttctggatgggaggtatggtcacagagtaagaatctgtgttgctagagcctgctatagaccttgattactatagtactgttctagagcttgcacagcttgcacc

SEQ ID NO: 47181 - DNA, 438 bp, Triticum aestivum
  Clone ID: PAT_TA_47181
cgtccggtgtgatcaagtactgactatttctgagtacagaggtctgctctatgactatataaaaagtaggatgaactccattgctagcaggttgtctgcacttgctggtgaacttgttggagctcgccttatttcccatgttggtagtttgatgaatctaccagaatcacggctgagcacactattctgattatggcggccgagaacgacttattcatagatatgcagacataccatgcttcaccaatgtctggtctcatctatcatgcatcattaattgtacaggcgggttctaagcacatgggaaagatctctcgttcgcttggtgctaacagtgcactcgccatatgatatgacgcccttgctgacggcgacaataactgcatgggtcttgaaagcaggatcaagcttgatacactgctacgagttatcgagggt

SEQ ID NO: 47182 - DNA, 596 bp, Triticum aestivum
  unsure (1)..(596): unsure at all n locations
  Clone ID: PAT_TA_47182
cgtgcgcacaatttctcagatctgagagaggagaggaacagaagaatccattagaagaatttagtgaagaacaaggtgactctctctctgtgtcatgtgaacacggttcattttgatgttatgatttgtgctaatgtaaatatgagttatgcatatattgtctaaatgtattagaaaaatggtctggttgcgcaaacatttggtagacactttttttattcaagatggaacaagttgtttggatgtattctgttaccgatattcatgtaaatggcttgcacactttgttttgttataaagtaaacatatgggtgtatggttatcggaattcagaggtcctgcgatggcatcaagagcctctctggttttgattttctgatataaaatttaatctttaccgaacaatgtgaaatagattggaagaagagcatatataaggactcaccttttcatgttgctttcttcagggcaatgtttattgacgattttttgctttggaaaacactttccgtatgctgcctgaaatggattcttcataacgttgtctttgaattcgcaccanattcagtcacaattcaatactgattaaagcaata

SEQ ID NO: 47183 - DNA, 509 bp, Triticum aestivum
  unsure (1)..(509): unsure at all n locations
  Clone ID: PAT_TA_47183
cgtccgcggacgcgtctacagactcgtcatgcctgagtttctcactaaggtgctctgtatggctaacgagcgatgaacttactgccgtgcgtggggaagactgctccccaccgtaacgcaactcgcgcctctaacgctccgacccgaatgcatgatggagatgcatctcgatccacatatgccaggacggcattcactgttggaacgcgtgctatgagctgtaccggctctagcgtggcattcaacctgctggacagaagcctggtgacaagaccgatgggggaggtgatgatgctttcaacacctcctatagtgagactggcgctgagaagcacgttcccagtgccgtctttgcagatcttgaacccactgggattgatgaggtgaggactggcacctatcgccagctcttccaccctgagcagcttatcagtggcaaggaggatgcagccaacaactntgccccgggtcactacaccattggcaaggagattgttgacctatgcctt

SEQ ID NO: 47184 - DNA, 231 bp, Triticum aestivum
  unsure (1)..(231): unsure at all n locations
  Clone ID: PAT_TA_47184
cgtncgcccacgcgtncgcggacacgtgggggcaaatccacatcgtaagttgggcgagccactggaccggattctccgccgcaccattcacataagaaccaccaccgcgccccaaacccaccagcgcacctgacccaaccccaccccattcctnctnctncaaatttttccctttgtcagggctcgatcgctcgttcacagcgccagctgactgattgatgctttctcgtt

SEQ ID NO: 47185 - DNA, 305 bp, Triticum aestivum
  Clone ID: PAT_TA_47185
gccgcagaccgtccgaatccgtcgccaccgccgcaccgccgcacgctcggtagcaggaagcgcgcgcccttccttcaaactcggctcgcggcatctcccgccgccgcgcgcaccgaccagcggccgcctacatcctcccgtctctcgaaagagccaggcagcgctgcgtcggacaaccggtgggggcgaagggaaggggctgtttggcgccgtagcgcaccacccccgtccttgtcccgcgctcttgctctccttccgcaacacctccttccctggccgtgcgctgtgtcactgggacgagtcat

SEQ ID NO: 47186 - DNA, 506 bp, Triticum aestivum
  unsure (1)..(506): unsure at all n locations
  Clone ID: PAT_TA_47186
ccgggttcgacccacgcgtctcgctcaggttagtttcctttccgtgcagctgccaagagaattcgatgcagggcgcgagcagcctcccccacccagatcgagggtccctgtgagatagagacgcggagctacggcggcgagcgacaatggattttccgatgtaaccaatcggcaggtacgcgcatccgtgcttttccctgcggtctctcctcggtttgtaggcggatagctttcgtggctggcagaggagcttccaatttttcagatctagtttcattgaagatgtggaggagagctaggtgccgcccccctgtgactgcggccgtaggctaggcgacgggccctgtgttgcccatggcgatatgagggtacatctgatggttttgcagcagccgcagaagtctgggtggaataagtangtgaggatagggccgctgcacccagcagagcacttgcacccgatcatatactgcattcgagaatgctgtctgtgtttaccgatatca

SEQ ID NO: 47187 - DNA, 358 bp, Triticum aestivum
  Clone ID: PAT_TA_47187
cgtccgattcaatataacgttgcacgtccttcagagacacaagtaaatgcaatgttaggccaaagaagagaactgcccaggatgctagtattacacagaatcaagattatgttggtccactgtctacgggtgctcgtggttctggttggttcgtccagctatgtcttcagcatcgctctacagagagctacaatcgcacaaggaaatctaaacagccggctgggtatagataagagataccaatttaagaggaccgtgagagagctcgagggaagaacgtagttgatgaccatatgtggtgcctttagtgcaacagtggaagtcttaagtgagatatattcatgcgaactttaagcta

SEQ ID NO: 47188 - DNA, 330 bp, Triticum aestivum
  Clone ID: PAT_TA_47188
cgtccgcaacagctcgtgagtgttgagcggcagttttgacggtgaatggcgagcggcacctggcttggtggtcggcggcatgatgctcagcgggttagatcggcgagaatggattcagacgcgaagcattttgagcaggcgtgtggcctcgatgtcggggcagcgcagcaggtggtggtcgcggcggcgctgcaagtggtggtcgcgaccgcactgctagcggtggtcacggcggcgttggttcgaccacggtcgccacggactgcagaaggacgagcatcccgcgccggcacccgtaattaagttcgtgctcctccttgcacatgacac

SEQ ID NO: 47189 - DNA, 499 bp, Triticum aestivum
  Clone ID: PAT_TA_47189
cgtccgaccgaccgccgccttcggtttgtttcttgagctcgagttttcgatttgcttctccccgtattgcttcgtccaaatcttgcctttcttccttgcgggtttagtagttagacgagttcttggttggggatccatggaagcaagtgatgatagcaagacagggacatcagaacccttcggggttatgacagactacgtctataatgggaatctctctgatgtgttcgatttcccaagccagatagatatgtttggagtgctatagttgtttctttcagatctgctcttttgggtttgctcgtattctttcgaatcctctttctcgttcgaggcagttcagatcttgtatgggaatccgcgaagcatgtgatgacaattagacagggacatcagaaccatctaatggttatgatataccaagtctataatgggaatctctctgatgattctgttttccaagtcgattcgagttttggatcgtttttcatgggattga

SEQ ID NO: 47190 - DNA, 418 bp, Triticum aestivum
  unsure (1)..(418): unsure at all n locations
  Clone ID: PAT_TA_47190
cgtccgcccacgcgtccgaaagaaaacatcttcttcaacacggaagatatgttaagctacataatccaaggtacacgagataactgaaggcagatgtactaaagcaccctgcacagtgcacgccaccacatcactacagcctaaataatgatccataggatacgcttcccgaatgggcactccacagactgaatgcagaagatttcttcacccaatgtcagtagaccgattgattgttcgcacgagcgaaggagctccttgcagagacaatactacgataataaagtaaatcgcgcctaattttccctgagaccaattcaaagagaacgtccatccactgactgggcatgttgtaggcctcggatggagacgcctnctcatctcgtatcttctccaggctcctcacaagatattttgc

SEQ ID NO: 47191 - DNA, 283 bp, Triticum aestivum
  Clone ID: PAT_TA_47191
cgtccgcgcaccgcaccccatctgcatcgccaccgcttttaaatccccaccgtcgcgaacggatcgaacggccgccctacccaccctctacctgccagccagcctagggttttgagtccgcccccctccgtcgagcaccatgggccccgacgagcttcccaaggccgccggcgcctaggaggccgacccgttctccttgagcatctgggcgtcgacgcaccgtacgcagggacacgatgatgcaggctcctggtggacaccctggccgaccccacattgttct

SEQ ID NO: 47192 - DNA, 371 bp, Triticum aestivum
  Clone ID: PAT_TA_47192
cgtccgcgcacgcgtgcgctatagaacatgttcttagcacagaagattagtaagctacataatgcaaggtacacgagataacttgaagcagatgtactaaatcatgctgcacagtgcacgccagcacatcactacagtctaaatgatgatcgcataggatacgctccccgaatgggcacgtccacagactgagtgctgaagatttctgcagctaatgtcagtagaacgaatgattgttctcacgagcgaaagcactcctttcacagaccatactactatagtcaagaagagcgggcctaagttctcctgagaccaattcaaagagaacgtccattcactgactgagcatgttgacgcctggtatggagacc

SEQ ID NO: 47193 - DNA, 126 bp, Triticum aestivum
  Clone ID: PAT_TA_47193
cgtccgctccacctccctacggctgtggatgaagaatatgtgtgcattgtggtagacttatcagatggtggcgacatatattcgttaaagtgaacatataataatctatatagatttattttggac

SEQ ID NO: 47194 - DNA, 415 bp, Triticum aestivum
  unsure (1)..(415): unsure at all n locations
  Clone ID: PAT_TA_47194
cgtccgccaatcaaggcacccagccgccctcgccttcctctcgctcccgcgattcccaccgccgtcacccccacccaccatcgccgaccttgtctccgccatgcatcctctcccctcgccttcctccgcggctccaaggctcggtgctcggcgaggaggaagtggtgaggccgaggtggaggacggngatggggtgcatgtttgactgcttctgtgcggccagcgactcgccgcgcaccgggtgcgcccgcgcctagctcccctcggatctaggctcggcggagcggatatgaagatcacggccctcgtcttgctgaagccgtcagccggaggcaccgagggctccttcttcagcgacgggcatggctccgaggcgctcgtgctgaccaacgccacgtacgtcaggcacttcggc

SEQ ID NO: 47195 - DNA, 208 bp, Triticum aestivum
  Clone ID: PAT_TA_47195
cgcgtccggccgcagctggagaagaagagtgctcccgtgggcgaggccgccgctaacgggaaagtccgcacccgcactcatcatcgccgactttgtctacgacatgcatgctcatccactcgcactgcctacgcggctccaaggctcggtgctcggcgagaggaaagtggtgaggccgaggtgcgacgacggggatgaggtgcatgtt

SEQ ID NO: 47196 - DNA, 464 bp, Triticum aestivum
  Clone ID: PAT_TA_47196
cgtccgtctctctcataccgaaaaaactctctcaggaactcacgatctcctcatgatccagcccagctcctctccccacgatctggtcgccaccgcccccacccacgccgtccggttccggcgggcaccggccgcgcgcaacgctccaccaagcacgcccctccctcccccacaccctgatccagcaatatcccttcctcccctcgtcgaccgcttcggcttcgatgacgacggcgccgccatccgcgtcctctccgacgtcgacccggtcgcgccgaggcagcagcagcccacgggcgccaacatccgtcgcgagctcgcgcgcctagtcgccgacgtgcgggccggggactccctcttctttcactacagcggtcacagtacgcgcctgtccgccgagaccgctcaggacgatgacaccggctacgacgagtggatcatcctcttcgacatggacctatcac

SEQ ID NO: 47197 - DNA, 109 bp, Triticum aestivum
  Clone ID: PAT_TA_47197
gcgcggatacagatcccgatcgactgctgcatctctccgtccgcgctctagcgcagaatctaggaggaacacagacctgctcttgcccgaaccgcatgagcatgctttc

SEQ ID NO: 47198 - DNA, 218 bp, Triticum aestivum
  Clone ID: PAT_TA_47198
agcgtccgcccacagcgttcagctccacagtcagttcagcccacgcgttcgcccacgcgtccgcccacgcgttcgcggacgcgtgggaaaaaaaaaaaaagaaaaaaaaaaaaaaatataattaaaaaaagggttgggcaatataggggttaaaggttaaagtaagattgaatgcgatggtggtcagttttaaaaagtctaagttaaattaaatagat

SEQ ID NO: 47199 - DNA, 186 bp, Triticum aestivum
  Clone ID: PAT_TA_47199
tcactagactaaggccactgcatgcacctccggaggatgcggctgtgactcaacacgctcagtaaggatgaggtgcccacggatcggacgggatggatggcggtgccgcaagatcagccgggatggagaggcggcagcgagctgccggctgaggatggaagaggcggcacttaatttgcttgctac

SEQ ID NO: 47200 - DNA, 240 bp, Triticum aestivum
  Clone ID: PAT_TA_47200
cgtccgcggacgcgtgggtttctatgaatatccatgaatatccaggttgttaggttgtcagcaggctgttctgttcctgctgtatgtaagcctaatgacttgtaccttgtataccctaaccaacatggtatatatacatgaggatgccacagcgcttagcctgcgcgcattgactaacaggatttatatgcgtagtaaagagagaaaccattttatgttaagcttaacttgaaacacgct

SEQ ID NO: 47201 - DNA, 342 bp, Triticum aestivum
  Clone ID: PAT_TA_47201
cgtccgcctggagtgccttttattcctttcccacagttgcaacgagggagtccttgtccttctacttctacttcaactcagatgtccatgaggcagaacaacagttcaagatatcgaggaagaggtttcgacagaggtggaagggtgcaaaggaatgggaggaatggggcaagaacgagatatccgtatgatcatcatcaaggaagaagattcccaagcaatcatcatagatctgaaaaatggcagccgtggccccaggagcgtgatggtggttcaagatctaggggcagacaatgaatgacccagcccctggcattgaacctcaaatagtgtgtatacatg

SEQ ID NO: 47202 - DNA, 445 bp, Triticum aestivum
  Clone ID: PAT_TA_47202
cgtccgctttaacagcggacatgtggacatctaatcatactttgtcctatctatgcatcacttgccatttgatcaacagcaagtggattttgcaaaagaggatcttcagattttttatggtggagactccacataatggagtaacaatgtttaatgtcttattaaagagtttgcaggagtgtaatattgaggacaaactctttagtatgacattggataatgcatcagttaatggtacaatggtcaataatcttagaaaaaatctgaacagcaagcatatgttgcctattaaaggtcaattacttcatatccgttgtgcatgccatgtgataaatttgattgtccaagatggtttgacaacgatgaaaggtgtgatagatgatatcagagagagtgtgaagtacattaagagttctccctctcggttggacaagttcaaagaagt

SEQ ID NO: 47203 - DNA, 420 bp, Triticum aestivum
  Clone ID: PAT_TA_47203
cgtccgatgataacgagcaaactagatgctaataaatgtgaagttaatccggctctacttccgtgtggtgatgaaaatcaggatggctgctacaagaaacagaggaaggaaaccattgctcatacatcaggaccggcggatcaagcggcggctgcagcagagcagccccgccacacgcaatgagtttcctatgttggaactgtcgaggactagggacggacgcgacagttggtgagctgaaatggctcataagcaaattttgtccctccctcatcttcctgtccgagacgaagatgagggattcaagagctcgaaagtttatgtggtctttgggaatttagtggttcttttgcgatgagtagcgatggcctgagtggagggatggctctaatttggtcttcgtccatatcagtctcatta

SEQ ID NO: 47204 - DNA, 464 bp, Triticum aestivum
  Clone ID: PAT_TA_47204
cgtccggttcaaagaagagagaatctgcattttatgaatcctttcttctttcttcattgttacttcaagttagtgaattcatttaagttgtattgagcagcttcatgtgcatggtttcttcatctacacatcttattcagtcacgaggcctctaagatcttttgccttttagaaaaagggagatgccatttagaccttactcttccaacttgatctttaacttgctagcattttcccaagcattttttatttgcttcagagaatgaactcaccttattcagtggatgtgccaagtaaaaaaattagaaactgaacaattagttccactctttaaatttgtacaacggtccaaattatccaataaatcagttgttagcagggtctaattatagaagttgaatcagttgttccctcctcttctcttcgaacccagccctctctagagtgtgtgtgccctctactac

SEQ ID NO: 47205 - DNA, 492 bp, Triticum aestivum
  unsure (1)..(492): unsure at all n locations
  Clone ID: PAT_TA_47205
cgtccgcacagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggagtagtgaggctgtgacccgcaagacccgtctcctggatgggttacaattcgtaaacaatgagcttggaggactagaccctngtaagaatgcattgtgaagtgagctgccctttaagcagggacctgactattatggagggaatggtagagaaaaagctgtgactgcaagggatctgtgaggacagattgagtgtgtgtgcacaagagataaaacaca

SEQ ID NO: 47206 - DNA, 220 bp, Triticum aestivum
  unsure (1)..(220): unsure at all n locations
  Clone ID: PAT_TA_47206
cgtccgcggacgcgtgggttttacttgcctcatagactcggaagaaaaaattcatgcggatgcggtaaaaatacagagaagaaatacggngtagaccccgtacgtacgcgcgggtcggtgaaaccagcaggcagctgcagtaatttcttctctctcacttttttctcgtgctagaaccgggcgagcgcgcggcggagcacctgggcgaggaggctggggg

SEQ ID NO: 47207 - DNA, 283 bp, Triticum aestivum
  Clone ID: PAT_TA_47207
cgtccggtaagaagaagaggaggataacaagaccaagcccaccacaagaagaagaaaagtggttcgcttcaacgactgcagcctcacccaggtcctcgagttccagcctagcagctcccgtgaggcaccatctcttgtggcccggcttagacttgctctgcggacaaaactctgagatcatatatatatcatcatctatggtgatgtgatgtccccatccatatggagtgattaggactatgtgctagtagatagagtgtgtgtacatatgccagagctgctg

SEQ ID NO: 47208 - DNA, 419 bp, Triticum aestivum
  Clone ID: PAT_TA_47208
cgtccgcaaaaatgagcacaaccactaacagcagcaatggtacaacttgttcaagtgagagtggaagtgaatgtgaggttgaatctgacataaagaagatggagctcgggaagaaaaagcttcagcaatacatgtatgttgcatttgtggtcgccatgcacaatcaaaagtatcttatgaagaaagaaaggagagaggtaagatgcacaggacaacagtggggatatgattgcttgggttctttgaaagattgctacatgatgtttcgtatgcataggccatgttttgacttattacatgagactttggtacacaactatggtttgcgagcaacatgcaacatgtgttccgaggaggctctatggatgttcttgtggactattggtagcccacaatcagtgagccaagtttagaaccga

SEQ ID NO: 47209 - DNA, 139 bp, Triticum aestivum
  Clone ID: PAT_TA_47209
ggcgcgatcgtgcactcggaagaacgatctctcgtgtgggatccataccgcgcatttgattgcgccatgcgacacgcgccgactaccagagggcacatggcaggcccttcaaggcatgaaactagagtgaccgcactca

SEQ ID NO: 47210 - DNA, 554 bp, Triticum aestivum
  Clone ID: PAT_TA_47210
cgtccgcccacgcgtccgtggacacaccattagatgaacagaaatgctttgatcatgttacctctttgatttcagtctcacccaatacagtgatgccccaaggatgccttgcacatgaccttattgagaaggtagaggttgaggtcaagaggctgaagcatttgaaagctagcaaaatgaaagagcttgtcttaaagaaaatgactcagcttgaagaaatctacagaagtgttcacatgcatattgacagcgatcatgagtggcggattctcaccgagcttattgattctggtagagcagatctctcagagctgcttacagatatggatgaccgaattgcagaagcaagagatcttgctctaagcagaaaggacattctagaaaaggtggaaaaatggacatcagcaactgaagaggagggttggctcggtgaatatgagggggatcaaaatcgctataatgctggtcgaggagctcacataaatctcaagcgcgcggagaaggcaagggtattggtcagcaaaattccatccctgctggagaatttgactact

SEQ ID NO: 47211 - DNA, 350 bp, Triticum aestivum
  unsure (1)..(350): unsure at all n locations
  Clone ID: PAT_TA_47211
ctggagatcatctncgccaggggctcgtcctgccgcgaggacgtgcgcctgctctgcacggtttatttcaagaacagcatcaaccgctactggcggactcgccgggattcctatggaattagcaatgaggagaaggaccaccttcgtaaaaatctcttgctaaacatacgagaggagaataaccagattgcacttcagctagctgtactaatctcgaagattgcacgtttggattacccaagagaatggcgggaccttttctctatattggcacaacaactgcaatctgctgatgttcttgcttcacatcaggtgtttatggtcttatttcgaactttaaaggagctgtc

SEQ ID NO: 47212 - DNA, 414 bp, Triticum aestivum
  Clone ID: PAT_TA_47212
cgtccgtggacgcgtgggtccgaaagcaagtgagctgttggcaggggacggacgcgacgatggtggtggtggcgaccgctagccccggcgggccggaggcgctgcatgtgcgcgaggtcgaggacctcccggcgccgggggagggcgaggtgcttgtcggggtggccgtcgtcagcgtcaattgcggtgacacagtacaatggcagtggccgatagcctccgcctcgtcctacccggggctcgagtgctcctgcaccattgtctctcttgtaagcgctctggacccgttgtaccaggtgtgcactctgtttaccggttccgggtatatcgagaaggcctactctcctcggcgtatcctcatcacattaccaacgggacatttccttcatatccactcttgacccgccgtaccgc

SEQ ID NO: 47213 - DNA, 504 bp, Triticum aestivum
  Clone ID: PAT_TA_47213
cgtccgcggacgcgtgggaaccctcccccttgggtggccaagaaagctgttaaagcctggcccagtgcaggattcatccctggagttggtcctaatagttcagggatgccaaattcagggtcttctggagctcttggtggtggcggtgtacctggaatgcctggcagttatatgggaggctatgggggtggtggcgggtatggtggtccaccgggaggtccaggaagaaattacatgggtcattagatgattctacgtgttcctgcgtcgcacttataaacatgctgttttaggcttgttctcgcaagttgcttactctagcggtcaaagttttcataagaactttgatttccctaatcctatgttttcaaaaatgaacaaatctatgtacaattatttaaaatttttgaaaaagttactaaatggtctttgtgacccctattgtaaaaaaactttctatttgattttaaaagcaccggcggaaattttttaactgcatttttt

SEQ ID NO: 47214 - DNA, 512 bp, Triticum aestivum
  unsure (1)..(512): unsure at all n locations
  Clone ID: PAT_TA_47214
cgtccgtgcttggtctttttctacttcccttgctgtacaaaagttctcttcaagtttgggtttactgtcgaacattgggcaagcaacgaacacaagcaattgagaaacgagcagaaaaaagagcaggttctgctgtattttatatctcgttgntagtggtgttattgttcttggtgccgtcatggacgcggcttgttcaaggtcttgaagtccatccgtttgtttggtaagaatcaccgtttgactttcatgggaagagcataccacttaacgttagtggaattaatattttaactgtgcactctgttctttctcggaaaatcttctgtatatttacagatactgactttgttgtttgcttaatggctcattatttcacagggttcttaactacatgttcaccaattcagatgaacggcttcttttatgtgcatactggatatttgtcatatgtgtatcaattagaaggttctacagtatatcaaagcaaagcaaaacagagagaattcttt

SEQ ID NO: 47215 - DNA, 368 bp, Triticum aestivum
  unsure (1)..(368): unsure at all n locations
  Clone ID: PAT_TA_47215
cgtccgcggacgcgtgggctgacgcgtgggcagngttggcttcttctccccttccggttcgggttctggttcagatcgggttcggttcgagagagaggccgagtagctagcctagtctagggtttctgttgagaggaagggagatccatggcggagacggagtaccgctgattcgtgggcggcctcttctgtgccaccgacgacaaccaggaggccttcagccagtacggcgagatccttgactccaagatcatcaacgaccgcgagacggtgaggtcccgtgggttcggcttcatcacgttcggcagcgaggagtctatgcgccaggccatcggggagatgaacggcaaggagctcgtctggcgcaa

SEQ ID NO: 47216 - DNA, 616 bp, Triticum aestivum
  unsure (1)..(616): unsure at all n locations
  Clone ID: PAT_TA_47216
cgtccgatggttaacaggtaggtagaatagccttttcccctatcatccagatccagatccagatctagctccccacaacgatggcagatctcgccacgatggtgccggactacgtgctcgcgggcgtnctccgccttctcgcaccacgcggncttgccgcttcccgctgcgtctgcaaggcatggcgccgcgtcatcgacgaccgcagactgctgcggtcggacctcctcccgcgctcgcttggtggcatcttcctcaactacctggacctatggttcacgcagttgctctcccgccccacgacgggcaccgcaatctctggccggctggactacacggtgcccggcgagcctgacctcatgccccccatccacgtncgagatcactgcaatggccttctcttgctccaccactgcgtggtcaaccctgccacacagcagtgggcgcccctgccacctgccccggacctgccacaacccccaccttcgggcatgatctcctttgcgcgcgagcacctcgtgtttgaccccactctgtcgcccaactattttgaagtgctcatagtgcccgatgtcccttccaagaacaacgacgactgtgaggaggaagctgaatg

SEQ ID NO: 47217 - DNA, 252 bp, Triticum aestivum
  unsure (1)..(252): unsure at all n locations
  Clone ID: PAT_TA_47217
cggtgtctgatctctgggtgttgtggctcggtgtttgcgcgggtgcgcgatgactggacgacaccgccgctgtgaggaagggcactggcgacctggcagcttcgtctggcttcggcaccaactgctgcgcctgggagccgcccgccgtcttctgctccgcgaccggccgagtcacggggctggcgctctcctccctcgacggcgtccgcgcgcccgtnccgccggcgctcggagagctcccggagctcgtca

SEQ ID NO: 47218 - DNA, 467 bp, Triticum aestivum
  Clone ID: PAT_TA_47218
cgtgcgggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccggtact

SEQ ID NO: 47219 - DNA, 130 bp, Triticum aestivum
  Clone ID: PAT_TA_47219
cgtgcgcacgcatgtctcataccatcctccatccaaaaatcagcgcatcgtatgatcgaatcattctaggtctgactagagcccgaccgcggtgacggcaacatgacggtgcctgacgtggatgccaccc

SEQ ID NO: 47220 - DNA, 568 bp, Triticum aestivum
  Clone ID: PAT_TA_47220
cgtgcgaagcaatccccacacacatctctccacttcccgaatcctttctccagctctcgccatggacgcctcagccaccgtagccaccgggaaggggaagaagggcgcggccgggcgcaaggcgggcggccccaggaagaagtccgtgtcgcggtccgtcaaggccgggctccagttccccgtcggccgcatcgggcgtttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccgcatcatcccccgccacctgctgctcgccatcaggaacgacgaggagctcggcaagctgctcgccggcatcaccatcgcgcacggcggcgtgatccccaacatcaacccggtgctgctccccaagaagacggccgagaagtcccccaaggagcccaagtcggccaagaagaccgccaagtcccccaagaaagcttaagttccttgcttagttaggctgtaataactgggatgtatg

SEQ ID NO: 47221 - DNA, 354 bp, Triticum aestivum
  Clone ID: PAT_TA_47221
ctcgagaccggccgaaccgtcgaccacgcgtcggccgctcgcctgcctccattatcggtcagtgttaccctctggtggcctcggccgctactcggcccctgtcagttctaccgacgcctgcgtcggcttttctaatcaagcgccgaccgctatcaggcctcggagcttctacatacggaacgcataagcccagctcagtccccgggctgcggacccgagaccccacccggtacacccatgggctcgccagaaccaatgtgcaacagaaagagtcaggtgctcgtctcagccgaccataatcccttcaaattcgagcctcgaacacccattgtcgtgtgcggtgtatacaataat

SEQ ID NO: 47222 - DNA, 364 bp, Triticum aestivum
  Clone ID: PAT_TA_47222
gcgtccgcggacgcgtgggcggacgcgtgggcttctcctccccttccggttcgggttctggttcggttcgggtccgagagtagctagcctagtctagggtttccgtagttcggagaggagagaaagggagagatccatggcggagaccgagtaccgctgcttcgtgggcgcctcgcctgtgccaccgacgaccacaaccttcagcaggcctttagccagtacggcgagatcctcgacgccaagatcatcaacgaccgcgagacgggcaggtcccgtggattcagcttcgtcacgttcggcagcgaggagtcgatgcgccaggccatcgaagagatgaacggcatggagctctgacggcgcaaca

SEQ ID NO: 47223 - DNA, 213 bp, Triticum aestivum
  unsure (1)..(213): unsure at all n locations
  Clone ID: PAT_TA_47223
cgtgcgtccaagcgtccgaaccgnttcgacgaacggaaccaacaaatccacaagccaatctcgtcttcgatcgacttcagctccccttgctgcggtccttcccgccgccccaagatgcaaatctttgtcaagaccctcactggcaagaccatcacccttgaggtcgagtcgtctgataccatcgacaatgtcaaggctgagatccaagacaag

SEQ ID NO: 47224 - DNA, 237 bp, Triticum aestivum
  unsure (1)..(237): unsure at all n locations
  Clone ID: PAT_TA_47224
cgtccggtatatgaatgcaaactacatacaacttcctacattcatatacatgcatgatgcctgtttgatgagacgacctctgttgagggttattattcctttcttctctttgatnggaaaatacacttataccgcattataaatgcctaacatggattttgtngccatgggataattttattttataagcaagtccactgggcggttatcctgggtatgttccacatgaggaatcat

SEQ ID NO: 47225 - DNA, 617 bp, Triticum aestivum
  unsure (1)..(617): unsure at all n locations
  Clone ID: PAT_TA_47225
cgtccgcccacgcgtncggcctttgccttgctgaagtgtcttcctggtactcctatcaggatagtgaagaacttgagggtgtgtggagactgccatttggtaattaagctaatatctaaggtatatgaccatgaaatcattgttagggatcgcagtaggttccaccatttcaaaggtggagaatgctcatgtaaagattattggtagttgattcatgtacggactgacagtgatgaatgcatggtttatgaggttccatgccctataatcaggggaatgctggtgacttatggttgcagaacagttctatagaacttcatttgtcgacacctcatgttttgactcaaccacaacatctggtttctgttgcacaggtctactgcagcgaaagcattggggcaacctcatctattacaggtcgctgcaatctcagtcttggtctaactcgctaaatgtgtagtggaaaaaataagcttcaggacatggcacatcaaaaagcaaggttgaagctggatactgccatctccattctattgttggaaatattatgatgtaaatntctgagtcctggttgtacaacatgttctgtagaagttcagatcttgacacatgtgttg

SEQ ID NO: 47226 - DNA, 563 bp, Triticum aestivum
  Clone ID: PAT_TA_47226
cgtccgcagaaatctgtgcaaagccagctaatgatgctcagtcaagtgaagcgttattatcagcccttcattgtctgcatctaatatgtacaacatttattcacgaggcaaagaaatctcagatggaatttggtagatcaaaaactcagtttgggtctgattggctgaatagttctgtgttggtatatctaaagaaattatggggagtgaaacgcttgtttcatgagaagggagatgacagatttttcgtcttcaatctgaaaattgctgaactctttttgtgcttgagcacatgtgtggacgatacaatgtttccagctgaggagttatgccagtttgtatcttctttatttgcaaagtcaaaagtacttcgcaacaaggatctcatggaaacgcatttgagtccacttataacttgtataccgggtcttatagccagttgtgcagatgactcaaaaggatatttgttggaagcatttacagatgcatttagagattccaaggtggattgcaagctaatgttgccatatttggatgcagtgcgagaaatgctacttcctgag

SEQ ID NO: 47227 - DNA, 459 bp, Triticum aestivum
  Clone ID: PAT_TA_47227
cgtgcgcggcgatgtaactgggatgcacacatcacacatagctgtggatccttcgttgtgcactcttcctatagccgtggtttagtacaagagtttactttttaggcctccaattgatttagttttttagattattgtgcttttgttgctactgcacacacactgaataattcagaaatggagcgcttcttgtttacctgccccacgcagtgttataaggtgaagaactttttaagcaaggggcctcgtagtctcctactcgtatgtttttggggtgatgattcttaaatcttaatgtggtctatccttcattatgaaaacaaagcagcacatcaagcgatttgcatgttttctcccagttggttaatctgggtagaacaatggttttccttctgcgtatatgaaaatgaaaaagttcagtgctctaagtgatactcacatactggctccgtccgaaaa

SEQ ID NO: 47228 - DNA, 558 bp, Triticum aestivum
  Clone ID: PAT_TA_47228
cgtccgcggacgcgtgggcgagtagccgtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaatgaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacctcgacattgtcttcaacgctagttgcaccac

SEQ ID NO: 47229 - DNA, 617 bp, Triticum aestivum
  Clone ID: PAT_TA_47229
cgtccgcagaagcagagcaatcccacaaacacttggtgatcccaaattcccaatcaatcttccaacccaaagtctgtctgatccattgtaggttgtgagcgcaagcagcggcggccatgaacccggacaacttcacgcacaagaccaacgaggcgctggtggcggcgcacgaggcggcgtcggaggccggccacgcgcagatcacgccgctgcacctggcggcggcgctggcggcggacaggtcgggcatcctgcggcaggcggtggcgggggcgtccggcgggaacgcgtccgcgggggactcgttcgagcgcgtgctctccgccgcgctcaagaagctgccgtcgcagtcgccgccgccggactccgtgccggcctccacggcgctcatcaaggccatccgccgcgcgcagtcggcgcagaagaagcgcgtggactcgcacctcgccgtcgaccagctgctcatgggcctcctcgaggacgcgcagatcgccgactgcctcaagggggccggcgtgttcgcctcgcgggtgcgcgccgagctcgagaagctccggggcggggacaacgcgcgcaaggtcgagtccggcttcggcgacaccaactttcaggcgctt

SEQ ID NO: 47230 - DNA, 609 bp, Triticum aestivum
  Clone ID: PAT_TA_47230
cgtccgcccacgcgtccggattctgatgcatctgagaaaagttttgagacacgaaaaatgaataagtggttcaagagtttttttgaagtcatcaataccttaagtgtcgatcagatacatgagcacactaggcaatggcattgtccggcatgcaaaaatggaccaggagcaattgactggttcaaagggctgcaatctttggtgacacatgctagaacaaagggttctaagagggttaagctccacagggaattggctgcattgcttgaagaggagatgtctcgcaggggatcttctgtggtaccatctggtgagcaatttgggaaatggaaaggattgcgagaaagcactgaccgggagatagtatggccaccaatggtcatcgtgatgaacaccctacttgaaaaagatgaagatgataagtggttaggcatgggcaaccaagaacttcttgagtatttcagtgattatgctgcgaccaaagcacgccatgcatatggtccaggtgggcaccgtggcatgagtgtgctaatatttgaaagctctgcttggggctatatggaggcagaacgtcttcataagcaatttattgatcaaagaacagacagg

SEQ ID NO: 47231 - DNA, 578 bp, Triticum aestivum
  Clone ID: PAT_TA_47231
cgtgcgcgcagccccaacccccacctcgcctgagcaggtcgccggcgaccgacaggcttcagccccccccccccccccttccgcgacccgggggaggcgctgagcgagcaaggggatggagttcacggaggcgtacaagcagacgggcccgtgctgcttctctcccgacgcccgcttcctcgccgtcgcctgcgactaccgcctcgtggtccgagacgtcgtcaccctcaaggtggtgcagttgttttcatgtgtggacaagataaactttttggagtgggcaccggattcagaatatattctatgtggactttacaagcggccaatggtgcaggcttggtcgctgagccagcctgactggacctgtaagattgatgaaggatctgcagggattgcttatgctcgctggagtcctgacagtcgtcatatactcactacatcagagtttcaacttcgattgactgtatggtctcttgtaaatactgcctgtgttcatgtacagtggccaaagcatgcagccagaggtgtttctttcactaaggatgggaaatttgctgggatctgcaccaggcgggact

SEQ ID NO: 47232 - DNA, 533 bp, Triticum aestivum
  Clone ID: PAT_TA_47232
cgtccgctagcgtagttcctcaccacatttcgcaagctgcaagaattgtaggccagatgaaggctcttcatccttttgccttgctccccttctggagttttcttctactatccaccgataatgccagtggctatggacatggcgaggcgttgcatggagatgcgctggccttgctctccctcaaggcctccctcagctgccgcccccacgtgctgcgctcgtggctgccgggcaatgtcgcctcggtgtgcgagtggaccggcgtccgctgcgccggcggcagagtggtctccgtcgacatcgccaacatgaacgtgtccactggcgcgcccgtgacggccgaggtgactgggttcgccgcgcttgcgaacctctccctcgccgggaacggcatcgtgggcgcggtggtcgtgtccgccctcccggagctccgctacgtcaatgtctccggcaaccagctcggcggcggcctcgacggctgggacttcccgtcgctccccagcctcgaggtgttcgacgcctacgacaacaac

SEQ ID NO: 47233 - DNA, 570 bp, Triticum aestivum
  Clone ID: PAT_TA_47233
cgtgcggccacgcgtccgtgcagatcctagaagcaagggaggagctgctgcaaagcttacaggctaagaataagcgaggatctgaaactgcgagagaatcatcagagaatgcgaatgaatcctctgccccagctgaagagaaggtgatagaaccttcaatcatccaagacaaagaagtctccatatcagaggtccgttcgtttgaagaacccacctccgacatcacgccagaaatcgaggccgagaagttcccagtgtcaaccaccgaagtggaaatcatcgacaagtcagtgatcgaagaagagctgttgtcagtgaaagataaaatcagggccccactcgtccagtccagactccacgccgacaccgatgaagacgaagtggatgaatggcctgacgatgactcaaccgaggagcccgaggcggtagcggcagcaagcaacagggcttcgctggggcgggaggaggacgtgtcgttcagcgacctggaagacgacgacgacgacgatgacggcaataaagggtcgggcaagtagctaagataatttctaggtccggtcccggcacaat

SEQ ID NO: 47234 - DNA, 396 bp, Triticum aestivum
  Clone ID: PAT_TA_47234
tcgtcctggcaatgctagtcctataaccaaacagcccctaagtttgccaaagatttccacacctaaagttagacaacctttgtcaaacttaagtgaatttttcttacaagcgccaccttattcaagccccacttcattccccacatatttatacacacaaaaactgtatccattattcccttatgcttgccaacttgcggctctcattttgatgaattaaccttacgcaagtttggcaagaatgtgttgcaaattatagcaatgctagtcctataaccaaacaacccctaagttcctcgtagcactcattgtataaaaagagaagacatctgttaattcaagaaaaagtgcacgaacaaacatcttaatctttttaagttgctacatgttgttttt

SEQ ID NO: 47235 - DNA, 557 bp, Triticum aestivum
  Clone ID: PAT_TA_47235
cgtgcgcatgcctgaaaattgttcagaaatgcaagcgcaagtttgtgacacaacaggtgggcgagaacgaaccatttgtttctgaactgctggagcaaccttgctacgacaattcttgatcttgagccgcatcagattcatacgttttatgaatcggttggtcacatgattcaagctgaatctgataatactaagagggatgaatacctgaagagattgatgagccttcctaatcagaaatgggcagaaataattggacaggcaggccaaagcattgatatcctgaagaaccaagatgttatcagatctgttcttaacatcttgcagacaaacacaagtgttgcgacttcgcttggaccacactttttcccacaaatttcactgatcttcctcgacatgctgacagtttacagaatgtacagcgagcttgtatcaagcactattgctgaaggggggccttatgcctcaaagtcgtcatttgtaaaactcttgagatctatcaagagggaaacattgaaattgattgagacatttgtggacaaagctgaagacctacc

SEQ ID NO: 47236 - DNA, 570 bp, Triticum aestivum
  Clone ID: PAT_TA_47236
cgtgcgcggacgcgtgggcctgtatttcatatcccagcttctctacaggaagtacagtggaaactttctggttaaccttctcggtatatggggggaatctgaatattctggcgcattctatccctgttggtggtcttgcttactatgtaactgcaccatcaagtatggctgatattctggcgaatccattccatgcattggtctatgtggtcttcatgctgtcagcatgtgctctcttctcaaaaacatggattgaagtctctggttcatcagccaaggatgttgcgaagcagctgaaggaacaacaaatggtgatgccaggccatcgtgagtcaaacctgcagaaggaactgaacagatacatccctactgccgctgcatttggtggagtgtgcatcggcgcattgactgttctcgctgatttcatgggcgcaattggttcaagaaccggtattctgttggctgttaccatcatataccagtactttgagaccttcgagaaagagagggcgacagagcttggtttcttcgggttttgattgatacatgatagctttgggagcatgttat

SEQ ID NO: 47237 - DNA, 605 bp, Triticum aestivum
  Clone ID: PAT_TA_47237
cgtgcgggcgtgcgccgcgccgaccgcgtcgacggagagaccatggagctcatgacggccatcgcctgcggctggatcgagcgcctcgtggtgagcgggggtgacgtctccgacgtctccgcgctcctgggggagatggactgcgtcggcctccgccccgggtttagcctcgtcgagaaggccgtcgcgctctactgggaccgcagcgagagggcgcgcgctgttgagttcgtcagggacgtgctcaggagggggagcgtggccgcgggaggggagtacgacggcgagcgtggaggccccgtcggttacctcgcctggaagattatgatggacggggactacagagatgctgttaaattggtcattgaattcaaagagagtggactgaaacctgaagtctatagttatcttattgggttgactgccttggttaaagagcaaaaggaattctcaaaggcattgcgtaaattgaatctgtcagtgaaggatggctcaattgccaaactggatactgagagcatgcacaacatcgagaagtatcaatccaaattattaggggatggtgttcttttatcaaattgggcagttcaggaaggcagcagtga

SEQ ID NO: 47238 - DNA, 469 bp, Triticum aestivum
  Clone ID: PAT_TA_47238
cgtgcgcagatctccactccccactaccaaactcccgatactttatagcaccaccacaacaaacccaccaaaatcccatctctcaaccaagtgagtttccttcccctctgagttgtctgatatctaacacctagcctatactctccaactaccaccgaaatcctctccatatagccgaacggtcggcgcattgattcagattgcattcttgctgcacgcagaagcactctttggtcctctgctcgccaagaatatcactactattcatatcataatcaaacatgtccatggtatccaacttacacgccttcactctggatgtcactggcactctcctcacttacaaaggacagattgctgattactactgcatggctactcatgctgcctgaaagccatgccctgattatgatccaatgcatgaactctccaatctttcatacactgagatggcgaggaaatacccatg

SEQ ID NO: 47239 - DNA, 351 bp, Triticum aestivum
  Clone ID: PAT_TA_47239
ccggtcgaccacccttccggcatggacatccaccgccgccgcccgcctcattccgagaggttcgagctcgcctgatagggaggagagatggccaggaacggcggagggaggaagaaagcggtggcccggtccaccaaggccggcctccagttccccgtcggccgcatcgggcgcttcctcaagaagggccgctacgcgcagcgcgtctgctccggcgcccccatctacctcgccgccgtcctcgagtacctcgccgccgatgtgctggatctcgccggcaactcctccatggacaacatgaagaccctgatcgtgccgggccacctgcttcctcgtcatcctctacgacca

SEQ ID NO: 47240 - DNA, 409 bp, Triticum aestivum
  unsure (1)..(409): unsure at all n locations
  Clone ID: PAT_TA_47240
gacatctccagcagcggcggcgacctgcangcaggaggcaactactgggggggtggattatatccagcgggggggcccggtccctataaaaagagaaatctcggacatagacacaaagaaccacaaggggtagaaatatagagggtgttgtctcattaacatccaggtcaccattggacatgccaagtatgtccatctacagcctgcccaatgtcctgattcaccaaacaatacaaccggaaactctatcctctgcctacagcaccaatccgtgcaggaaacactgtgcctaccaatgattattgttctccacctctttaacactcatattaaaagtgtgatatccccttaccttaaaaaccatctttaaggaaaatagtggtaccatcacttatgggcctatgatgat

SEQ ID NO: 47241 - DNA, 527 bp, Triticum aestivum
  unsure (1)..(527): unsure at all n locations
  Clone ID: PAT_TA_47241
gatctcctcaacaggggctacaccacgggcgcagaagtgtcaccttcacgagccgcggcggcaacggggggtgcgattactanttcnagcacaaanaaaaatggagctatcggggctgacctccagacccaggggaagatcaagaatttcacagggggtgtgaaagcaacttcggactcaaggggtggaactacaatcactggtcctgagctggacacaccgggcttggagggaggtctttctcttcctttcccctaccagaaggctacccctgggaagggtgaactccaggacttggatccccatcttggcatcaacggcaggggttgcctgaattcaaaccctcttggtaacttttctgggggcattgggactaagggttttggttttgggggtgatgtggcatttgacactggctctggggacttcaccaaggacaatggtggactgagccacactaatcaaggtcgtactggttccgtgaatctgaacaacaaggggaacacgcgtgggtgctttctactacc

SEQ ID NO: 47242 - DNA, 327 bp, Triticum aestivum
  unsure (1)..(327): unsure at all n locations
  Clone ID: PAT_TA_47242
gggggcgtgcgtccacgcgtccggccactcgtccgagttccggaacaaatacaagggcctcttggtacatgtgctnatantggttgtcaggtccttatggggggggggggganttcttaatgcaaacggaagtgtatggtaggcgtttcacaggtctagcatgctttagggaggaaaatagttcttactggaggtctcatcaaacttaaaatttcatgtgctgtcatatcatattatggatgagactagtgacgggtgagaatcattgtgttccttttttttcaattggggggggggtatttagggggagcaagctatttatatggg

SEQ ID NO: 47243 - DNA, 623 bp, Triticum aestivum
  unsure (1)..(623): unsure at all n locations
  Clone ID: PAT_TA_47243
cgtgcgcacaaatgcagaaagacatgctgtctaatctcaacaatattttgactgacactgatgttgcttttgacgttgtaaccacctctggtgctgacgaaggaaacaccgcagcactgatgttgagtgctggcatttcacctggaactgagccgcacctgaaagcattgctgttggctataaggtcctcacagctactgggtcttttggaaaaatcaaggatttttgttcccaagggaaggtggttgatgggctgccttgatgaacttgggatccttgagcaaggacagtgctttattcgggcctcatctccagtactcaataattctctgctgaagcatggaccaagatcttcctcagcgaacaacaatgcagagaccgttaaaggtactgttgttatggcaaagaatccgtgccttcatccaggggatgtccggatccttgaagccattgatgtgcctgctttgcatcaccttgttgattgcttggtctttcccaagaatggcgagaggccacacgccaatgaagcgtctgggagtgatcttgatggggatctatactttgtgacgtgggatgaaaaacttatcccaccgggtaaaagaagctgganacctatggactac

SEQ ID NO: 47244 - DNA, 204 bp, Triticum aestivum
  unsure (1)..(204): unsure at all n locations
  Clone ID: PAT_TA_47244
cgtgcgggaacgcacctactgccttactgtccacaagcaccgcatacgctgccgctgccatcgccgncaccaactgcacccatctcaatgggagcggctgaagagttccagcacttcctttgtgtactaaacaccaacgcaaacggtaaccaaaaaacattgttgggcctaacctcaataaagggggggggccgccgtttttcc

SEQ ID NO: 47245 - DNA, 471 bp, Triticum aestivum
  Clone ID: PAT_TA_47245
cgtgcggcaatgggcaatgtacagggcagacgctctcctcgatctaccactgcaaatcatgcccaagagatcaaaccctcagccaagaacgcgagccatggagacgctggagccgatccagcaaaccctgggcgagatcgacaaacggatccccgacgccctccgcgccgcgttcggcctcgagaaacgagcctcgtgctcctccgaggacgccatcgccagcttcttcgcgctgtatctagagccgccgcatcatcgggagcgccgcgagcgcgacggcgaggagccccgggctctgaggatgaactgggcctcatgctacgcgccgcgccacaacgaggacgcgcacttcgggcacgacgaggccggcgtcgtcggcgtggcggacggcgtctgcgggtaccgcaagataggcgtggacgccggcgccttctcgcgcgggctcatgacgagcgccttcctgcaggtgct

SEQ ID NO: 47246 - DNA, 378 bp, Triticum aestivum
  Clone ID: PAT_TA_47246
cgtgcgccgaaggcagacccaaaaccaacaccggcggcggctgcagcgatggcggcggcggctatgaacacggacgtggaggcggtctactgtggcgtgcgacgactacgatctgatggacgaggagggtgccatctaaccctcgccggcccccgctccccgcctccgatctaccatcgcatggggcggcggcggcgacgacgattccccgcgtaagactaatgggcgcggcttccgcgaggaccccaactcctctgtcgcgcaccgagactcgcggttagctggcgcatgccgctatggcttacacgccctgggctgctatgcgctgccctggacccgggcgctccattgaagggtggatcgttctgcatactggag

SEQ ID NO: 47247 - DNA, 444 bp, Triticum aestivum
  Clone ID: PAT_TA_47247
acgtgcgcggacgcgtacgcggtctcgtgcttcccgagcgcacgccattcgtcttcttcgtcttcttcttctcctactgcatcccataaacatggtggccattaagaaaacgcagctcatacttctattctcacaacaacatcttcagaatacagaaaattatcttgctgcttaactatataaactgtgcagaccacctattctacaacatcgtctgatttaatgcccccatccacatacacaagagggctaaaaatctttacgcggacaatattgacaccctgatggctgttatgcacaacccgcgccatttcattgtacccaactatttcctcaacactattaatgattataaagacagcaggttcttccattttgatccaacgccttccacatataacttaaggatgacctttataggctcaatatgatcatgaaccatcc

SEQ ID NO: 47248 - DNA, 226 bp, Triticum aestivum
  unsure (1)..(226): unsure at all n locations
  Clone ID: PAT_TA_47248
cgtgcgggaacggacatactacagtactgtccctatcaccatataccactgcaaatcatgcgccagcgatgaatacatcaatcaaaaacggagccattgagacgctggagccaatcctntatatactaaacgagatcgacaaacggatcccaaaaaacatgttcgcaatgaacttcatcaattttgtaggctggcgctccttctaggacgccatcgacagcttctt

SEQ ID NO: 47249 - DNA, 376 bp, Triticum aestivum
  Clone ID: PAT_TA_47249
cgtccgagcctgctcgcggccgtcggcgcgcactccaccatcatcgagctggagggcccctcctagtatcgcgcgtctgtttattccttcgtccgctgcgttcttaccggcggtgttggtggaccctctcctttagtcgtcctgaatggcctcatgtggctccacctcatcgtcctcctcgtcccacgcctccgagaggtcgtgcaccctcctctcctatctaccatacgtcgaatcctctactacccttctacgacgactctttagcacgtactcgctcatgctccatattcatatcctcttccatctccgtctacgtttatgttcatatgaatgaaaccattttctttgatattccaatacttattaatttttt

SEQ ID NO: 47250 - DNA, 482 bp, Triticum aestivum
  Clone ID: PAT_TA_47250
cgccgggtcggagcgggcagcggcgtcggctgtcgcggccaccccggccacgctgctccggcgcaaggccaccatcgcggctgccacttcggcatcgtagggttcgctgtcgcccacccagtcccctgcctccgccgcgtgggctatcccggcgaacccgaggcccaagaaccgcgcaccggccccgcagtatcaccagtcggctccagttaaggttcccgtccgcccgcccccgaagccggccatggacaagtgggacgaactggacgacgatgactagctccgacacggtgatgccatcatgctgccaccgcacgagatggtcgcgcgtgcgtctgctggtggcgccgggccggccgcccccttctcgatgctggagggcgccggtcgcaccctcaaaggccgagatcttcgacgggtacgggacgctttgctccggcaaaccgatggctcgactgaatccggcgaggtgatatggctct

SEQ ID NO: 47251 - DNA, 515 bp, Triticum aestivum
  Clone ID: PAT_TA_47251
cgtgcgcgattttttcaggatgctttcatgctatttcacaacagtgggattttacttcaacagcctaatatcagttgtaggtgtttatggggtcctatatggacaactatacttggttctcagtggattacagagtgctctgttgattaaagctcatcaccagaatatgaagtccttagaaacagcccttgcatctcaatcttttcttcagttgggactgctcacaggattacctatggtgatggagttagggttggagaagggtttcagagcagctttgagtgacttcatcctcatgcaactgcaggttgcttcagtttttttcacattctctcttggaacgaaagctcactattatggacgtaccattcttcatggtggcgctaaatatcgaccaacggggcgtaaatttgtagtttttcatgcgagctttacagaaaactatcagttgtactctcggagtcactttgtcaaagcatttgagctgatcttccttttgataatctatcacctat

SEQ ID NO: 47252 - DNA, 598 bp, Triticum aestivum
  Clone ID: PAT_TA_47252
cgtccggtgaattgtaaaaataggtatatcttggttcagttagaggaatattggatgcgcttttgttagtgttttccagtttatgttgcatgtggttggctagtatctgagtttatgttgttttgtctcagtggaaatttgcttatgttgcctacaatcgcccggattacctccaagattcagatattgtgttgagccgattccaggtggagtagattttgttttttggatgtttgacagaaaatatgcctttattcaaacttttcttgctggtatttctttcagcagaaaaacatttatggaccatgggaacaatccctaggactggagcactcagacatgcccaccaaaagggccaatcagaatcgccattcttttgaaaagccggtgaagatctacaactaaagatggcgatattttcagttctgacctgacggtttctctaaacgaatgggcaagaacaccaatgttatttacgcacaccctgcagatgaagtggcggcaaaatccatgaccatgatgtgcttttgacccggtagttatacagatgtagaaccggctgttgagagggtgctgtgctgagttattattgtttgga

SEQ ID NO: 47253 - DNA, 168 bp, Triticum aestivum
  Clone ID: PAT_TA_47253
cgtccgcgactcgtactcgacgttcacttgggaagagattgataacgctacagcatcattctcagagtcactcaagatcggaactgggtctaatggaacggtatacaagggccatctcaaccacttggatgtagcgataaaggtccttcattctaatgacagcaccag

SEQ ID NO: 47254 - DNA, 450 bp, Triticum aestivum
  Clone ID: PAT_TA_47254
cgtccgcactgcttgccactccggcagcggcgtccatcccccgccgcctgccacaccggcagcggcgtccacctcccgccgctggctgccccggtcccggcggccacctctcgcgcccccctctgccccttggtcgtccgtcccctgccgtaggcatggccaacagtccccgctcggtcacctccacgatccgcccccctggcgagaggccggtggtctccggccttggcatctcctctggctccgaggcctccgaggagcgtggcccggtggtcgagtcgtcggcgcctgctgtcctggtcgccccgcctggctgggagcagccccgaccgtccaggagggagctgtggcgtcgccgccaagatgccgccgcccgggcgccacaagttccgtccccgcccagggagcgctgcgaggtctcaccggagatggtgggcctctgtttccgct

SEQ ID NO: 47255 - DNA, 378 bp, Triticum aestivum
  Clone ID: PAT_TA_47255
cgtccgcccacgcgtccggtcgggttcaagtacccgatcgcgctgtcgctgatccactacgcgggcgcgctggttctcatggcgatcctcaaggcgctgtccctgctgccggttgcgccgccttccaagtcgacgcccttctcctctctgttcgctctgggcgccgtgatgtctctctccaccgggcttgcgaacgtgagcttgaaacacaatagtgtacgtttctaccaaatggctaagattgccgtgactccgacgatcgtcgcggcggagttcatgctttttcacaagaaggtttcctgtcagaaggttatcacactggcgacggagtcaatcggagtggccgtggccacagccacagacctagagttcaacttc

SEQ ID NO: 47256 - DNA, 246 bp, Triticum aestivum
  Clone ID: PAT_TA_47256
cgtccgctcacgcgtacggtccggttgaagaaccccatcgcactctctcttatccactacgcgggggcgctgtttatcatgacgatccccaatgttctgtccttcacacctgactgcctctcctttcaagtcgactcccttctcctatctgttcgttttgggccccgtgatgtttttctccaccgtccttccgaacgtctgctttaaacactttagtttatttttctaccaaatggctaagatttc

SEQ ID NO: 47257 - DNA, 284 bp, Triticum aestivum
  unsure (1)..(284): unsure at all n locations
  Clone ID: PAT_TA_47257
cgtccgcggacgcgtgggcggacgcgtgggaaaaagagggggcagttcatcatacataatatgaagagttttagagggcctttgcgggggatggaacaggaaatgtgggaggcgactcgggaggcgactcgagacccgcccgcggcggccgtcgctagccggcggccggaccctgcggctctgcctgcgagccgtgttggagggcggttttgggtgcttgcagactcggatgacgaggacaacgacnacgaggagccggcgggtggatcgacgacggactactc

SEQ ID NO: 47258 - DNA, 256 bp, Triticum aestivum
  Clone ID: PAT_TA_47258
cgtccgatgagatggtttgtgtgaacgagattcaatgcgcttaggcataggactgctacatgggggagccgattacagtctgcaaacttagctcaaaacaaaatggatgagccttttgtaggcacgctgaccatcttatccaatataatacccatttgaggtatatgctgtacatgatgatgggcaggacagaatgacaagtactcggtccagatctacagaacgggccagaccacagccacggctcttcaatgtg

SEQ ID NO: 47259 - DNA, 369 bp, Triticum aestivum
  unsure (1)..(369): unsure at all n locations
  Clone ID: PAT_TA_47259
cgtccgcggacgcgtgggcatcactccactcctgcacagtcctctgcaccagccagcgcacggcgagcgcgcgggggcggccggcattggcgccgtaagatggcgagcggctccggggagcacttcctgaggcagctgagctccagcaacgggctgcaggccgcgcaggacgggtacggcggcggcggcggagggaggaggaggggctccaggcggtggtccaagaagcgggccggcgggagagggtacggcggcggcgggaagggggaggcggcggcgtctgcgtcggccgggaggaagcgggtgatggtggtggtcgactacagctccggngccaagcacgccatgatgtgggcgctcacccacgtc

SEQ ID NO: 47260 - DNA, 325 bp, Triticum aestivum
  unsure (1)..(325): unsure at all n locations
  Clone ID: PAT_TA_47260
cgtccgcggacgcgtgcgtgctcntgaatacattctcaagctcgggctattaccgaagcgctacaatcatgtcatgagtatgattaaaaactcacaattgtgcggccaggctagcatctcttatgggcaacagagaggcacatcagaagcggctctccactgtgcgacagatgaaaagaccacattcaacctgcctcttgaaagccggagcatccaaattgctgttgctttcgcaaaggacctcaatgacaaggatcactgggccaggttgtgaattgaggctctgaggcacggaaatgttggtattgttgaatattcataccaa

SEQ ID NO: 47261 - DNA, 341 bp, Triticum aestivum
  Clone ID: PAT_TA_47261
gtctgtggtgtttgttttctcgccgagcagagcaaaaccatgggggttttttctttgtccctggcccctccaaccgccgggctcccttgtttgccccgaaggcccaccacctccttcttaaggccgggggtcccctcccgagctacccttgccgtttgccttggtgcgaaacccaaggggcccctccccattgtctcgccggcccaactgggggacgaccccgttaagggggacccctccgagtgcaacgccttcctccggggggggaaaaaggtcgcttccttgctccagaaaatgctcaccctgttggaaaacatggagatggttggtgcattttcacc

SEQ ID NO: 47262 - DNA, 435 bp, Triticum aestivum
  Clone ID: PAT_TA_47262
cgtccggtcgccgtaaagagaaacttctcaagttcttcagcacatatgatacgacgcaagacagtgagaaaaaaacacccttgatgttacatttccttctgttcatcgtaattcatgtttctgacacattttattggttagtttttgttttcctcagattactagtagctatccagatatgctcgcacagggaggtgtatgaaccgattatacaagggcccggaggaaattacagtctggaagtttggtgcttgcagcacgtcattccagctcgtgtgtacgcggaccatgttatgatggtggctttggccagagcgcttgaggtccccctcagagtggaatcactccaacgaggatatgctccagatatctacactggtcctggagttccccgtccgagcgtgaccctgctgtacacgggtgatcactacgaca

SEQ ID NO: 47263 - DNA, 451 bp, Triticum aestivum
  Clone ID: PAT_TA_47263
cgtccgctcatctcagatcgcctgctgcttctctccttccttccttggtttggtctgctctgctctgattggcatggcgacccagatggacgcgtacgtgatgttccgccgcgccgcggagatgatgatggtggcgccgcccggggccgcctacgacgagcaggacgaggacatcggctccgcgtccgactccgagtgcacgtcgacgtcctcgtcctccgacctcgccgacgacgccagctcctcgtcgtcctcctccagctccggcgaccacttcgagatgtccgccctcatgacgcagctccccatcaagtacgtgcgcgcgaatgcgattgctgatggtttacgttcgtgatctatttctaagcagagagaggtgctgacctgccttttttctgtgctgtgcaggaggggattgtccatgttcttcgacggcaagtcgcagtcgttc

SEQ ID NO: 47264 - DNA, 434 bp, Triticum aestivum
  Clone ID: PAT_TA_47264
cgtccgcggacgcgtgggcgcgctcccaaaccctagctcccaccgcagcggccaccgcctgtcgacccccgcccctctcccggtgcgcgcctgttgctgcagacgagaagcggctgaggcgaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctgatcaagtggttgttcagcgcatcgatgagag

SEQ ID NO: 47265 - DNA, 293 bp, Triticum aestivum
  Clone ID: PAT_TA_47265
atcatagggtttttttttacgggtattgtcgttcttttattaaggtgggtttttttgggggggaaaaaaaaagctgcgccggaccgatccatttttatattttttttaccccaccgaccctgaaacggccgggttcgtctgaagtacatattggcgggtgtccttttttgtcccccgataaatgaagggggagccccccggttaccacagttgttaaattttggcgttttcatcggccctggaccttcaggggaacgtttagccgggggtggtttggtgcccattggctatgc

SEQ ID NO: 47266 - DNA, 466 bp, Triticum aestivum
  Clone ID: PAT_TA_47266
cgtccgctttttctgtaaagatactattacattattggtctccctcgagcccttgtttcatgcatcataatggctcgcggccatcagtgtatacccatcgtgcaattattaggaagatcttcagaattgaagagatttcataacctaactacatgcgggcagcagccagcattgatgtcatgagatgtcttgtactttacttatttaatctgctaggagtggtaatggatctgcatctgcttggaatgttatatttccatcttgagtcacaccatatggaagtggcatctgctattttaggtggttcgccatctggtacacacttttgttcttcacaacatatgtttattaattttccttacatggagagttctctgagacattttctggttttgctttaatttgactttgaattgtaaaaataatattttaagctatattctggacgccagaaattctaatgagt

SEQ ID NO: 47267 - DNA, 286 bp, Triticum aestivum
  Clone ID: PAT_TA_47267
cgtccgttcacgcgtgcgtgcccgaactatcaccggatcggatgagcccatgatgctgcaatcatgctaggaggatagctcagtaggttgtcaactcacatgcatctgattactcgatgatggaccggcccctattcggccgatatgcaatagatagtacgatcacgcagagactatggggaagagctttatctgctttgaggcaggttctttggttgcgacagagatagatgacctgggcttgaggaagatgtgacctcaaggaggagagagaagtatttgaata

SEQ ID NO: 47268 - DNA, 405 bp, Triticum aestivum
  Clone ID: PAT_TA_47268
cgtccgcggacgcgtgggcggacgcgtgggttgattttggtcctaggacacgtggatgaacaaagtttgcaagcagtagtgtaccagtctgtgcattggatttataggatttttgtatcttcggtatgttgcagatccaaagatcctatggacatggtatgagccctacttgaaggatgatgaggaattctcccctggatctaatggtcgcatgacaaccatgggtgtatatgtgcgtgatcttatacttggacagaaactatgccaactagctggacaaatttcttagtcagtactactttgatagtatccttccaagagttcctgttccagtagttcgtcaagtaacaaccaatcttgagaagatgaagctgcctaccaagctttctggggtgacttgagaca

SEQ ID NO: 47269 - DNA, 378 bp, Triticum aestivum
  Clone ID: PAT_TA_47269
cgtccgcttcaattccattaactcacagcttcaagttcatcatcctctgtctctgctcaaccaataatacagatttcagtcacacatacagaaatgggtaacactgttgccgaggaagacatagaagacataccaaattcagatgcaaatccaccaattttgactgaatatcacatcacagtccctacccttcacgacggactaatgcaaggggaacaccaacacgagagaaggcttctggatttcctgaaagcaacgccttcagtgcaatggctgaaggacatcaacgtctgcgcgccactgggaaaatttcagctgccatcgatcggcgtccaccgctaccttcatgtccacttcatcagaactgtcgactggagc

SEQ ID NO: 47270 - DNA, 168 bp, Triticum aestivum
  Clone ID: PAT_TA_47270
tggtttctgggctgtgtgggcaggaacacggaccaaaatattacaggcatgttctctcacacaattggttccagaaggaaataaagaagctccacaaaatcaattactggagtcttaccgttcaaaatgtcacttgatcagtgctaatgttacagaagcgtatgtact

SEQ ID NO: 47271 - DNA, 430 bp, Triticum aestivum
  unsure (1)..(430): unsure at all n locations
  Clone ID: PAT_TA_47271
cgtccgctcccaaagcccgcaccgagaccaaatcctcgctagggttttactccagcgccgccgtcccgaaatctcccccgaaaggcgaccatgtccggcggtcccgcggcggtctcgttcctcaccaacatcgccaaggcggcggcgggcctcggcgccgcggcctccctcctctcggcgtcgctctacaccgtggacggcggcgagcgcgccgtcgtcttcgaccggttccgcggggtgctgccggagaccgtcggcgagggcacccacttcatcgtgccgtggctccagaagccctacatcttcgacatccgcacgcgcccgcacaacttcttctncaactccggcaccaaggacctgcagatggtaaaccttacccttcggctnctttcccggcccgatgtcgtcaacctgcccaccatcttcacct

SEQ ID NO: 47272 - DNA, 332 bp, Triticum aestivum
  Clone ID: PAT_TA_47272
cgtacgctcccaaagcccgcaccgagaccaaatccttgttagggttttactccagcgccgccgtgccggagatgtcccccgaaaggcgaccatgttcggcggtccctcggctggctcagctctcaccaacatcaccaaggccgcggttggcctggtcgcctgatactgaatactctcggagtgattgtactccgcgaacggtgggcagcgtgcctggcgaatggaacgcgtcctgtaggtgctcattaagaccggcggctgtggcacctacgcgctcggggcccggctccataggcagtacattatcgacatccgctcgcgctcgctcaact

SEQ ID NO: 47273 - DNA, 390 bp, Triticum aestivum
  Clone ID: PAT_TA_47273
cgtccgcccgccaggcccctcccgctccctctcctcgctcgggtgcttcctccctccctctgtccactccactcgccactggctccgttcggtccgtgaatcttgaccgacccgcctgagccggcagccaccggtggcctgctgccgcctctcgctccagtggtggtgtggctacgagctgcggacggagggggtccgggatggagcggtacgaggtgatcaaggacataggctcgggcaacttcggggtggccaagctggtccgggacgtcaggaccaaggagctcttcgccgtcaagttcatcgagagggggcacaagattgatgagaatgttcaaagggagattatgaaccacagatctctgaggcatccggatattgttagattca

SEQ ID NO: 47274 - DNA, 385 bp, Triticum aestivum
  Clone ID: PAT_TA_47274
cgtccgcggacgcgtgggtgaatatgaagtattgagtgtgtggtgcttgttttctttcgccgtggttgatatatcattagcacttgtctttccggttgtcaagccgcaacatgtctttaagagtgtggtattatggtttgctgggtgagactgctcgcttgtattccctttgtcaagtcagtttgcttgtccgtgtccagcttctgaatatagggtcgagccgccgtcgacgccttcggcaccatcccagctcgcagcctcagtcgatttgctctgtgtctgcaaccgtccaaagatcccaaccctatcatcttctcctaccacgagctcggcaacgagatcggacacggcacgttcagctccgttcggatctatgccggtcaag

SEQ ID NO: 47275 - DNA, 429 bp, Triticum aestivum
  Clone ID: PAT_TA_47275
cgtccggtttgaagcatctagagatgggctttactttgtttctgaggataaatcttctggacaatctactgataagggcagggcatggcagcaaactttcgtgaatctactgacacgtttagatgcagcataccattcctttacatgtgcagaacaagactggaaacgtggccagctcaacatggaaactgccggaaaaggcttgtattcagctaccaatcaactttctgtagtctctgtcaaggcaaaatctgctttagttgatctgcaggatactctggtagacatgtatgaacgtgcttgtgaagtcagtgtatcattatctggattcaaacatatttcacaggaccgcactgccttgactgcagaatgtggctccttgctcgaggaggttttggctatagcagaggggttgcatgatgtctacac

SEQ ID NO: 47276 - DNA, 411 bp, Triticum aestivum
  Clone ID: PAT_TA_47276
cgtccgcacccataccaccacctgcaggaacagcgagatccagggctcgagatcgagatcccgggcaggcagcaatggcagggacggtgactgtgcctggatcgtcggtgccatcgacgccgctgctcaaggacgagctggacatcgtgatcccgaccatccgcaatctcgactttcttgagatgtggcgccccttcttccagccgtaccacctcatcatcgtccaggacggcgaccccagcaaggtcatcaaggttcccgagggcttcgactacgagctttacaaccgcaacgacatcaatcgcattctcggccccaaagcctcatgcatctcctttaaggactccgcgtgccgctgcttcagctacatggtctcgaaaaagaagtacgtcttcaccatcgacgacgact

SEQ ID NO: 47277 - DNA, 426 bp, Triticum aestivum
  Clone ID: PAT_TA_47277
cgtccggagcgcccgaggaattcggcgtcgatccgacgcgaccgaattcgccccatttctcggttttcccagtggttcgtgctgatctctgtctctgtgtactatcttctcctggcccgattgttgatgggatttggcctctcacgagtcggccagggagaattccctgcttggcgaagcttctgctgaatttgctaaccatttccacgttttacttgggtctaagaaagctccagttttctccaaccaatcgctctgatctcttcttgtctagatctaatttttctttttgggtttcgtgtctaaggtcttcacccaataggtcagaaattatcaaccatttcccgtttctctgctgaattttctcttcatttcttgctctttctgccctcgttcttcctgatctgaatggtcaagctcggggtt

SEQ ID NO: 47278 - DNA, 276 bp, Triticum aestivum
  Clone ID: PAT_TA_47278
gtgcccgacgcgtgctccatgtagtccatcttcaccgagcaaactagcattgcaccgtgcatacgtggttgtccgaggtcggaggaagaaggcggcccgagatggggaagatgggggagtttgtataaaatctctaaataaacatgggctggtgattgggaattgtgaaatgtacgtagctggccggtggtagatagtaaattcttttgtttgctctttgctacgctcaagttcagctcgtgtgtactgtaatatatgcttcccttcgttttgttc

SEQ ID NO: 47279 - DNA, 342 bp, Triticum aestivum
  Clone ID: PAT_TA_47279
acgcgtgcgatgatgtttattactctcagcctccaccaccttaatgctccccgccggttagacgggggggggggcgaggtcacttggcgacaatgccgcgctttgcccgtagggtattaattctttgtgcgcggacctcctgaaggtccggccgattgtataccacgcttttgtagatgggaagctgttatgcttcaaccaacagctgtgttgtttgttgtagagacctaatggctaacagatacatatccaaatctgggctgactttaatctaaaggccgatttcgacggtagaacctgttgagcttttagttaaagggtatatttgttagcttggaaact

SEQ ID NO: 47280 - DNA, 454 bp, Triticum aestivum
  Clone ID: PAT_TA_47280
cgtccgcccacgcgtccgggacaatgtgtttgtttttgatgagaaatgcacacccaaaaccgcgggcaaatctgcaaacggtaactctggatgcttgagaaatcttagaagctcaaataggaaggctaaagtagagcttcagaaggtcaattgttctagcatgatttctgacaagatcacaccggatggtagggaaggacggctatcttctagaaatgcaccatcagagaataagggagagaaaaccacctccttttcttctttgtcccgaactggaaaaactgctgagagctgttctagaagccctactaaggagaaacggctgaatggaatggctaaagttgagcctcaaaagatgcagtcttcagaaaagttgctgtccacgacactgaatgaaggtgaagataagctctcttttcaaaatatttcatcaaagagcaaggcaaattattct

SEQ ID NO: 47281 - DNA, 436 bp, Triticum aestivum
  unsure (1)..(436): unsure at all n locations
  Clone ID: PAT_TA_47281
cgtccgcgtcggtactgtcaaacggtgagaaatagacaatagcggcacgagttgatgttaccctatgaagatggtatgtatgcatgcctgccgttgaccattcccactgtgaagctatatcctgccattgcaccatgaatggcactgtgtgccagcagtgtgcagtacacattgtccgaagcattgcttggaatggctcggatcatgtaggttggatctatgtatttaatggtcatctccatctttttgctcttgcaatgatccttaatcttgtgagtcaaccagagaccaacatcaagaagcagcttatttccagatgcatctagctgatctgctacaggtatacttttggcaatgagatcctgtcctgctccctcagccactacaatgaccatgtggttgttctctttcagcctnctttctatatactcaaaga

SEQ ID NO: 47282 - DNA, 185 bp, Triticum aestivum
  unsure (1)..(185): unsure at all n locations
  Clone ID: PAT_TA_47282
cggaatttctgggtaaaaaaaaaaaaatcanatacagctattaaaataagttagtaataaatgcacttagacatttaatatttaaaatcctagggggtggggtaatttaaatggggtgttctttttataaatctagtttctttgggggggtttattaaacatttttggctgtaaaattatttttt

SEQ ID NO: 47283 - DNA, 432 bp, Triticum aestivum
  Clone ID: PAT_TA_47283
cggacgcgtgggcggacgcgtgggcaagcactcaatgtgttcagaatgcgacttcttggtgccgaggtgagaggagtccactctggaacagcgacattgaaggatgcgacatctgaagcgataagagattgggtgacaaatgtggagactacccattacatattgggatctgtggcgggtcctcatccttaccccatgatggtcagagactttcacgctgtgattggtaaagaaacaaggaaacaagcgttggagaaatggggcgggaagccggatgtcttggtggcttgtgtcggtggtggttcaaacgctatgggactcttgcatgaaattggggaatgacacagaggtccggatgatcggtgtggaagcagcgggattcgggttgggacagtggcaaacacgctgctacattgacaaaaggaagatgtg

SEQ ID NO: 47284 - DNA, 365 bp, Triticum aestivum
  Clone ID: PAT_TA_47284
aggttggtctgtcatgcttaaagcggatatagtgactagtttgttatgtgctttgcagaacggatggttcaccataataggagcatcacaagacattgtagtcattggtgaagaatgatatgcagtgaaacacaaggatttatgatggtgtcccatgactgaagattatgaaaaataaatcactcttctagttgatgtatttctggttagatatggactaaaatagttgtctacaaggtgtttttggtttatattttctaaatggtatttattaactccgctgtatgtgaggatcatcttcaatatgtatgatttggattaatgaaaacagggtatatctacatctaaaaaaaatcgctgtttac

SEQ ID NO: 47285 - DNA, 414 bp, Triticum aestivum
  Clone ID: PAT_TA_47285
gctttgatctccaagttgaccgaagaaaagaattctgcaattcaacagaaccataaaattagacaggaacttgtgagtgcagtattgcatgctatctttctagatatagtactgtggcttcatagtggaacctttatctgaagttttggaacttatctaatactaagcacctactagatgccaccatctatgatcatctgaaatttaagaatctaaattcaattggtgctaagaggaacttaaaagcataaagctgctgtgaatgctttagttttcttcttctccctatcattttctgttttgaaaattttcacccttcttgtttccttgtgatgtattgggcatttttacttgaggaccaaaccaacagagttattacattaaaggaagtaatatggaactatcttgaagctc

SEQ ID NO: 47286 - DNA, 355 bp, Triticum aestivum
  Clone ID: PAT_TA_47286
tccatcttttacacctcgccgacgccgtgctgatacggtctaactcgccgccgccccgccgggacggcgttgctcccggtcaacccgcggctgcccctctttaacctcgccgccgccagccccagcacgccggcaccggcaccttcggctctggctacgatcgctcgccgcgctggggcagatgaatcccggagggcaggctccgctgggtcagacggatccggccgggcaggctgcgctggagcagatggatccaggtgggcagcagtgggcgccgagaggcctggccgtacaagcgggctccgtaccggctcccgggtacgggaacgggcaggcggggccggctccagcggac

SEQ ID NO: 47287 - DNA, 436 bp, Triticum aestivum
  Clone ID: PAT_TA_47287
cttttgcctgagcctccaaagatgagaacagtgcagcttcgagccgcaactagaacagcagagatgagatagctggctaccagtcccgaataggaatccatggcgccagccgcgaccccgtgctccccgcgtctcctactcgcctcgtctgcatctccgcctccgctcttccgcgtcgcggtccgccccctgctgcccggtagccgccgcgggggcgtgcgccttcgggttcgatgcggagcggcggacgaggaggccgaggttcggcggggtgagcaggttaaggcgtccgtggaggagatggcgcccggcctcgacctcgtcacgctcgcggcctgcctcgtgggcctcctcactggcgtctccgttgtcctcttcaacctttcgtacatggtgttcgcgtgcgccgactcgcgtgtgtcccatcggtcaccct

SEQ ID NO: 47288 - DNA, 420 bp, Triticum aestivum
  Clone ID: PAT_TA_47288
cccgtctccgccgctctccctactcatcgccacgacctcctaccctttctcgtcaggggggagcgagggcacgatgcggattcctctcatggctggactcaccaagattctcctcccactcctcctcctcctctccgtcgccgcggccagttcgccgtcgtcggacgcggaggctgtatcccggttccaggagtacctccgcatcgacacggcgcagccgacgccggactacgccgcggcggtggccttcctccgggaccaggcggcggctgttgggcttgaggcgcggacgctggagtttgccgccggcaagcccttgctgctgctccggtggcccgggcggcggccgtcgcttccttctatacttctcaactcccacaccgacgtcgtgccgtcggagcccaagaagtgggagcacgc

SEQ ID NO: 47289 - DNA, 440 bp, Triticum aestivum
  Clone ID: PAT_TA_47289
tacgtcggatttccggtcgaccacgcgtccgatagtaggaaaccctttctccaatgggtttatttaaaagataggtagggttattacactaggtgcgcggcctcgccatgggcgagattaatatcggaatcaacggtttcggaaggatcgggaggctcgtcatcagtgtcgccctccagagcgacgatggcgagctcgtttccgtcaacgacccctttatcaccaccgagtacatgacctacatgttcaagtacgacaccgttcaccgccactggaagcacagtgacatcaagctcaaggacgacaagacgctgttctttggctagaagccagttaccgtcttctgcgtcaggaaccctgaggagatcccgtggtgtgaggctgttgacgattaccttgtggagtccaccggtgtctgtactgacaaggacaaaggcggt

SEQ ID NO: 47290 - DNA, 329 bp, Triticum aestivum
  Clone ID: PAT_TA_47290
attttacctctggtggtacaaagccccggttaattccatttttttcgagggtgctgattcttactgaaatgccatttaactttctggggcatgagccttggtgaaaacaaaaacattcccccttcggcccattatggaagacatttttaccagctattaaacggttcttgggggtttaacaaggttattctaaggtaggttttggaaatataggtaatcaggtggggggtttataaacttgtcagaagccagttccagggggcctggatcaaatagggggggaattggtggcatttatcatttttgattaccctacaaagaaaaaccct

SEQ ID NO: 47291 - DNA, 350 bp, Triticum aestivum
  Clone ID: PAT_TA_47291
gccaagcatgcggctaaacacgtcattgctgacaccatggctgataacttggatggctccttgaaggggcagactaacgaggagactaccaaggaacattcaaagggtcattcaaagggtggggccaccaatggcgccaacgataccgacggttaatcaaagggctattcaaagggtggtgccaccaatcaggccgccgatgaaaatgtcgaagacaagttctcagacaaggcttgcaatgatgctactactgctaatactcctgctcggagtagccagcggggggacaccgaaggggaatctaaaagcgacactacaactggcaccacggatgctaccactcatactac

SEQ ID NO: 47292 - DNA, 360 bp, Triticum aestivum
  Clone ID: PAT_TA_47292
ccgtcgtgccctacagttccgccgtgccgcatcctacgacaccgccgacgcctcaccagccaccccccaacactccgcccctcacgcgcgtcaccgccgtccccgtcccagtcccagtccccgttccacctcatcgcccccgttgctgcccccaccctgtccgcgatcttgtacgggattggttcctgagttattatcatggcagcaatgaatagtgatctgggtggcttaggtcctagacctgcaaatgcaccaccaaatccttttgaaagtgccatgtatggtgctggacctggactgatccgtactggacttggagcatatggagagaaatttcttggttcgagttctgagttcatg

SEQ ID NO: 47293 - DNA, 283 bp, Triticum aestivum
  Clone ID: PAT_TA_47293
gctaaatctcacttgcaccttcgtggccaccacacacacacacacaagatcttgatcatcagctgcgggggcaacaaccaccaaggaaatcctcgctcccccaccccgccgggggtacccccgcaaatactaatccgacccaccgaccgcgccaatattcgaccccgaggagattaccaaatgttccacgtaccgctcggtcatactcaacttcctggacacgctggtgttcctatacatgacaggcggcaccttaatgatttacaatcaccagacaaacccc

SEQ ID NO: 47294 - DNA, 386 bp, Triticum aestivum
  Clone ID: PAT_TA_47294
ccaatccccagaagcacccacctctgcgcgagatcccacgcaccaaaaaccgcgcgcggattgtcggtgtgcctcgatctcgcgccgcgcctggtggaggttgggggcaggaggcgaaggcgatggccgcggcggcgaagctaacgcggagcttctcgcggcagctgtcgtcgggggcggcgcgggtgtggcgccagctgtcgctggagccgcacaccccgcggcgaggcgcgcccgttgcggcggcggcggggccgaccaggttcggcctcgcgaggcagtcgtcgctcgacccgacgccggcgcccgacgacggggcggtgctggccatgccggagaacctggacgccaccatgcggctgctgtacgcggcgtgccaaggggga

SEQ ID NO: 47295 - DNA, 374 bp, Triticum aestivum
  Clone ID: PAT_TA_47295
gcggtctcctctcctatcctctcctaagcggatccggcaccgacccaccgcccctctgctctctgctgggggcggaatcgctgggcctctctgtgctctcaattcatgcggcgactgttagtttgactcggtcccatccttctgttgatcaatggctgacggtgaggatatccatccacttgtgtgcgacaatggcactggaatggccaaggctggctttgctggtgatgacgcacccagagcagtgttccctagtatattcgcggctgctggacacaccggtttgatggttggaatgtgccataaggacgcctatgttggagacgaggcacatgctaaaagaggattcttgaccttttaattccccattgatc

SEQ ID NO: 47296 - DNA, 431 bp, Triticum aestivum
  unsure (1)..(431): unsure at all n locations
  Clone ID: PAT_TA_47296
cccacgcgtccggcggacggcccagcttcgcgaccacgatgagggctctccccatggccgtcagccgtggcgccgtcgcctgcgccaccccggccgccgccgcagcagccttaccccggagatccatgctcctctccaccgctggcgcgggcgcaggtaagctcacgttccctactcctgtccttcacgccaaccgagaacacgagcattgcatgtggctgattccgttcccctgttgcttgcgtcccggaatagcgctggagtccgaccccatcaggctgatgagcacgcccaagctcaagctccgcgcctncgcgggcgccgagcaggccgcggcgacctccttctccagcaatgacgaggccttcgcctgggccaagaaggacaaccggaggctcctccacggtggtctaccgcgtcggcgacatcga

SEQ ID NO: 47297 - DNA, 438 bp, Triticum aestivum
  Clone ID: PAT_TA_47297
accagccgcgcgcgctccactccgctgctcctgcggccgccgccgtccatggcgtccgccgcgcgggctctgggcgcgctcctccacagggcctcttcgttttcgtcctccgcctctgctctcaggagcgcctcccttgtacacaggaatggcccaactggtggcgccagcttgttccaggggcacgtggctaggcggaggatttggacgttccagccgctctgcatggggcggcgctcctgcaagatcgccgggaggaagggtgctcagaatttgaaaaagatgaagcgcaacagcaaaatcggaaaagaactcgttgctgccatcaagaagggcggtccaagtccttcatccaacacagctttagcagcgctactaaagaaagtaagagagcttgatgtccccaatggaagttgttgagcgtaacatcaaaagagc

SEQ ID NO: 47298 - DNA, 325 bp, Triticum aestivum
  Clone ID: PAT_TA_47298
taacaacacaacggcattaactatagaacaagattcaaattagacatgtgtctcattccaggtggtggagaaagtggaagaacgatacatgcagttatcaacgtaaaagggatcctgtggggtcggcagtagtgacaatgcccagagagttgaagggtcaccggaggggatagatcttgcacctactttccatttatttgtaagttgtgaatccgaacaacagttcatctgaaatccttacagcggatatgcgcaatttttggccagctttcttcgtcaggcgcttggcagctctcgttcaagcgttcacaaccccaaacacata

SEQ ID NO: 47299 - DNA, 433 bp, Triticum aestivum
  Clone ID: PAT_TA_47299
cccacgcgtccgatgcagtcgagctccagcccaagcaagcaagcaccaaaccaaagcagcgcgccggaggggagtcgggtccatggacctggccgcgaaacggggctggcttccgccgctccgtgcggatcgacgggccccgtgctggaggcagggagcggagcgccggaggagccacggtgcttcaagccagggtctcaatcgacctcggaatccagtccccgccgctcgacatcgacggagacgaggacagaatcagcgcgctcccggacgacgtcctcctagcaatcctagagcgcctcgacatgtgcgaggcgttccgcgccagcgcattctccaggcggtggcggaaccccccccggcggctctcgctcctgcacctcgacgtccgccagttcggccgagacacttcgacggtcgacctcggggcaat

SEQ ID NO: 47300 - DNA, 411 bp, Triticum aestivum
  Clone ID: PAT_TA_47300
gtgaccgctgagcccatgcaccctcagctcactcccgatctggatccagatctactcggtccacttcagtctgcggcgaccactttttctcctcccacgcagatctcgtcggcgctagcaccagccgcagcgccaaagagctcgatctgctctgctgttgacttcttcagcgttgcgaactggaggtcgagatctcgtcctcgccgtcttcagttcacctggaatcacatctggcatcgacaagcttactatttcccccggcttgatctggcatcgacaagcgatttcctccgatttcttcactgtatggatctggactccctccgagcacctcccgactggaagggtatcttcccgagctttcccttaagcaggtactggttcaacacgaaaggtggtttcatactttct

SEQ ID NO: 47301 - DNA, 455 bp, Triticum aestivum
  Clone ID: PAT_TA_47301
agttctccctgcagcccctcccgccggccgcggcctgcggcgccgagggcgcgggcgcccacccgcaccaccacgacggcgccagcgtctgcccgacgtgccgcggggccttcctattccgcgcccaccggatcgaccccatgtggggcgcgttcctcgagatccccggcggcgtcgcgggcgacgacggcgaggacgcgcccaggggcgacctatcccggatcaagaggtggattgcggagcgcccgccggacgactggcctccgatgccgccgcaggctcccccgatgcagatgccgccgcaggtccccccaacccgacgtaagcaggggaggaggagagggagggaggaaggaggcggctgctgtggcggtggccgcaactgtaacggaggggactcctcgggcggtgagggtacgagcgcggcgcccaagagggagtggtgggggggcgcc

SEQ ID NO: 47302 - DNA, 406 bp, Triticum aestivum
  Clone ID: PAT_TA_47302
cccacgcgtccgcccacgcgtccggttgtgtttcctctgtgtactatggtgtgagcttaagcgagcagaacgccgaaggaggatcttggggatgacggaggcatcgacgacaacctcaaaggcgagagctgtgcctgagcccccacaaggacgttgggtggaggatatccggtgccaacgggccgctcatgtaggtgtccgagatatcggagctgtcggagtcaacggtcatcgtccggagacgggtcgatgggggatgctatgatgaattggcccgtggataagaatattttagtcactggagagattgttgaacatgtgacattgatgcaaatctctggccacctacgggtgaaactgcttgaagaccaagtttgaatatgtacgagggcagtgaatttcggca

SEQ ID NO: 47303 - DNA, 446 bp, Triticum aestivum
  Clone ID: PAT_TA_47303
cccacgcgtccgaatccccaaaaaaaaactctcacagctttcgtcccgacccactctcgattgccctgcccgaaacgccgctccaggattcagccgcgatccgatcgccgaggcgaccgcgccgtcccgcccactcgattcggtcgtgtgcgcgctaggaagttcgtccgtcacgcgcctcgcggttttgtgttcgttttcccgttctggtttcctgtggctcgctcggttaccgcttttaatcttatagctagctcgatccatctgtgttactgtgtaggtatgtgtgttcttctgattgcctgcgcccgcagtagatgctggtcatgactaactgcttgattgatggattgcttgattttggttgtggtgactaatttcctaattggatttaatcctgctcctcaattggttcgttgactgctgcttgatgttattgatgtgca

SEQ ID NO: 47304 - DNA, 256 bp, Triticum aestivum
  Clone ID: PAT_TA_47304
cccacgcgtccgaatactcaaaaaaaaactctcacagctatcgctctgacccaatcgggaaggggctccacgaaacggggatccattattcagcacctgatccaatctccaatacgaccgctgccgtaccgtccactcgattcgatcgtgtgctcgctaggaagtgctaccctcacgcgcctcatggtcttgtgctcgttctgcctgttctggtttgctaaggatcgatggcttaccgattttaatcttatagctt

SEQ ID NO: 47305 - DNA, 436 bp, Triticum aestivum
  Clone ID: PAT_TA_47305
cccacgcgtccggagtcttcttggatactgcttgttccccatggacgtgggagctctgatttgcctgctcaaggacaaggacatgctaaagatcgtcgtggtggcggtgacactagcatggagctcctgggccgcctatccattcatgagcaccgccgtgaacccaaggaggaaggccctggcgctgtaccccgtcttcctcatgtatgtctccattagcttcctcataatcgcgataaactaggggtatgaaggttgctgccgcggaccgtcaagtccggagattttcccgtcgaaccatccgagtgagtacaggttttgtctgactggtttcttttgtaaataataaattttgctgactactttgagatttcttcttcttcctcttctttacataatcaaagggcgtatagtaggggtatagaaaatcaatcca

SEQ ID NO: 47306 - DNA, 435 bp, Triticum aestivum
  unsure (1)..(435): unsure at all n locations
  Clone ID: PAT_TA_47306
ctgcgtcttcctctgcttcctcttctcctcccaatccaatccttgtagaatcttccaccggcggccgggtaagatgaacggcctcctcgtgtccccgtgcacaaggccgcccctgctccgccccttaccgagcccggccacccgtcttctacccgccagaaccctagttcttcgcccgctccgcctcccccgtggcgtctgtgcgtccccttcttccccgcgcgccgccgccgncgctgcgtctgcagtgggcggccttctggcgccgctcgaggttggcctgcgcagcatcaacctctcgccgctgcgcccgccggttgcggcggccatgtctgcggccgtgcgctggctgggggtctaccgggaggttctgcttgtcggggtgctcttctcctggtttcccaacatcccctgggaccgccagcccttctccgc

SEQ ID NO: 47307 - DNA, 409 bp, Triticum aestivum
  Clone ID: PAT_TA_47307
gccgcggctaactggtgctacgcaaccgtcgcgccccgtgcccgctcctccaccatcgtcgccagcctcggcacccccgcgccctccaactccttcttcttccgccccaagctcatcaggaacacccccgtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcgcgtgtgtgcccatcggtcaccctgggcctggagcccggcgaggccttcaccatccgcaacatcggcaacatggtcccctcctactgcaagaacaagtacgccggtgttggat

SEQ ID NO: 47308 - DNA, 430 bp, Triticum aestivum
  Clone ID: PAT_TA_47308
aaaacactcaacgcctgatcgatccagatccccaatcccgtctccgctcccaccttctctcctcccctcccaagtcccaaccctccatggaggggggagccgcctaaacatgccccgccccccaaagccgccgccgactacggctccggcggtggcggggagaagggcgccccccgccaaaagtgcggggagcagccgtggaagtaccgatgcccgggctgctcccgcctcacctgctctcttggcgcattgacaacccgctgcgcccccgcaccgtccccgtcccgctcgcccagttcgacgacaaccaacttctctcccattacatcttggagagagagacaagcactgtcatggagcctatccacaggctgctcggcggcttcggccgcaacttcagctgcggcatctacgaacgccatggcgcgca

SEQ ID NO: 47309 - DNA, 195 bp, Triticum aestivum
  Clone ID: PAT_TA_47309
agcaaatttagctatcccaccctttttccgtgagctagcccaccaccacaaggtccacaactacagctaacttggtcaaaatggctcgcactgcagctactaagctcgggctggtcgccctgggggcggcaatgatcctcgaagcctccgacccggccataaattggggccaggtgagccttgccttgaccccct

SEQ ID NO: 47310 - DNA, 306 bp, Triticum aestivum
  unsure (1)..(306): unsure at all n locations
  Clone ID: PAT_TA_47310
cccacgcgtccgcaacagacgtcctagctgccactccgccgcgcgcgtcagcgacctcaccggcaccggcgaagcaacaccggcacccatggcgctcgcctccacctccgccaccgcctccgcgggcgtgctcaagaacccgttcctcggcgcgaggcgcgcgctcgctaatgccgcctccctcggcgccgccaagcccgtgacgcgccgcgtggtggtcgtcgncgcggccgtcggtaagaagttgtggattcccgcgggggaatagcgatgcactgacttcaccaaacgccgtcttaggctcga

SEQ ID NO: 47311 - DNA, 264 bp, Triticum aestivum
  Clone ID: PAT_TA_47311
cccctccgttccggactctcaagcagcagcggcggacggcggcgcgcgcgtctccgtctcctcgcgcggcgaatcgcagatagaatcggattgattctccgtaggtttctgtttcggcgggttgggcgtgatggcggtcgcgtcgcgcctggcggtggcgcgggtggtccatccggacggcggcgcggcgggcgggaggaaagggcgtcaagggttcgcggtggtcggtctcccccccgccgggaggagggggaggctttattt

SEQ ID NO: 47312 - DNA, 431 bp, Triticum aestivum
  Clone ID: PAT_TA_47312
cggacgcgtgggcttggttgttcttgcagtgcttataagcttgaaatctttgatgaatccagcccgaactaaagcatgtcggtgagtcaggtgctgggccaaccactgtcgtttgtctacctccttcccggtgagcccatgctcttctgctcttgacgcttgagctgcctgcaattcttttctctgttcaaaaattcccaaagcatcagcaattcttttctctgttcaaaaattcccaaagcatcagtactttgtatctggatacaccatgtttctgcaaatttccattatgcttgtatgtacaaaatgtgtgcatttactacttttgatttgttgtagtgcagagaagttaccttattgcgggctgacctggaggtggctcctccatgtcgacacaattataggaccaacgtgctactgaccatgcaagc

SEQ ID NO: 47313 - DNA, 451 bp, Triticum aestivum
  Clone ID: PAT_TA_47313
cgcgtactctccagcgtcaaacccgacggtggaaggaaacctcttctcgccgaccaccgacagggtccgtgtgtcctccagacggagcacgtatctaggctagcccatcttttctctcctgctcgtgtccctcctcctcgcccaatctgccggaacatggcgttgagcggaagagatccgtccggattcgtcgattgcacaattttgctgcaatcagaaattgtagtcgataatagcccctccaagagtgtaaataccaaagagcagattatttctattacagctgagaaaacaagtgctactgatgcgcgtggctctacctccttaaagtcaccagaaggtgcacatgagaaggctaattttttgggaaaaggtggagaacagccttatgtctaccagcccaatgtgaatgtaccacagccacagacagtctattctggaggatacatca

SEQ ID NO: 47314 - DNA, 434 bp, Triticum aestivum
  unsure (1)..(434): unsure at all n locations
  Clone ID: PAT_TA_47314
tcgtctcgtccccgatactccaaacacctagtatgcgtccgccgcnncgccaggtatagagagcgagatgtgtgtccggcttccggcggtgttcgccaagacgcgtggtgtgtgtgactcccgtcaacacatgcgtcgtgccgcctggcgtctgatcgtctgccaaggaagctgctataacgggcagtcgtgtggtgggtggtccncatgcgaggaggatctgcatgtttccgcgagtcttgttcgacagaagatgaagtacctccgattgctcctcaagagagatgaacaccaagccctgccactgtcccatatcacttgctggcaccacacaagatactgttgcgcaccattctaggtatgattactcacaagaccgtgcggatcgaaggccgtacttttcaggctaaaggcgtacaacagccttatgtcta

SEQ ID NO: 47315 - DNA, 211 bp, Triticum aestivum
  Clone ID: PAT_TA_47315
tgctgccggtatgggcgcggcggcgcgggctctgctgcttctggccctcgtcgcggcgggggcggaggcgctgagcctggacgtccaccaccggtactcggcgacggtgcgggggtgggcggggctgctcaccgggccggctccggtcacagcagagtactacgccaggctggcttgccacgacgaccttcgccggcgatcgctctctttc

SEQ ID NO: 47316 - DNA, 449 bp, Triticum aestivum
  Clone ID: PAT_TA_47316
gggagagggagagagagatagagagagaatctagtggtaccccaatggcgcaaatcatcgacggcaaggccatcgccggcgaaatcaggcgcgagatcgccgccgaggtcgccgcgctctcgtccgcccacagcatcgtgccggggctggcggtggtgatcgtggggagcaggaaggactcgcagacgtacgtgcacatgaagcgcaaggcctgcgccgaggtcggcatccgctccttcgacgtcgacctccccgaggacatctccgaggccgcgctcgtcgccgaggtccaccgtctcaacgccgaccccgccgtccacggaatacttgttcagcttccattgcccaagcatatcaacgaagaaaatatattaaaccagatctccatcgagaaagatggcgacggctttcatcctttgtacattggcaagctcgcaatgaaaggcaga

SEQ ID NO: 47317 - DNA, 280 bp, Triticum aestivum
  unsure (1)..(280): unsure at all n locations
  Clone ID: PAT_TA_47317
cggacgcgtgggtggctcaaaatgacgccgtcaatggcaacggtgccaccacgcgcccggcgtgcgacttcctnccccatacgcttatccaagttctttcaggccaacatgcggatcctggtcaccggcggagctggcttcatcggctcgcaccttgtcgacaagctcatggagaacgagaaaaacgaggtcatttgtgctgacaacttttttactgggtcaaaagacaacctgaagaagtggatcggacacccaaaatttgaactcatccgtcacgatg

SEQ ID NO: 47318 - DNA, 187 bp, Triticum aestivum
  unsure (1)..(187): unsure at all n locations
  Clone ID: PAT_TA_47318
gcactacgtggtagacctggtactccactcacactgaaccatgctgtgctaggctagctcattcactgcgcgcgggcgacctcgcctaggtatttccattcttctacatacgccacaccttngtggaaggggaaggctccnacccgtgtgagaaacgataaaaaaggggggtctgctgcggtgcgtg

SEQ ID NO: 47319 - DNA, 356 bp, Triticum aestivum
  Clone ID: PAT_TA_47319
tcgtccgcgcgtacggtgaaaaagactggtcaccgatgctagctacctgttttgctgattaccatctccatccacataatacctgcttttcattaatcatcatatgtcctatcattgggcatcaggcggctccatatactcttgtggtacctgcagattaacttagaacttgctcattcacataaatctgaacctggtgctcatcacttgatatgtgaacctgcatgtgttacctaaaaaattcgtgcatgatgatcattgtcatgtctgtgggtagcccagggtaggtggtttccatcagttgatttgtagagttttcaaggaataaaataccattagattgattcgtggacact

SEQ ID NO: 47320 - DNA, 197 bp, Triticum aestivum
  Clone ID: PAT_TA_47320
tgcggcccgagcagattcatggagcccaaccgagacggcaggtggccaacccacaagtggtatttatttgtccaacaagacactgctcaagagcaacgccgtttaaaaatacatgctcgacaccaccttcttcccccgcgagctcgagtgcatgctctacctgtgccttatcaccgacaagcacccatggggctaca

SEQ ID NO: 47321 - DNA, 138 bp, Triticum aestivum
  Clone ID: PAT_TA_47321
cggacgcttgggccaccacataccctatgcccattaaccctctccataaccctgagctgcgcaccgaccggcgatgtctgcgacggccatccgctcctgctagctcttttctttccccagcgcgcttaggcttgtcct

SEQ ID NO: 47322 - DNA, 397 bp, Triticum aestivum
  Clone ID: PAT_TA_47322
cgccgccatgggagcgctcgaggaggcgcaccttgcggcctgcgggtgcgacgaggaggaggagggggaggaggatctcctggcggagctcggcggcggggaggcggcgggggacgccattgagccggcggtgcgcgcgctgctggcggggctcggcgaggacgaccgccgggaggggctgtgccggacgcccaagcgcgtcgccaaggcctttcgcgatggcacccgaggttacagacagaaagtaaaagacattgtgcagggtgctctgtttcctgaggttggtgttgacaaaaggactggttctgctggaggaactggatggcaagttgttgctcgcgatatcgatccttattcatactgagggacttgcttactttcgttcagcatacaatgc

SEQ ID NO: 47323 - DNA, 282 bp, Triticum aestivum
  Clone ID: PAT_TA_47323
ctcgaccttatcctcccaccgcaccgcgccgcgacgcctgcccgaccttgcacggcgccgcccccatctcgcccgaccttccaccgcgccgccccacccagcctcccaccgcgccgtgctgccccgccccgcccgggctcccaccgcgccgcgccgccccgcccggcctttcatcgcgcggcgccgccccgctcggtcttactacgcgttgcccggcctcccaccgcgtagcgccgccccgcccgaggctgcaccggaacgcaccctgccgctacatgtcta

SEQ ID NO: 47324 - DNA, 277 bp, Triticum aestivum
  Clone ID: PAT_TA_47324
attgttttttggtatatactttttttagcatgagtttctattaaaaaaaatggtttggtcgattacatgaacaaacaacacaaaggttattcaatgatggaaaaaacatttgagcatgctttgaaattacaggaaaattgagtagtgggttccagttaggggctcaaatgtaatcgaccctgaaatatttggtggatttcaaaacgaaataaacttatactggctgcattggttaagggctgaagggaaaaagggaaataaaatcttacttggtgaa

SEQ ID NO: 47325 - DNA, 368 bp, Triticum aestivum
  Clone ID: PAT_TA_47325
ctcgaccaccactacaggtacgcacgcacgcacgcgtgattacttaattaattaactacggctacttgatcactaagtaataacatacgagacaacggatagcatcagattccacagattgattcaactgtttctgacgaggcagcctattgttagtcctcacacgtacagcagctcaaaaaacaccatgcagcaattatagtactgccactgggatatcaacaggagataagattgggtgcgcaaatcagaatcgtactaatttggcagcaggaaccaacacgattggaatggaatcatctgtttagagagagacacttgtttgcctttttcgtgtcgtcgctgcaggcaagtgatgaaggaattcg

SEQ ID NO: 47326 - DNA, 408 bp, Triticum aestivum
  Clone ID: PAT_TA_47326
agcggagcggagaggggaaacgaaagaaaaatctggccttgccttgctcctccggccgggcgattccgctccggcgccgccaggtgcttcgcttcttgccttgctccggtccgtcgtccgtccgtccaaggctccaagaaagctaggcgccattcctgggctccgccgctcgatttcctcacccacgccaggccaggacaggtcaagtcaagtgctatatcagggacaatttcaagtgttgaaggtcaccactagcccattggctcgatgggcgtcgaggagcaagatgtgcaacaaccggaacgcggtggaaagcctgataccgccgccaagtcaccaactccggaacacggtcagcaaaaaccgagcaacccccgtgtatcaacctgcagcactgacaaggacgat

SEQ ID NO: 47327 - DNA, 148 bp, Triticum aestivum
  Clone ID: PAT_TA_47327
cccacgcgtccgcggtcgattgggaggacccgccttttctggtcctgttcttgctgtcgtagcagaggggtctaaataagatgtacttttaactcatattctgaatccaccggaagtggcatcggtacaattttttttgcttggttca

SEQ ID NO: 47328 - DNA, 427 bp, Triticum aestivum
  Clone ID: PAT_TA_47328
ggaccgcctaaccccaagccccccaagcccctccgccgccggccgggcggcaaccccagcccttcctttctggccctccgccgtagcggctttctagattgccacccacccgggcctcacctctctctgcgcatctactgcttgcatataatatagtagtacagtaaatatggctacaaaagttcgcccaccttctactgacgcagaaaaattggaggttggagaaatagatacaagagctccttttgaatctgtcaaagctgcagtgagcttatttggtgaagtaagggtttcatctgacaaatcagctgcgagaaagccaaaggctcctcaagcagagcagaaggtgttagctaaggagaccgaacttcatttggcccagaaagagttgaataaatacagggaacaactgagtaatgctgaaaca

SEQ ID NO: 47329 - DNA, 436 bp, Triticum aestivum
  Clone ID: PAT_TA_47329
gaacggcaagtcagtccatttcttccttctctctctattcttctctgtcaaatctgaagatctgcagcggaacgaagaaatcgatgtgctcctccacggccagcgagaggacgggcggtgctgctgatggagaatggcatgcctagtttgccacacatactgccataataacaatggtcggagcttcgtcatctatgtctgtgatgccaacgaaatctttccgactctcatggatgcccacaagcagattgaacacaagatagaaactaaaactgaggtctccttgaaagaaggagcatgtcaacagcctaaaactctatgcactcggtctctttcctgtgtttgattttaaccacttttttctacagttgttatgagtcttatcatcaattcttattttcacacaggatcctggggagaaggctaaagctgaaac

SEQ ID NO: 47330 - DNA, 357 bp, Triticum aestivum
  Clone ID: PAT_TA_47330
tggatgctaggcgtagcgccgtcgcggcggcggcgtccgcggtcggggagatagagcgcggaaacaggggtgtcggcttcggcttggacaccaaggccgtttcgtccctgcttcgcgatggttctacaggcagtgacatggtggaccagaaattgagccttatccaagtggcaagcctcatagagtcatcagcaaagagagggaccacggagctcaatctccgagggaagctggtagaccaaatcgagtggctccctgtctcacttgggaagttgcaagatgttactgagcttgatatatctgagaacaggatcatggcactcccatcaacaggtggtagccttagatacttgacaa

SEQ ID NO: 47331 - DNA, 343 bp, Triticum aestivum
  Clone ID: PAT_TA_47331
ctctgtatcagtcacctcaggctctggtcgatcaccgtatcacgtagctgtcaggctagctcacattccctattcatgggcatgactaaaatcggtatcaacggtttcggaaggatcgggaggctcgtcgccagcgtaggcctccacagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggg

SEQ ID NO: 47332 - DNA, 391 bp, Triticum aestivum
  Clone ID: PAT_TA_47332
aaaagacaccatctacaggctcttgaggagatttttcttaagggaccggaacgactcctacggcgtatcattcctgagacttgtctatccatggctgaaatcttgtgtatattttcccctagctgccttgtggttgtggatcacctaggctctccatattaaacctgcttctgcatctaaaaaaagggcttcgttggatataatatatccgttgatgactggcctggcctgctcgattgaaataacaaggcaatcatggatggatcgatcatgtccctgaactctctttgggcaggcatatgatgcaacaaacctgcagtctttgaacggatgatgcatgctccactgtaccattgctctacattaagtctggtgcgttttcctacaccca

SEQ ID NO: 47333 - DNA, 383 bp, Triticum aestivum
  Clone ID: PAT_TA_47333
gcgcgacgagcatgtctacaagtcgttcctggacatcctcaacatgtaccgcaaggataacaagtccatccaagatgtttaccatgaggttgctgtgctgttcagcgaccacaaagacttgctcgaagaattccagcacttcttgcctgatacctcggtgtctccgcaagcaggggccgctccaagaggcggcttagttaagcgggaagctctaatgccccctgctagtaggggtcacattgaaaagcctagggcttttccgtctcataccgaccgtgacgccagtgtcgatcgtcctgacgtggaccatgatcgccaaagacaacgggagaagaacaaggaacgcaaggcagaaagagatagaagagattatgatagagatg

SEQ ID NO: 47334 - DNA, 306 bp, Triticum aestivum
  Clone ID: PAT_TA_47334
cctcgctcgatccccaaatcaaatcgctgcctgctgcttcctccaccccaaccctaaccctagcggcgccgccatcctcgatccccaaatcccttctccctccaccaaaccctaatccaaagctagctagccgccatggcccgttccatggttctgctcgcccgcgagattgatttcagcccccacgacgagggccgacagttccggtgggggttctatgaaggaatgctgccaacccgcaaagcgatgagggaggatgtcatcaggtacctgcggaccttcaaggcccgcgcagtcgtcgacaat

SEQ ID NO: 47335 - DNA, 262 bp, Triticum aestivum
  Clone ID: PAT_TA_47335
ttgtggcactggaggagaggacagatggagaaggggaggtcaagcgccggtgtttggggaggtagcgactgtgaaggagggaaggagggtttggtgcatcgaacccttatgtctgttttctgttgcatcaccttgctatccatgccctacgccaagatgctcctcctgtgcgcgatgctccccccattcgccttttattgttccgccggcggctttccgggagagtgcccctaataacttctgccgcacgccaagaggcgcc

SEQ ID NO: 47336 - DNA, 151 bp, Triticum aestivum
  Clone ID: PAT_TA_47336
catgggacaaaagaggaccaggtggacactattgcagaccagatgaaaaaacatgatattaagatggattgcattgttttcagggaatctggagttcaacacaattcttgtatggatgaaaatggccggttatttatttcacttcaaagat

SEQ ID NO: 47337 - DNA, 128 bp, Triticum aestivum
  Clone ID: PAT_TA_47337
atgaggttttgtctgatgaataaaaccaccgatcatggataattggagagctggctgagggtctgcatggcacgggagatactaaacccattgatctttgagtactatcgagattgtgaatggtggat

SEQ ID NO: 47338 - DNA, 345 bp, Triticum aestivum
  Clone ID: PAT_TA_47338
cgaccacgcgtccgcggacgcgtgtttcgacccgcgctttcgggcccgcttcctgcggacgtacgtgccgctgctagtaagtatttccttcaacacccatcacgacacgttgaatatcgtcgagaaatacgccaattcaaacatccaaatccatacattcaaccatagccaggatccttgtgtcgtggccttccatggggaggaccgtcaaggatgggtggtaaaacattcatattgcatcgcccgttaaggatggctggccgtccagttctgaatattgggacgttttaactccaattagtgtatacagcgggttatgacggggtgggttgacaacaaaaatct

SEQ ID NO: 47339 - DNA, 405 bp, Triticum aestivum
  Clone ID: PAT_TA_47339
accaaagattcaggttggagtgttctctgcgacaatgcctccggaagctttggagatcacaagagaattcatgagcaaaccagtgagaatcttggtgaaacgtgatgagctcacacttgaaggtatcaagcaattctacgtgaacgtggagaaagaagactggaagcttgagactctctgcgatctctacgagactctagccatcactcagagtgtcatctttgtcaacactcgtcgcaaggtcgactggctcacagacaaaatgagaagccgtgaccacacagtctcagcaactcatggagacatggaccaaaacaccagagacatcatcatgagagagttcaggtctggctcgtctcgtgttctaatcacaaccgatctcttggctcgtggtatcgatgtgca

SEQ ID NO: 47340 - DNA, 289 bp, Triticum aestivum
  Clone ID: PAT_TA_47340
ggcagccctgcgagcggacgagcgaggggggagatccgaggaagcggcggggaggatcgatcgatggcgaaggggacgacggagatggaggtcgggtccgacggcgtcgccgtcatctacgtcgccaacccgcccgtgaacgccctctccatcgacgtctggtatagcttgaaacggcactatgaagaggcgcttcaaagggaagatgtgaaagctattgttcttacaggaagtggaaggtcattttctgctggactcgacgttagtgtcttcgctgatattcacaaac

SEQ ID NO: 47341 - DNA, 405 bp, Triticum aestivum
  Clone ID: PAT_TA_47341
ctcccctgcctatccactctgctccaccgccatggatttatcctccctagcgagtccgcaagcgctccgcggcggctccacgggcgctctcggtgcccacgccgcccgacgccgctccgtccagctgctccgcccgcgcaggccaacattccgctgctccgtcgaggcagccaacgccaggcagcaggtgcaggggacgctagcggcggaggcggcgcgcaaggaatgcttcggggtcttctgcaccacctacgatctcgaggcgcttgcctccggtgaggtttttggacaggaccaaccaatagcacttaagttattgggctcggaaagatcgttacaagcactcgaaggtgtagctatggaactggaggattcattgtatccattgctaagggaagtcagcat

SEQ ID NO: 47342 - DNA, 143 bp, Triticum aestivum
  Clone ID: PAT_TA_47342
actgaccggtgaaaactcaagaccaaaggctggactggtccgatcgactgcatcttaaagtggagccagaggacgagagaaaccttgccctttggcccatacatccaaaatctttcaaggatgacctgcatgagtacccattg

SEQ ID NO: 47343 - DNA, 236 bp, Triticum aestivum
  unsure (1)..(236): unsure at all n locations
  Clone ID: PAT_TA_47343
attttaaagatggggtgaggtatatcaaagcatctatgaaaaactaaagttggtggggggtttaaagatatcgttaaagattataaattgacttactntcaacctatattaagaaattactattccgtattattttgtgttataacagcagaatcatcaagcactttctacccatgggatccaaaatcaacattcattcattagcctccttattttaagggatatgacaattgacc

SEQ ID NO: 47344 - DNA, 317 bp, Triticum aestivum
  Clone ID: PAT_TA_47344
attttgattatgcgacttggtgtcttacttgttctgcctaactgttggatcctagctcttatgttatctacctatagccagtgcatgccaaaaaataaaaataaaacctatggccagtgatatgtttatggctggatgtctactgcttctgtcaatgccatagtagattcaatcgaaactggtatatctgaacaacaattgtttcatttcgatcacataacattatttttgctgaaaaatcacaatgttttattcaagtttgtgggtgttttccctgatctgtttgcaacttggcatgagagtccgtttatgcatgt

SEQ ID NO: 47345 - DNA, 135 bp, Triticum aestivum
  Clone ID: PAT_TA_47345
ccacgcgtcgccatacccataccactgcagtccagtagtagctaaactgcagaactgttggggctaaacttcaaggcttggatttgcctacatactcaagctaaactttttatggcgccggcgtccaaggtcatg

SEQ ID NO: 47346 - DNA, 150 bp, Triticum aestivum
  unsure (1)..(150): unsure at all n locations
  Clone ID: PAT_TA_47346
gttcccgnnccggcccacgcctacgcccacgcgttcgtgcaattcggaccgtcgttttcggatctccacctaagcaacctgcagtcgagcctgctatacgcgggcgccgcaccaccgcctttcgccgtccacgtcactcctcttgcacca

SEQ ID NO: 47347 - DNA, 127 bp, Triticum aestivum
  Clone ID: PAT_TA_47347
ccaatccatgttctccttgctcctctccacgaagactaggccccggccccgaccggttcggcgccgttgtgcccgcttgtgaccgcgagggttggacccccagtttcggcgacatggtctggggcaa

SEQ ID NO: 47348 - DNA, 291 bp, Triticum aestivum
  Clone ID: PAT_TA_47348
ttagcattgaaccacaagttcatgttcgcaagctgaaaccaagatatatgtgtctgatatttgcctcaaatggtctttgggagcatcttagcgatcagtacaggaagttgtagtagctgccccatcctttttaatctaaatgatggtacttctaggacacggacaattgccctcaagctggatcggtggcgcggcggaggagctgtcttctgagttgaccagagagggagcacaccggagatgcttctgagatggccaagggtttactgatcgatccatcctgattgggat

SEQ ID NO: 47349 - DNA, 405 bp, Triticum aestivum
  Clone ID: PAT_TA_47349
cccacgcgtccggcggcggcagcgacgacgaggatgacgaggggtacgggagcgaccaggaggggcccgccgtggagggggacgcggatgagctcgccatttccaggctcggcctccccgcccagctcgtcgccaccctcgagaagcgcggaattacccacctcttccccatccagagggctgtattgattccagcacttgagggccgcgacctgattgcaagagcaaagactggaactggaaagacgctagcctttggtatacccatgatcaagcaaataatcgagcaggacgaagggcggactcctgggcgaggtcgtattcctcgagctttggtccttgcacccactagagagctggctaaacaagttgagaaaggaattatggaatcagcgccaaagctta

SEQ ID NO: 47350 - DNA, 471 bp, Triticum aestivum
  Clone ID: PAT_TA_47350
cctacctgaccctgctaagctaatcccatcaccatatctgcatatcatatactcattcattactcatcattcatgcatatacatgggctgagtacatgatcagtctacttcgctggtgctactcgatcagttagccagccggcgatcgatatggggaaggtggtcgtcgcggaggccacggcgcggcaggtggcctccttcgtcctcggcgccgccgccgcgctcaccgtcgtcatgctcgtccagtaccgggcgccggccgcgggcctcagccgcgccaggacgccggcccacttctccggcttgagatcatcatccgacgaccagcaccaccgtcgaaacgggacggcagcgcgtgccgttcttcatcatacgtcgccgtccatcgccggcagtgctgcccgagacgacgatcatcgacgtcgtccggcgaacgccacgacaatcacaaagcgcagttctacctccact

SEQ ID NO: 47351 - DNA, 242 bp, Triticum aestivum
  Clone ID: PAT_TA_47351
acgccatatactatacatacagtaggaaacgtttccgctgttactgacaacggcttaaccgcgaccgcgaactgatcaagcacaaaccagcgatagcactagcatgttagcaccgccaccgtccacgacggcccgcgtgttctgatcggatcgtgcgaagtacacgtcggcgagcaggatggtgctctacaacgccgcgtagatagggatcgccgatgagacagtgcactccaactttatct

SEQ ID NO: 47352 - DNA, 444 bp, Triticum aestivum
  Clone ID: PAT_TA_47352
cccacgcgtccgggctactcctagcaagctatatacctacatagtacagtcatggcccataccgtgatggtcttgcatgtcacctgcgtgggtacttgacaggggctcaagtccaccgcctgcctacccgtcagccgacgctccaacggcgctagcctaggcagcgtcagcaacggtggaaggatcaggtgcatgcatgtgtggcccattgagggcatcaagaagtacgagaccctgtcctacttgccaccggtcagcacggaggccctcctaaaggcggtcgactacctgatccgttccaagtgggagcatagcctcgagatcagcagggtagggttcatattgcgagagcacaacgcatcctctgggtactatgatggccggtactggacaatgtggaagctgactatgttagggtgcaccgacgccacacaagtgatcaac

SEQ ID NO: 47353 - DNA, 388 bp, Triticum aestivum
  unsure (1)..(388): unsure at all n locations
  Clone ID: PAT_TA_47353
gttcatccattatatgtttgctttcaaaccaaagaaatcgggggtccaggttctgatcatgctccgattgagtctatgtagccgtccttgggtttttttctatacgcttgcatcatctaggttctgaccatggcacaatcttgtttcaaatttgttctcctatatgtatgcgttgggatgattgatgaggcgtattggtggaaataaatctgaagcaaataagagctgcgagcaactggttgtgcccctatcaacctgctcaatatttgtgttgttttcctgtcagtcgaatgcccgctattcagcaaacagatagcttagaaaccagcgttagaaaggacctgatacacattacaantatggactggtgatctacctgatgcatttc

SEQ ID NO: 47354 - DNA, 296 bp, Triticum aestivum
  Clone ID: PAT_TA_47354
gtgagcgggcaggacgggctggccgcggagatcgcgtccatggcgagcactacgtactgcgggtccgccgactacgcctccccacatccgtaccatatggcgaggaatccgagctgcgccggatacatcggtaactgggatgaaagggtctcggagaggtttgcggatgagactttgattcagcaactttgctgactatactggcacataccccgtgacagggcaactcgacgacccagatgatatgcttaggctgagtatgaaacagaggagattgcccagtatactgttaggct

SEQ ID NO: 47355 - DNA, 448 bp, Triticum aestivum
  Clone ID: PAT_TA_47355
cgtccgctcagtcgccatggcgtccctcgtgccccggctccttggccgccgggctctgcaacccgccgttgctctacgctctccacgcgatccttggatgcgattccacggcgcaaatcccccacgcccctgcccgctgttccggccttccctgggggttgatggatgcgcgagagctgcgcggagatggtggtttctctcgccggtaaggcaccggagcacggcggtgacgctgaacacggacggaggctttgcgcgcttctcggtcggagatccgggcacgaatcataatggggggcagaatcagccgcaagcgaagaagaagaagatgtccaagaagtccaggtcaaccagctcaagtggtatccgcttaaggccaaaaagaagatgaagtcgccaaccccgaattcaggaaagatacaagctcgaaaagccacaaggaaagaag

SEQ ID NO: 47356 - DNA, 112 bp, Triticum aestivum
  Clone ID: PAT_TA_47356
cttctctgtcggggcaaagcagaactcggtgatgaccttcaggtgcacgccctatgtctcaggcggccgtcaccgtgttctgcctgcaccgctgtcctacatgcacccgctt

SEQ ID NO: 47357 - DNA, 420 bp, Triticum aestivum
  Clone ID: PAT_TA_47357
cccgcgttgcccccatccatccatccatccacccccaccggaccggtgggaaggggaggggaaatcggcggcaggaggagatgagaatctccttttctcttcccttcttcttcttcttcttcttgctctttggatccaccgcccgctaatgccgcctagccgccccgattcgacccatcaccaccgcgcaccaaggcggtagctcgtgccacagaggccggagattcgcctggcctcctcctactcctcctcctgcgtctcctgcgcataagggatgcaatttgtggatggacggacggacgccaggacacgcaggacactcctaagaaataaagaaagatcgaatgacataaattttgaggcaacaccccaattcattcatgccttacttccttacttgtaccagctaggaagccactc

SEQ ID NO: 47358 - DNA, 474 bp, Triticum aestivum
  Clone ID: PAT_TA_47358
cccacgcgtccgcgaagacgccattcattcagctgctttgcgctgcacggcggggaggccacggcggcggcgggggatggatttgagttcctctcagatcaggttcctgctgccggcaattggcggcgacaagtacacgcaagcggcgcatacggtgctagatctgctggatggagcagccgagtccagcactagggaggtggggaagcgccgcctgttctcagagcagtcaacggggctcgacgacctgcaggccctggctggacaaaaggctgcactagtgatgcgggcgaacaccccactggaaatgcacgctagcaatacctacaccaggctatgttcgagaaatttggtgtagtcttgtacgatgccggacagtacaaggtggaggaggttgagaaaggcacgaggttcttggtgcaccggtaccaccctaagaagcatgacaaatagtgcaaagttgtctatgaagtg

SEQ ID NO: 47359 - DNA, 300 bp, Triticum aestivum
  Clone ID: PAT_TA_47359
cccacgcgtccgcctacgcgtacgctcacatctggcgggcacaaacaaagcaaaggtctgcgtgtcggtgacgcaaccactctcctttccatgaagcttgaaccgcacgaaggcacgcacgaggcacccatgggggaattgttcaagggaatgtgccctcttgcgaacaacattccggtcttggatcttgaggggaagcgaggcgatgagaagaacttgtaggatgatgtggtcaaatgacgcgagctaggtcgacatctgaaatgctcatttttactagaactgtgatgacaaatgcac

SEQ ID NO: 47360 - DNA, 450 bp, Triticum aestivum
  Clone ID: PAT_TA_47360
acacgacgacagacctgtgtgccgctcggctgggacagaaccccgcgctcgacgatgccatggacatggaggtcttcaaggggaagctgatacccacacggccagctcgtgctcactgtgtttgaccgccagcttgtgctctaccgcgacgagtaccgatgcccacacaggtatgacctgcgtgcccccatgaccttgcaccggtgctatgtgcgtgagcgcatgcgcgcttgctgcaatgtcgggtgtggtggtgtgttgcaaacttacgatgggggcggccaggtggtgcgtggccgtgtgtgtggcgatgtatggagctccggagattcctattggattgccgagacttggtcttggttctgccgttggtgtgttggctttgctctaatctggttaaaactgtgtgattagactagcagcatcaagtctttatttggaaaagaatac

SEQ ID NO: 47361 - DNA, 397 bp, Triticum aestivum
  Clone ID: PAT_TA_47361
gttgcaaagccttaggcaagaaagcaagccagcagtctatacatatttgagtcacatagaagcaagacctggttcttagaggttccgcgacaatgcgacaaatgacgaccatttcggttggcattgttgtgcttgccacacttgttttggcatccgagggtcgcattgcccggaaggacttaggcctaaaccttggtggtgtaggcttggggaccgatacaggtgtcaatatagggggtaacattggcataggtggtgccggctctgcatcggggtctggttctgcgtctggatcagggtcgggatcagcctctggttcggggtctggctcggggtctggttcgggcgctgcatcatcagcaggttcgggtgcagtttttggtggggggtcttatgc

SEQ ID NO: 47362 - DNA, 464 bp, Triticum aestivum
  Clone ID: PAT_TA_47362
gcaaaagaaggatcatgtaggttcaaatcaaggacggtaagccagaatttcttctttaggaattaagaaatgactttgtctgcctatattttgcttgttagccctaacaaagtatcgattatcaatgtgaaatgttagatgcaaaggtttctagtcagattaaatgttatgaacttatcgcacatctcatccaattgatgctttgcaagatgaagtaatttactttgcttaccacctgatccagtgtaacaccttacagagcacaagagacgaaatctaccagcagcacgaaagttccagctaaccaacataagtcaataaagacagcacaggagatgaaatctaccagcagcacgaaagttccagctaaccaacataagtcagtaaagacagcacaggagacgaaatctaccagcagcacgaaagttccagctaaccaacataagtcaataaagacgccctca

SEQ ID NO: 47363 - DNA, 462 bp, Triticum aestivum
  unsure (1)..(462): unsure at all n locations
  Clone ID: PAT_TA_47363
cgcagcttcccattcctcgccgccgccgccgcttcgtacccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaagaggaagcccatggcgctcgtcaagaagctgcgcaaggcggtgagttgcccagtcctttttctttgtttccgttttatgaacattctgactgatataactcaagttactactagtctactaccttatacggtatgatgcctggatctgtctacttactattgcgggactcagggattntaagttacttgtttggtttctgtcacaataaatgtttatgttaccatt

SEQ ID NO: 47364 - DNA, 440 bp, Triticum aestivum
  Clone ID: PAT_TA_47364
accacacaccacgcctgcctcatctctcggagcaggaggaggaggagcttgcaggaacaatggcggcccagggtcttctctctgggaggcagctgctggggaggcctctgcagtcttccatctccaggtcgtcttcctcccggaagtcccccttcgtcgtcagggcatcttccagcccccctgccaagcaaaatgacaacaggcagctgtggtttgcgtccaagcagtccctcacctacctcgacggcacgctgcccggtgactttggcttcgaccccttggggctgtccgacccagagggcaccggcgggttcatcgagcccaggtggctggcctacggcgagatcttcaacggccggacggcgatgatgggggtggtgggcatgatcgccccggaggccctgggcaaggtgggtctggtgcccccggagacggcgatc

SEQ ID NO: 47365 - DNA, 378 bp, Triticum aestivum
  Clone ID: PAT_TA_47365
aacccgcgttcgaggcagatttcatgggttatttcatgggcatctgcttgcacatgggctatgacatggcatagacatcagcaaaaacattgtgggtgccactgggagggccacggcgatgggcacactgtatgtgaaactgaatgaacaggacggggctggcattgacgctggctttaatgctcactatgatgtccaccaaaaggccaatggtggggctactgaaggggctgttgcactaggagccgcactaagatccgcttctactttagatcctgctctcgagcatgatatctagagtgagctatgaatggagctaggcactgtgcatggcactgtgcatgctatcttgaaggctttctctaagcaatgcacgga

SEQ ID NO: 47366 - DNA, 450 bp, Triticum aestivum
  unsure (1)..(450): unsure at all n locations
  Clone ID: PAT_TA_47366
ccgagacccctggggttcaggtccactacccccgctccgtggcccgggacggtctcggaggccggcgcggcagcgggggatgacgggctggaggtcgcgaggctggggatctcgccgcggatcgtggagagactcgccgcgcgtggcatcaacaggctcttccccatccagagagctgttcttgaaccagcaatgcaagggaaagacatgattggccgtgctcgaactggaactggaaaaaccttggcttttggcattcctatcatggacaggattcttcgtcacaatgagaagaatggaagtggtagaaatcctttagccatcatcttggcacctactcgagaactcgctcgacaggttgagaaggaatttagagaatctgctccattagacactctntgtgtctatggaggtgttcccatcagtcagcaaatgagaactctcaattat

SEQ ID NO: 47367 - DNA, 158 bp, Triticum aestivum
  Clone ID: PAT_TA_47367
ggcgggaataattaagtaaggttaacaacagaccggtcgtatccggtgtacagaggcagagagatatgcttgtcgctgagcatgtctgccgtttgtattgtttgaaggcagcacggtatccgtgtcatctttggttgatatcgtgacttattttgtga

SEQ ID NO: 47368 - DNA, 361 bp, Triticum aestivum
  Clone ID: PAT_TA_47368
catccccttgccgccacccacctccgccacccactagtcccctcgccgccacccacctccgccacacctcccctccccacctcagatcctctcccctcttcccactcccagatccaacttcccaccgccacctccggcgcccaatcccggtgacctaaggcgggattcgacggtgcccagcagacctacaccagtcaccggccatggaggcggtggccctctccgccggcgacgcgcgaacgagacctacacctgtcctgtccttctcctttcctctgtctctctctctctccctcatgcatcttccctctctctcaggtacatctacaacagccccgccatggatggcctcttcacgagc

SEQ ID NO: 47369 - DNA, 265 bp, Triticum aestivum
  unsure (1)..(265): unsure at all n locations
  Clone ID: PAT_TA_47369
cccacgcgtacgggcagcaccactgcctctaccactggtacagatgatgcatatgtatatcccctttctcgcaatctttcgaaaattgattcggtggaggttgtgggggcaaagcaaagaacaggggatgtttctttcggcgagcggatggttggcgtcaaagagtacactgtatacttgttgaaagtgaggagtggcgaanatgagcgggaaatcgagcgtcgataccgagaatattatgcactntatcaacaactcaagctct

SEQ ID NO: 47370 - DNA, 454 bp, Triticum aestivum
  Clone ID: PAT_TA_47370
cccacgcgtacgcccacgcgtccgcatcttttctgtgaaggacttcttgacgtcatattacaaggatgaacatactctccgcaaagttctcaacaaggccacaaagctagtatggacgactattgttgatcatgctaaaaagtgtgttcctggaaaggagctttactctttcatcgtggaaggccatgacgttgtcctgttcttcaactgtttctataggattgttggaatcacatccagtgaccagtacactcccttcaaggacctcgataaaccgatgcaggggcgtgtggaacaatggagcaaagttgcatatgaaactttgaccaaccttcagcctgattatgtaatggataatggaaaaccaagaccaatcaaccagagtattttccaaggacttcaacagaattgcgcagagagaaatgttcatgaagctgatgatcatcaaagtact

SEQ ID NO: 47371 - DNA, 467 bp, Triticum aestivum
  Clone ID: PAT_TA_47371
acttaaacggtgaagttgctggagattatggttatgacccatttggtcttggaaagaagcctgagaactttgctaaataccaagcttttgaattgatccatgcgagatgggctatgttaggagcagctggtttcatcattcctgaagctttaaacaaatatggcgctaactgtggccctgaagctgtctggtttaagactggtgctttgcttcttgatggaaacacattgaactactttggcaagaacatccctatcaaccttgttctcgccgtagttgctgaggttgttctcctcggtggagccgagtactacagaatcaccaacggattggatttcgaggacaagctacacccaggaggtccatttgatcctctaggccttgctaaggaccctgagcaaggagctcttctcaaagtcaaagagatcaagaacgggagattagccatgtttgcgatgctcggtttc

SEQ ID NO: 47372 - DNA, 248 bp, Triticum aestivum
  Clone ID: PAT_TA_47372
cgcccacgcgtccgttatcaccttgagcttgaggtcagtggctggcaggcaagcaagaaaggaagaagaagataaatggacatggcatctgctactctcctcaagtcctccttcctccccaagaaggccgaatggggcgtcgcgcgccaagtcgtcgccccgagggtgtccatggtcgtccgcgccggcgcctacgacgatgagctcgtcaagaccgcgaataccatcgcgtcgccggggcgcggcat

SEQ ID NO: 47373 - DNA, 329 bp, Triticum aestivum
  Clone ID: PAT_TA_47373
atggacgacacacaaagatgcacatggcatactgtggaagaggtttgtttgtgctagggagggttggagaaaggaggccccagaagaggaaaggataaaacctaaacgaaaattcaagttaaccaggtgtggttgtgaggctatgattggactgaggaggcaggatgatggcaaatataaggttgcccggtttgttcaatcacacattcaccaacttatttcgccaagtaagagacatctcatcaagtcaaatagggaagtaagtagtgagttgaggagcaaactacttacatgtcataaagcaatggttggcacatctgcagcatatc

SEQ ID NO: 47374 - DNA, 236 bp, Triticum aestivum
  Clone ID: PAT_TA_47374
cctgcgtgtatcagcatatgacagcaacagtgttcgtggatgttcgtcatttagcgtcgaactgcgctagctggcgacaagatgggatgcgcctatctgaagattggcatgatgccattcacacactctaataattgcattggctggcatcgcatacagagcacgccaggcgatgattgagccatgagacgcagactgaggcgaacctagcgacatctgatacactgcttacgcac

SEQ ID NO: 47375 - DNA, 406 bp, Triticum aestivum
  Clone ID: PAT_TA_47375
cggacgcgtgggttcccgttcactatcaccgagtcctgcactgtcagctgcgcaaacctcaagtccgcgttcctgctcgacatcatcatcctagcgattacgacgtacgttagcgtcgtgacggtgcaggacaatcctactttcggaagcgatgaggcggcacctccaagcagccacgaggaggaggctttcctctttgagcttttcgggtcattcaagtacttcacgatgcctgtttggatggtcttgatcgtcacttcgcttacttggatcgggtggttccctttcatcctctttgacaccgactggatgggccgagagatctatcggggaagcccggaaatcgtcgccgacacccaaaagtatcatgacggtgtgagaatgggctcttttggtctcatgctca

SEQ ID NO: 47376 - DNA, 262 bp, Triticum aestivum
  Clone ID: PAT_TA_47376
acgcccacgcgtacgctacctccagctcccgatccctccaccccaccttcttcaacctcccaccacgccgccggcgccgactccccgcaccacccagcctttcctgcgtcgaccccgccctccctgcgtcatcacttcgacggatcagggcctctctccactggatccgcccctgccttccaccactctgacgtcgagatggccgacgcctccacgttctcccactgctcgtgccggtccccagtgctctgccccgatgccc

SEQ ID NO: 47377 - DNA, 122 bp, Triticum aestivum
  Clone ID: PAT_TA_47377
ggataagactcaaaaatcttgacaactgcacagctcgcaggctgtggcaatggcggcgacactggagcacatcagcctgatcggcacctgctcctcccattatcgaagacgtttctgcagca

SEQ ID NO: 47378 - DNA, 382 bp, Triticum aestivum
  Clone ID: PAT_TA_47378
cagccccgctccgtatccgccgccgccggatccgcgtctccgtatcgtcgtcgtcggagagcaaggaggagggcgcggggagcaccaacgggtcgctgccggggcttccccccgtgggggaggaggaggaggacgacgagtcctgcccggtggagtgcgtgacggagttcaagacggacgaggagttcagccggttcctggagcggtcgaaggcgacgggcgcgctggtggtggtggacttcttccggccgtcctgcggcagctgcaagtacatcgagcagggcttcatgaagctctgcaagggctccggcgaccacggctccccagtcatcttcctcaagcacaacgtgattgacgagtacgacgagcagtcggaggtggc

SEQ ID NO: 47379 - DNA, 390 bp, Triticum aestivum
  Clone ID: PAT_TA_47379
gagtagggccaacatggttttcgtggtgggcatggagtagcagaggacgatggcggtggggggtgggagcagagtagcaggacttccaggcggcgctcgcgtcatggtagagtggaggagctcgtcgttcatcatcaccatccccaatctagatctgagatagaaaagaagagaaagatttattggcggttattcttttgctgggactctcctgaactcaccggagagagctgggatggaggcgactctgaggaagatgaaggccaagagcggtgccgccccggggagaggaagccggtgttgtcgaggacgatactgctcctctgcgcctgtggcttcatccttggcgtgctcttaactgaccgattcagagcgatgccggatttaaag

SEQ ID NO: 47380 - DNA, 337 bp, Triticum aestivum
  Clone ID: PAT_TA_47380
gaaccaccatcctatccaggcgctggaagcagatccctgccatgctctcaaaaattatcataacggtcggttcttttgagcccaagcgcggaagagggacaaaattaacctcacatgatatagctcgggccaacaccaccgtgcgggaagcaaccaggagcatactagaatgcaggaccggaagtctacacaccattcacctaatgtccatgcaattctatctgggagatgactccatcttcattggccagactgttggccacaccatagcaacacaaaaagttgcttcggttgagttcgtaatcttaaccgaagggcggaccaattggtacgtcga

SEQ ID NO: 47381 - DNA, 189 bp, Triticum aestivum
  unsure (1)..(189): unsure at all n locations
  Clone ID: PAT_TA_47381
gacgactggcgaagctgtgtgacaactgagaccatagggcgcctggcactaggcggcgctgatgtccgggcggaaccccacggcctgccccttgatcctactcgccgcggcgaggccgctacctgggtccactgccttggcgcgcatagcgctctcctcaccgagcgtnggggcgtactacaagcacat

SEQ ID NO: 47382 - DNA, 421 bp, Triticum aestivum
  Clone ID: PAT_TA_47382
tcggccacctttccttcttcaacaccatggcccccactgtgatggcttccttggccaccttcgtcgcaccctttcagggtcttaagtacaccgcgggcctgcccgttagccgccgctccagcagcgccggcctcggcagcgtcagcaacggcggaaggatcacgtgcatgcaggtgtggccgattgagggcatcaagaagttcgagaccctgtcttacttgccacccctctgcacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgtctatgttcgggtgcaccgacgccacacaggtgctcaacga

SEQ ID NO: 47383 - DNA, 384 bp, Triticum aestivum
  Clone ID: PAT_TA_47383
ccggtcgacccagcgtcggtcacaaccatccgaaatacccctcctccactgtgatgatgggccggagatctgtgggggaggctactggaaatgcaagggaactgtggaactggttgagagcatcctctatactatcaacgctggacagatcgcctgtaccgatgttgggaacattggcattagcccgccctatatcgtgcttcccaccaagaaggagaagctgcgcacatagatccaagttgctggtgagaactgctaggtgaagaagggtagttgtttcaccggtagaaggcagagctcgctatgcgtgtaaacctggggggttccgtgggtcatgcatcgaacaactctgaaaggagggagcttgatggggagaaatcaagc

SEQ ID NO: 47384 - DNA, 365 bp, Triticum aestivum
  Clone ID: PAT_TA_47384
cccacgcgtacgatttggacaatttctttggtgggccggcctttctttcatggtctcggatggacaatatgcatggatggggtgggcctcttcctcagacttggcttgatgatcaattaactcttcagaagagaatcctttctaggatgtatgcatttggcatgtccccagctcttccagccttttctgataacatacctgctgcactgaagttaaaattccgctcagctaaagtcacccaccttggaaactggttcacagttgacagcaacccacggaggtgttgcacatatcttcttgatgcatccgatcccttatatgtaaaaaacccgacgtttgttatagaacaacaaatcacagaatat

SEQ ID NO: 47385 - DNA, 476 bp, Triticum aestivum
  Clone ID: PAT_TA_47385
gtcctcatccccgtgcagctgcacgctctcgcctgcccccacggtgagctccgcctcctgcgtgtggtcgccgtctccctcaacctccaccacctgctgcaagttggtgcccagggcgtcgcaagctgccagcggcggcagagttgctgctcccgtgtcgtgattggactccgtgttcttctccaacagcaaatacgtgttcttctccaacaccaatcaatggatttcccgagccggatttgagttgcctactataagaaggaagggtcctcggaccagaagcttcatcacatcaaatcaaatcccgtcgaaattgcaatcttcgtcgaaacatccatgtcgccgccgagttcgccggaggaagaagcgcagagttcgccggaggaacaagcgttggacgtgtgtggcggcgtgctcggagagcggtgaggggcgctgtggtggtggagatggccgacgctgtatacaagcgctgg

SEQ ID NO: 47386 - DNA, 373 bp, Triticum aestivum
  Clone ID: PAT_TA_47386
cgcatacacaaccaggcaaactatctagaaaagcgcatgatcgaggattagcatacaaagaccacacagccgttgtgttgaactgctataccaaatggaaagacgacgacacggtggaccctttcatcaaagatgaagatggggtcagcgaaaccaagctcgatgtggaaactgccataccactatgccgtgcagccggatatcatgaacatgctatggtgctggccaaaaacgctgggagacatgagctgtattcgaagatgctacgtcaggatcatgctacatatgatgaggccctgcatcacacatctggccttgacggaagacaacctgtccttactggaaatcaatatggaaaaattctcggcgacca

SEQ ID NO: 47387 - DNA, 342 bp, Triticum aestivum
  Clone ID: PAT_TA_47387
cccacgcgttcggttatatacctacatactacacacatggcccgcaccgtgacggactgcccgcgcaccagggacgatgactattgacgccctaactgacatcgacggccatgatgctagccgccgatcaacgaagtaggctcggagccgcaaacacggcgagagatcaccacatactgttcggccgatgcgagggcatcaagaagttcgagacgctggcctacttaccaccgagtcaaacggacgccctccttaagcaggtggactacctgatccgctccaagggggtgccttgcctctagttcagaaagggtgagttcatattgcgagaacacaacgcat

SEQ ID NO: 47388 - DNA, 440 bp, Triticum aestivum
  Clone ID: PAT_TA_47388
cccacgcgtccgcggacgcgtgggcgagcaaaccctaggattccctcccgccctctccagatgggtgagccgccgagccgagagggatcctattcctccttccccaactccgacgacgacgagccggagaccaccggatcggaacgaggagggggaggaggaggagaggatgctcatcgcccgctgcctctgcgccagcagctcgtgggggcctgccgcgccgacgaccgtctcaggcctctcctcaccctcaacgtctcatgctccgccgccgagaaccgcttcatatcttacctctctcagcacttcgaggtctcggaggtgggcatgctggcaaggtgtctttgcgttcccctcgtcttcgctgcgcgtcggcaaggttgaccggcacgggccccttctttggccaacaaccattagagggaaagcttaaccttggc

SEQ ID NO: 47389 - DNA, 398 bp, Triticum aestivum
  unsure (1)..(398): unsure at all n locations
  Clone ID: PAT_TA_47389
aagcaatgctgactgctgttgatggttctgttcgattgctggtcgatcggccgtacaaagcaggagaaccaataattgtttggtgtgggcctcaaccaaactccaggttgcttctcaattatggttttgttgatgaagacaatccatatgatcgcatagcaatcgaggcatccctaaacactgaagatcctcaataccaagagaagagaatggtcgctcaaagaaatggaaagcttgctatccaaaaattccaagtctgtgtaggcaaagagaaggaaactatttctgaaatgctgccatacttgagactaggatacatttcagatccagatgaaatgcaatgtatactttcgtcagaaggtgatacatgtncagttagtccatgctcagagcgagct

SEQ ID NO: 47390 - DNA, 388 bp, Triticum aestivum
  Clone ID: PAT_TA_47390
tgctctccccgtcccactgacggtggtccccaccgcctccccacatcacagtagcgtctatatgttgttggcgaacagcgcacggtctccaggccaaccagagacggatatcgcggtgaggtgtacgctccttatatcggtggatatctctcctggtcgctaggctgcacttgagaacttgcattgtctatcaaaggcacagtatattggtgctatggcatgtactggcctacatgctggtgtagatcattcaactcctaggctcctggtacttgaagcataccacagtctacaccatcgcccatacctacaaagaagactcactttgccgaccttaaagatgaagatcgtatggtcaccaacctttatgggcttcatgacccttttc

SEQ ID NO: 47391 - DNA, 331 bp, Triticum aestivum
  Clone ID: PAT_TA_47391
ctcattcatcccaggctcacgcatacacgacacacacgcacacacacagctggcgctatgtcgctaatgccgttgcctgactgagcttacgagtgatccacgtggataagcttgacaccggcgaaaggggcgcgaccatgggggtaatgcgctatgcctgcaagaactggggattgttcacagctgctgaaccatggcattttggtcgaactgatggactaggtggagctggtgagcaaggcgcactactcgggtcgccgggaggagcagtttaaggagttggcggctaaaactctagaggccggcgagaagggcgactacctgaaagacg

SEQ ID NO: 47392 - DNA, 303 bp, Triticum aestivum
  Clone ID: PAT_TA_47392
gtttttgctgagaaatctattctagcctcagaagctcaggggctccagtcctggttgtttgacatttctgaagaacgaaaacacttcgtgtcggtcattgacgagatgcaccagactcttcaaagaagacttgatttagcagaagcagaaagagcagctgctgagatggaaatgattgaaagggaaaaaatggctcaagaaatgctgaaagaacacgaagtcctacttgatgctgccaaggaagagtctaagaagctggagcaacaggcagaggagaatgcaaagctgggggagctactgatg

SEQ ID NO: 47393 - DNA, 383 bp, Triticum aestivum
  Clone ID: PAT_TA_47393
gctcttgccgctcctagctcgtcgacaagcacacccacaaagccactgagaataagcacatagcagcgcgctctcttatagaacggtctcaactgcacaccagcccatgcaagacttgcagtccatcccgggcctcgccgggcggctgttcggcggcgcggcggcggcggacatccggcgtgtgcagggcccggcgtcccggtgcggcgtgttctcgcaggcggcgtacgcgcagtcggaggcggccgtaaagtgcccgcggtgcgagtccaccaacaccaagttctgctactacaacaactacaacttgtcgcagccgcgccacttctgcaagagctgccggcggtactggaccaagggcggcgtcctccgcaacgtccccg

SEQ ID NO: 47394 - DNA, 299 bp, Triticum aestivum
  Clone ID: PAT_TA_47394
accatgcgttctgccatgccttctgcgacacagccgagaacgcagccgagaacgagtttgaactgcagcggacggtggtgaagatggtcctggaggccctcgacctccaggacgagcgcatcgacgcgcacttcgactcgctgggcctgtccggctgggtggtgcgctacggtgtcccgaccgatatggacacctgcatgtacttgcaggagcactgcgacaacagcgtgaccaccaccatcgtgcaacaccgtgtggaaggcctcgaggtccaagccaaggtcgggagctggcttgac

SEQ ID NO: 47395 - DNA, 445 bp, Triticum aestivum
  Clone ID: PAT_TA_47395
ctcatgcgtcgtagactgcattgagggagacagcgtgcgccgcgcccaacatcgttggagcgatgaacaggacggtcgtgtatagggtactggcggagatggcggttgatgactagcacatatacacgcagttcgactgcgtctcgtactcgacttggttcaggcgctactggaggccgaccgatatggagacctggatgtgcgtggaggcgaactgggacaacagcatgaccaccaccagtgtgcaagacgtggtcgaaggactcaaggaccagagcacggtctggagctcgctagacgcgccgactgataccgtaacgttcagctttatggcctctgagttgatcacggtaatgacgaattgaagggtgcaaccgggcattcaccgtggtaagacgtagagcaatggagagctgctggcattgcttaggaaataccgagggaa

SEQ ID NO: 47396 - DNA, 383 bp, Triticum aestivum
  unsure (1)..(383): unsure at all n locations
  Clone ID: PAT_TA_47396
gcaggcgtacaagttaaaagaagttgaatcattgagctacgatgagatgatcggtgagtgcaagaccatcttcgccgctgggcaggactcangtgcaaccctcctcacctgggcgatgttcttgctcagcatctacccagaatggcaagagaagctcaggaaagaagtgctgagagaatgcagggatgatgatggcgacgcccccaatagcaatagcatccaagtccttggcaaactgaagctacttagcatgttccttcttgagacactgaggctctacagtcctgtgccgttcttgctgaagaagaccgcgtctgacacaacattagcaaacatcaaatntccgaaaaggaccatgaatacaattccgatcatgatgttgc

SEQ ID NO: 47397 - DNA, 212 bp, Triticum aestivum
  Clone ID: PAT_TA_47397
tctcctctttcatctggaggaatgtttaaacagcattcgtttagtgcaatgggttctgctgaaaagtctgtactagctatgccacctcatcaatctaatgaaagttttctgaaagtttatgactgggggctgatattggatgatcgagatactttcggaccccgttccagaagaaaagtggtggataatatacgctcgcattttaatattcc

SEQ ID NO: 47398 - DNA, 410 bp, Triticum aestivum
  Clone ID: PAT_TA_47398
cccacgcgtccggcaccatggccgaggagaccaggaaccccgcccgcgacatccccatcggcctcgtggggtccatggccgtcaccaccgcgctgtactgcgtgctcgccgtcacgctgtgcctcatgcagccctacggcgccatcgacaaggacgcgcccttctccgtcgccttcgccgaccggggcatggactgggccaagtacgtcgtcgccttcggcgcgctcaaggggatgaccaccgtgctgctcgtcagcgccgtcggccaggcgcgctacctcacgcacatcgcccgcacgcacatgatgccgccctggctcgcgcaggtgcaccccaggaccggcacgcccgtcaacgccaccgtcgtcatgctcctcgccaccgccgccatcgccttcttcaccgacctc

SEQ ID NO: 47399 - DNA, 455 bp, Triticum aestivum
  Clone ID: PAT_TA_47399
ctaatatatagataatcgaaattgaaaagaactgtcttttctgtatactttccccgttctattgctaccgcgggtcttatgcaatcgatcggatcatatagatatcccttcaacacaacataggtcatcgaaaagatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagccaaaaaaaataagtcgaagatagaagagcccagattccaaatgaagaaatgga

SEQ ID NO: 47400 - DNA, 465 bp, Triticum aestivum
  unsure (1)..(465): unsure at all n locations
  Clone ID: PAT_TA_47400
atgaaattcaatttacgcagaagttttccacttctgacaacaaagcgagttttctggagaggtgttgttgaggaacttctatggttcataagcggttcaaccaatgcaaaagtccttcaggaaaaaggtatccatatatgggatgggaatgcgtcaagagagtatctcgatggtatcggcctgacagagagagaggaaggcgaccttggacctgtatacggatttcaatggcgacactttggtgctaagtacacagatatgcatgctgattatactggtcaaggatttgatcaacttgtagatgtaattgacaaaatcaagaacaatcctgatgatcggcgtattataatgtcagcttggaatccntttgatcttaagctgatggcacttcctccatgccatatgtttgcacaattttatgtggcagaaggggaactctcatgtcaaatgtttcagcgttcagca

SEQ ID NO: 47401 - DNA, 266 bp, Triticum aestivum
  Clone ID: PAT_TA_47401
ctccccgctcctcccctccgccacgcggagccgcccccgcggccggcggttccgctgcgtcgccgcggcgtccaagggggaggaggtgttcggcggccggaaggagctcacgggcgtgcagccgctggtggaggcattgccgcccgcggggcgggcggtgttggagctcgcggtcgttgccgcggcggcggcgggggggtacagcctcgggacacgctacggcggcacgcggaccacggccgtcgcgggcgcgggccgtggctcgg

SEQ ID NO: 47402 - DNA, 340 bp, Triticum aestivum
  Clone ID: PAT_TA_47402
cccacgcgtccggccgtccatactcccaactcccaagagtacagcgagacatgtgagacagatccctcctccatggagcacggcgacggcaaaaccgccgccaagcgaaccaggctctccgccgccggcggcggcggcaccgacgacctcctcagcgcgctgcccgatgacttggttctccacatccttcacacgctccgcgattcccccaccgccgcccgaaccagtctcctctcccgccgctggcgccgcctctgggcccttctcccgcacgtctacttccccggatacaccgccccccaccttatagcccccgccctcgccgcccatgaagcgccga

SEQ ID NO: 47403 - DNA, 298 bp, Triticum aestivum
  Clone ID: PAT_TA_47403
aaacacaaaccccattttgggggggacacacaccaactccttattttgaatggcccttacatgcaaaatttattaggccggactacttaattttaaaacgggaagaagcaaagatcgacgaccacccacatgggggaggttccattagccatgaagttgtcggcctaaagggtgagctgactggcctcacttgccggggacaaatttggggggaaaggcccaggcgtttttgttgacggggtcggcaagggggtcggagaggtttttgagggggcccttgccggtgacgatggcctgg

SEQ ID NO: 47404 - DNA, 403 bp, Triticum aestivum
  unsure (1)..(403): unsure at all n locations
  Clone ID: PAT_TA_47404
acgcgcagaaaatggcgacgtcgaccagcctcgccgccgcgctgccgtcgcgggtcacctccccgggccgccgcgccgccctctcctgcacaacctcccgcgcgcgaccgcgaccgcacccagcccgtgccgtctcatcggtcgggccccgctgcaggctggtcgtgacctgcaacgcgcaggcggcggcccccatgagcattgggcaggggacgcccgtcaggccgacaagcgtgctggtggtcggcgccacggggaccctgggacggcaggtggtcaggagggcgctggacgagggctacgacgtcaggtgcctcgtcaggccccgcccggcgcccgccgacttnctccgggactggggcgccaccgtggtcaatgccgacctcagcaagccagagacgat

SEQ ID NO: 47405 - DNA, 466 bp, Triticum aestivum
  unsure (1)..(466): unsure at all n locations
  Clone ID: PAT_TA_47405
cactggctcctcgtcggagctcacctgaccaccatgctctcctcctccctcatgctaacctgcggccacgctccgctccccccgttccgcaaaccacggcgcctcaccctcgatagaaccgccgccgttacccaaaccagcgcctccctctccaccttcctgcccgggcggggaggaggagcagccgcgccgcgccggggctgggcccagatctgccgggactcctcccggccgggcgccgatgccgcggagcaggacagagagagcaagaacgacttagcaacggcgaccgtccccaagattggcggtggaggtggcggcggcggcggcggcggtgggcagctcagcgactggataacgtcggtgctgctgttcgggatatgggcggggctcatgtactacgtnctccagctcgcaccaaaccagacgccatacagggacacatatttcttgcagaagcttttaa

SEQ ID NO: 47406 - DNA, 468 bp, Triticum aestivum
  Clone ID: PAT_TA_47406
cgagatcctgggcgtggtgaccagcgtcggcgccggcgtcagcaagttcaaggccggcgacacggtgggcgtgggctacttcgtcgggtcgtgccgctcctgcgagtgctgcggcaacggctacgagaactactgctccggcatggtgctcacctccaacggcatcgaccccgagcacggcggcgcggtcacccaggggggcttctccgacgtcatgctcgtgaacgaggactacgtggtccgcgtcccggacgggctgccgctggacaaggccgcgccgctgctctgcgcgggcgtcacggtgtacagcccgatgatgcgcttcggcctgaacgcgccggggaagcacctgggcgtcgacggcctcggaggcctcggccacgtcgccgtcaagttcggcaaggcgttcggcatgcgggtcaccgtcatcagcacctcgcccgggaagcgcgaggagggcgctgagcg

SEQ ID NO: 47407 - DNA, 431 bp, Triticum aestivum
  Clone ID: PAT_TA_47407
cggaattgcaactagctgcgccgctcgattagccggacgtcacgcacctataccacccaagcggattctcaagggactaacggacctgcaaacctatccccgcacctcctgcagctccacatcctgtgtcatgaagacatgtgaccactggcaagcgacgatcatgggtccatgcgcacagatcatatgctcacggattgtctacggctactattcacttcagtccatactacccattgaggactaccaacgctgcctgtaaaacacacgtttttcacccaaatgtgcacagcaccggatgcatgacccttgatatatgcaaggagcaatggaccccttcattgtcagctacataggtgctcttttcaatctgctctctactaaccgacccaaacctggacaacccgatggtttcgtagactgcacacatg

SEQ ID NO: 47408 - DNA, 248 bp, Triticum aestivum
  Clone ID: PAT_TA_47408
gagccacgcgtccgctagcaccttgagcttgaggtcagtggcaggcaggcaagcatgaaaggaagaagaagaaaaaaggacagggcatctgctactctcctcaagtactacttcctccccaagaaggtcgaatggggcgtcgcgcgccaggacggcgtcccgagggtgtccatggtcgtccgcgccggcgcctacgacgatgagctcgtcaagaccgcgaaaaccatctcgtcgccggggcgcgggat

SEQ ID NO: 47409 - DNA, 485 bp, Triticum aestivum
  Clone ID: PAT_TA_47409
atttgggattcgtggagcggaccacgcgcgcgctttgtttgccttcctccccgctttcgctccggccacggccgcagatggcgacggccaccgcctccacgtccctccgcccgccgccgtccccgtccccgcctcggcttgcggggtcgctgcgccagtggtgctggggaacccctacgcattcctctcggagagcattccacgcgcatcggcggaagaggaacactttgttatgcgcagccgttaaaggcccagaagaatccttcaagaagaccattgaagtggataggctgattgatatgctgagagatgcaaatcccggagagcttgatctaatagtggttgaaaatattctagcgttcagtgagggtttctgggttcggctggctgctcggattgatctatgcaaatcggatgatgataaaaaagattatgaagaactggcagagaatgtcatgaacatagttgaccgtgtcgtccacaag

SEQ ID NO: 47410 - DNA, 198 bp, Triticum aestivum
  Clone ID: PAT_TA_47410
cgtacacacacacagacagagagactagccaaaagcgctaacgtcacctaagttgcctgatgggttgcacggcaacccttgatattgctcactgcaccactgtcgcactctaccagggtcgagaacgagtcaggtggcgagccacgcgccggcgcacggggaggactagtgggaataatgtcccggcgcggccagact

SEQ ID NO: 47411 - DNA, 168 bp, Triticum aestivum
  Clone ID: PAT_TA_47411
cgtgcggtgcggccccgtcatcgtaacacccgcgcgcctcgggctctctgcttggcgtgtggacgccacccaccggtcatttccggcgagccaccgcacgggggccgccgatctccggcgaatcgcgccgatgccgtcggccccgatggcagcctagaagaggagggc

SEQ ID NO: 47412 - DNA, 305 bp, Triticum aestivum
  Clone ID: PAT_TA_47412
cttccgattaaaccaaaattgggattattcggaaaaaattattgttaaacgggtattaatggctacggggggggcttggttttaccaaaaattattaaaaccgtaacttaccaccatttattcccttgaaaaaaccgtttggcttttgtgcccaaactttttattaattaccaggccgaacccggggaattaaagggccttacttggattgcactggcggttccttggaagaaattattaaaaaaactttatttggcagaaaattaaggggtcctattggaatggattgacttcttaacttgggg

SEQ ID NO: 47413 - DNA, 339 bp, Triticum aestivum
  Clone ID: PAT_TA_47413
cttcgcttgattattcaccggcaccggttgccactggcccgatgaattttaagccaacaaacgggaggtgaagggggtgcttaatttctacaaaaaaacacttgcaactgatgggattcgtggattggacccaaggtttaatggggctattgggggtattactttatattggggcctttattttggcatttaccacaccattaaagcttttggtctaataaggcccgtggaagggaattttctgggcaagtttggcttgggattggcaataaactccatttttggggcctgtgcctaatcatttgatacacttcgaccaaaaatggtggtaactttaag

SEQ ID NO: 47414 - DNA, 312 bp, Triticum aestivum
  Clone ID: PAT_TA_47414
cttctcttaaggtcgtccgcgatggcggctccgtggtggacgccgagtacctgcgccaggtggacaaggggcgccgcgcttctcccgcccttatcggcttcaaaggatgccgcccccattattcctcggcttgcattggatgattcttgcacctattaatggaacacaaaaacttggggggcaaatgggttaattagattccagggaaaaggcccccattggtcaaatggtggcttaaaaattgctattgatcttctcgggcctattaaaagggaacattcaaaggttacatatgccaaactttattaactt

SEQ ID NO: 47415 - DNA, 205 bp, Triticum aestivum
  Clone ID: PAT_TA_47415
ggatattcgaagggggaattggagcgggttcttaacccaccccttttcaagggccaggaaaagcctttgggattttggaaggatttattccatcctccccttaaattccaaggggtcgggtttccggattaacttattcttgtataaggggaactggaccatcaaatgaacttcttaatatatgggaccaaaggggaagaaaaat

SEQ ID NO: 47416 - DNA, 326 bp, Triticum aestivum
  unsure (1)..(326): unsure at all n locations
  Clone ID: PAT_TA_47416
gcgcaaaccctcgccccctcccccgccgccgacgccgncgcaagcaaccagcccccagcacccatggaccggcggcgaagatgaagacgatcctggcctcngaaaccatggatatcctcgaggaagtgacggtgaaagtgtccgcgaaaatgatctcggtgacggggtcccggggcacgctgacccggaacttcaaacaccttaaccttcacttacaacttcaagaaggcgggccgaagcttaaagtggacgccttgttctgcacccgcaagaccatggccggcattcggaccggcattttccaagttcaaaaacttattacgggg

SEQ ID NO: 47417 - DNA, 459 bp, Triticum aestivum
  Clone ID: PAT_TA_47417
gcgggcgcgcgcgtccgcccacgcgtgcgcatccaatccttctccccggcggcatcctctcccaccttggggtgggtgcggggggcatccattcaccgggcagccgctcctgatcttcctcgccttccgggccctaccaaccaccacaggccaagcaaacctccccggtcccctcgtcgcgagccaaggggaggggctccctgccggctcccacctcgtgccggcctgggctccttcggcgcgcccactggtggaagggcggcccaacgccgggggctcctttggttcgggtcatgcccagccccgggtggacttcccctgcacaaccggcgggcttcggtaagtcctaccaacggcatgccccgtgaaccctcctggtggtaccggtgctctggtcgggcggagacgacgagcacccggccgagccaggaacgcccttgactgggcgcatgggccgga

SEQ ID NO: 47418 - DNA, 466 bp, Triticum aestivum
  Clone ID: PAT_TA_47418
ctcctatcaagctatatacctacatagtacagccatgcccccaccgtgatggcctcgggggggcctacgtcgctcctttccaggggctcaagttcaccgccggcctacacataagccggcgctccaacggcgctagcctcagcagcgtcagcaacggtggaaggatcaggtgcatgcaggtgtggcccattgagggcatcaagaagttcgagaccctgtactacttgccaccgctcagcacggaggcccttctcaagcaggtcgactacctgatacgctccaaatgggtgccttgcctcgagttcagcaaagctgggttcatctttcgtgagcacaacgcatcccctgggtactatgatggccgggactggacaatgtggaagctgcctatgttcgggtgcaccgacgccacacaagtgatcaacgaggtgggggaggggaagaaggagtaccctgacgcgtatgt

SEQ ID NO: 47419 - DNA, 469 bp, Triticum aestivum
  Clone ID: PAT_TA_47419
aacagctcatcagagctcccgccgccgccggcttcgatctcccgcgccaccacctcgggggggggctcctgcgcggtaggatcctccgagtacctgcgcgacagccgtccccgctgcgcctgcctggtcctcgccgaatcttcagcaaggggccgcatggaggagggtgtccccgcttcggctaatagccaagcttcgactggtgatgccgcggcagatcagcctatcaacgggtacgtgtgggacttggatgaaacgcttattctgctcaagtccctgctagatgggtcggttgccgggcattttgaaggcctcaaggaccatgaaaaagggaccgaaatagggaagcgctgggagaacatcattcttgaactctgcgatgagcacttcttctatgaggagattgagaactacaatcaaccctatctcagttcattacatgagtatgatgatgggaaagacttgacaa

SEQ ID NO: 47420 - DNA, 417 bp, Triticum aestivum
  Clone ID: PAT_TA_47420
gcggacacacgcgtgcgagcacgcgtcctcaatcagaaactaagcaaggggtggatttaaagctggggggggagattatacatgggctgactacaccctagagtatgaaactaaagatactggtatgttggcaggattactagtatctgctcaatctggggctctctccgaaaaagcatgggctggattagcggccaaatcttttactgggacattgacaactggttggactgatggacttaccaaacttgatcgttcataagacgatcctatcacatctagcctgtgtctggggaagacaggcattggatctggtatgtagcttatccattagacctatttgaagagagggcgttactaacatgtgcacttccattgtggggaacggatttggtttcaaaggcctacgtgctctac

SEQ ID NO: 47421 - DNA, 314 bp, Triticum aestivum
  unsure (1)..(314): unsure at all n locations
  Clone ID: PAT_TA_47421
ggacgcgtgcgggagttgcaaagcgcttaagcaagaaagcaaggcagcagtctaacatatttgagtcacatagaggcaagggctggttcttagagggtcctcaacaatncaacaaatgacgaccatttcgggtgggattggtgggcttgccacacttggtttggcatgcgagggtcgcatttcccggaaggacttatgcctaaacctgggtgggggaggcttggggaccgatacaggtggcaatatagggggtaacattggcatatggggtgccggctctgcatcggggtctgggtcttcgtttggatcacggg

SEQ ID NO: 47422 - DNA, 209 bp, Triticum aestivum
  Clone ID: PAT_TA_47422
cgtccgaattcccggtcgcccacccttccgggttaatgacccgttcggaatttttgggattaaccaattccttgtttccggttgggccgtgggggtggtgaattttccaaggccgttctttgaaacttaaataggaattttgagggttggttggaaatcttgtttttggttggcttaaattttgggattttgtacttaaggccaaacca

SEQ ID NO: 47423 - DNA, 480 bp, Triticum aestivum
  Clone ID: PAT_TA_47423
gcgcccacgcgtccgaatcaattccagccgccacaagttccagaacgccagatccaatctagacacgatcacggaggggttcatcatccttattagtgcctctccgatgatgcgtgagtagttcattgtagacctacgggtccgtagttaatagctagatggctctctctctctctctctctctatctctctctctctctctcttttgattctcaatacaatggtctcttggagatctatttgatgtaactctttttgcggtgtgtttgttgggatccgatgaactttgagtttatgatcagatctatgtttttatccatgaaaattatttgagtcttttgatctcttatatgcatgattacttatagcctcatatttcttcttcgaatctttggtttagcaactatatcaatttttcttgccatgggaaaaggtgctttgtgatgggttcgatcttacggtgcttgatcccagtgatag

SEQ ID NO: 47424 - DNA, 276 bp, Triticum aestivum
  Clone ID: PAT_TA_47424
cttcccaaatccttaccttcgtaaccttttttttttggagggccggccaaacccacacccggggggcagccagaaaaattggaaaccgttgcggtttccgcttacccccggggggcccgacacgctttccccggtttgttgcgccaatttttttttttcgaatttctacagccaaagggttcccggccgcgaacacacattttaagggaggtttttgtggccaaacacggaaagaactcttttcccgggggggaggcaatcaaggggggggagccg

SEQ ID NO: 47425 - DNA, 350 bp, Triticum aestivum
  Clone ID: PAT_TA_47425
ctcgcaccaggcgcccctcgccccgccgctgcccgacctgctgcccacccgtgcctgcctctctctctctccttccaaaccctagatcacctccctgccccgtccccgtcgtcgaggaggagcgcctccggtgagcagcaaaaggaggaggggcacgcggcggcggctacgatgggcgcggccccgccgtcccgccctgcccgccgtggctacctgccccgtccccgtcgccgaggcggagctcgcgctcggggaggacgaggagacggccgcctccggggagcaacataaggaggaggggcgcgcggcggcggcaacaatgggcgcggccccggcgtcccgccctgccc

SEQ ID NO: 47426 - DNA, 334 bp, Triticum aestivum
  Clone ID: PAT_TA_47426
ccggcgaccgccaacggaggacaccggggaggatcttctactccgccgacgacagaggagagtttatgccttggttccttttggagtgttctgttttctgctatcgtcgctaaatgcttgcaatacaagcctgtgaagaaagagtcattggtgatcatgccagcttttggtattcagctagaacagcacttttggagtggaagagtagatcgcaagtttgtgcccatcagcaagatcctacagccggtgctgaatgagtgtgtgacccccgttacatgctactggagcttggcattgcttctacgcgatgaagacgagaccatgctcgtttttc

SEQ ID NO: 47427 - DNA, 193 bp, Triticum aestivum
  Clone ID: PAT_TA_47427
gaacgctcaacgcacgacctccttcttagggcagccgccggggtcgccgaaaaaaccccaggccacggggtttgcctcctgatcggcccggcaagggaaggtcgtcgtcccccgcccaatccggaaggccaagaggggagggcggccccggaaaagaaaatgcattcgaaggacgtggtggggaaaaccaggg

SEQ ID NO: 47428 - DNA, 422 bp, Triticum aestivum
  Clone ID: PAT_TA_47428
cctgcggattctctgccagcttccggccgctccccgcctcctccggcgactgaaattccctcctgttgctggagaaatgcgtgagcagcttgccgcagcttgatgagcgtccagccatgccgacgctacatggtcctcttctgttcgtgaatcctggagcttaccaagagccgaaatcattcccgaaaagcaccgccagtccatttaacaacttgttaggctgcaatacggtttgtagttccgtcgaaggccatcatgtacagaagccacacattgtttctagcttcagagttaactttaccagagtcagccattatcttcagagaagcttaaatgagagaactacacggcactggctgcatcgatttcatgttaatgcttcatcggacgaggactttcgctcgtcgcgtaatatagcaacc

SEQ ID NO: 47429 - DNA, 377 bp, Triticum aestivum
  Clone ID: PAT_TA_47429
gctacgcgttcgactagatactccacaccaagccccgaggagagtaccgagagtggcaccgttcctgatctgatccgttatcttctccgaccgcaacgccgaccggagcggagactggagaggtgcatggcgtatagctatgaatatagagtctaggtataggatgaggtatagtagggatcatgtggtgtatgggtgtatagcgatgtggagagcgacgacgacgggttcgagcatcacgtggtgtgtcacggaggctgcgtttcatgcaaggctgtctgtcgcccggtcgctgccgatgggtgatctactaactcattcaccaataagctcgtttggtacgctgttctgtacgcttttcgctacttgtgtagctc

SEQ ID NO: 47430 - DNA, 413 bp, Triticum aestivum
  Clone ID: PAT_TA_47430
cccacgcgtccgatttgcttggtgaacaagagcgatgggtgggggtggaaacaatgatgtcagagatgaaggaacagggcttggttcccaacattatcacctacactacacttgtggatgtgtatgggaggtctggtaggtacaaggaggcaattgattgcattgaggcgatgaaagctgacggactgaagccatcgcccaccatgtaccatgcccttgtcaatgcatatgcgcaaaggggtttagcagaccatgcgttaaatgtagtcaaggccatgagagcggatggactcgaggctagcacggtagtgctcaactcattgattaacgcctttggtgaggatagaaggttggtgaagcattctccgtgcttcaattcttgaaggaaaattgatttaagcctgacggtatta

SEQ ID NO: 47431 - DNA, 344 bp, Triticum aestivum
  unsure (1)..(344): unsure at all n locations
  Clone ID: PAT_TA_47431
cgagactattcaaaccagaatggtattagtaacgaagcttgccggaaagctcattccgaagaccttgaccgctaggagatcggtgaagttctggttgtcatcgcagggtctccggcagatatgtctttccgcagcatagtccgcgatgttagagagagcttcggaagcttatcaaggcggngctttgacgtgaggatttcaggcctccctggtctttccggccatcatcaccgggggatgtcttttgggccaccggttgagccacacggcggggcttgtggtggctgatcagaatggctgggttggtcttcctcctggattacttcgggatgtggtgaaaaggc

SEQ ID NO: 47432 - DNA, 323 bp, Triticum aestivum
  Clone ID: PAT_TA_47432
cctgcggtaccggtgccggaccggccgggtagttccggcgtgccccgcgtccgattgattttattgaaaaaggaccgggtttaaccagggtaaaacgctcacggtttgaaattccagaattggaagttcaagcgttcgtatcagaccgtctttaagttcaaggttgaaactagactttactctttagagtgcgatatgaactgttgatattattttttatgaaagggccaatttgcaggtgctaagttgtgctgagctgaatttatgtataacctggtgcggaaatgttgctaccctgctttacaggattttttattgacact

SEQ ID NO: 47433 - DNA, 416 bp, Triticum aestivum
  Clone ID: PAT_TA_47433
attacacggtgcatctccggcggttcttgaaggaagcttaaagatcaatggctccagccgtctgaatggctctggaagagtggcggtggctcaaaggtctagacttgtcgtcagagctcagcagagtgaggagacttctcgccggtccgtgattgggcttgttgctgctggtttagctggtggctcgtttgttcaggctgtcctcgccgatgctatttcgatcaaagttggccctcctccagctccttccggtggccttcctgggacagataactcagaccaagcaagagactttgcattggcattgaaagacaggttttacttacagccattgccaccaacagaagctgcagctagagccaaagaatctgcaaaggatatcataaatgtgaagccattgatcgacaggaaagctt

SEQ ID NO: 47434 - DNA, 314 bp, Triticum aestivum
  Clone ID: PAT_TA_47434
accattgacactctccaggtggacgtaaccaaaccgggcttggaagcgtaccttgacactaactgcatcgcgaacgtgccctgactcgttgcactctaactgctaaagggttgtatgcactcacacatggtacttactagaacatctacagtgccattcactgtttatatcgcgctgtactctcacgtgtgcgctaacgcgatatagctctgcatctgaactttatagatatgcatctgacgccgatatgagcatcatatgctgttactaatgctgatgcgctgaaacatcacgaacttggcgcgccacatcgt

SEQ ID NO: 47435 - DNA, 401 bp, Triticum aestivum
  Clone ID: PAT_TA_47435
gcggcatctttgaagccagccaccgtagctgaaggatcatatgctgcccaggtactggcaccaaagccagacaccgctgaagaagcatcagcgtcgactccaaagccaaagccaaagctaaagccaaagccggctgatgctgcagctgccaccagcaatggggcgggtgctagcggtagtagtggtggtagcaagaagcagaagaaggggcataaggagaggcttatggcttggaagggaaaggggaagcaggaggaggcgcaggggaataagaaggggatgaggaaggaggagggggagcaggggaataagaaggggacggagaaggaggagggggccaagaaagaagggggtggtgatagcaagggaggagggcttatcttcatgtgcaatgcacagac

SEQ ID NO: 47436 - DNA, 356 bp, Triticum aestivum
  Clone ID: PAT_TA_47436
ggcgccggagccgatgctgctcgacgagcagccccccaccgcaatcgcctgcgagaagaagcaacaagatggcgaggcgccgtatgcggaggggaacgaccccattaccggtcacatcatcttcaccaccatcggcgggaaggacggcgagcccaaacagacgattaacttcatggcggaacgcgttgggggcaattggtcggttgggattggcttttaagcttaaaggcctggaaaccgggggaatgggggccttaaaaaagggcctgaagacaaaccggacaaggaccgggagctggaacttatgccgtcgaagatccattccaaaggtggcttccttaaagactggttttttt

SEQ ID NO: 47437 - DNA, 293 bp, Triticum aestivum
  Clone ID: PAT_TA_47437
cgacagggatatgtttgtcttctgctgaccgtgcgcgtgagcgcatgacagcctagccgactagaatatttgaacatgagctgaaaatcccctgttgactagtctagctgaaagtttttgtgcctgatgttgtagtaagtagtggattataccttgtggagggttaatgcttccaaattttgtttctcatcaatcttgagcaaatcttgagctttgtggcagccaaacttttctttatttcagtacatggaaattttattttatgggcaatataatgaaactaatttaggcct

SEQ ID NO: 47438 - DNA, 421 bp, Triticum aestivum
  Clone ID: PAT_TA_47438
cccacgcgtccgcgtgagcacaatgcgtctcccggaagatacaacggacgttactggacaatggggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagttcggtaaggcctaaacagctcactcaccacgggccacatataaagtgccattgcagttttgtcaactctgacattgctttgggttttccttctccatttgtctttcttacttgtttctaagaatatgtgtatgtccatgttcatgtaacaacatggctcgagaaagcgtgctcgtatttgaatgcaatc

SEQ ID NO: 47439 - DNA, 430 bp, Triticum aestivum
  Clone ID: PAT_TA_47439
aaagcgcttatcctcgccgcgtccgatcccgcaccgcaccgaccggcccgcggccatggcggcgccacccctacctccactcctctgcagtgccgcctcctcctaccgcgtgacgctcctcgcccctcatgctctcccctatcgcgcggcggcgcggccgatggtctcgcgcagctcgtcgcccccgtgcatcgcccccacgctgcggcgagcaggggcccgggcccctctgccatgcgcggccaagcgcggcggcgaggcgtcttcgattggcggggaggggacgcgcatgctgcttcaggcggcgctgtggggcgccgaggccgcctacatactctggctcttcctcctcccgtacgctccgggcgacccattgtgggctatctcgcaagccacgatcactgacctcgtcggcctgtcgctcaacttt

SEQ ID NO: 47440 - DNA, 336 bp, Triticum aestivum
  Clone ID: PAT_TA_47440
ccacacgcgtacggagacgcgtacgacaacccctaccgagaggtgcacgaggaggacgcacaatggcaacggcaacagcactcaccatggtcttggcgacggggctgcgcatgttctgcgtcagggggctgtacttcttggggcttatgccggtctactacatgggatccgtgccggcgacggccgagagattcgacgccacctgggccgaggaggtccacgcgacggtcgacgaggtcgaccccgagattgccgacatcatggagctggagaaggtcctccactggaaggaactggagctcatctcggcggagaacgtcacctgattcttggtga

SEQ ID NO: 47441 - DNA, 417 bp, Triticum aestivum
  Clone ID: PAT_TA_47441
cacgctcctgctgcgagacctcccctgctctacgccggcggccgtctacgagggcgtggtcgccgcatgccctcagctgcgggttctgcatctcatctcctgctccttcgacaacgatacagcccggtgggtggtgttcgacgcgcccatgtcagaaatcagagagcttgtcgctgacggccagttgatgacggtcaagctccggtctctccccaagctcgagagactcactgccgtggatggcagcgttctgttgtgctccgacgccaacgtcccttgccttgcggatgtgagcctcgtcttctctattggtccactggaccactcgattgtgaaccacttgattgcaatgttcatgctcttcttgaaagacgccgccatcagcttgaggaatctcattctgcgctttactgggcc

SEQ ID NO: 47442 - DNA, 213 bp, Triticum aestivum
  Clone ID: PAT_TA_47442
cccacgcgtccgggcccatcccgcgggacccaacgcacgcgccacagccagccggcgtccgcgcccgcgtccacacgcctctcgccgacgctggctccaaagaaggatggccaaggccctcaccaagctcggcagcttcaccatcccgcggaaggcctaccaggtgctctgcgacattcggggcgacttatggcgcatgttaagcaccgggga

SEQ ID NO: 47443 - DNA, 406 bp, Triticum aestivum
  Clone ID: PAT_TA_47443
gcctcggccgcgtcagcaatggcggaaggatcaggtgcatgcacgtgtggccgattgagggcatcaagaagttcgagaccctgtcttacttgccacccctctccacggagctccttcgacaaccatacagactccctggatgcggttcaaatgggtgctctgcctaaagttcaacaaggttggcttcgtcttccgtgagcacaacaacttctccgggtactacgacggtcgatactggacaatgtggaagctgcctatgttcgggtgcaccgacgccacgcaggtgctcaacgaggtggaggaggtcaagaaggagtaccctgacgcctatgtccgcgttatcggcttcgacaacctgcgccaggtgcagtgcgtcagcttcatcgcattcaggccaccgggttgc

SEQ ID NO: 47444 - DNA, 423 bp, Triticum aestivum
  Clone ID: PAT_TA_47444
tacacctcctcactccgccgccgctgaccctacgccgacacccacccccgccgctctgttgccgagcgtgctcgatccgagctccagttccggtgcagcttggccgagtttcccagccactagctcaaacccaacccaggcctgctcgatttcgcttccttgacatcgcccgcgcacccaccgcgagcagtcgctgatgaccaccgcgccggtcgtctccccctcgctctcccgactacactccgcgccggcctctccgttccccaaagcccccgttgggtccggggctggggtcgccttccccgcccggccgtacgggccatcgcttcgcctgaggtcggccgtcatggctgccagcggcgtcggcgggaacggctctccgatggcgcctgaggaatccgcagtgtcgtctaggttggggga

SEQ ID NO: 47445 - DNA, 368 bp, Triticum aestivum
  Clone ID: PAT_TA_47445
ggaaaacgggggggcgacccacgcgtgcgcgtagcacaaatcttgatgcgtattcgaaacacttgttttttttttttgccgggcacttgccggggtatttgaagagaatccagacagcttcaagcgccagccgcgggcgccggcaagggcaaggaggccgcgtcctgtttcgccaagatgggagagccgacgggtcccgactcgaagagaatcaacgtgtgtacattcggttggctcgaaggtggaggaggaggcggccacggccacggccagcgatgggtcggccggcggggagagagggcgcaagcaggccaagggcaagggctccaagtccaagcagccggcggcggacgagccgcccaagggct

SEQ ID NO: 47446 - DNA, 425 bp, Triticum aestivum
  Clone ID: PAT_TA_47446
cccacgcgtccgcccacgcgtccggagcctggatggcgtgatgtgcctgtgcatgatcctgtagtcaaagatgctgcaagccatgctgtgaaatcaatccagcagaggtcgaattcccttctcccatatgaacttgttgaaatcgttcgtgcaaaggctgaggtttgttttatgtaattgtttttctacttcaattctccttgacaagtagtaatattcatctcagctttacttgctgctaccatgaccaggtggttgaagacttcgcgaagtttgatatcctcatgaaactgaagagagggaccaaggaggagaaaatgaaagccgaggtgcataagaacctcgagggagcttttgtgctgaaccagatgcagccagagcatgacgaatctagcagccagtgaatctgacttgttgagctcaca

SEQ ID NO: 47447 - DNA, 419 bp, Triticum aestivum
  Clone ID: PAT_TA_47447
aatcgcgtttagagaagctggttccgagtgtgaaggtgtctacttatggacgatggaactggcttaaaagagctaactctttacctgggtcaggtagtgatgatcctacagaagcatcgaaacctattttccagagttctagcaagctgagatcagggttacagactgaagttgtcgacaagattgctgttattgagttatcatttccttctctattcagagctatagtctcgttgagtccagcgggttctgttgatccagatgcagttgctttttttttccccagatgaggggaggcagctacttacatgcgaggaggcctctcggtttatcatggtttacaaacacattaacggaacatgctgctacagccttgcaatatttcctcggctttggtactggaacagctctctactctc

SEQ ID NO: 47448 - DNA, 308 bp, Triticum aestivum
  unsure (1)..(308): unsure at all n locations
  Clone ID: PAT_TA_47448
cgtagcacaaatcttgatgcgtatttgaaacacttgttttttttttttgccgggcacttgccgttttatttgaagagaataatgacgtattcgattgcgattttgtgtgtggactgtcatgggcgatgggtcttttcttttttgcgaatcatgagcgatgggtcttcgctcaggaaggaatttacgtgtgtacatttgtttgtctcggtacgtaatagatacttcctccgttcnaaanaaaaaaaaaaaaggaaaaaaaaaaaaaaggngggaaaaatgacgaaagaaaaggaggagtggtgagaagg

SEQ ID NO: 47449 - DNA, 369 bp, Triticum aestivum
  Clone ID: PAT_TA_47449
gctcgtctcctctccctctcgcccacgaactcctcgccgccgccgccacctgcgccggctgcttccggcgacctccgacgccgcgcagcacgcccccgagctcctcacggtccgcgcctccctcccctccgaccagattctccgctcccgtcctctacagcccgcttgcaaccccacccccgtggctagggttccgggcaaggcttcgccggctcgtctccggcggccccaggggataggtcgcttccgcggtggggctggtgagctgggagctggtaaggcatacgcccttgcagacgaggagttcttgctctagggagagagcagagggcatgctggacactgtttgtggtgagacagttatttggc

SEQ ID NO: 47450 - DNA, 203 bp, Triticum aestivum
  Clone ID: PAT_TA_47450
ttgtctaaaccgcgataaccatcgcatctccaggcaggggtattcttgccttggatgattcgtatgccacctgtggcaagagacttgcctcgtatggccttgataacaccgaggcttaccggtcggcttaccggacccttcttgtcactccaccaggcttgggaatctacatctctgggggtatcctatttgaggagacgctt

SEQ ID NO: 47451 - DNA, 307 bp, Triticum aestivum
  Clone ID: PAT_TA_47451
gccacgcgttcagtcgaacgataacaccaaaaacaaccaccagtagtaactggcatacggagaggcagagttagagtcaaacatgggctacatcgcagcctacatggacgagtacgccgacgtggatgctttcatgtatgctctgcagctcgtcttgccgatgacgctcaagatgacgctcaagatcggccatcgtgctgactctgctggacaccctggtggacgtcgtggacaagctgctgacgcccgccaaggtggcagccaagctgaagtccacggcgaataacatcgcggactacatgctgga

SEQ ID NO: 47452 - DNA, 278 bp, Triticum aestivum
  Clone ID: PAT_TA_47452
catcctcgcctcgtcccactcccgcaccaaccacaacccaacccttagccttgttccctgcgatccccacagcctctcccgccttctccatccctcctcctcgcctcgccatggcctccgccccggggcctagccccaccacttcaccttccttttcttcgttgtctgcgcccgtcagcgaggcctggctccagatcaggtgcgggctaggcgagctcggtggtgggatgaatgggcagaggagggtggcgatgagggcaggcatcagtcgggcgcgg

SEQ ID NO: 47453 - DNA, 326 bp, Triticum aestivum
  Clone ID: PAT_TA_47453
accctctcgttaggttaggctaggctatgggctttacagaagctcgcggtaatggtggccttaaggttccatcaattccaggtggtgagtcgcgcgcatgtccacgcccggcgatgagccgccgaagatctaccgcatgaagctctgggcgacctacgaggtgcacgcctagagcaagtactaggatctcccgaggaagctgaagaaggttaagatgagcaacgtgcagatgctcaacatcaacgagatctttgtgctgaacctaaccacgatctataactatagcctttgcctgagctaccagagcagaaccggcttccacaaca

SEQ ID NO: 47454 - DNA, 380 bp, Triticum aestivum
  Clone ID: PAT_TA_47454
cggacgcgtgggctttcttggaagcgtcatcgtggaggtgctcctgcttctccccacggctttggctccggagggaatcctcagatccgctggatcgggcgatggaggcgtcttcgcgtctttctcctccttgggggcatcgtctcggagccggcaatgactgggagaccggtggatggcggcatcttcgccgcgtgggttgcggcatctttgccgcgtggtttgctgaggcggccttttcgggggcgctgatttctttttggaacgatgatggcgtcgagaggaactctggtcgcggctcgtgcttcgatagtcggatcttcctggcgtgtccgaggtgctctttaaggcacggtcggcgcaagttctgcataattttc

SEQ ID NO: 47455 - DNA, 341 bp, Triticum aestivum
  Clone ID: PAT_TA_47455
ccccgatccgctcttcctcctctcccgaggatacgcagccgccgccgccgatctgccgatccgggcatcacagccgccgccgatctgcctatccgggcagacgcggccttcacggatcacgagaacgccggcgccgccggctcctcggatgcgtcgcccccggcgcctcggatgcgtcgcccgtcaccaccacgatggcacctcgctgatgccgctcggcatggattgccgccctgaaggggggcaagggggcggtcaccgtgggcccccaaactctaggggccacatcccagatcgggggccttccctccctaccgatgcaagtcacgccctacgcgggg

SEQ ID NO: 47456 - DNA, 382 bp, Triticum aestivum
  unsure (1)..(382): unsure at all n locations
  Clone ID: PAT_TA_47456
gttacctatctgtttcttctactctcggctatccccaatgaaaacacaaccgcaaatcgctagggttcaccattccccgtcgtcaccgctacccgtcccaacctcggccactagtggctcgaccgtcgccggccgacgaatcggaggcggtgcggccgtaatctccctttcctggagcgcagaggcgcagccacctcgtctactgcatcctccaccggccactccctatcactggaccgtctncacccgccccaaccccggccaccgtccactcggatctcagtcgttgctgcggtaaccttcttcgcctatttccatctgttctctgtccggtccttccccttcccttctgccagtgtccgatgcctggctgctctatttc

SEQ ID NO: 47457 - DNA, 363 bp, Triticum aestivum
  Clone ID: PAT_TA_47457
cccacgcgtccggagaaacacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggtccgccggcgactatcttcggtggactccgcggagcggtcaacttctaccaggcaaggtacttttcctgcccctagaaaaccggttctac

SEQ ID NO: 47458 - DNA, 410 bp, Triticum aestivum
  Clone ID: PAT_TA_47458
cccacgcgtccgatttaattaatgtgatctgagtgaaagacaatgtcaactaaaggtatcctttgcccaagaagtaggacattttatggtgatagcagtgtgccttttgccttgatcaccgcaagggatcctttaacctacgtagaggtcgtgttgagaaaatattatagtgcagtttgctgagatacaaattgttgtggaagatagcctttgaagaatcaggattataactttagctaggttaaatgatagtggtgatcgggacttgacttctagatgctggattagttccaacaattaaatgcaactgcaagagggtatcatgttggcagtctgacatggtaagttttgtgtagtgtctcaggaagaaactagctggttggtgtctttggtctgtgtcatatttttgc

SEQ ID NO: 47459 - DNA, 361 bp, Triticum aestivum
  Clone ID: PAT_TA_47459
acgccactgtcgacacgttcattggttcaacatcctcgaatcctctcagggttgctattgctgacacaacctgtcccgaagcacccatgcccttacaagctcacattttcatcccttgaaccatataggagcagcgcatgcatatgtgatcacagattgtgaattcaacctcacagaatactcttgacctctcagcctatctgccgacaataacagctgagacggtggacatcaagcatattgtgacgaatctgcccctaaacacatggagcatggtgctgtataacaaccgtgtttacttgatgatatcccccatcttctgatttttgacaggggaacacaagaagctctttatagcagg

SEQ ID NO: 47460 - DNA, 347 bp, Triticum aestivum
  Clone ID: PAT_TA_47460
gagaattcttaattcaagagttatagggagggacttatgtcaccacaaacagaaactaaagcaggtgttggatttaaagctggcgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcggttcaaaggacgatgctttcacatcgagccttttggctggggaagaacaccaaagggatctggtttggatactta

SEQ ID NO: 47461 - DNA, 420 bp, Triticum aestivum
  Clone ID: PAT_TA_47461
ccaaaaccctagatgggatatggcctggatcgataaagttttaagcctacatatcgcgatatcaagctcagctccaagaatgcctcacctatgaggagtgttggcgcacgcaggcaacaactacgcttccccgatcaggacccagcccggggcggaggaggtcacggcggaaaggacgcctgaggcagaagaggccacactacggtacctaaagtgcgtgtagtaaggcggggctcatacacgacgtgcttccaccagatggtacacctattcaacgcctagatcaacaagcagttcaaccaggactagtcaaacgcgctggtacaggagttgacgtcggactaccaccagacccacgttatccgcaaccccgagtttaagaagctggcgactagatgcaggggccgttacggcagatct

SEQ ID NO: 47462 - DNA, 404 bp, Triticum aestivum
  Clone ID: PAT_TA_47462
gagattccttccgtctccgccgcctgctgcccggcggttcgaatcatgcccactggtctcgtgatctagcctccgggccgtgtcgtccagttggtcccagaccgttcctgcgggtcttcttctggaaggacagcagcgcccggagtagcccaggagctgccgggtgcaaaacgcactcggtcccttagaccaggtgcgcgtgctagtccaccgcgattcatgtgaaggctaatattcagtggcgcatctcatcttagaaggatctgctattgctcgaccagctcagacacttacatgcccgcagggcattaaacatgtaacttgtgataatgcacggggctattttaataacatcgactaagatgctataaaggaatgtcatttgttgagcttgctgatgtctg

SEQ ID NO: 47463 - DNA, 351 bp, Triticum aestivum
  Clone ID: PAT_TA_47463
cggcacaccaacctgtcggaccggcgctgccccaaccggtcgtgcgcgcaccgccgcaaccctccggctcctgcacctagcgagcgccgctgcatccccaacctccagcaccactgaagtcacctttgctacctccctgcttctggtggttcctctgcatctcccacttgcggccacgacttcttgtcctcccatggacggcgtacgacagtgatattgttggcaaattagaccggcctgatgctcttgttgttggtcgtcagggtggccgtgcccaatccgtcaaggaggagcagctgtagtaggtacttgtgcaaattaaggtgtgtggtgaggagaggagatttcttt

SEQ ID NO: 47464 - DNA, 218 bp, Triticum aestivum
  Clone ID: PAT_TA_47464
cccacgcgtccgcccacgcgtccggctttgctcctagcactcctcctcttgagagagagagagagaccactactccattggaggccaagaccttccatctaggagaagaatcctacgggatatcataaagcacccctcacgggtggaccccccataaaaacctcctttgggagaggaccttaaccttgaatctttcctttggtggtcaatgtaccttg

SEQ ID NO: 47465 - DNA, 330 bp, Triticum aestivum
  Clone ID: PAT_TA_47465
ccattctgcatcctcagatcagcgcagcggaagatcgaatcaatctatgtttggcgagagccgagccgaggggaggggaggaggatggtgaatgccattgcgggatgcccctctaagatttggtttcggatgcccaccgagtgggcagccgcacgagcagcgctggttgggttggacgtatcgttcacacaactggtgggagcatgctgagccatctagaaatacatttgagagaactgcaattggcatttgaaagtgggggcgcttcaccatttgcccaagtgccaaacaacctccttgtgttcaccaacttatggaacaccaaccgaa

SEQ ID NO: 47466 - DNA, 339 bp, Triticum aestivum
  Clone ID: PAT_TA_47466
acaacgcgggaaaggaaaaagggagaacgctccgcccacccaccgccccgctggctcggctcggcgcggcggccccaccgccggcgtgggcgcacgtgccaccgcatcaccggtatccggcgacggccggggacaactaccgcggaagacggaagtaccaacagaagagatggtgtgaggaggcccggggcccccgccaccctcccccactaccagcgatcggcgctggtacttcgtggctcgccagtcggtcagtccgtccgccacctgcttcactttcttgagctcggatcaccatttcctttccttcgctcctctttttttttttttgggatcacc

SEQ ID NO: 47467 - DNA, 353 bp, Triticum aestivum
  Clone ID: PAT_TA_47467
ggcgagcaggcggggaattactcaccagtagcaaagctaagaaatgcacagacacaaacaacatccagtaaacctgcgcccgggcagtatccgcatctgcatctttggcctcttacccgtttactgtgtgggtgacgtccggaccacaccattaagtgaaccattgtttaacacggatatgcacaggcgtgtggatgtgcactgcccctgaatgtgaagagctattcaagatgttgcatttttggtggagttcaatgcatctgcttaaggaggatgccgcgacagggtaaactcctctgccgttgcagagcatccactgtgcctgcaccggcatccttgtctttgagccattt

SEQ ID NO: 47468 - DNA, 412 bp, Triticum aestivum
  Clone ID: PAT_TA_47468
cccacgcgtccgtaaaccctcgcgtccgaaaaaccacccccattcaacccccaccgccgtgccggacaagcagaagcagccgtcgcagccgcagccgcacggcgtgatggcgccggagccggatccggaggacgggagggagctctacgcgcttctgcacctttcgccggaatcctccgatgaggaaatccgcagggcataccgtcagttcgcgcaaatctaccaccccgacaagtaccaggacgcccagatgaaggatgtagcaactgataacttccaacggatacgtgatgcatatgagatactattcgatgagaacaaaagacagatctatgatatctatggcttggaaggtttaaaatctggtctggaacttgggcccaagtttaataaacccggaagaatcaaacga

SEQ ID NO: 47469 - DNA, 393 bp, Triticum aestivum
  Clone ID: PAT_TA_47469
ccaccacagccccactcgtagagagcacgcgcaccggacacgcacgaaggctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctaccttggcccgctctccggcgaccccccgagctaccttaccggtgagttccccggcgactacgggtgggacaccggggggctggctgcccgccccgtaacctttgtccagaaccgggagcttgaggggatccaatggcggggggccatgctgg

SEQ ID NO: 47470 - DNA, 248 bp, Triticum aestivum
  Clone ID: PAT_TA_47470
tacaccaccacagacccactcctagagagcacgcacatcggacacgcacgaagtctcctcgaccagcgagcaatggcgaccaccgcgatggcgctctccccctacttcttcgccgggaaggcggtgaaggacctgtcgtcatcggcgctcttcggggaggcgcgcgtcaccatgcccatgaccgtgggcaaagccaagccggtgtcatcgggcaacccggggtacgggtccgaccgtgtgcttctacc

SEQ ID NO: 47471 - DNA, 380 bp, Triticum aestivum
  Clone ID: PAT_TA_47471
tcgtatggatggaaatcctagccacatagtctattatttatttctgtgttggctagtgtagcttggagtattataaagttgaacgtaacttaatctttttgccatgtgatcatgcattagatcatacatgtagatctcatcttaaaaggattatcaagcggcatattatgtagtaagataggaactggtggtgtagggatgctgctattatcctttagtagcctgattgctatgtgcccccttttcaaaattggatcaagcaggtattcttatgttatgatattacctaatgatgcaacaaaggtggccacattcactttgcaaccagactcatgtcatatgttaataaggggttgaaacttcaaagcacggtgaactac

SEQ ID NO: 47472 - DNA, 368 bp, Triticum aestivum
  Clone ID: PAT_TA_47472
cccacgcgtccggaggctggtatctccaaggatggccagacccgtgagcacgccctgcttgctttcactcttggagtgaagcatatgatctgctgctgcaacaagatggacgccaccactcccaagtactcaaaggcccgttacgaggaaattgtcaaggaagtctcatcgtacctgaagaaggttggctacaaccctgagaagggtccctttgttcccatctctggatttgagggtgacaacatgattgagaggtccaccaaccttgactggtacaagggccctacccttcttgaggctctcgaccagatcaatgagcccaataggctctcagacaagcccctgcgtattcccctcaggatggttac

SEQ ID NO: 47473 - DNA, 172 bp, Triticum aestivum
  Clone ID: PAT_TA_47473
gcaccaaccaccgtcccccccgagcccctcaccgccactagctgtgtgctgagtggctaacctgcagagtgtgcctaccgttccgtttaccatcaccacacaccgcacgtgcgtacacctgcttcttcttttttcttcttcccccattgcaggtaccggggtgttctcttga

SEQ ID NO: 47474 - DNA, 306 bp, Triticum aestivum
  Clone ID: PAT_TA_47474
cgctaaccaactcgggctcgtgctaaacacacctccgtcagaggggaaagcgcggcgaccggcggctgcggttaggcagagccatggtggtccacgtcgtgtacaggaggcgggagaacagctggaggggggccgactcgtctgtcaggttcctgggcgccgccatgagcagcaacccgccgagcaagcaccaggtccgcctcgccggccgcggcggcatcggctacgcccccaccttccccgcgggcgcgcgcaacggaggcctttttgtgcgcgccaccttcccggcggcgtcgaccgttttca

SEQ ID NO: 47475 - DNA, 323 bp, Triticum aestivum
  Clone ID: PAT_TA_47475
tcgcaagcaatggcggccaatgaggaggaggaggggacttcgccgctgctgatcaagggggaacgccggcaccacccgggctgcccgggctgcgaccaccaccggaggaaggagctccgcaccgggctaccttacaaggaattctcctacgtctggatgatctggcttaccaccgctttaccaatatcgtcactgttcccccttttgtatttcatgataagagacttgcatggtgcaaaagaacagaagatattgggttctatgctggggttggaggtgcttcttttatgttcggagatggttgacttcaactctttggggaa

SEQ ID NO: 47476 - DNA, 220 bp, Triticum aestivum
  Clone ID: PAT_TA_47476
ggtagcggcgaggtggtagccagccagccgaaagaaacagagcacatccgagccgggagcctgcccgggagaaggaaggaaggaaggaagatggacttctccgcggtggcggtggcggcgccgcttcttgaggccggcggcaaggagatgcggtacctgggccgtaccgtgcacaacatgttcttcttcttccttcgcaagaaggtcgacaccttgcttg

SEQ ID NO: 47477 - DNA, 316 bp, Triticum aestivum
  Clone ID: PAT_TA_47477
gcgatcggtgatcaccgctacagccgcgcatacgccgaggggtggatggggcatcgggggcggcgggggtgtggggcggtctcaactccggggtggtgctcaggattatacgggtgctgtggacggtggtgtggcagaacctggagcacctgcagctgcagcaacttccaaggcgcgaagctcagacgccacgcgcgccgagtcgtcgccctcgtagacctctacctgtccaggaacatcgacgagtacgacggtggtgcggatgctcctcgccgaggccttcaaggaggtcacggacggcctggcctcggggact

SEQ ID NO: 47478 - DNA, 105 bp, Triticum aestivum
  Clone ID: PAT_TA_47478
ccggtcgccacgctcggagtcgctttaacagtggccctcggctcatgttctcttactatgtgtcctaacgcctttctcgtcacacttctctccgcccgcggcgcc

SEQ ID NO: 47479 - DNA, 170 bp, Triticum aestivum
  Clone ID: PAT_TA_47479
tgacacaaacaggtactaatatttcatttaattgttgcattgaaccatttattgctgaaaagattgagaatcattcaaaccggggattacatgtttgagacactgaggagagttgaatttagtggtcagggaatggcacaaaacatggatcaagggttatattaggttat

SEQ ID NO: 47480 - DNA, 426 bp, Triticum aestivum
  Clone ID: PAT_TA_47480
cacgcgatccgtgatcaccactacagccgcgcatacaccgatgctagcaaggtgcaccaagcaccaccgagatggctgctcgctctcaactcaccggcggtgctcaggattatacgccgaccaactacctgcggaagaaactaaccaagcacacgtcctggtgcgtgaactaccatggcacgagctccaagggcaacacgctcacagtcatggcagtcgaaaacatctaccagaagaggaacacagacaagtggaagggtcttgcctacgatatttgccacgaccagcaggacatcaccagagggaagggcatcgtggacttcctctttcaggcgcccacgggcgacggcacccacgaggccgtcctcagctcctacgagtacgttagccagggactcaagaagtacgacttcgacaacaccatgg

SEQ ID NO: 47481 - DNA, 218 bp, Triticum aestivum
  Clone ID: PAT_TA_47481
gcctcgcgttcggccttggactggtcgctccacagacagagcctatagcaggtgctgtagctacagctgctgttcaacttctgagtgagcaacagagccagcctaggacccaacctctggcgcctgctatgacgactactcagaagaccaagcacaacagggaggccgagagggaggccgccatggaggggctcttcctgatgctcaacataatgggc

SEQ ID NO: 47482 - DNA, 180 bp, Triticum aestivum
  Clone ID: PAT_TA_47482
aagtctaagctaaacagcagcgagcaatggcgtccacctcctgctttctccaccaggccaccgcgcgcctggccgtctcgtcgcgccctgcgcccaccgtcgggcgcacccagctttttgtctgcaaggcgcagaaaaatgactaggctgcatctgacgctgccgttatcaccaagtcgg

SEQ ID NO: 47483 - DNA, 174 bp, Triticum aestivum
  Clone ID: PAT_TA_47483
tcagaagtgcacgtcggcggagttcgaggtggtgtacatctacatgtacaccgaggaggatcggtacgaacgagggaccgtctacatcccttggctgacgctgccctacaacggcgaatgcttgaccaaaaaaggcgctggccaggtactgccacgtgcggaagatcccgacgc

SEQ ID NO: 47484 - DNA, 140 bp, Triticum aestivum
  Clone ID: PAT_TA_47484
cacgcgttcgggggtggaaaggctgtgatgcaaccactgctcttaggagagtttttgttgcgagggctcctaacagaaagatattaatgtactcctactaagataacacaggaaacgggatgtttgaaatgaatgtggat

SEQ ID NO: 47485 - DNA, 358 bp, Triticum aestivum
  Clone ID: PAT_TA_47485
cttatagccagtcgccaacgcagacctgaaatctcgctctcgcctccttgcgcaggcgtcgtccagaggagcaagaaaatggcggcgagcaacctcgaaggtgtgctcctggggatgggcaaccctcttctcgacattttcgacctccgcgacgaggccttcctccctgagtatgatgtccagccgaacaatgccattctcgccgaggacaagcacttgcccatgtacgatgagctgtccagcaagcgaaaatgttgaatacattgcttgaggagccacgcaaaactctatcagggttccccaatggatgcttcaaactcctggtgcaacaagatacatcggttgcattggaaaagac

SEQ ID NO: 47486 - DNA, 415 bp, Triticum aestivum
  Clone ID: PAT_TA_47486
ctacgcaccaatggcgtcctcgtccatgatcaccttcgcagccgccttgtgccttgtggccgcttccgccgtcgccgttccgccggccaccctccaggagacgtgccagagcgctggcgagcaggaggcgctgtgcgtgcagctgctgtcgtcgaccccggcggcccagaagacgccggtggacacgcccgggctcgcccaggcggccgtgatggcggcggggtcgaacgcgacggagacggcggcgcacctgcaacggctcttcgactccgaagacctcaagaacatgagcccggagctccagcgctgcgtcgaggactgcaccgagagtcggccgccaagttcctgggccaagcatcggagaagatgaccgcgggctccttcgatgaggcgggcgtgctgatcgacggcgcgc

SEQ ID NO: 47487 - DNA, 364 bp, Triticum aestivum
  Clone ID: PAT_TA_47487
gtcggacgcgtgggcacgccataacctaagctaggttttcctcctacacctacaccggcatcacatcgaacacgcggctgcgtgcacccatggcgatggtggcacaggccggctttggcctcacccgcgtcgagatgctcgtcagcgcgggcgtggccggctccaaccacctactaaacggcctcctgtaggagatactgaccgagatacaagagtttctactgaagggcttgctggtttaggtaggtgcagaggacgatgctatcacatcgagcctgttgctgtggaagacaggcaatggatcttggatgccactttatccattagatctatttgaagagggttccgtgactaacatgtttac

SEQ ID NO: 47488 - DNA, 419 bp, Triticum aestivum
  Clone ID: PAT_TA_47488
ctccaaaatattaattgagagagcgcgctcaatgtcccctgctctgaagtatcataatgaaggagagccacaattcatgttacaaatggtaacaaatcaacgtttgactaagggagattctgagagagatgtccgccattttgaattggaagatcgatattctcccatcagttatcaagttggtgatgccctagaaattctaccaagtcagaatccatcagctattgatgctttcattaaacgctgtaacttggatccagattgttacataacgattcgagcaaagggtggtgacaaactttccaaaggttcacctatgaacagtttgatggatcccatcaagctaaagacctttgttgctttgacaatggatgtcacatcagcttcccctcggcgatatttctttgagatcatgagct

SEQ ID NO: 47489 - DNA, 412 bp, Triticum aestivum
  Clone ID: PAT_TA_47489
gtttggtataaataatatttcctcatctgtagcaatcaaaatcagcacttggcgtgctggtgcaactacatggctacatgaggacttccctaatctgtttccttcttacttcaggcgcttaggaaacatcttatactcagatggtctcttctatacagcttcggaaactgcgctaggggtattcgatccaactgcacgtacttggaacgtacttcctgtgcaacccatccctatggcgccccgctcaatcaggtggatgactgaatatgaaggacatatttttcttgtagatgcatcgtctctggagcccatggtgtataggcttaaccggttggagtccgtttgggagaagaaggaaacattggatggttcctcaatatttttgagcgatgggtcttgcgtgatgacctac

SEQ ID NO: 47490 - DNA, 282 bp, Triticum aestivum
  Clone ID: PAT_TA_47490
ggatgctaagttaaatgcagctggatggatttcagaacagctgggtggtgttagttatcttgaatatctacgagacctggagacgaagattgatcaagattgggacagaatatctgcttcacttgaggaaatgaggaagtctctattttctaaggaaggttgcttgataaacataacaagcgactcaaaaaatcttgaaaaatctggtcaacatattgccaaatttcttgatgcactgccaagtgccccatccctgggaagtgatccatggctctctcgtct

SEQ ID NO: 47491 - DNA, 417 bp, Triticum aestivum
  Clone ID: PAT_TA_47491
cccacgcgtccgccacacaccacgcctgcctcatctctcggagcaagaggaggagcttgcaggaacaatggcagcccagggtcttctctctgggaggcagctgctggggaggcctctgcagtcctacatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcattgagcccaggtggctggcctacggcgagatcttcaacggccggacggcgatgatggggggtggtgggcatgatcgccccggaggccctgggca

SEQ ID NO: 47492 - DNA, 400 bp, Triticum aestivum
  Clone ID: PAT_TA_47492
cagacgcgtgggatcattacaaatttttacctagcaatccaaatccagagtgacttgcatattacttgttcagcggcgtatcgacaccatattgaattgcagtccaagtgttttgcatgacaatcatgacatgaacatttgttttgtcataattttgcatcacacgtaataacaaattgaatagttcaagaatagcattgtaacaagtctgcaccatgacacatgcatcctctaagcattaccattatggtatttgttctcactctgagatatgattttaacaagagattgactctacgttcatacagatatcatgggtcaacattaatatcagatagtttatccagtcttactgctcttgataaaaagtttgatctaccggcaccttttgttgtgaaca

SEQ ID NO: 47493 - DNA, 423 bp, Triticum aestivum
  Clone ID: PAT_TA_47493
ggtaatagcagaataccttcagaaagtggatcccaagtcagatggtgccaagagagactgggttgctatttatgatgaatgtgcaaatgtattatatcaggtgcgcctgtcttatgctcacaacctacggtctgttactatctcatgcttgtcacagctcatgtttttgaaataacacctattatataacagactattggaagcaaatgtatccattttttatgcatctttcctcagtgagagtaaattgagataatttgatgcgtaggtagagttctctaggcatcacataacagcgttttggtgtcaatacttccataatagtgcaaggattgggcttgagaggcttacatcttgatgttgactttgctctgtattattagaccatttcatgatgctctttcttgctttgagatctttgta

SEQ ID NO: 47494 - DNA, 386 bp, Triticum aestivum
  Clone ID: PAT_TA_47494
gggttatgctcatgagcgatcggaacagacggttgtcgttcatttagaataccatgctccgtatgtggcattgatgggtggaagacaacattccggcgcgcagatatggctggggtcgtttgtgatgctgttgacatttgatgttgcttcacctcttacatcatcagtggcggattctgcgctatggtattctgcactagctggttatattacctatggacaaacttacgcttatactttccacgctatgagttcctaactaggggtgttacgcgaatagctagattctacaatcagtgactgtggtaaaatatacagagtggcttcatgatgttcgtgatgacgaggactgaagtacatgttaagatgcacttaacctcctatgc

SEQ ID NO: 47495 - DNA, 423 bp, Triticum aestivum
  unsure (1)..(423): unsure at all n locations
  Clone ID: PAT_TA_47495
ggaaccaatgcttctgttgtgcaaagtcttataagcttttacttaagagaagggcagttcaagcaggcccttaagctgtgcttatcactctcaaaccgtgagatttcttgggaagcactggttaaagattttgctcaaggtgatgatcacgttggaatacttaatcttttgtgtgttatccaacgttctggtggggttcttgattatccaacttcattacacatcttgaattcttgtggaaaattggaactccttcgtgaagggcttcaagcacatgcctaccttacaaagcgtggccttgcttctgaaccatgcatcagcaatcaccttattgacatgtactccaattgcggcagtctcaaaaatgcattggatgccttccgatatatgtcntgacagagtgcatctacttggacctcaata

SEQ ID NO: 47496 - DNA, 307 bp, Triticum aestivum
  Clone ID: PAT_TA_47496
gaggaggaggccgtgatccatgtctggaacgcgtgctgggagctctactgcctcgagcatggcattcagtctgatggccagatgcccggtgacaagaccgttgggggaggcgatgatgctttcaacaccttcttcacctagactggggctgggaagcatgtcccccgcgctggctatgtagatctcgagcccactgtgattgatgaggagaggacaggtgcttaccgccaggtattccaccctgagcaacttatcaatggcaaggaagaatcagccaacaactttccccggggggattttaccattg

SEQ ID NO: 47497 - DNA, 193 bp, Triticum aestivum
  Clone ID: PAT_TA_47497
cggacgcgtgggcggggttggcttctccttcccttccggttcgggttctggttcggctcgggttctgttcgagagagaggccgagtaactagcctagtctagggtttaccgagagaggaaaggtgatccatggcggatactgagtaccgctgcttagtgggtggccttgactgggccaccgacgacaacaacc

SEQ ID NO: 47498 - DNA, 360 bp, Triticum aestivum
  Clone ID: PAT_TA_47498
atgattcttgggcggaaatggttattagcttcttcttaaaacaacgcccgggtaagcacgccctcagtctgagcttatcactctcaaaccacaagagtctaggggttagcgctgattgaagatgatactcatggtgatgaccaagcaccaatacttaatctgcttgcgtggatgcaacgccttggtgggcgtcttggttctccaactccaatacacatgctcgaattcttgcggaaaatttgaactccctcccgacaggcgacgagcccgcgcctaccttacaaagcgtggacttgcttttgaaccatgcatcaaccaacaccctattgacattcgctacaattgccccagtccttaaaa

SEQ ID NO: 47499 - DNA, 296 bp, Triticum aestivum
  Clone ID: PAT_TA_47499
cttcccgaataagcaagccttggggggggaaaacaccaccaccacctggttcaccacaagaaggggggcgaggactttcaaccccccccttaccggcgggttgacattttccggtacttcacccaaaccggggggacccgcccccgcaaccaaggccaataccaaccggttacccaaggggggaaaccccccaagccccaagggcaccttcgcgaaaatggcccccgccgccgccgaacctttcgccttttacaaaaacaccaaggcaaaaaaggacccgggccccccccccaacc

SEQ ID NO: 47500 - DNA, 458 bp, Triticum aestivum
  Clone ID: PAT_TA_47500
gctcgctcggccctggccatttatgcgcggacacacgttcttctcagcaataaacaacgccagcggggccgatcgttgctcgttccgcatcccgatccgcggctcctcatcaagagtcgtcgtcgtcactccggctcctcgcggccggttctttgcttgcctccaagaaaccgtcggcttggcttctcattcccgtcccaaatccgtcctgttaataggcccagctcagcttcttgcattagcttcttctcggggcggactctagttctagtgtgttgatttggattggagttttggggcaggtgctgcaagcaatggcggaggtgcggagccgggtgccggggttcctgcggaaccggtggctggtgttcgtggcggcgatgtggatgcagtcggtcgccggggttgggtacctgttcggcagcctgtcgccggggatcaagtcctcgcttggctac

SEQ ID NO: 47501 - DNA, 321 bp, Triticum aestivum
  Clone ID: PAT_TA_47501
actgattgatcgagcgctcgactcgtctctccgtgccgtacgtgcgcccacgaaggtgggcaggcagcgatggccggcgagagcgacgaccggggcgccgcgcgcgcgcctcacgtcgcgctgctctcgtcgccgggcatgggccacgtggtgccggtggcggagctggcgcggcggctccacgccgagcacggcttcacggccaccgtcgtcacctacgccagctccgactccgcggcgcagcgcgcgttcctggcgtccctcccgccggccgtcggctccgcgttgctcccggccgtcccgctcgacgacctcgtcgcc

SEQ ID NO: 47502 - DNA, 475 bp, Triticum aestivum
  Clone ID: PAT_TA_47502
cccacgcgtccggaacacacagaacctccttcgatcagaatggctgcaaccaccatgtcactctcttccccagccttcgccggcaaggcagtgaagaacctgccatcgtcatctgttttcggggaggctcgcgttaccatgcgcaagacggcggcaaaggccaagcaggttgcctccggcagcccgtggtacggttctgaccgcgtgctctacctcggcccactttctggtgagcccccgagctacctgaccggtgagttccccggcgactacgggtgggacaccgctgggttgtcggctgaccccgagaccttcgctaagaaccgggaactcgaggtgatccactgccgttgggccatgcttggcgcgctcggttgcgtcttccccgagctactcgcccgcaatggcgttaagtttggtgaggctgtttggttcaaggctggatcccagatctttagcgagggcggcctcgact

SEQ ID NO: 47503 - DNA, 391 bp, Triticum aestivum
  Clone ID: PAT_TA_47503
ctgaaagggaacgagagttgaaagacctaaaagatcaattccgtgaagacttcccggttggccctttaatcggaaagtgttgcacaatggatcagggtaaagctgttatcaatttcctagactctattttggacaagtcccttaggagcacggttgccttgctcgctgctcgtggacgtgggaaatcagctgcccttggtcttgctattgctggagccatcgcagctgggtattcaaatatatttgtcaccgcaccaagtcctgagaacttaaatacactatttgattttgtctgcaaaggactaaatgcaatggagtacaaggagcatttgcattatgatgtaatgaagagttcagatccaaatctcaagaaagcaataatacaaataaa

SEQ ID NO: 47504 - DNA, 349 bp, Triticum aestivum
  Clone ID: PAT_TA_47504
gttccggttttgacggatgggtcccgcgtgcgtcacgcctaacgctgatgtataaacacaaggaaactgtcaggatctgagcctacatgacgaagagctgagtgagacacagtcatccgcagataacccaacacttctgattccgcaccatctgggcgtttgcaacacaggctgagcccaagcgaccttggttaattgccgatatgaagcgatcgctgtgatgctcccgctggcgaagagctccgacaacaccgtggacgtgcctatagagaacgaatctgctcctatacatcatacagacacgagggatcaagacactgatgcaacgcctgcgtattcatcaccaaac

SEQ ID NO: 47505 - DNA, 477 bp, Triticum aestivum
  Clone ID: PAT_TA_47505
gtccgctgcgagaccaacatatcagccggtgctgtgtccgtcagctcggctgcggttgaactggccatgatgaagcttccaaagtccgagtgcctgtcggccaggatgcttttgattggtgccggcaagatgggaaaattagtggtcaagcatttgattgccaaaggatgcaagaaggtcgtcgtggtgaaccgttccgtggaaagggtggatgccatccgcgaagagatgaaagatattgagattgtgtacaggcctcttgcggagatgtacgaagccgctgctgacgctgatgtcgtgtttacaagcacggcatctgagtccttattattcaccaaggagcatgcggaggcgctccctcctgtttctcttgctatgggtggcgctcggcttttcgtcgacatatccgtcccgaggaatgtcggtgcctgcctatctgaagtggagcatgcacgggtatacaacgtcgatgacttg

SEQ ID NO: 47506 - DNA, 485 bp, Triticum aestivum
  Clone ID: PAT_TA_47506
cccacgcgtccgcccacgcgtgcgcggacgcgtgggtgacctcggccgtgaactaccatggcaagagctccaaggccaacaggttcacagtcatggcagcggaaaacctggacgagaagaggaacacggacaagtggaagggtcttgcgtacgatatctccgacgaccagcaggacatcaccagagggaagggcatcgtggactcgctcttccaggcgcccacgggcgacggcacccacgaggccgacctcagcttctacgagtacgtcagccagggactcaagaagtacgacttcgacaacaccatgggaggcttctacatcgctgctgctttcatggacaagcttgttgtccatctcttcaagaacttcatgaccctgaccaacatcaagatcccactcatgttgggtatctggggaggcaagggtcaaggaaaatcatctcagtgcgagcttgtcttcctcaagatgggcatgaacccaatc

SEQ ID NO: 47507 - DNA, 469 bp, Triticum aestivum
  Clone ID: PAT_TA_47507
gttttgaccatagaagttgggcctgctcctctacatctccactggtccactgtttttctggttttatcataaaaaggaagatactgcttttttatagctcattggtatacatagcctcacaggaggctgattcttaaaatggctaattaacacgcaacagtgtagacgcgtatcttacactatctgatctttccccgtcccacagaccatataaatgcatgtgtcagaaggctgattagaaactgctctttagtaccggctgccctctatctgaaagatcaaacatttacttcctcctattataatgccgacgctaagcttttgtgattgcacaccgcttgcgatgttgagtcggtcaccacgttcagagacgagcacttagagaagtgtgcgctcgcttaggacccaatgggttttttgagagttggctgcacatcgttggtttctgatgcacccaacaggcatacat

SEQ ID NO: 47508 - DNA, 482 bp, Triticum aestivum
  Clone ID: PAT_TA_47508
cccacgcgtccggatcacaatagcttccgaagggtttgtttaccttgtaagtatcaacggagttacaggagcccgcccagatgtgaacccgcgggtgaaggatcttctcaaggagattaagcaggtcactaacaaagcagtggctgttgggtttggcatatcgacccctgaccatattagacaggttgcacaatggggtgcagatggagtgataatcggcagcgcgatggtaaagcatttgggtgaagctgattctccaagagaaggtttaaagaggttggaagtatacgccaggagcctgaaggatgcactcagtggcgggtccatcattggggcgagttagggcgactgccccggttctccaatgtcatggcagggtacatcccctgtctagtgaccagtgatgcagtgcaatctagccccgtcgttatccgctgccctggcaaacctcagtatctctgggtccatcactggatgcactt

SEQ ID NO: 47509 - DNA, 377 bp, Triticum aestivum
  Clone ID: PAT_TA_47509
cccacgcgtccgcccacgcgtccgcccacgcgtccgatggcatgaaagaatctgatcagacgaatccaacaattaggattactgattcagaggaaaatgcttttatggagctcttaagctatatgtacagtggaaagttgactacagctgagcccactcgtctgctcgacatcttgatggctgcagacaagttcgaggttctttcttgcatgaggcattgcagtcagctgctcataagcttgcctatgaccacagaatctgcactgctctacatagaccatccttgttctggttcaatggtcaatgaagttcggcctttgatagatgcatccaagggattccttggccaccaggaccaggatttttatgagtttaaa

SEQ ID NO: 47510 - DNA, 486 bp, Triticum aestivum
  Clone ID: PAT_TA_47510
cttcaagcccatgcattcaattccatccatcgatctgggtgtagagtctcgtccgacggattccgatcgatcggtcgagagttctgacgccgctacagtgccgggcggggggactcagggctgcttgctacaagaggcagtggcgactggggaatcgcccatggagggctcccgggggcggtggaggtggggtggcaggcgcagatccatgctaatggtggcgctggccctgtgcttcgtcgtggccgtcgtctccctctgctgctgcgcccggcccggggcttgcagtgccagtgcctgcagtgggaggagtactgtggcggtgctccgttcagacttttggagacgaacagcagaatcgttcggtaatcaggaccggtcaagcgccagcgggagcggagggcggcggcggctgctggtggtggccggaccgggtcgtacccggccgggtgcacgggcaagtgcggcagctgcagcccgtgctac

SEQ ID NO: 47511 - DNA, 481 bp, Triticum aestivum
  Clone ID: PAT_TA_47511
gcacggcacccacgcgtccgcttgtcccgactcccgacccaactcgccgccgtcggcaaggaaccctagctagcgtgttgatggcatcgacggaggagcaattcttccttggatcaaggaacctctcatatcacggcgcccactaccccgatgcttacactgaccaggccgatttggattacccggaagaccccggcgatcggcgggagggggtgaggttgccgagctccatcaccagccggcgcgcatgagcacctattcagatccatatgaagtcgccaggcgtgccttggacctcatgttcccgcgggaggaggacgcctggagcacctggagcgcacgagaggagggcactgatgacgacgttgatgatgaacaaggaggggaaaaagtcgatgactgtagcacacaggagggcagcgattatgaagaagacgacgacgacgacggcaattgccaagtgatactacccgagacaaac

SEQ ID NO: 47512 - DNA, 341 bp, Triticum aestivum
  Clone ID: PAT_TA_47512
cggacgcgtgggtagtccaaatatcaggtatatagaggaaaatacattttgcctacattcacttcagccaatgagctctatcatctgaacatgtggccagacagaggaccattcctgatgacttggtactcttttgagcctggtatgcgctgaggtaatttctcatgaccctgtaatgcagaagggtttcgtgtgcgcccattccatcgatagcgtcaccttgaactgggggcaaagtgtatatagtaacacgagccacggcatcagccgtgttactagagaaaaccatttgaagtatgattgcttttgtaatatcctgtttttcttatgatttgatccac

SEQ ID NO: 47513 - DNA, 466 bp, Triticum aestivum
  Clone ID: PAT_TA_47513
cccacacgtgcgcggggactccacacgtgcatgcgcagctgccgataggcgaccactgcagagaccacacgtgagcgggcatggacgagggctacaccagcctcctcaccagccacctcctcggttccgttcccgctgtggctgagggtaacgatgagaggaagcccggagctcccgacgaagttggaaatgccggtgtgacctagcgcctgcatgattttgctgctgatcctgctgggaacggaggagggtaccaccctccagggagccctgtaggtggagatgcaaaaacacagacatactggaaaggatactttaatgctgcctattatactgcatatactaatgttgatactgacgtacttgttgacagacttatcacatcagatgatccaatggagggaatattcaggaagattgacgtgtatcctgacatgtatggcaccttatggatcaccactacact

SEQ ID NO: 47514 - DNA, 498 bp, Triticum aestivum
  unsure (1)..(498): unsure at all n locations
  Clone ID: PAT_TA_47514
ctttaagagaagatctaataagaaagaagaggaaaaaaaaggatggttttctcagtttccatttttgcctctgtcgctccgtacttagtctctgcgttactactcttctttctcatcgagcagctctcttacctcgtcaagaaacgtaacctccctggtcctctctttgtccctccgatcatcggaaacgccatttcactcgtccgtgatcctacttccttctggttcaagcaatccgacacggcaggcacttcccctggcctcgctgctaactacctcatcggcaaattcatcatctacatcagagacacagagctttctcatcaaatattctccaacgttcgtcttgaagcttttcaccctctaggacatccttttggcaaacaactattcggtgatcatagcctaatctacttgtttggtgaggatcacanaactgttcgccgtcaccttgctcctaacttcacccccaagcactctccacttactctgatctcc

SEQ ID NO: 47515 - DNA, 416 bp, Triticum aestivum
  unsure (1)..(416): unsure at all n locations
  Clone ID: PAT_TA_47515
gggggcgagggggccgccgcagcaacagaagtgcggctgatggcaaccgctggcctgcggctactcgaggagggcgtccgggaggcgatactggtgtcctgcagggacgccctcagggcctccgggttccggttcgaggactcctgggccaaggtgatcccaggttctgatgaaggcatctatgcttgggttgcggcaaactatgctctgggcacacttggaggggatcctcacaaaacaattggaataattgaactcgggggtgcttcagctcagttgacgtttgtttccgacgaagtacttcctctggaactatcaactaattntacttttggggaaacaacatacactctctatagcaacagctntctaaactttggacaaaatgcagcacaagactcttaccgtgaaatact

SEQ ID NO: 47516 - DNA, 370 bp, Triticum aestivum
  Clone ID: PAT_TA_47516
cccacgcgtccgggagcttctccatgccgccgtgcaggccatgtgctgctgccgccgcataggggggcggctgcaccgtgcactgtcggaggaaggagcgctgcgttttcagttggtccaggccgcgacaccacccgccgggagatagtggtcgagggcatcgcctcgccgttgtcagggtctgcgacttcgccgaggttgccgcctgcgcgtgcaggttgcggttctcgggcgctctacgccggaggacgtccgcatgctgcgcatcggaaatcgaggccgagcagagcgtcgagggggcgccaacgcaccgcgtgctcaggagcgccgagcggttgacggcgagcgtcaccgcgccacacgtcggggc

SEQ ID NO: 47517 - DNA, 480 bp, Triticum aestivum
  Clone ID: PAT_TA_47517
gagcttcgtccaagggcatcgcatcctatagccgtccacccggtccgcccctcccgtccaccccaccaaaccctaaccccagcggtcgccatgggcagcggagagggtcccgtctcgccgcggtccacctccaggcgccaccgccggtcgtacggcgacggcggggacgaggcctcctccccgaagcgccagaagcgtagccatcaccaccgccaccacggccacggtcacggggacaggggagaccagcaggcgggctcgcggtcgcggatgtcggcagcgaagccgggggagcgcgaggtagaggatggtgagatagtagacgatgccgccgccgccgcctccagggggccggatgccggcttcggcaaggcggtgtcggtgttcggcggtctggcacctgctccgggatgtgatgacaaatttgatgcaaacaagaagtgtagagaggctaaccacagaaagagatctgaggaaatc

SEQ ID NO: 47518 - DNA, 387 bp, Triticum aestivum
  Clone ID: PAT_TA_47518
cggtcgcccaccgtccggcagcagtataggccgcctgcgctctgctcacccatcccacagcgccgttgcacaagggcgctacaacaaggttgactagacgactctcaggctgtgccgtactagtgctccgtcagcgccgacgacagggacgctgacttctacaatgagctatgctcgcagatcgtggtcagggcttgcgtacagaacgacgtgagggcgatggacgtggccacattcaaggtggccatgaacagattcatgcgcatcatgcgcaacttcatcgggtgctagaacaggcgtgagaactaaggagtgtacgcaattgcactgaacgacagcgcaggcgtaacgaacacgtctcacctgttcaagtctacctcgatgctg

SEQ ID NO: 47519 - DNA, 166 bp, Triticum aestivum
  Clone ID: PAT_TA_47519
gcccatcgtgcgtacaaacatcatgatccggcctatttcatattagcgaaggccgtccgtcaccttggtcgactactgaatgaatcatccgcaccagagacgcctcactcaaatagcatgcgccgatagctggagaaactgatgaatgacgggcttaccgtcttct

SEQ ID NO: 47520 - DNA, 264 bp, Triticum aestivum
  unsure (1)..(264): unsure at all n locations
  Clone ID: PAT_TA_47520
cggccataaggcatagcagcagcaggtacctgcttattctatatcatccaaagccgtaagatacctaattagcctactcaatggatcatcctcgccctacgatgcgacagtgacccggcgctgaacatggtattgcaggagggatgccacgatcaacctacacttattaaaggtgctgttcatgaagctacgagatggattcgggccgacccaaggacacnaataatgagctgacgatggaggacgccgggatgctccaaggtt

SEQ ID NO: 47521 - DNA, 365 bp, Triticum aestivum
  Clone ID: PAT_TA_47521
cggcaaaggcgcgccctccggcggccggcgaccagcgaccggcgacttacttcaaaggagcacggacagcagtatggcgaccagacggaacattccttattctgttcttcctacggaggacagggatgaagacaatgttgaccgccggttcacatacactccaaaatccttgaggaggatcccgtggaagtcgattgccttagcattgttcctcctcttcctgggaagctctgttctcttcctttcatattttatatccaccggtcacatggagggcgatagctctcatgtgtatggtctattgatcctgggtatccttgcctttcttcctggaatttatgagacccgagttgcatactattcat

SEQ ID NO: 47522 - DNA, 407 bp, Triticum aestivum
  unsure (1)..(407): unsure at all n locations
  Clone ID: PAT_TA_47522
ccagtctgcatggcggagaaactgcaatggctgcgcttgtgttgcctcatggtctttgcctccttcttttccctgtctgggagtacgtcagctgctcaccaccaccagcgagacgtcctccacccggtggtgctgctgccaggcttgttctgcggccagatcgaggcccgcctcaccgacgcctacaactcgccgtcgccactctgcggagtactcaagggggacggccgggggttccggctatggaagaacatcacgggcctgcaagacctccccgacgtgccgtgcttcgacgaccagctccgcctggtttatgaccccacggccggcgactaccgcaatgagcccggcgtcgagacccgcgtcctatcgttcggctccacccncggctttctgttcgaccaacc

SEQ ID NO: 47523 - DNA, 465 bp, Triticum aestivum
  unsure (1)..(465): unsure at all n locations
  Clone ID: PAT_TA_47523
caagcccagagcagggtagacgcccggcctgaccagctcggggcagcaccctcggcctctggtgatagtcactagcgaggaaacagcagccggcgcgaggaagcgagagccggccggcgttctactactatgaggaacggcagcaccgtgtgcgacgcggcggcggctgtgggactgggcgtggcgccgcggtacaggggcgtgcggaagcggccgtggggccggttcgcggcggagatccgggacccggccaagcgggcgcgggtctggctcggcacctacgactccgccgaggccgccgcccgcgcctacgacgtcgccgcgcgcaccctncgcggcccgctcgccaccaccaactttccccacgacctcgttttcttccccacgctccccgcgctggcgcgtacgttttcaccggcttcccccggccccgcctggagcgccagcttcaccggcgagtcctac

SEQ ID NO: 47524 - DNA, 350 bp, Triticum aestivum
  unsure (1)..(350): unsure at all n locations
  Clone ID: PAT_TA_47524
catatgcataggtgtaaattaaccnagccggtgcggttcatcggagactccgtgaagaaccagggcgacatgaacccgatcaacaccgtcttcgatgcgaagcggctcatcggtcggagtttgtcggactcggtggtccagagcgacgcctagctgtggccgttcaaggtgatccccggtcccgctgacaagccgatgatgggngtacagtacagaggcgaggacaagcagttataggccgaggagatctcctccatggtgctcaacaagatgaaggagacggccgaggcctaccttggtacaaccatcaagaacgcagtcttgaacgttccttcctacttcaacgtctc

SEQ ID NO: 47525 - DNA, 479 bp, Triticum aestivum
  Clone ID: PAT_TA_47525
cctgactctgcgctccgcgtccgccgcgccaggggcagcagaggatccgcgaggagccgcaaccggctgtgaatctgggacgaaggagccgctggaagcagcagcctcgcgcagcggcgaatccagatctgacacctcctgtgtcagctgcgggaagagggagaggaccagcgcctcccgcccgtatctagggagcgcgaatccgggagggaagaccggcgttggaggggagggcggagcaggcggagggctagcggcggcggcttgggtggctgcaggcgccggggcggcgcgtcgcaggagcgcggggaagaaagccattttttccacccctccatccgtttgctttgcctgccattgttactctcacaagctacttctctttgaaatgaatccatgatagatgctctcgttgccctcagaaagaatattgcattgccaataatagttcctacccctagcctacatgaactactaca

SEQ ID NO: 47526 - DNA, 366 bp, Triticum aestivum
  Clone ID: PAT_TA_47526
aacaaaatccttatcccaagcttagcatccccggtctcctcggtttctcctcctgcccgaaccctcgctccatcactctctccctctcccactccggcgcgcgctcagctgaatctcgacgtaggagcaatggcgtcggcgcatctgtgcggcccgaaggtggcgtcggcggcgatggcgaagccgacgctggcggacgggctccgcatccgcacttcgatgtcggcgcgttccgtgccgacggcgcgcaggctgcggggcctggtcgggagggccgccacgggcgtgtcgcccaagtatacttctgcgaaaccatcgggagatcgggtgctagagaagacccagactactggggataaaactggt

SEQ ID NO: 47527 - DNA, 157 bp, Triticum aestivum
  unsure (1)..(157): unsure at all n locations
  Clone ID: PAT_TA_47527
aatttgtgttgaatctggtccatgtgcctaacgtctgacataaatggatgatctcatttgtgactttgcggtnctcatctcaggatccagtcatggtctgcaatgaccgtagcatgtgcaccagcactatcaggtgagaacatcggtctacgaaaga

SEQ ID NO: 47528 - DNA, 431 bp, Triticum aestivum
  Clone ID: PAT_TA_47528
cctacaagatgagctcggcatcgccattcccacccccctcgccgtcgagcgcgagcgtcccgatggtggtgatcaccgtggtggggatactcgcggcgttcgcgctgctggcgggctactacgccttcgtcacccggtgccagccgctccgcgcgctgctctcgcgcggcggccccacgacgtcggtgagccccggcccctccccgccggcggcggccgacgagaagcggggcctcgggctgccgctcatccgcatgctccccgtcgtccggttcacggcggcggaggacgcggcggcgccgaggatctccgtgtcggagtgcgccgtgtgcctgagcgagttcgcggagcgggagcgcgtgcggctgctgcccggctgctcccacgccttccacatcgactgcatcgacacctggctgcagggcagcgcc

SEQ ID NO: 47529 - DNA, 465 bp, Triticum aestivum
  Clone ID: PAT_TA_47529
cccacgcgtccgggaggagaggagagaagagaaagctcttgtgctcgcgcgatgacgacgatgacgacctccgccgcggcgacgatgatcccccttcgcggcctcctcgtcctcgccgctatcctcgcggcgtgcctcggccccacagcggcggaccagcccggatccgtcgagggatacaccatcgctggccgcatcaagatcgacgatcagtgccctctcccccgtggttcaaactagacgcatctggtaacttctgcatgcgtgggtaggcgggcgggatccagtttcgtgctctactcgaacctgaccaatttggtggaattatctctagggcgcgtgaaccaagtagggccaagtgtgtcgatgctactgatctccctactggtccactatgcattggcgttggttaagcagcatgcttacaagcattagtgtccatattatcccgcttcatctttgaaa

SEQ ID NO: 47530 - DNA, 233 bp, Triticum aestivum
  unsure (1)..(233): unsure at all n locations
  Clone ID: PAT_TA_47530
gacgccacgcgtccgacgccattgatggaatcgagcgaacctaanccaagaagaatttcctcgttgctagcgccgatgagtagacgtcnactgcgatgggcaagatgaacatgccggccctgttccgccgccgctcctccttcaagttgcgctccgcgacgccgccgacgactccttcccgggaggagcagcatgatgagagcgcggcaggccatcatggtccccggcgcggt

SEQ ID NO: 47531 - DNA, 284 bp, Triticum aestivum
  Clone ID: PAT_TA_47531
tcaaaccgctagcatacgacaacactcgagacgaaaggatggtacgatggctaaagaagaggatggagctgctgccaccagagccatggcggacagaggaggcagatgacgacgaccaggcgtacaccatgagccgcaaggggaaggacaccggcaccagcgtcctaggggcgacccccactatgaacatgcgacgcataaagcgcacggacctctacctcggcgtcgacgacttcgaggaggaccagatcgacccacagctgcgctactcattccagcgcatc

SEQ ID NO: 47532 - DNA, 474 bp, Triticum aestivum
  Clone ID: PAT_TA_47532
ctcgttggccatggcggacgagccggcgctgccggtggcggcggggagggacaaggacgagcgccgccgcttgatgggcaggtgcgcgctcgccgtcgtcggcatcatgagcaccctcctcgtctacggcgtcctccaggaaaaacttatgagagttccctatggagcagagaaggagttcttcagatactcactatttcttgttttctgtaaccgtatcaccacatccatggtgtctgcactcgtgctactgtcgagtaagaagtccacggacccagtggctccaattcagaaatactgcgttgtctccttctcaaacattctaaccacaacttgccagtacgaggccctcaagtatgtgagtttccctgtccagacacttgccaaatgtgcaaagatgattcctgttatgatttggggaacgataattatgaaaaagaagtacgggggaaaagattacttctttgcagtcat

SEQ ID NO: 47533 - DNA, 392 bp, Triticum aestivum
  unsure (1)..(392): unsure at all n locations
  Clone ID: PAT_TA_47533
ctgccgcccgcgggcccggattcccggttcgcccctcgccccaggcgttcggtcgtgttgctacnctcagaagtagcccgcgagctactacccattcagcatggtagcggtcctgtacttctactcatcaatcatggtcgcgccagtcgtgcactgcctctactgcattttttccagacggggatgcgcggtgtgcaggggcggaggggctcttccctggcggcaccggttgcctacaggcaaagggcgacggccgaccatacggcgacagcggagaccttggttctatctgtgggggaagcattttgtgacgcacaaaagcatatgcgagactggcagatgatgagagcaaatacgtgaaggatgctgctatacatgggataaggccagtg

SEQ ID NO: 47534 - DNA, 238 bp, Triticum aestivum
  Clone ID: PAT_TA_47534
ggcgaccactacatcccgccggacaacaacttggtcgtagcccgagccgaggcggagctggtcatcttctcggccatcgacgacctgttggccaagacaggtgtcacccctgatgccgtcggcgtcgttgtcgtcaactgcagcgtcttcgcccccgtgccgtccctcagcgacatgatcgtcaacagatacaaactccgcagcgatgtccgtggtgtaaatctgtctgggatgggct

SEQ ID NO: 47535 - DNA, 315 bp, Triticum aestivum
  Clone ID: PAT_TA_47535
cccacgcgtccgcccacgcgtccggggcttgtacgcaccaccgaaccatgccgggcagcatccgagtttcagacattcagccacccgtcgccgctccactcttcttgcaagttaacctggggaaaaaagagtacagcggatatattggacaagatggcttctcttttccagttacatcacttcgagatagcatggtgttgtcgctgtacgatgcagataaggaattggtatccaaaacagaagtgaagacacggtcgattgtcgagctggggagtacggatgttgtgtttactcttgatagtggaggggaaatta

SEQ ID NO: 47536 - DNA, 313 bp, Triticum aestivum
  Clone ID: PAT_TA_47536
cccacgcgtacgatcgagcagaggagaaagggaaagaagagtcggacccgactccggatctccgccgccggtgctgccggttggggaagagatggggaaggtgctcggagctctactataagtagtaggtctagcttagttgattccttagaggagtctgacgagatgccggagcttggctatatgccgatggaggccgcgtcgctggcgcgcccgagccgcgtgcggtggctgctggagttgaccttgatggtggtggtgagttggttgttgctgctgctagctggcgtcaatccagcatctccggtgataa

SEQ ID NO: 47537 - DNA, 447 bp, Triticum aestivum
  Clone ID: PAT_TA_47537
ccttgataatgcaaattctgacctaatcttgtatgtcaacttggaattggttaataagaagtcagaccggaggtacattgtcgaagaaatgcttggccaaggtacctttgggcaggttgctaaatgctgggatgcagaaaccaacagttatgttgcagtgaaggttataaaaaaccagcctgccttttatcagcaggctatcatggaagtctcattgttgagcatgctaaatgacaaatttgatcctgatgatcagcaccacatcgtccggatgctggatttttttccatggaaaaatcatttgtgcatcacatttgaaatgcttggtcataacctgtacgagctgttgaaaaagaacaacttaagaggtctgcaactgcaattttgccgtactttcttaagacagatattggatgcattgattgtcatgaaaggtgctggaattat

SEQ ID NO: 47538 - DNA, 454 bp, Triticum aestivum
  Clone ID: PAT_TA_47538
atcagcaaccagctggtctgccacagaacctttacacccaccaattccacaatcaagtagcgaccagttgctgtttcaaatgtcaggtcaacagagggaaacaaactatttgcaaggtaacatgtcctgttactcttgctcattatatgttacagatgggcatataagtttcagaacagatctgaagatgatattgcagatagaggtcccatggcgccaccaccgaagaattttggtccatttccatccacctatgagcaggaggtaccttataattattcttctgctcaaggtatgcccttgctttgcaatttaaattgcttgtgtggcctgcgtcagaattaggtgtaccctgctggatatgtattcaattcaattgcagaaagactgaaaaggctaaagcatcacttattttagaacagagagggtatatcacttcatctatcttctgata

SEQ ID NO: 47539 - DNA, 413 bp, Triticum aestivum
  Clone ID: PAT_TA_47539
cccacgcgtccgacaagatcgacgagcggacgcgcgccgtgctggtggacaaggtgggcggccccggggaggggtacgacgagctcgtcgccgcgctgcccggcgacgactgccgctacgccgtcttcgacttcgacttcgtctccgtcgacaactgccagaagagcaagatcttcttcatcgcatggtaattcttcgcctggatccctcccttaattccactcactcccttcttctcgtttgttcaccgccgaatcgagtaaaatcatggcggctgatctcggttattagccatactgattacgaattataattattgatgcggatactgcgatgctggatggtttcttggttctggcggctaaacattccttgctggctgcacactgtatgtgtattggaaacagctttga

SEQ ID NO: 47540 - DNA, 393 bp, Triticum aestivum
  unsure (1)..(393): unsure at all n locations
  Clone ID: PAT_TA_47540
cttatacggacaaaccttaaacctagatttctcctgtgtgacttacgttactacacacagagccttagccagttcttgtattggcagctggacttaaacaccatacattaacttactccaccctgctggatgactaggcaacactctattacgtcctaaacattgcgagcatagatacagtagtgttagacgcccaaanaactaagtgcgtggcgtctccgtcgactcatgtactgggtcatggacaacgatttggactgatcgctgtacgattcnnngacgtttgagactaccatgcttttacacagagcttgttgatgcggtacaccagcagaagtgctgttatgtggcttctccattanacatacnnncgcaggggttcgatactagcat

SEQ ID NO: 47541 - DNA, 483 bp, Triticum aestivum
  Clone ID: PAT_TA_47541
cccacgcgtccgggaaaggaaaagaaaaggaataagctgcagtaaaattttggtgaagaacttttttgccttaccttgtgaacatgttggtcctcagattttgattattgatgatttgtagttcatacatgtttttatattcgatcacttcatttgttcacatactacttgatgttgcatactctacagtcaaatcaccactttgagaagaagaggccggtgcagacgctcatggaccagctcggcctgcaggacctggccaataccgtgtcaagtgttggtgcgtgtccgcatggacaccatcgacacacataggaacggttcggttcagcagcagcaagcacatccagcaggtgcgacctccatgctcgggtgacaacaacgaccagcattgtagaacgacaatccgcttctactcaccttgcctctgcccccttgctacagttccatgctttgataatgcattaatacagccatgcaggg

SEQ ID NO: 47542 - DNA, 199 bp, Triticum aestivum
  Clone ID: PAT_TA_47542
cccacgcgttcgccaggcgtccgaagagtgggtcgacgggcaaacatggccgccttttcctggttcctcgccgtggtccgggggttcctcctaatgggggggtccgcgcaagcgccggaggaacaagcaagcccttcaaggggggcaaccaacaagccccttcttttcccggaagaggttcttccctggattaacgggc

SEQ ID NO: 47543 - DNA, 341 bp, Triticum aestivum
  Clone ID: PAT_TA_47543
cactgccttaactatagccgagaacgctaagcatgtcgcggactctgcactgaaaccacgtgttacacaatgggcacctgaataatccctggctgaaagagtgattggtgcagtgagggtggctctgatgacataccggatggcctacgaagaagagtatgatgaaacacccattgggtctgtcatggatgatgtgatctcagcgatgcgctatacggatcacgctaacgataagacatactctttgatgtccatgccagagggaaaaccagcttgtgctataagttacgctattctgtgcactattcgggatgctcatactggagaagaatgtgcccaag

SEQ ID NO: 47544 - DNA, 365 bp, Triticum aestivum
  Clone ID: PAT_TA_47544
aactggtgagcattttgatcatgcaacctattcatttcttccatttcttccttaagtcttgatatcatgttctggccatcctctttttcttttattaaccggccaacattttgctcatgcaggctattcatttcttccatcttttccttaaggcttgatatcatgttctcatcgctctctttttcttctattaactgaacaacatttttctcatgcagcctattccttttttccatcacttccatttcttccttaagactcgctatcatgttctcagcattctccttttcttttattaaccggacaacattttgctcactgaggtcttgtctctacttaatttgagacttctatttcttcactac

SEQ ID NO: 47545 - DNA, 312 bp, Triticum aestivum
  unsure (1)..(312): unsure at all n locations
  Clone ID: PAT_TA_47545
ctcttgcttgctcttcatctttttagtagcacacgctcacggagaggggagacagaagggacgagaaatggcggcggatagtgtcttgctgaagagcagcctcttcctatcttcccctctttccgacttgcgcggctcatccgtctccatctcaacccagaatctgagaagggcgtggcagcccagggcggccagactgcaggtggatgccgctgcagactgcaagagcaccctgatggtgggcggcaccagcttgatcccntcgtcctctctccaggaagctggcgcagcaggggcaccagggcacattgt

SEQ ID NO: 47546 - DNA, 249 bp, Triticum aestivum
  Clone ID: PAT_TA_47546
attcagatggccaatggtgagaagaagacgataaggaaaaacgtaactgaaagaatgtactctgcactgaagaacgaaattaaacaaagagaagccatgtgggatggtgtttactgggaaatggttgagccggttgtcaaaatccgaactttacaagctcgactgattggaattgaccggacggaccttatgaaagcatttatacaactgacactcgagtttttgacgaaacagaaatttgaagcatac

SEQ ID NO: 47547 - DNA, 318 bp, Triticum aestivum
  Clone ID: PAT_TA_47547
gctcgacggcgaccgtcgccatggtgagcggaggagagtaaaaaagctgcaagccgtgatgcgtcgacgccgccgttggccggagcggaagcaccgaccggccgtgcgtgctgccatggcagcggcaacccgtgctgcaaacgggccgtggaagctgcaaccggccggcgaaaaagccacgagcgacgcgcagatgcttcaacagggtgtgatgtgataatgttggaaccggcgtcaagatttgctggaactagcgtcgagatttgctggaaccggcttcttgatttgctggaatcgatgtcgcgagcgcatcatttt

SEQ ID NO: 47548 - DNA, 317 bp, Triticum aestivum
  unsure (1)..(317): unsure at all n locations
  Clone ID: PAT_TA_47548
agcgggatgacgctctgccctcgtcctgtagtttgactttcaccgcgctcgaccaaatccgccgagctcatcaattccgggagatttgcgtccattcagatggcgtcctctgctggtaatggcaaggagatggccgcgctcgagtccggccacgcgtcctcctcctcctcctcctcctcctcgccggccgctgctgcgaagatgacggcggtggcggngaaaccgcgccccttcacctggacagggcctgccattgttatgggcttcgagttgctggagagcatcgccttctccggcgttgcactgaacctggtcat

SEQ ID NO: 47549 - DNA, 405 bp, Triticum aestivum
  Clone ID: PAT_TA_47549
cgccctttactagtagcaccacatctgttccgtcctccgccgaacacgcctcgggcaccgaagcacgccacctggaaggagctcttcctcctcctcctcctccgctctactgtgctgccgtggcgtggagatccaaccggagctagaccgactccttttactgaaccagtgtgctagccaccgaagcggccatggaagtggtttcttccagccattcttgcttggcatttcatcaaacacctaccagtgctcggaggtttctgggtaccggtgttggtccgcggcataccaagcttactcggccaaggaaaagcgcaatgctctgtgttgggagagcttcaaatccaggtgattcaagaaagcttcatgtcagccgcagctttgatgtaagcgatgtcgatgctg

SEQ ID NO: 47550 - DNA, 343 bp, Triticum aestivum
  Clone ID: PAT_TA_47550
tccacgcgtccgcagactctccactcaccatccttgctgcctgccaccagcactctcctacttgttgttttgtgaagcgactggactggtgtcatttggtgcgcgtcgcattggaggagtaggaacaggagtgctagacagcagtgccaggcaggcaaaagccacctgtgtgtacaagattggtcgccgatttctccttccctagtgcgtctagggtccagaaagctctggcgtgtgttcattagggtttgtgcctgcgcaccttggttacggcggactctccttatttgcggtggaatattaaaaaatgcttccggtgtcaatgaacagcttgaaatccctc

SEQ ID NO: 47551 - DNA, 393 bp, Triticum aestivum
  Clone ID: PAT_TA_47551
gccacgcatccggcctttgatcacaatggacaccgcagcgaatactggcacgaatctctcagaaactatcactatgccatcagtgctgctgaccaaggacctgagcgaggaccttaagaaatgtgccgtggatggtgacatggtgagtggcctgctggattggagggaatccgttccgcatgctgaggagcgtgtagagtctgactgctgggcagactgcagtgatgaatgcggtacgcaatgtgatatgcagatgggctttgtgaggagctgccaaggaaccgcacatgttgttgacccacagggcaacacacagtatactacttagtatatcacatgggcttgcacggaaggcaagaccgggagcaagcaatgcatataccattgcataaa

SEQ ID NO: 47552 - DNA, 395 bp, Triticum aestivum
  unsure (1)..(395): unsure at all n locations
  Clone ID: PAT_TA_47552
catcacaccagattggtaagactgtcaaaagaaggcatgtagtgcaagatggagcacggccagtcgactaaccgcagtgactagtactgcaacccgttggacgtacatggcgtcggcaccggcatgggggcgcacggcggcctgggcaccgacgcggctgctggtgggcatttccagcccacgagggaggagcacaaggccggagggatacatgacggctccttcagctgtagtaggtatacacaggatgatgatgacggcatgcacgtcaggaggacganagccatcttggataagatcaaggagaagctatcggctgggctctgtgaccagcagcaaaccgatgccacctactggcaggatggtcacacaagaatgaccggcactggggcgca

SEQ ID NO: 47553 - DNA, 107 bp, Triticum aestivum
  Clone ID: PAT_TA_47553
tgtctatggaatgctaatggcaaggcctacatatgaaggaatggtgatggctagtacagacagacgactcatttgctcttacactgagcgtggtgtctatagcgaag

SEQ ID NO: 47554 - DNA, 414 bp, Triticum aestivum
  unsure (1)..(414): unsure at all n locations
  Clone ID: PAT_TA_47554
cggacgcgtgggtccggacgcatgggcggacgcgtgggcgacccacgcgtncgcggacgcgtgggatgccttccttcacagactgtcggtccgcaaccccagtctgttcccctctgtctctaaacctctctctccctctgcatctgtctaaacgcggagctgagcggttttggctcaaccagccgggccccacctggcggtccttctccttggacgcgcacaacctagcttggccatctcctcgtgcccctgcatatatagcaaggaagctctctgctcttcccatcagcaggggcgccagatactgcttgcccggcttcgtctccactcgatccaagccatctctgctatctccaagctccacttggtgcccttggaggatggagggggcaaagacgcaggttctcaccatcc

SEQ ID NO: 47555 - DNA, 455 bp, Triticum aestivum
  Clone ID: PAT_TA_47555
cccacgcgtccgaacggaaccaacaaatccacacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccagaaagagtccacccttcacctggtgcttcggcttcggggtggtatgcagatttttgggaagacccttaccggccagaccatcactcttgagggtgagagctctgacaccattgaccatgttaaagctaagatccaagaccaggaaggcattcccccggaacagcaacgcctgatct

SEQ ID NO: 47556 - DNA, 450 bp, Triticum aestivum
  Clone ID: PAT_TA_47556
ggctccacccccacatcctcctcgtcgtcaccatgccatggtatggtgagtcaagatcactgatggcggaaatacagcagctggtcgcaaccgaggagatggagctaggtcgccttaagttgatggtcgtgtacagaaattctgagaagttgctgtcggatgctattggcgcaactgaaggaacaaagttcatatactaccaacaatccatacagttcaaatatcaaggaaagcttcgtgcacgtgatatattgtattcagtacgacatatcatgtcacttaagcatgaggaggccccttttggggctttgcatacaaaagatgatgtagaggagtttattcaatcaactgacagagctgtacttctgtctgagttctgtgggtggtttactcgattggctaggggcagaagcaacagaagcagtggggtcactccatcaaaaactcacg

SEQ ID NO: 47557 - DNA, 343 bp, Triticum aestivum
  Clone ID: PAT_TA_47557
cccatgcgtccggtggctagtgactcttcttgaaactaaactggctatgggtagtaccggtagcccctcctcggtagccgctctaccaacaagcgggcggccactcccgatacgcacgccaagatcagcgacggggtctgatgattccgcggcggaggaacccgggagcccgactggaatacctatggaccctatttacatcgggggtaccatccggcttgggtggcccgtaaaccttcccgtacttaagggccggcttggcaaccaacttggccggtacccgcgccttccgaagatttcagttgcccgacggtggcagaacccaaggggggaagcccccggg

SEQ ID NO: 47558 - DNA, 183 bp, Triticum aestivum
  Clone ID: PAT_TA_47558
cccacgcgtccgatgagcagctgtcctactgtcacatacacacacacacaagtgctagctagctaatctatcagccagccatgttggaggagaagcaccaccaactgttccaccacaaggagggcgaggacattgagtccgacgatgacggcggcgtcgacacgtacaggtactctaccgaaa

SEQ ID NO: 47559 - DNA, 276 bp, Triticum aestivum
  Clone ID: PAT_TA_47559
taccggaccggccggcccggcccgacccacgcgttcgtctgcggggggactgaaattataacgattttactctcatgcattacaatgcccatctatagtagattcctcaaaatgagaggcatcccaagcctgggtgtcaaagacagaagatactttggcttgtgaacatatgccggggagagggatatggagaacttgctgaggatcattgccatgacaacctgcacttgcacgatgccaaagttctgaccagtacacactctcgggcctagagag

SEQ ID NO: 47560 - DNA, 430 bp, Triticum aestivum
  unsure (1)..(430): unsure at all n locations
  Clone ID: PAT_TA_47560
taccgtcacgggcattacagcgaacccactcgcggactagctccacacacatgccctgcaatggctacgggcatctcaacctccgcgctcgtatcctcctgattcgcaacctattgggggagatctcgatcggcgaggaccacaccatgacaggccgcctaaacgaccctcactccacagagaacaccaatcgacatgtataatcgctagatatctttccgcacttgtaccccgagagcagcgcttcatgttctagggcgacaaagtctgatgaagctacttannnaccagagaatggaagtacctggctgcggactatgtaactacctaaaggaacaggcctgttgcaaatacactggtcacgattcttggcaggctaacgtctcctatgaaagcgcatatgatatgataaaatgagcctacatacatt

SEQ ID NO: 47561 - DNA, 443 bp, Triticum aestivum
  Clone ID: PAT_TA_47561
cccacgcgtccgcccacgcgtccgataccgtttcagggtgaggctagggaaggcgcctgaagagagggagatgaaccctgacaggaaacagctcttgagtcgtctgtccgtgcttatgctgaaaatcgtgaagggcatgtcatcaatccaaagattggcacagaatttgactcactggacgaggcttatgaattctacaacctttattcatggaagactggttttggtatacggttggcaaagagcaggctaaatgtgcaaagattgtgtgtgcctgtgcggtatgtgtgcgggaaaaataattttttccatgcctctggtataatagtcgtgtatcaagctagtttcattaatatctgaactgtagttagcatgcatctttgagaaaaattatttgagcccgagggagtgtagtaggatgtaaacaagtcttgatgaaaatt

SEQ ID NO: 47562 - DNA, 405 bp, Triticum aestivum
  Clone ID: PAT_TA_47562
atggaatcgaatgatgaaccaacgacggattaattacttgagctccacataaagcacgccctaggcacccctaataccaagggaaaccttctctttcttccattggtctccgtattcctcctgggccacacccgacacacacacatagcgagcgcgccggacattattgcgccacttgcacacgcgtggacactggccgcgtgcaactgcagtgcatgcacggtttcctctccgcgaccatcatcaccagcgccgtccccgtgccctgtcctcacctgagcgccattgtatcatccacaagactagcaatcaagagcaagaggtaaggaatcccatggagcagtacgaggtggtggagcatatcggtcggggcgcctactggaccggctacctagttcaccacaa

SEQ ID NO: 47563 - DNA, 461 bp, Triticum aestivum
  unsure (1)..(461): unsure at all n locations
  Clone ID: PAT_TA_47563
gccacacctatcgaactttctagaagccaatgcagcaatgtcgtttccggccatggaagtcgctcggagtcctcacctcccatgcgttcccgtggacgcgaacgcgacagacagcaacagtgccaccgacgtcctcgacctctggcggcagcaaaaacaaatcccggctcccttcgtctggccccacgcggacgcacggccgtcgtcgatgttggagctggacgtgcctgtggtcgacataggcgcagctctgcacagcgccgccgggatgggccgtgccgcggcgcangtcgccgaggcgtgcgcgagccacggcttcttccaggtgaccgggcacggcgtggacctcgcgctggcccgcgccgcgctcgacggcgcggcggacttcttccgcctgccgctcgccaccaagcagcgcgtccgccgctccccggggaccgtggaagggtacgcctccgccc

SEQ ID NO: 47564 - DNA, 245 bp, Triticum aestivum
  Clone ID: PAT_TA_47564
actcaattttgcttacctcctagcggggggacgccagtcaccaacagagcaaagcggaccaccgtcacgactgctcctacgaacgcgaccatagggcctgtctggaccagactgcggatcctgcgctcacccgctgctagaggcgctaggcctaataccacctcgcccaaaggcgcagccccagagggcatactcacagggagcaggttgggcatcatgggtacaagcagaatgggaagaaaggc

SEQ ID NO: 47565 - DNA, 316 bp, Triticum aestivum
  Clone ID: PAT_TA_47565
cacagaagctcggctaagctaagctacggcaggagcgacagaagcgacagggagagcagcacgttggctcgtccgttcttggagttggagtcgagcgagggaggaggagagatgagggccagggtggcgctggagccgctggcggaggagccgggcgccacggacgagtcgggggcgcggcggcggtcagacttgcaagccacactgtaccgatgagcgccccagctagatggcgaagatgggcgggttgagcaccatcgaccagttcggctgaaagcgcgccgccagggggggcgcttgcatcgacgagtccaag

SEQ ID NO: 47566 - DNA, 460 bp, Triticum aestivum
  Clone ID: PAT_TA_47566
ggggaggcattccgcgctcctagcccccccctcagtcccctcccgccgccgcctcccctccgttcgttcttcttcttcgagttgggtagtttagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgac

SEQ ID NO: 47567 - DNA, 274 bp, Triticum aestivum
  Clone ID: PAT_TA_47567
cccaatcacagcgaacccccacctgacccgatcggattgagcctcaatcgaagtcatgtgcggtgcacgctactgggatggggtttagagcaagtccccgccatcgtgtgcgcgggcgaccctaaacatccgtgtgcgtcaacggtgccaagttcacattgcatgccgatgtgagcgagacggtcggggcgttcaacgaggtcgtggtcgggagctgcgacgtgccggagccatagtatagactgttctactatttacagatcctcaaggacga

SEQ ID NO: 47568 - DNA, 464 bp, Triticum aestivum
  Clone ID: PAT_TA_47568
aaatcacattctaatttctactccaatcaacatggctccaggttcagccaccctcgctgtcagagcggtcgccgtcgcctccttcctcgccatgctcgtcctgccttcgctgggacggtgtccgtcgctcggcccagaaccgccgatggcggctccagcaccggcgccgggaccagcgcaggcgatgcggtgcgacgactgtggcccgcactgcatctcgacgtgcagagtttccgtccccctgaaatgtagcaagccctgcgacgctccgagctgcgacgagtgcaggtccgacgtgatggggaagtgcagggctggctgcaccggcggcagctgcgactgcgacggcgaagcgacccgatcgtgctacgactcttgctccaacggttctgcgtgcacggactgcatgaggtttgccagcaagcagtgctcggcgaactgcaacagccagtgcgccgccacct

SEQ ID NO: 47569 - DNA, 184 bp, Triticum aestivum
  Clone ID: PAT_TA_47569
gcggcgattactgagtgagggaagcaagcacggaaggagcgctcggatggctatggtagctgttgtgcgggaggcggcggcgtactgcgtcgtgaccttactctgggtgctctgcgtctcgacgctcggcacctacacagacaggttcaccacctacctaagcctgcacgagattatccactac

SEQ ID NO: 47570 - DNA, 288 bp, Triticum aestivum
  Clone ID: PAT_TA_47570
ttagtgatttagcggggagggagggagcgattgctcttaattggaagccagcggagccgccgagggatgccgaggggatatttcgcggagtctacatcttctttgttcaccacggcgtgcagccccgacgcctctaggtgtggaagcagaagctggtgcaaatggggggtcgtctggagaataaagacgcctgcgccaaaggcgccaggatcaaccatatgctcaccgtcgacgacgaggtgctactgttgctagctcggatccttactgtatttacctgttttaggg

SEQ ID NO: 47571 - DNA, 130 bp, Triticum aestivum
  Clone ID: PAT_TA_47571
taaggtaaatatcttaaaacataatattatgtgaaaagtacgaaagcaacatctcaacgcacaaaagaaaacctgtacagagaggctaaaacataggcccaacgtgctattttagggccatggctgtcgc

SEQ ID NO: 47572 - DNA, 248 bp, Triticum aestivum
  unsure (1)..(248): unsure at all n locations
  Clone ID: PAT_TA_47572
gacgaggtccccctccgcctcccgcccgatggcccagtacgcctcctccgcgcctccatggtccgcaagacctggagccacaccgtctccaacccggaattccacccccgccncgcgagctccacccggcaccccccgggctcgggttcctccacaaccgggccgacgagcgcagcccctgcttcatccccaccgccgccttgtccttttccttggtcgccccggaccgccgtttccgggggcccccc

SEQ ID NO: 47573 - DNA, 250 bp, Triticum aestivum
  Clone ID: PAT_TA_47573
gatgagtctaccctgcccgtctttctcgatgctccaccactgtttttctttctttctatgtttcttaagatttcgagggaatcctcctcccatgccctttccgacatccctttcagatgcagctccaggagtgacaggagcgcgactagtgccgcagccgaactcgcgagatctccccgtgcgctgagcaccaccgtgtcctctactttcccactggccacctaggtatgagccttgccgtcgtcgatca

SEQ ID NO: 47574 - DNA, 430 bp, Triticum aestivum
  Clone ID: PAT_TA_47574
attctgtccaacccagccgggcaatgccgtacaaaccctagccccccgccccgctgatgcccgcgcgcggccatgggcaactgctgccgttcgccggccgccgccgtgcgggaggacgtcaagtcctcgcacttccccgcctgcgacgccgccaggaagaataagccgcaccagccccggagcggcgccgtggggaccggcgggggaggcgggcagaagcggctggccgggctgggcgaggaggggtgcgacttcatcggggggatcgacgacaagtacctgctggaccgggagctgcggcgcggggagttcggggggacgtacctttgcgtcgaccgggacaccaaggagcagttcgcctgcaagcccattttcaagcgcaagctgcgcacccctgtggacgtggaggacgtgcggcgggaggtggcca

SEQ ID NO: 47575 - DNA, 461 bp, Triticum aestivum
  Clone ID: PAT_TA_47575
cccacgcgtccgcccacgcgtccgcccacgcgtccggtctaggatatgtttgctgatcaaaatacaattttattttttgcaaatctagagcacatgaacaatgttattctgtgtaattcaatctgtggtgacctgttgcgcgcgcacgcgcatgctcacgctcacgcacacgcacacgcacacacacagagggagatttggggcaccgcaggacttgtgccttttctctgtttctttcttctcactaacaaatgaaccggatacaatggcttaaatagcgaatacaatggcttaaatagcgaaacatgcaatgccccaagccacactggcctgatcttaaactcatgcacacgttctccacttgtgcagcatctccgcaacggctgcacaacgcagccaaaacagcatgcatttagccggctgacactaacaacctccatgcaatctagctgactaacaca

SEQ ID NO: 47576 - DNA, 437 bp, Triticum aestivum
  Clone ID: PAT_TA_47576
gccactctaccacatgcgctaccacaccttctagctgaccatacataggtccagagacaggtacgacgagatcaacgacacgatgagcggcgccacctgctgcgttacctgctgacgacagttgaactgacagctgcgcacgcacgtcggcaagctgatcccctacctgagcctccacttgtgcatggagggctttatgccggtcacatcgcgggtgacatagatggaccgatagatgaatggctctgtgattacacatgagatgacacactcgaagaacatcatgtgtgatgttgaccctggcgatgaccggtaccatagacgctacgtcatagtctgtggcatgatgcgcaccaaggtgggcgccaagcaggtgatcaagctgctgaacaagaactcctactagtactgggagtacatcccggacagcatccagt

SEQ ID NO: 47577 - DNA, 462 bp, Triticum aestivum
  Clone ID: PAT_TA_47577
cccacgcgtccgagatcgaaggctgggcaaccgacgggctgagagattcgtcgatggctgctcacgacagttgtggcaaacctggtggcgaggggagcagagacggcgctcctgccgagtctggcgaggcggcaagtcggcggtgaagcacgatcccaaggggctgggctggattagaagcttgtcgatcttgaatttgtggtcgtcgtcgcacggctctgttcaggacgaggtgggtgagatcgagggctgggggcgctgcactgcgagattcgtcggtggttgctcacgacagttgcggcaaccctgggggtgagaacagtacagacagcggtcctacggagtccggggagtccgcggtcaagccagatcagtaagcgccggggtggattaaaaggtatttcatgcctgattaacattgtgtggcgtgtggtgatgactagagaatttacattttttttg

SEQ ID NO: 47578 - DNA, 458 bp, Triticum aestivum
  Clone ID: PAT_TA_47578
atcagatctcatgaacatcgccatgactacgcttagttcaaaaattctctcccaggacaaggagtatttcgctgaacttgcagttgatgctgtcctcaggcttaagggcagcaccaacttggaatcaatccaaattctgaagaaacctggaggatctcttaaggattcctttttggacgaagggttcatccttgataagaagattggccttggccaaccaaagcgaattgagaatgctaatattttggttgcgaacaccgctatggatacagataaagttaagatttatggggcacgtgtccgggtggattcaatgtctaaggttgcagatattgaagctgctgaaaagcagaaaatgagagagaaagttgagaaaatcattggccacgggatcaactgctttgtcaacaggcagctaatctacaactttcctgaagaactttttgctgatgctggca

SEQ ID NO: 47579 - DNA, 457 bp, Triticum aestivum
  Clone ID: PAT_TA_47579
cggacgcgtgggagatggccttcgcgtcgtcgctagtggcgccgctgcccccgccgcctcctgccgcgagggcagggtggaggcgcgcgagggcggcccctcggccgctcgtcctggcggcatccagccgaggcggtggcccggtcccggccccggccccgtcgacgttcgaccggttgcgggagcagctcctccaactccacgccgaagccgacctcacccaatccaaagcaaacagtgctcgggtgaggcttgtgcggttgaccgaggccgctgagaatcttaagaagagagccgtggtcagtgtccggatgggcagagagaatgaggcagtggaattacttgtgcagaagaagaagttgaccaatgctttggagaacataaaggagcgcattgagctgcttgacaagctttccgcaaagattagtgaggttatttcagtgaagcaaaatatgtt

SEQ ID NO: 47580 - DNA, 379 bp, Triticum aestivum
  Clone ID: PAT_TA_47580
ctacaaggcttgcaggtaaagttcatcgatgtgctcctgaaagagaattaatggcacccaagtatgcgctcgtgctttgcttatgttatggcttacctatttgccttggagtgtgctttttttaggggctcatattcttggcatatgcatgtatgtacaatgaatctttttttatctgatcacttgtttctttatatagaacttgaaggataaaaaatatgacgaatatgaaagcacttaccacggccatattaaaagctaaaaaattggagaaggacctgatagtaaaaagctagatgtcaaggattaagtctttgctgtagatcaaccacatatatgtgtttgaaaagaacactgcttttctaaaaagattttagtg

SEQ ID NO: 47581 - DNA, 464 bp, Triticum aestivum
  Clone ID: PAT_TA_47581
cgatttccgaaagaaacaaaaacaaactctcgccgccgtcctctccccgctcccctctcccctccccccacctccgccgcgccctcgccggactccggccgccgcgcctctcgccggactaccccagggctccccgtcccctcctccctcccgtccgccgcggcaatggctcactgaccaggccgtcgaggcgagagggagacggccgagcgccgcgggccgaggacgacgatgagctcgtcggcttccaggagggaggcggcgaggagcggggagctcgggcggacgtgcggagcggacggccctcccccgaggccggcccccaaggcgcggagcggggagctgctgctgccgcccaagggcggcgccgaggcggctgcagcggcggcggtgcggcacgaggggtggatggtgcggtacgggcggcggaagatcgggaggtccttcttccacacccgctactt

SEQ ID NO: 47582 - DNA, 386 bp, Triticum aestivum
  Clone ID: PAT_TA_47582
acgcccacgcgttcggccacgcgttcgaacaatgttattgagggaatgtttaattcatgagtgatagggagggacttatgtgaccacagacagactctatagctcgtgtcggatttaaagctgatgttaaagattatatattgactgactacatcatagagtatgacactgagggtactgattattgttgcagcatgtcaaggtagaaacttaggttggggtagcttactaggaaatacgagctgtagaatcagacgaatcatctactggtgcatggacaactgttaggactgttagacttactcattttgatgcgatcaaaggacgatgttattatactgagcctgttgctggtgaagacagccaatggattctgttatgtagct

SEQ ID NO: 47583 - DNA, 193 bp, Triticum aestivum
  Clone ID: PAT_TA_47583
tcgaaacttaatatatcatgaaccgttatttgtaacagcccatgttaccgtaggcgtctctttttagagaacagatggttaggtacgcttggctgcgaaattatagttatcttatagcgtataatgcataaattttactggctggttatatacaacgttcccgttgcgaaattgtagaggtcacccaacataa

SEQ ID NO: 47584 - DNA, 451 bp, Triticum aestivum
  Clone ID: PAT_TA_47584
tcgcccacgcgtccgcttccttggaccttcacgccgccgccttctacttctaccttgtccagacgaaccaccgcagcgttgttgccgggagtgccttcggagaaccacagctctgccccccgcgccgcgcctacggtggccgcttcttcctcgaccccggcatagatcttgccctcaagtgctcaagccccagcgtctcaccccatggcgaagaagaggaagcgcagcttcgatgctcccgcctctgctgccgtagagaaacctgatgactctgcccccgagcgggcggaacgcaccctctttgggttcaaggactcggccgccgagcctgcttctaaggacgctgggccgctctttcggaacaaggagaaagtgctcattacgtgctcccgacgcatcatttacaggtaccggcatctgaagcagaacgtggtgtcgctgctggcgcacg

SEQ ID NO: 47585 - DNA, 452 bp, Triticum aestivum
  Clone ID: PAT_TA_47585
tccacacatacgtcaacccggactccaacacgtccggttgaaaatgtggatcacgtcaggatcaacggggtaaagctactaaaaaaatttgagaacacataactaccggatggagcacaatggaaaattattgtaaagggcgatctggatagtttagaccaagtgctagttctcgatgaaaaaacaagtgttgataaacagacactccaggggtgcccacctgtagagctaaagcaccttaggaagagaagctcttagatgaaattgattgtaaaatgttgagttaggctagttcgaccactaagacggtacaggcatgtgaaacgccatctccctgttgagcataagaagatcgagtggttaaaaagtgatagtggaaaggaattgactagagctcctcctcacctccctatgcactacaaactggaaataaatcatgtttcatgaaggga

SEQ ID NO: 47586 - DNA, 458 bp, Triticum aestivum
  Clone ID: PAT_TA_47586
tacacaataacaaccaacagcaagagcgcccagagcacgccgaatcgcacggaggcatggaagccgccggccacggggatcgcggtgcaattcgaccctgtcgaggaagccgtcacgtcgccgctgcaactgggcaaggcccgaatcgaccgccatcgcgccactacgatggcggcagcagagaacggaggcgcgcccaacacggtgcctcgcgacgtggcggcggtggccgctgtcggggagaggaggccactgtcggtggcgctgcggctggccacggcagtgctcagcctggcgttcttcgcggtgatggccagcgcccggacgttcggctgggacggcgatcactttgatcgctacgatcagtacaggtacgccctggcgatgaacgtgatcgtctgcgcctactcaatcgcgcaatcgcttggtgagatccgccgtctggtcgcggcgaggtt

SEQ ID NO: 47587 - DNA, 453 bp, Triticum aestivum
  Clone ID: PAT_TA_47587
tcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatg

SEQ ID NO: 47588 - DNA, 486 bp, Triticum aestivum
  Clone ID: PAT_TA_47588
cgccaggaccgggccgggatttccgggttggcccaagccttcggccaagccttcgagggatttgatcagggttattggcggtcattaatcgagacctacgtggtttaggttaacagtaccagaatgagcttcttggacgacacctgcggcaagaaggggttgtggcccgagctggttgggaagttcattgaggagggccagaagatcattatgaaggacaggccggatgtgaagataattgaggtgtttccggtcggcaccgccgtgaccggggacattaagcccgaccgcgtgcgcatattttttgacaccgttgcggagatatccccgcattgggtatcttttgtggatgccccaccgcgttatgtgtgtgtgtgtgtatgtgttatgtgcctgagaaaaccatatcttgtgagtggtgaccatgtgtgcatactactcctagctatgtcgggcgctctgtgagaattaaaataatcatttaac

SEQ ID NO: 47589 - DNA, 441 bp, Triticum aestivum
  Clone ID: PAT_TA_47589
ccgactaccgcgccgtagacggcggtgtcaccgtggcgcacgcggggcggaccacggcgcacctggcccggttcggcgtcggcgtgcgcgccgcgcggatggtgacgcggatggaggagtcgcggaccatcgacgacgtggcgttcgacgtgccggagctcggccccgacaccttcatcccgcctgaggaggtccggcggagccgtttctacgacgccatggccgccgccggcggcaaggaaaacactcgatcgtacgcaggctcaagagagtggggtaagtggaacacgtagtagctcaatagtgttttcgatagtttcgtcggtgggtcgatgattgtctgtgattgtggcacggacaaaatgcaagcgcgtgtacatacatatgggtaccctgggttgttacctacgaagaaagaaaaactcacagtttgtaaaaact

SEQ ID NO: 47590 - DNA, 458 bp, Triticum aestivum
  Clone ID: PAT_TA_47590
cccacgcgtacgtcgtatataagctgtcctactccgatatcacagggtgagacaatgatgccaattgacccaacacaaggagcttttatggctgacactatgagcccaaacagattactttttggaccaagaccggaatgggatagatcggcagaaggaactggatcatttccatcacctgcagcttcacctgaaccatttggtggtgtttcacggacgattggacaaagcaactttgctatggcttctgggatgatgtaccctcagcagaagtctttatttggttgtggaactcccggagactcgtatggaagaggcttctgtcatagaggtggttttccacacgccactaactacggtggttctttccctggctatggcatgaatggcacaagttttattccaatcgataaagggcgcaggagaggaaggggtaatactttgttatgcacatgtga

SEQ ID NO: 47591 - DNA, 192 bp, Triticum aestivum
  Clone ID: PAT_TA_47591
gtcccggatctaagaactagggtggggccttcttttgttctttctttgcaaaaaaaagaagttggcccaagccaggggtgcgaataaaaacacctgtcccacgtgcgggcagtccgtagcaaagcaccattaccctggttccatatcccaactcgcgctgtgggtaacctcagaaaacgtatgggatccaca

SEQ ID NO: 47592 - DNA, 420 bp, Triticum aestivum
  Clone ID: PAT_TA_47592
ccaccggcgccgacgtccccggccgcggaggcccgctcccggaaccagagcagcgcgccccgctcctcctcgccgctctccgcgccactcgcctcagggacgaagaatcacgccgcccagatcccctttttattgatccatatgctgctgtgctactttcacttgatgtggcacatcaagcttcggaatctctcgtctctcatttaatgccatctgcagagcattataggctaactactaaatatcttgatgacaaattgcaacacttgataagtaggtcagacaattttagacagatggaatggacactcgcccatataggcttagctggccaaggatgtctatcgtgtacgatgtatcacctggaagaatcttcagtacagcagcccagcaactccgaggagcaggagcaaaaacacc

SEQ ID NO: 47593 - DNA, 103 bp, Triticum aestivum
  Clone ID: PAT_TA_47593
cacacacattcgagaaccttgaggagcgtccactcaaggttcaagcgatgaagcactctgaaaccatcagctatacgatctctctgtcgacggagaagaccac

SEQ ID NO: 47594 - DNA, 172 bp, Triticum aestivum
  Clone ID: PAT_TA_47594
cccacgcgttcgatcctcatcctttgggctcgttatcactcctatcagcatcagccatgttgaacgtgaagactcacatcaacataccgaccattggccatgtgaactctagcaagtagaccaccactggccatctgatctaaaagcttggaaggatcgacatgcgtagtga

SEQ ID NO: 47595 - DNA, 317 bp, Triticum aestivum
  Clone ID: PAT_TA_47595
tcggcccatgatacttcaccggctgaaggtggcctgcaagccccataccgcgcggatatagcatgcactgcaacagacggtctttcaccataagcacagaaacgaccgacacgggctcttgcactaccgtgaaagaagcggatacgtgtcttttcctcgacccgagcagccacacggaggtgattttacatccccctgcacggacctcccatccgcagcccagatgcgcgtccaaggcagcaggatccgcccaaatggcgcgcggcactgtcactacctaaccccagtgcgaacttattctttgtgacgagctaaac

SEQ ID NO: 47596 - DNA, 232 bp, Triticum aestivum
  Clone ID: PAT_TA_47596
cggacgcgtgggcccctccctcttaatatactcgccgccgtaacaattactgtttgtcaccgcactttttgtgctatgttttatcgactgatgcggtttgcttatgtgaaattctaatcgacacgctatgttctttggattgatcaatctacttgatcgacattgatatgttttgattctgtcattaatgagagatcagagatgcacctgggctcggcatcatgagtcaaca

SEQ ID NO: 47597 - DNA, 212 bp, Triticum aestivum
  Clone ID: PAT_TA_47597
gcgcacacgcagtcggagccaccttcactccgaggcgcatcgatagtccttgtcgccgccggacggaactgctccgcccaagtatgtccgttaccgagtggactcggagcgtccagcaccacctcaacacaggccggccggagctgcgccccccaccacagcaaacgggtgggggtagggggggcgtataggatggaggccgtaacgtcaca

SEQ ID NO: 47598 - DNA, 302 bp, Triticum aestivum
  Clone ID: PAT_TA_47598
agagagaagcagtactagcacacgttacctatctaggctggacgtctgcggactaacgcttgttcttcgaggctgtcgcctggagaacactcgccgtagtctagaacgattatgagggcagtgaggcggcggctccagaggataatcaggaagaaagtctgctacgggccatatcactcctgcagaagaagtctgctacttacagtgcaacttatgaaacagcgtactagtggtgagtgtccctgtgaacactagtgcacaacattgtgacatgacggtgtgagcactgaacaaacctactt

SEQ ID NO: 47599 - DNA, 147 bp, Triticum aestivum
  Clone ID: PAT_TA_47599
gcgcatgggttttgccataataagcttcttggctggcgccttactatacagatttgaaaagccaggtggtggccctatcacacgagtatgccacatagttgctggcactgtgcgctagtggaatgcacatgttccagaggacaggtc

SEQ ID NO: 47600 - DNA, 147 bp, Triticum aestivum
  Clone ID: PAT_TA_47600
ctcagtcaggtagctatccagctactcagataccctcgaaaggccctctatccgcctcttcagctactctggaaatgctcctaacatggctctccagccactcatgaatagaagcaaatttctgacgaccatcggtggagcttcgac

SEQ ID NO: 47601 - DNA, 193 bp, Triticum aestivum
  Clone ID: PAT_TA_47601
gcgtttacgcgtgagtgaaaacataaagagtatattctgtgaaatgctggagaaaacaaaagaagatgctcagcggtgtgctttaattttaaaggtatgatacacattattgaatgattatgacagatttattaataatattgggtaatgagaatcattgctatctaggtaggctgagattatgacagccatt

SEQ ID NO: 47602 - DNA, 288 bp, Triticum aestivum
  Clone ID: PAT_TA_47602
tccgccccgcaataccgggctcgacccacacgttctcgtcgcacaagaattcctcccacctagaccgtatcaacaacagcaccaccaccactggtagataagactaaagaactatagagaaaaactcgtcattagggctatcgatctgtgtacagagagacgcacttcttgacatcggtatcataccaagctggcgcgctacgtatcggggataccatacaatagttcccaggaacctttaatgaatgcgctaatggagtcaaagggtgccaaacagtctatcagtac

SEQ ID NO: 47603 - DNA, 263 bp, Triticum aestivum
  Clone ID: PAT_TA_47603
atctctatctactcatgagggtcatcgtgagacttcgtctctctcctcacgacggtcaccgagggagctcgacgttgacctgactagggtgctgacagattgacgactctgatatagctctcctgaatccagcatgacgccggtggcacattgctctgtaggcaccatcagcctgttccacataggcagtttcaggcccaaccgagaaatacagatatgacagctccgtggctcaaagaggtgttcaagagtcacatccccct

SEQ ID NO: 47604 - DNA, 261 bp, Triticum aestivum
  Clone ID: PAT_TA_47604
agcgttcggactcaagagactccggtcaagatagactgcttgaacttcagtagcaatggcaaacatgacctactaggggcactggcccctgttgtaactcaccatgctacgctgcactagctattgacgtttattactctctgtgtcccaaaatatacagaacgttattgacactatgctagagtaaaaaccattcttatattgtgggacagagggagtagccgtagcatgtaatggagccttatagcctatgccattcat

SEQ ID NO: 47605 - DNA, 236 bp, Triticum aestivum
  Clone ID: PAT_TA_47605
aagcagatatcattgcctgcaaaaactagaacacaccgagatctccaatcacgccacgatgtgtcaacgccggcgatgaatatggcctcgtttggctgcctacgagggaataactggtacatttatgctttcaatgcgctcaaaaagaatgcgagcatgcaaatttggagcactgattcctcatgctaaggtgtcagcacatgcatcaacagcttatcgctcagctatcttgacat

SEQ ID NO: 47606 - DNA, 241 bp, Triticum aestivum
  Clone ID: PAT_TA_47606
tcgctgagcccactatgcagtgaaccttgaaccctctttatttgtatataaaagtgttggtgatctatgcttcagctattaatagcgtattaagtggacattgcttctgtctcatacctgtatggcgtataagctggacctgatgtggtattgataagcggtggtccttgatttaatctgggtaagataaactgtgggaagtggatctggatttgtggtgtgagagttggcacgtgaattt

SEQ ID NO: 47607 - DNA, 268 bp, Triticum aestivum
  Clone ID: PAT_TA_47607
tccacgcgtccactcactcgttcgttcaaaaccgtcgttgttgccaatcactatctgctgctccgccgccgtcagggcctatcaagatgagtacgcgccgtgtattacagtgcactcaaaggattgacaaggtgtctatgacagcccaatagcctgacgcgtatgatgctctggtgaccctggaacctgagggggtatcctctatctttgccactggtggaactgatgaggaactgctatgaatcgcaactggatttgaatgacaaag

SEQ ID NO: 47608 - DNA, 150 bp, Triticum aestivum
  Clone ID: PAT_TA_47608
gtctatccactatgcactacagctttgaaagtattcattctagctgaacagtatgaggtggtaatgcgtcacatgtgtatatcaagatgattatgacatgtgtattatagtatacttaaatgattgacaaggtgtatatgatattctaaa

SEQ ID NO: 47609 - DNA, 378 bp, Triticum aestivum
  Clone ID: PAT_TA_47609
acgtaactaatggagagcggcggacgaagcgaaagcatcatccatggccgcagtggtccgaaccgcgtggtacggtatcacggagaagagccttacctactttctccggtacacccgcacatagggatacctaaaatgccttgcatacggacacctattgcaaaccaaaactcacaacattgctgcaactcttgtaagatacgtcactcttagaaacaagtgctatgataaactacatgacactcactatggaaggcatatgcatgtagagtatgcggtcaatggtctctacaatgcatccaaagtgcctgctgaatggcatgcatggctgctccacattacacacagcactgcatacaagctgctagacgagactac

SEQ ID NO: 47610 - DNA, 329 bp, Triticum aestivum
  Clone ID: PAT_TA_47610
gttcattttactacccgtagctcgtacgcaggatgtgcatctgaccaacaatcttggttagacaggcagtgtaaaagtgacagccacaatgaccgtggtcaccgccagagccggcgcgcaagagctgcccgggcacacatagaccgtgtgcgtgaccagctcctcctggtacatcgctgcacggctcaggacgctgctagtgaagcagatctacaccatcacgggcaccttgaggcactcaaatgatccgaagaacgcgcatctgatggcgctggacagctccgtcaataggatggtattttgcaaggccgacctgcttgactacgact

SEQ ID NO: 47611 - DNA, 406 bp, Triticum aestivum
  Clone ID: PAT_TA_47611
cccacacgtccgaccggccgacggcggcgacagaggtaatcgacgggaggggcaccctcatggctacagatacaaccatggaagctaggggacatcgctgcacattgacaaataccaagtgcaggactacttcttgagtcaacatatacaaatgacattacagtaactaaatttgagcatgtatcatcaaatacatttgaatgaattgttgtgaggcagaacgggcaagacaatgatatgtcactggaaagagaggcaaaaggcacttgctatgtaactagtggcaaattgacaaaatgcatagtctatggttgcatactaattaaatcctacattgaactctgtatcaatacgtaatagccaagaattacacattatgagcatatgagtgtcctaccaaaatata

SEQ ID NO: 47612 - DNA, 147 bp, Triticum aestivum
  Clone ID: PAT_TA_47612
cccacgcgttcgcgccatccgcccctacaactatcgttccttcagctgctatagagccctacaagtacctcccgtctagctccttcaacttctccaacgtggatcaccaactgcagttctcttgtctagaacacttagtactatatg

SEQ ID NO: 47613 - DNA, 253 bp, Triticum aestivum
  Clone ID: PAT_TA_47613
gcctgtggctactccaggccactagctgctgctatgcaatgggtgaggcgcgcgcctcctcgcggctatgccgtcggctatgtgcgccgaccccgggcgcgcgtcgttttgctcatatgggcaacgcactgctcgcttcttcactcccacatagtcgagctactcctgcctgcttcactacatacgagtcgcgctgacgctggtcacgttaggacatgggatagagtggggagggttcgagttaaactccata

SEQ ID NO: 47614 - DNA, 292 bp, Triticum aestivum
  Clone ID: PAT_TA_47614
cccacgcgtccgctacatccagctaccgatccgtcgacgccaacttcttgaacctcccaccatgccgtgggtgcagactgccctcactacgtaatcttttctgcggagaccgcgctctctctgcgggatcacttcgacggatcaaggactctgtccactggatgcgcgcctgccttacaccattctgacgttgagaggggcgacgactgcacgtgtctccgagtgctagtgccggttcccagtgctctgtcccgatgccaaaccatcttcttcctacctcaacttcctatcc

SEQ ID NO: 47615 - DNA, 185 bp, Triticum aestivum
  Clone ID: PAT_TA_47615
acctgctccgcccatcttctgtggcagcctccggagccgtgcgcatcaccctcctccgcatcttatgcatagctaccaaccaccgacctgagccacccaagtcgagccagcgtcgcccaaatcgagccgccatctgcggatcagattgtcgcccaccttttaaccatatgctgagtgcagcctgc

SEQ ID NO: 47616 - DNA, 158 bp, Triticum aestivum
  Clone ID: PAT_TA_47616
agctgtccctatccacctaagaactcccaaccccaaacccccgctgcgttgccaggtcccggaaaaggaactctccgttccttaggacgttcctagagatgaaggtcttcgatgcgccaaaggggcctgccccggggaatttttacggggcccagggg

SEQ ID NO: 47617 - DNA, 236 bp, Triticum aestivum
  Clone ID: PAT_TA_47617
gcgtccacgcgtacagcacgaagtaggaaggatggtcttgattttcacagatcaacctatgctcctggcgcccaacattgagatggtgtttgctgctcttgctttggcacaatgtgaggaggttaggttcttccaacatagaactgattgcattatcaaaatctactccagggagaactgtttacattgatgcaacgtgcccacccattgtctgatattagatggaatgggcaaac

SEQ ID NO: 47618 - DNA, 226 bp, Triticum aestivum
  Clone ID: PAT_TA_47618
gcgagagccgagccgaggatgaggggaggaggatggtttacgccttggcggcatgcccgagtcagatgaggttccctatgcccgctgagcggtagccgcacaaccactgctggatggtcttgccgcagcgtccatacaactggagggagcatgctgagccatctcaaaaaacattcgtgagaactgtaattgccatgtcaaacagtgtgcttgtgaccatttgctc

SEQ ID NO: 47619 - DNA, 354 bp, Triticum aestivum
  Clone ID: PAT_TA_47619
tttcgtttgcgagggaccaggagctagctgtgcctctgctcctcaatggcccgcgtcgttgtcgcggtgccggtgcttctagtcatactgcttgtttgggcgaacgcgagtttcatcgacacggtgctcggccagaaacgcagtgccatcgtggcggggccctttctagttccgggggtagacaaacacgccgtgatcttttatagctggagcacaagcacacccttgctcgtattcaagtttgacaacaagattgaccttcttgagatccgcgactaagtttatgttttcgacaaggtgtaccccctgctgagctccttattccgacggtcgacagaggctacaaagttcatg

SEQ ID NO: 47620 - DNA, 241 bp, Triticum aestivum
  Clone ID: PAT_TA_47620
ccaaagataccacccacgtcctcgctgataaccacgggagatattaagtccggtcttcctacccactaacgggagatcaaagctagatgatcatgagcactatagcaatgtcggctctaaacatagactcgctgattatcatcccgactgcgtttaacacggtggaagtctacttgtccgagtagactgagctggtcaccaccaccagctgtattagggactactggatgaactagtacta

SEQ ID NO: 47621 - DNA, 187 bp, Triticum aestivum
  Clone ID: PAT_TA_47621
gcaacatgaacaggtccgccatgcacctgccgctgcaccactcgaggtgcccctgctcgccggtgtcagccacgacggacctcccattgtgggcggggctgacccacgacgacaagcgcattgcgtgcctggccgcgcgcctcgccaaagcaccgtggtcgtcgtcctccgggcgaaccacgaggac

SEQ ID NO: 47622 - DNA, 252 bp, Triticum aestivum
  Clone ID: PAT_TA_47622
ccattcgttgactcgtaatcaaactcttattctctaactgagtatattctaaagatacatttcttcctcaaaggcttatattattaacctcaaattctatgccaaaagatcacacttctaactccacatgctcttcaataaatatcaattgatgacgttcacttacatctgatgcttacctcttttcaatcctttaccacacttattaaattaattaacttaatctttaccatcctataaatgaaaatttat

SEQ ID NO: 47623 - DNA, 205 bp, Triticum aestivum
  Clone ID: PAT_TA_47623
agcatacgctcctgtggccccccaaaaggcccgcaagaaaagtacaggcgcagaaccaattgcaccggcggtagaatgcacgcccaccacacctcgttcctgcctgcctccgatcaaaatccgtcgatgcttcattcctagctacggccgagatccctgcctgccgcatttcgagcgatggctgactgcggcgcactatgctcct

SEQ ID NO: 47624 - DNA, 192 bp, Triticum aestivum
  Clone ID: PAT_TA_47624
acagagaaggaggcgcggaacgccacttacacaaagaaggattgcgattcggcgacccagccctacacaaaatccatggcgcttgacgactaggacatatgatacctcacaaaccggaccgccgtttaccttgagatgcgactgtatgaagattgcatgaacgattgtgctactgctgtagagaggggaagg

SEQ ID NO: 47625 - DNA, 229 bp, Triticum aestivum
  Clone ID: PAT_TA_47625
actactcattcgaagaaaaatcattcctgctagaaatactttgtacatgatatatggctcactagacaatttcatagcccctaatccttggattactagccgctattacactctgccaaagcaaccactctatgatacttattacccagtgctaacgtgtgctggagcatactgtgcggacacccagtacgagatattgcttgcccaaagacggacacccttcggctga

SEQ ID NO: 47626 - DNA, 296 bp, Triticum aestivum
  Clone ID: PAT_TA_47626
tcgcattggactaggtctcagacatacctctatctatggcttgcttggggaagaagaagaagaagaagagagggcttcagaagccatcgcccatggatgccaatctgatgttacgagccaacgaaaatgcattggaccaatttgttcatcgaggagcccatccctatggtctccatactacaaccatccaagccacacttgttcccaacgatgacgaagatcgaggcgactctgggtgccaagaccccgtccggtgaggccatctccgcctgtctaaaggccgggatgtctgtggc

SEQ ID NO: 47627 - DNA, 204 bp, Triticum aestivum
  Clone ID: PAT_TA_47627
cccacgcgtgcggccacgagttcgccttatccgccaactggcagctgcagctaggctgccctccgaacccaaggacggcgcctcctgcgctcgccggcgtatcgcaccactgtcagcactaacaatgggggcctactgcagcagttgttgcacaaacagaaagctacttataaagaagttgtacgagaaggagagcaccaccta

SEQ ID NO: 47628 - DNA, 276 bp, Triticum aestivum
  Clone ID: PAT_TA_47628
tcgtcgcctgtaggacgacagcgaccaagggctcttatctctatttagggaagagatagtgagcttgctgaactttctctaccgcacctattaggagctgccggcatctcacaactagctgcgcttgtccatggattgcattggcgacctcatgccagatcggtcagggactttgctgccagccaagagctaacatggtctggtgcagacgctgacggagtacctagcatcctcttctatggacggtgatactgtgactacctcgctcctccatgc

SEQ ID NO: 47629 - DNA, 375 bp, Triticum aestivum
  Clone ID: PAT_TA_47629
acgaccacgcgtgcgaccgcacactcacaaattaaaaagagagagagagagagatagacatacagagagagagaatctgcggaagagctatttcttctacgggagttcattgttattaaccatatctgccctacgtcaactgcatcttcataaacatggctgcaggtggaagactgccagctcctacttcttgcaagacatagaaaaccgtctccacatagcgtgatccgagcgaagaactcccttctttggtgggagatcttgagaaagctattccttctcataggttaaaacgctcaatcccttagtctttttcctaccctaacagcgacatcattatagccttatgcttcttctacctcgtcactaattact

SEQ ID NO: 47630 - DNA, 237 bp, Triticum aestivum
  Clone ID: PAT_TA_47630
gcagatgcgactccacgcgtccgatcacacccttgggacatggcgacggccatgctctgcacggccatggcgccactgaatgggggcatgctggagttctgcggactgacgagctcgacgactctgtcgctccggcggaatgccagatgcgacgactgaatgtccgcgggttccttcacgacgtacgcgatgagcaccaactgaaggtcgcgcaaagcgcctacggacgccaaactc

SEQ ID NO: 47631 - DNA, 177 bp, Triticum aestivum
  Clone ID: PAT_TA_47631
tcgacgcgtagttgccgactcatcgacgtactgctgcataccagcatgccacacacagccatgctcttcggactaggaacaagtagagaggcgccgcaccttcaagtctgataggaggaaggtcacctcgactagccaagggagatcatagtcctctacacagattatctgccttga

SEQ ID NO: 47632 - DNA, 218 bp, Triticum aestivum
  Clone ID: PAT_TA_47632
ggattacgagtgctgatgagcgccaacacagacatggccgctactgcgatacgtcagagtggcacaaggccgctgtgctcaaggaggtcatgaatgcacactacccctgtgcctacgaggaggatgactatgcactgacgcggtttctacgagccttgtaccaaatcatgaacaaagcattggcaacgcttctcatgtatctagcctggaagactatg

SEQ ID NO: 47633 - DNA, 358 bp, Triticum aestivum
  Clone ID: PAT_TA_47633
gaccgcctttgaagaaacatgcagctcacagcaagagcaaatggaaacattgcacaagctgcttgcacttgcaactgagaaactgcagcatgctgaactcactgcgatacaagcgatgaccggatatgaaacacagcatgagacaatctaagatctgtaagagcgttcgggctatgcagggttttaaatcattgcatctgacaacctacaaaagaaactgcataataccatctgggaactcaaaggctgtatcacactatttttaatggttcgaccctatctgtcagacgctaattctaatggtgcaggaagaagccattatttcttatgcatcatctgtggaaaatgctaggcgtgg

SEQ ID NO: 47634 - DNA, 347 bp, Triticum aestivum
  Clone ID: PAT_TA_47634
tcggagacgcgtgtgctacaccctataattcaattgggacttgaagcgatcgcaatatacatatattcagccggctcgaacgatctctttatacaaatatatcgattccgcagatcacatagatttgcaaatctaagtgattcctactgcagagcgatctatcaattcagagtgttcaagactcatggatctctgtcacgaggaggtggttcaagacgcccccgaagaggaagacgatgatcttgaggacgccccactaagccctccggatgtgctgcgattaggtcacagtgtggtgtccgcagtacctggctagaggaaactgttgatgaaagacactatagggg

SEQ ID NO: 47635 - DNA, 164 bp, Triticum aestivum
  Clone ID: PAT_TA_47635
gcgatctccgagatcaccaccggcaacgccactggtgagccttgagatgtacttgagaggtggagcggttgcttttcaagcggtctttcaaaagccaaggtctctgcctgcaggctgttctccacgacgacgtagtcgtacccggtggaggaccactcgtatga

SEQ ID NO: 47636 - DNA, 329 bp, Triticum aestivum
  Clone ID: PAT_TA_47636
acgaagggctgcaatctgtgcagcaatggactacatggatcagtttgatcgcgatagtgaaggtatgattgctaatgatggatctgctgaccaaacctattatgcttggactgttcacggtatcattgcctactgtggtgccctgtgtcttgctgcacttcaacctgatgctacaataggcgtcatcgccttggggatcgaacattcgctgaaaagtccaagctgaagtttatgaaagctaatgcagtgtacgaggcgaagttacagactgggttttatttcacttatgacagtgatacaagcgacgatagccggtccattcatgctga

SEQ ID NO: 47637 - DNA, 256 bp, Triticum aestivum
  Clone ID: PAT_TA_47637
gccacgcgttctgttacctttcgaaaccaacatatacttgctcgtgggacaacccggctttgccgaacacttagtcggttttacctaaattaatttcattaaactgaaagaagtagacctaaatgacacctttatacttcagaacaagaaactgagttaacgccaaaatgctttcacaaatacagctgagctatggcacaaagtacttacggaattgttcagatattctcaacaagttcctaacggaagaatccac

SEQ ID NO: 47638 - DNA, 186 bp, Triticum aestivum
  Clone ID: PAT_TA_47638
tcacagcgcacgaaggatctggagatgacgagaagatgatggggacgaaggccctgtactacgaggagctcaacgagaactttaagaacgtgcattacaccgtgcgcagggagctataactatcatcttcccaactgtagaaggagggcacgaggatcatcttaaccaacttacgttacccggaca

SEQ ID NO: 47639 - DNA, 220 bp, Triticum aestivum
  Clone ID: PAT_TA_47639
agcgtgcaacaaagacaagttaacctcaccggatagaaaggagaagcgtagatgtgggcgcgcgccaaggcaagcaagggtctctgcaaggccagatccaagcgctaaccaaaggtgctatccgacaacatgcacggcatgaccaagtcagacatatgtcgcctgtcacgtacgagcagactcaagcgcatctcaagacttatctacgaagagacctgcg

SEQ ID NO: 47640 - DNA, 231 bp, Triticum aestivum
  Clone ID: PAT_TA_47640
gcgtgaaacatgaaacacagtgtctgcaacgggagcagtggccatgggcgagaggctcagctagccaacgccatctccgccgccgcaattccatattgggaactccatgttctcctcggcgtgtgcataatccgggatctactctttaatcctaagatgcacaaactctcactttcttcttaagccctagacgctgagcctttcgctctcttcctgctcgctcgcgtctat

SEQ ID NO: 47641 - DNA, 126 bp, Triticum aestivum
  Clone ID: PAT_TA_47641
aaaaaagatcaggacgatgcctactcaacaccatctgctaatcgcagcggctgcctgctaaactggattgcgaaaccgtaaggtcaacagaggaacctgtcgcgcagagggctgatgactgagatt

SEQ ID NO: 47642 - DNA, 291 bp, Triticum aestivum
  Clone ID: PAT_TA_47642
tcttgcgagcaccagcattggcagcacatgcagttttcacagccaggcccattccaaccagagcgcgtatgcacaccacggccgcctgcagacacagggtccactcttccgacttgtccgggctgaggacgccgtcgtgctccatgagcgccgcccgcagggaggcctcattgttcgatgtcataacgccgcaagtccgtcccagggcttccagctagaacgccgcgaggacgccttcggacgcgatactcaaagttgccatcaacggtgtcagccgcatcagaactaact

SEQ ID NO: 47643 - DNA, 219 bp, Triticum aestivum
  Clone ID: PAT_TA_47643
gtacgcttggaggctttctataccacttagtacatgaacactggatgcttcaataccacatacaacatgtacaagtgtgtgtgcacacacatacacattgtacgggaatacacgtgtagatacattacagtttaaaaatccacacccggacattgttttagttttaacacaaactattttatcataatccctgactaaaaacaaacacttcttaatact

SEQ ID NO: 47644 - DNA, 210 bp, Triticum aestivum
  Clone ID: PAT_TA_47644
acgaagaagaggaaaatcccgtagaggccaaaaagagaaaagctcacttgatgggctgagtcccacagtatccgcactccaaaaacactatgattccgaacctgtccgcagtgcagaaccacttgggcgccgccgccgccaggagggacgacctctgggccttgttttccgcagacgccaccgaccagattggcctcaagttgcccacct

SEQ ID NO: 47645 - DNA, 177 bp, Triticum aestivum
  Clone ID: PAT_TA_47645
acgctcgagaagaacgatatatagtaccatcgtccaagcgtgcgatgctagcaaaaagacgacggtccatccattctgcgaggagagtctgttgtgcgatgcataaaagtagcaaggtcacatcaggctgcgttaacgcacacaaacattatgcactagttcttgcttgttgcacat

SEQ ID NO: 47646 - DNA, 189 bp, Triticum aestivum
  Clone ID: PAT_TA_47646
gcggtacagtcgggcaatagcacctagatcctgatgatgcaacattgttgtaagacagagagcctttgttggctgctcatgggcgacggaagaaaggctctgattgatgctaatctatgcagaaaaatgcggactcactggccatacactaggactctgcaggctgaagctctcatgcttctgatggac

SEQ ID NO: 47647 - DNA, 185 bp, Triticum aestivum
  Clone ID: PAT_TA_47647
gcaaaacaacctgaagcagcagcttccgccgcttgctccgtcggaggaagcacatggagacgcaccttgagccgcctaatcaggagcgtaagcacacgtgggtatccacatgatcatcaacgaattcgcgcatgaatctcccagtagatgatcacagtgatgggcaagtccaggtccaggacaag

SEQ ID NO: 47648 - DNA, 144 bp, Triticum aestivum
  Clone ID: PAT_TA_47648
agggtctctttcgcttgcacaccgggtctatacacacaagcgctatttatgccgtccctggccaacaaaggttcactatttgaggtgaagtacttctgagaagttctgccattctgtactcgaaaggagctgatccatttatgc

SEQ ID NO: 47649 - DNA, 328 bp, Triticum aestivum
  Clone ID: PAT_TA_47649
cgacatacttcacgtacagcaaggactactaccgccggatcggcaagggctgacagcgcggttacctattacacgggccgtcggcgactacctagtgcaccatgatcgcgaccatgagcatctacctctagtaagacatatacgacatcgagctcactacattgaaaagcaacagcgacctatgcaagctattgatggcgaccactggtaagtccatcatagcgatagaggacatagactgctgcctcgacctcaccggtaggaggaccaccatgctgccggctatgaccaggttcgacgacagaggcacagcatgctaccacatgtc

SEQ ID NO: 47650 - DNA, 232 bp, Triticum aestivum
  Clone ID: PAT_TA_47650
agcatccggtgaaggcgtaggatgcacccggaggcagatactatgtacgtcaaagaggtagacgtctgctaagagcattaccgcaccatctgcagcagcctagtcaagtacttactcttggtccaactacaggacaacacaggcattgtttttgctaacctgaaacgaatatacatgcgcggcatgcagtctaatagaatgctgatgtgtgcctctgatgctactgacgaga

SEQ ID NO: 47651 - DNA, 158 bp, Triticum aestivum
  Clone ID: PAT_TA_47651
acgacaggcgcatgatccttctgcctagtgcgatatcgtgtgcgagagaaatgtctgcatagtacactaaccatagttgaagagaagtttcacatcaacattgcggtcattgaccacttaacactagaaagtcgacaaccactggacacttgatctac

SEQ ID NO: 47652 - DNA, 212 bp, Triticum aestivum
  Clone ID: PAT_TA_47652
agcggtacgactcactcgtacagtcctgctagcaagctatatacctacatagtacagccatggccctcactcgtgatggcctcaagggccacctccgtctctcctttagaggggcgttaagtccaccgtaggcctggcagtgagacgacggtccaacggagctagcctatgcagcttcagcaactgtagaaggatcaggtgcatgcaagtgt

SEQ ID NO: 47653 - DNA, 336 bp, Triticum aestivum
  Clone ID: PAT_TA_47653
cagcaccgatcgatattaattaacggcgagccttctgtccgattctccctagttcagtcgctgagcgacctacctcacgcagcgagcatcgtggctttcttcacggatgcggggggccagcatgcaggcggtggcgggcatgaggaggcggctgaccatagacccggccggggaggacgaggcacccccgcagtgattttggcgggtggtgcgtgagagccccgtgacgatattcacacgccgcgggtggtacatggcgcacgttatgaagagcctcatctggggcgtcggcgcgcacagcacccttatgtagctggagggccccacccaggagcg

SEQ ID NO: 47654 - DNA, 389 bp, Triticum aestivum
  Clone ID: PAT_TA_47654
gtaccttaggagacacgtgtcgagctcctttatactcacccagtttcgttgagacgttaggtagctcacatagtgttcctacgaccatcggtagttgcttaatctcatagtcataggatcatgtataagtgatgaggaaagcaatggcatcatacttgacgatcgggtgctaagcttatggaatgggtcatgtcaatcagatcattccactaatgacgtgatcccgatacttaaataacaactctttgcgcatgggtaggaaacatagctacctttgattcacgagctagtcatgtatacgcacactaatgacactctgggtgtctatgtattcacacatgaattatgacttcggttaatacaattctagcatgaataatacacattta

SEQ ID NO: 47655 - DNA, 120 bp, Triticum aestivum
  Clone ID: PAT_TA_47655
aggacacctgggctttacgagagctgggaaccagaggggaacttgcgcttaggtttcctgtagattgacttgcaccatccatggccgatccacccgaggtgaccgtgggcgcgcccccgc

SEQ ID NO: 47656 - DNA, 159 bp, Triticum aestivum
  Clone ID: PAT_TA_47656
catacgcgagggctcgactgctattgctacccctgctaggggatcgccgtagaggaatcgccacgagggctatctactctgagtgaaatcatagccatggaccacaacgagaccggctgacatgctggtgagggccccatccttcgactcaataaatgt

SEQ ID NO: 47657 - DNA, 200 bp, Triticum aestivum
  Clone ID: PAT_TA_47657
cggacgcgtgggcggacgcgtgggccgccttcttgctacgccctgaccacactgggtgtcgcggaccggccatgtgttgactcgtcgagtcctcggcgacgccgtcagcgtgaaggcctacggcccatcgtgtgtttgttgcggtggtcgctccttctcgatggaggaacgctgagcctcattgagctgtatggaggagt

SEQ ID NO: 47658 - DNA, 261 bp, Triticum aestivum
  Clone ID: PAT_TA_47658
ctccctccagcacggaccgagccaatcagaaacaatcagacgagcagctatccggctactcggcgaggctggaaatgctcttaagcagccttttctgccactcatcaacagaagacaacttttgtggaccttcggttgttgagagatgcccatttctgatgaacatcaatggagctacaaccttgtcattttcttctgctttgtctgaagctgcccgaggcagcaaggctgcaatcttggatgatagaccacagctttgag

SEQ ID NO: 47659 - DNA, 297 bp, Triticum aestivum
  Clone ID: PAT_TA_47659
acgatcaaggttctggtttcgatgatactaaacaacatcaaaggtggtataaactctgataatccccaacattcaaggtgatatgagttatgcgacatttttcgcatttatgttattgatgaagccaatatccacacacaaggctttgatgaatctagccattttatacattccacactataacccatctgggcaaaagttatcctagatcgtctcgcatacatagtggacagtgacaaaaatcatgcgtgcataatcattaggcccttgagaaatgaaacctcatatggaccaaat

SEQ ID NO: 47660 - DNA, 255 bp, Triticum aestivum
  Clone ID: PAT_TA_47660
tcgtacataatcgagcggcgagacatcctcatcctgttccctaaccgcgatgcgagacgacggagaccagtacctacagggtgctggcacccattggatgtgatgaccttagggctgagggtgaccatgcactgccaagcgtgcaaggagaacgtcccgtgggagctcaagagcgtctaacgagtgcaagacgtgccggtgcatgcccagctgcacaacgtgataatcaccggcaccaggcacgcagacacgctc

SEQ ID NO: 47661 - DNA, 182 bp, Triticum aestivum
  Clone ID: PAT_TA_47661
actctcacgcgtacgaccacacgtgcgcgtccccactgtccagacgaggaggagaacggagcgacacgggagccatgtcaaccgctggcacacagtctgcggcggcggaggcgatagcctcggacgcgtacctggcgcgcgactctgtcaggcatgctccctagctggtggcggaactctgc

SEQ ID NO: 47662 - DNA, 236 bp, Triticum aestivum
  Clone ID: PAT_TA_47662
gtacgcgccacccgtacgcccgagtcgacgcacgcgtactcccacgcgtacggagacacgtaagcgtacccactgtcctgacgaggaggagaacggagcgtctcgggagccatgccaaccgctggcacgcagtctgaggcggcggaagtgatgagcctcgcacgcgtacctgtcggccgactctgtcaggtatgctccctagctggtggcggaactctgcccccacttctacctgc

SEQ ID NO: 47663 - DNA, 174 bp, Triticum aestivum
  Clone ID: PAT_TA_47663
cagacgcgtggtagcgctccgtgttcgttgccacacactctatggtgccggtcagggctgtccgtcacacacaggatggagtgcgccatggagctatccctgctaaaacgggcaatgcactaccacggcatcgcgggcgagacggcgtcctccgtttcggttttacgcgcgcgc

SEQ ID NO: 47664 - DNA, 347 bp, Triticum aestivum
  Clone ID: PAT_TA_47664
acgagcaccaccaaccagctcctaaaagcacagcaaaggtcgatgaggacaagctcggaggagcgagcacccatgtcttcatcggtggtcgccaccccgagcgcgttactaggcacctggctggccgactcggctccgcaaaaaagacgcatcgtggcgcgaatgggcttgcgcaagaagaaagcccccgcgaagaagggcaaggcgccccccaccaccgacaggacgttgagggtaccctgcgcgcaggctcccgattacatcgactggaccctcgtaagcgactacggtttctaccccttcagccttgggaagtccacggagtacctgcagtacaacgtggactc

SEQ ID NO: 47665 - DNA, 238 bp, Triticum aestivum
  Clone ID: PAT_TA_47665
tggtcgtcgagagcgaattccccgcaccaaagactacacgtagtcgttaacccgtcgcagtttcagggctcagccaatcactacggcttttaagccaccggtctgagtcggtcagcgaccgttgggaccggaggtagggatgagctatagagcccttgtaggcgggtatagcgatcgtgtttaacgcgctgctgctggtgtgcatggtgaagctcttctttgccatgttccagatgaa

SEQ ID NO: 47666 - DNA, 264 bp, Triticum aestivum
  unsure (1)..(264): unsure at all n locations
  Clone ID: PAT_TA_47666
gtaagatatggtccgacaactcgatccactgccatctcgacaaacgccgcggtgaaccacaggttaaggacggacacacccagcacgtaccgcgagggcaacgaggcgtactgcagccacattaggccgctctcgcgctaggtactggagcgcctctcgaagcgtctgtgcctggagacagcngccatggcggaagccttaaccgtcagttacaaccgcctggtgctcatgcagaacgtcaacttttattcgcgctgcacacag

SEQ ID NO: 47667 - DNA, 151 bp, Triticum aestivum
  Clone ID: PAT_TA_47667
ctgatagtaaaggctatcagctagtgaaggtgatactgatactccaggcaccatagaaacatatcgtatcaaagtctgcaacacctgctgaaacacatgtcgtcccatctgaggaggcgccccaacacgaatcacctccaataaacgctga

SEQ ID NO: 47668 - DNA, 236 bp, Triticum aestivum
  Clone ID: PAT_TA_47668
atttgggtgtgcctgtaattcttaggcacatgtgatctgggcgcgctcgttcactatcaggatcagttgacggagagctctgatttaccaacaatatctagccagtctaaattccgacctactcacgaagtcaagcacgtgcagatccatcaggggtaccacagggacgctccggcagatcaatctgtggaacgacggggtgattgacgccgctcgacctctgttatttcagttgg

SEQ ID NO: 47669 - DNA, 209 bp, Triticum aestivum
  Clone ID: PAT_TA_47669
agatggtgaacgcgaccatcatgaacatctgtgctgcacgcaccagtgcgcacgtgcgacgcttgtacaacaaggaggcgaactctcgtgtgcgcatggtcgtcactggcgacgatgtctcgacgatgtacgctcctgtgatccgagacgggacgatccggacgttgtactggactgtcacccgcaacaaccctatgggtgtgtgcaag

SEQ ID NO: 47670 - DNA, 272 bp, Triticum aestivum
  Clone ID: PAT_TA_47670
gataaattgcccaacttaaacgtgatccgacctggctttaattaattggcctgacagatgcagaactccgcgtcaatgaattaggatcagctatggcgaagtggcctagacgatgtctgaagcactagctcgcatgtacatatgcctctcggaaaatggaattccagttctctgctgaaagtgctgcagatctccggcgagcgtatcgctcagccatggcccatgcaaccgcgatggaatccacgacgtatgctgcttcatgtgacatggac

SEQ ID NO: 47671 - DNA, 121 bp, Triticum aestivum
  Clone ID: PAT_TA_47671
atactgttttaatttaagttgttagaaacattaattctgtttaagaggaggtcgttacatacattatattcttcgaggggggccaaattcttcttaaaatatacagtgcatgaaataaaca

SEQ ID NO: 47672 - DNA, 263 bp, Triticum aestivum
  Clone ID: PAT_TA_47672
gggaccaggtaggcaatctggaagaacctgaagggcttgttcgaaagatgtccacctgacattggatcataaaattgaaaaacttcgaaatcgtgtccattccagcagatgaaaccataggacgcgatgggctagccaccattcgcacacacagccctgccggcgtctgcgccatgccgtcgtttgggggctgggcgaatgtgtcggcggaccttgtttggcgcatgggcgacaggcttgacctgaagtgctatgccagctct

SEQ ID NO: 47673 - DNA, 139 bp, Triticum aestivum
  Clone ID: PAT_TA_47673
gagctctcgtcgttactggaaaattcaatgtgactcacgcgcgttttgacgatctaatggaacgcgccgcttcacgcgttgtgttctacactgtgaataaacccggcgatgtggtttgtcgcaccttgcgtaacaccga

SEQ ID NO: 47674 - DNA, 227 bp, Triticum aestivum
  Clone ID: PAT_TA_47674
acggcgtagcaagaccgtcatccgcctgctgttaagctcgcggtgagatgacgctctacctgatcttcaagtccgcgtccggatacgccctattgcacacgcacggcattgacagagatggggcagagcgtggacgcagttcggtccacagtgctggacgttaagcgggtctacaaggacgtgatgctcgcctggttcagcccattgctctctgccgacggcgccct

SEQ ID NO: 47675 - DNA, 281 bp, Triticum aestivum
  Clone ID: PAT_TA_47675
acgggcctaacgctgaagaacttagagggcctgaacctcggcaccatggaccaggccaaagactccggactgtcgtcttacgtgacctgacaaatctaccgaacactgagatggtacgacgtctagtggctggagagcataaccaccatgaccatcctctggaagggagttatcaccgcggaagactcttggttggccatccactccggcgcgagctggattatcttgtgcaaacactgagcccgccagatgaagtacgtaccggccaccatgagcgccct

SEQ ID NO: 47676 - DNA, 247 bp, Triticum aestivum
  Clone ID: PAT_TA_47676
tcgtgtgaggcgtgtcaaagacgagggtagcagctgatctgcttgcttccagaaacaatggcgtgtgctactcttgtgaaatcacgcgtcattcccaagaaggccaaatggggcaccactcgcaaggtcgccgtcccaaagcctacgaccgtgtgcatggttgtacgtgccagagcatacgccgatgagcttgggaaatccgcgaaaaccatgagatcgacgggcacgggtatacttgacatggatg

SEQ ID NO: 47677 - DNA, 207 bp, Triticum aestivum
  Clone ID: PAT_TA_47677
atcatgtatataatacatactgaggaatgcactaaacatgtttgcgaacatttatgggctggagcgttgagtataaacacatcacaaactaagtgggctgccaatactagctacgacccacgccgcataataccgaatcatactacgtcgttcggtccacatacatacaattagtacaggcacctgcagaccgtggtgcgaatatta

SEQ ID NO: 47678 - DNA, 144 bp, Triticum aestivum
  Clone ID: PAT_TA_47678
acggcgtaccaagacggtgatccgccggctgttaaactcgcggtgagatggcgctctacctgatgttcgagtccgcgtccagatacgcgctattgcacgcgcacggcatctacaagatcgtggagatcgtggacgcagtacggt

SEQ ID NO: 47679 - DNA, 315 bp, Triticum aestivum
  Clone ID: PAT_TA_47679
gatggcgaaaccacactgtctgcatcaggttcgtaggcaccaatgagacctgtattgagcaatttaatgtacgaggaagatcatggaaatgaatcagaacttggtgacatccatgtttgtgcatgggtaggagcattcgatgacgcttaaaagcatgtggctgatgatgtacatatcaccatactagacaccgaagagagatctacgctgcactgggctgtggaccgtgatcatctagatgctgtgctggttattgccaactgaaatgcagacgtgaatgctcacgacatcgaaagacagacggcgctgcactac

SEQ ID NO: 47680 - DNA, 233 bp, Triticum aestivum
  Clone ID: PAT_TA_47680
actcaaactatttcttctagccggctcactaaccactgacaatgattgatatagccagcttgccaaccagacaagatgaaggagatactgcacatacagggtggacagtgtggaaaccagatcgtgtccaagttctgagaggtggtgtgtgatgagcatgggatctaccccaccaggcgcgttgtctgcacctctgtcctgcacttggagcgcgttaacgtctactacaatga

SEQ ID NO: 47681 - DNA, 385 bp, Triticum aestivum
  unsure (1)..(385): unsure at all n locations
  Clone ID: PAT_TA_47681
ctgtcccagcacgtaccgtctcggatattgcggtggacccactcgtccgcctgtgcctgctgatgctggacgccctcctcgccgacgcggctgggcacggggatacctccaggtgctcatgcagcttccacagcagccacaacgaggagcccgaccagcaccatgaccacagtcacagctgcagcagcgccatngacgatatcaatgacgagcgccaccaccactacatccaccataaccgggacaagatgcagatgttgatctccgaggaactggccaaggacgcggttatcaagctgaagggcttcgagaacaaacaccatgagcattatgatcaccatcaacaccacatgcaccgtgatttacagccataggcaacacccat

SEQ ID NO: 47682 - DNA, 134 bp, Triticum aestivum
  Clone ID: PAT_TA_47682
acccgagcgtacgcccacgcgtgcgtcctcactagcgagttcggaagcgatccgcggcggactccactggcgctatctgtgcccacgccgcacgacaacattccgttcatctgctgaggccgcgcagccaacat

SEQ ID NO: 47683 - DNA, 185 bp, Triticum aestivum
  Clone ID: PAT_TA_47683
ttgcgtgggccttctcgcctgacaaccggtgcaatggggtgcgccttgtccggctccagagatgtacacggcgggcgcgctcgtctggtgctcgaagccagcatgggaggcgcagtgcctggggtttccccgctccatcgcaggcgctggcggaaggccttggcgcctagcctccgccagctcga

SEQ ID NO: 47684 - DNA, 110 bp, Triticum aestivum
  Clone ID: PAT_TA_47684
cgcagtccatccaatggctcaacgatcaatattatgtatacgatgcgagggccacacgatcataacattcctccagctgctagatgtacaggtctgacctgacctcctcc

SEQ ID NO: 47685 - DNA, 298 bp, Triticum aestivum
  Clone ID: PAT_TA_47685
acgagcggagctgaacgacaagacgagggcggcgaccagcggcgccgacttagggcgcgcttacaccgtacagtttggcaggtgctagttaagctacaaattgaccggctgataagacctgaccaagcaatagaaagtgacgttcatgacagactacctggagatcgagtgcgaggggaaggataagttcaagtgcggatccaacgtgttatggaaatggtgaagctggtcgatctgccacgcaatatggctagagctgatgtattgtaaagcaccgcgtgtgcctagatgtccaaac

SEQ ID NO: 47686 - DNA, 225 bp, Triticum aestivum
  Clone ID: PAT_TA_47686
agcactcttacgaggtcgcgtggtaaacaatgaaagtgctatcatcacattgttggcttccacatgtgaatacagtaatagcggcgtgggctaccacgttaggatcatggttttgcaacctaccagtttccagactgctgatgatatgggttctgatccgcgtataatcaatgaaagtgctatcaacacattgttgccttctacaagccaatacagtggtggtgg

SEQ ID NO: 47687 - DNA, 284 bp, Triticum aestivum
  Clone ID: PAT_TA_47687
gacgaacaatggctttctctatgctgtctttcggtactatggctgccatctgcggctcaggccactatggtcgctcatttcaacggactgatgtcctccgctgtctttccagccaccgccacggctaacaacgacactacttgcatgacaagcaacggcgggagaggaaactgcatgcaagtgtggcctacgattgtgaagaagaagattgagactctctcttagctgtctgaccctacagattccgcatgggcttacgaagtggactaccttatccgcaacac

SEQ ID NO: 47688 - DNA, 138 bp, Triticum aestivum
  unsure (1)..(138): unsure at all n locations
  Clone ID: PAT_TA_47688
acgccatcgacttgcctggtcacagaggtacacactcttagctgctctggctgggaaatatagggacactctgagtcatgtgtgtcagtgaaagagaaggtctcacactatatggntgagtgcgctagtgtgagcctc

SEQ ID NO: 47689 - DNA, 209 bp, Triticum aestivum
  Clone ID: PAT_TA_47689
agaagatgcaccttgtggtatgacagggacgcggtaatgatgctctgtatgataaggcccattggattgctgacacgatgctacacatgctgcatcgaagagcttcatacatagtgcttaccgagccaggtctcacagtcattatcagagctgtactgaccagatcgtgcatttttcagaggatgtacaactacacgatctatgcatgc

SEQ ID NO: 47690 - DNA, 290 bp, Triticum aestivum
  Clone ID: PAT_TA_47690
atgcacattaaggagatagacagtccaagagcttcacagcaccaagtacagataccgatcaagcgatctgactaagccaacaatgatgggatcgattgagtgcgcatcaaccacagagcctaccatcacctaggtgtaattcaacgcagattactacaagagtgctagcatcattactaccaccgcatcgcagtcgatcaagcaaatctactacaatcccatgattgtgtgtcaagcagatagatgtatataagaccctgatgtatacgacttacagatgctgatgaacc

SEQ ID NO: 47691 - DNA, 261 bp, Triticum aestivum
  Clone ID: PAT_TA_47691
tcggagacatacctttgcttctacttcttcttcctactacatatcactcttgggaggatctcatattgagatcccatacaagcagcgcacgcacgagaggagacgcgctcctccctttggaaccaaaccaggcaatgggcgcggatgactatcgacacggtgtaggagttccggtcgtgaacctacagccacaacctctagatacgggtgctcagggccaagcccgtggtactatacacgtcgcatggtgcgtgggccggg

SEQ ID NO: 47692 - DNA, 271 bp, Triticum aestivum
  unsure (1)..(271): unsure at all n locations
  Clone ID: PAT_TA_47692
cggacgcgtgggatcttagtgttagtaccgattttatacggcacttagctcatgtaaaaggtatcgtgctatagaccactcatatcgatgaagcgccctgaactatttactacaaatgaaaaggcggcaccctgcccttattttaaccaatgccgaatcgtcgacctatgtataaaaaagagaactnttttggatcagaagacatatatataagaagtctatcaatatgcatttgccattaatttagttagcttttcttaatgaaattgca

SEQ ID NO: 47693 - DNA, 230 bp, Triticum aestivum
  Clone ID: PAT_TA_47693
ccggccagaccatcaccctggaggctgagtcctcgaacaccatggacttcgtcaaggccaagatccaggactaggagggcattcgcacgtaccagctgcgcgttatcttgcccagcacgcaattcgaagatggtcgaaccctcgcggattacaacatccagaaggaatccagcctacacctggtactaacgctacttgcgggaatgcaaatctgtgtgaagaccctcact

SEQ ID NO: 47694 - DNA, 120 bp, Triticum aestivum
  Clone ID: PAT_TA_47694
acggatcatgattccacggcggcttgccccaagacgcttaccaaggaggacgctacctacatacggaacaccataatcaaggactactacttccaaatgtactacgatgatctgccactg

SEQ ID NO: 47695 - DNA, 163 bp, Triticum aestivum
  Clone ID: PAT_TA_47695
ggcggctgtcagtgctcctgctgcctgacctacttgagcccataggtttagcgttggcacatagaacatgcgctgtaagggttgcgaacaggacagacactagtggggattaaaggtgcccatggaatagtgatgacgagccatttggagcctgacttttatt

SEQ ID NO: 47696 - DNA, 213 bp, Triticum aestivum
  unsure (1)..(213): unsure at all n locations
  Clone ID: PAT_TA_47696
cccacgcgtccgcctgttcctcatcttacggcgcgcatgcccaccacctgtgcgacctgctgacaccagcctgtcagcccgctatgcggcctgagcttaccttctacgccgctgcgttccagcccttatcctccgctntccggcggcgagccctatggttgctgtggcaggtcagagccaagcagcctgtggcggatgaagaggccaagaaga

SEQ ID NO: 47697 - DNA, 165 bp, Triticum aestivum
  Clone ID: PAT_TA_47697
tcgcccacgcgttcgtccacacgtccgactatgattagcgactactgcacctgcagggcgcactcgcaaattccaaagctggacctgctgccaaagtctgatccatatgactgcgcagataaggagatcgccatactgatctgacgctgacggctagtaccctgt

SEQ ID NO: 47698 - DNA, 208 bp, Triticum aestivum
  Clone ID: PAT_TA_47698
ccggattcgagatgtttaagaccgaggtatacgacaagaagcccgatttctcatagcccctgaagtgtcggccatgcgcccaagtacatgttgttagcgtgtgcctactaccgtgtgtgcccctcagtcaccctgggactggagccctggtaggcctttaccatacgaaccattgccaacatggtgcagtcctactgcaagaacaagt

SEQ ID NO: 47699 - DNA, 249 bp, Triticum aestivum
  Clone ID: PAT_TA_47699
catcgatggttaggggaatccaaaccccaaacaccatccatggcgatggcgtcctttcgctctcttcccttgggtctgctgctggccacgtgcctatcggtactcgtgctggccacagtgcactcgcggaccatacggctggagcccaccatgacgatgacgtcgcagcgagccggcgggcaggacgactatgactcctgaaggaccagtaggaccaccctcatcagcgggttctacggctactacaac

SEQ ID NO: 47700 - DNA, 303 bp, Triticum aestivum
  Clone ID: PAT_TA_47700
acgaccacgcgtgcggccactcgtccgatcgttgatcagcagcacaggcgcgcatgcaccgtttgttgcatggtcgtccaagcagcaccgagatggctgttggcttatcatccaccgtcggagcaccggcttgtacgccgaccaacttgctcgggacgaagctgacgaagcatgtgacgtcagccgggaactaccatggcgagagctccacagccaacaggttcacagccctggcaaggggaaagatcgtcgcgacgatgtacacagacaagtggaagggttttgcctacggtatgtcctacg

SEQ ID NO: 47701 - DNA, 301 bp, Triticum aestivum
  Clone ID: PAT_TA_47701
tcgaccacgcgttcgatttggcagagatctggcttaaatgcttgattccagtcacagagaaatggctgcattgcttccgatacgcatcaatcaaggttcactcagtctatatgcctactgcgaaactggattttacttacgagcatcaggaatgggtagagcacgaagcaaatgaggtggtggatccatctgtactactgtacactgaaggactgaatgcacttcatcaaatggcagagtaaaggccaatgacaggctactttgctggcaacatgaagatgcttgagttcaaacaaaacat

SEQ ID NO: 47702 - DNA, 124 bp, Triticum aestivum
  Clone ID: PAT_TA_47702
ctggtggtgcgagaattctcacttcaagagtcatagggagggacttatgtcaccgcagacagaaactatagcaggtgttggaactacagccggcgttaaagatcataagttgccttactacacc

SEQ ID NO: 47703 - DNA, 272 bp, Triticum aestivum
  Clone ID: PAT_TA_47703
ccggacggtatcctgccgtaccaggcttcaccgactggtcactgcccgtgctttagaggctgtccatatcatacacgccgactatctgcgctagcatgaattggatgcggtatgcctcggagcggaccaagatgctgctccgcatggagatcgacgaggagtccgcgacatcgacgcctgatgagcagtccttattagacaacatgaacctggactggaccactaacaccacgcagaggttgcatggacttgcgatatgcttggctgccggt

SEQ ID NO: 47704 - DNA, 340 bp, Triticum aestivum
  Clone ID: PAT_TA_47704
gcgcttgcacaacgtcgaccgccgcggctaactggtgctactcaaccgtagcgcccggtgcccggtgctccaccattgttgccagtctcggcacaagcgcaccatgaaaatcctcgtccttgcggcgcaagctgatcaggaacagccatgtgcagggcgagcccgtagaacccgcattggaatccggccggggagaggagcgcaataacagaagattagcggctggaacgccagcgccatattttatgatgagcggttggctgtgccttgcctgatgatataagaagccctgcggccccggtggggagaacaacccaggagaatccgccggaaggataga

SEQ ID NO: 47705 - DNA, 270 bp, Triticum aestivum
  Clone ID: PAT_TA_47705
tcgggtgttgcgagaattctcacttcaagagtcatagggagggacttatgtcaccgcaaacagaaactaatgcaggtggtggatctaaagctggtggtatagatcataagttgccttactacaccccagagtatgaaactaaggatactgatatgttggcagcattgcaagtaagtcctcagcctgtggctccacccgtagaagcacgggctgcagtagctgccctatcttacactggaacatggacaactgcttgggccgatggactta

SEQ ID NO: 47706 - DNA, 279 bp, Triticum aestivum
  Clone ID: PAT_TA_47706
acgcgacggaggaaaccctaacctacatcatagaagaagaccaggcggataccgatggcggcgctcagactcgcggcgaggatgctcacaagccgcagccacacgccttccgtagcttctgacaaggcgcaccgcctactctcaccaaagctctcgctggtggtgcgggctacgcccaccacatgctccgctgctgctgccagggacaccaatctgaccgcgaccaactctgcaaagcgaggctgagcatatcaggagaaactcatgagagagatccat

SEQ ID NO: 47707 - DNA, 275 bp, Triticum aestivum
  Clone ID: PAT_TA_47707
acgttcagttgcatgacttgaaggcgtgaagagctgctccaagaggtcgagcagataacatggctttctgtacaccacactccaacacatacgtgtgatgcacatgcaccaccattccatactcacgcttaacgcagaaccaagtcatattattcacgaccagaagcacttggaggagtaacacgcagcatggcacacggaccttacaggtctgatgcgcaactgagcatgcaataaagatagctctgtgcgcagactcagcatgtgggaaatac

SEQ ID NO: 47708 - DNA, 115 bp, Triticum aestivum
  Clone ID: PAT_TA_47708
cgcacgagcgtatctcaacagaggagttctaatccgcgcacgggcgtggccaccgcatccctcttatgactccacagacgtggacttggactctcttctccgacagcaaaaacgc

SEQ ID NO: 47709 - DNA, 228 bp, Triticum aestivum
  Clone ID: PAT_TA_47709
gcgcccgtcacagaccgcgcggactgtgtagcgtgtcgcgggagagaaccccagcgctttggcgtatccatggcggagggaacaggagcaacagcggcttcagggtcgacagacagcaacacgactactgcgctctgcgtggaccagagctagcacagttactacgcgctgaagtggacgctcatccacttgttgtccccagggcagcagcaacagtacgcgtctggt

SEQ ID NO: 47710 - DNA, 140 bp, Triticum aestivum
  Clone ID: PAT_TA_47710
acgcccacgcgtgcggttctggtggctgtaccgtagccgacaccgcgtcgacatacaggacagcgccatggcctaccgtgctgtggctcgaaggcggaccaagatcgtcccgggtcacacacagcatcttcatggagatc

SEQ ID NO: 47711 - DNA, 255 bp, Triticum aestivum
  Clone ID: PAT_TA_47711
tcttacgcgcgtccagccagctgaccacgagagatatttcgtgcggcccgacgaccgacgatcgccatataaaagcgaggcgatcacgcgcaccatgtcattgtcggcgctgtacccagactcgccgatgtctatcccggctgcgtgtaagatggtggagagactactctgcctactggagggagctggtcaagagcaccagctgtattcggaccactggttcacgcagcaccagatctacgaggacctctccta

SEQ ID NO: 47712 - DNA, 189 bp, Triticum aestivum
  Clone ID: PAT_TA_47712
ccctctcgtcctcgccgtgcgatcttacgtgtatcgttcctccggccgccatggacccctacaagtaccggccgtctagctccttcaacgctgcgatgaggagcactaactcaggggcgcatgtctgggacaactacaactgcatgactgtcagatgccgaggtaaaatcctgattgaggactaccacc

SEQ ID NO: 47713 - DNA, 221 bp, Triticum aestivum
  Clone ID: PAT_TA_47713
atctatctatccacaacccaaaccataaccctcgaatctaaacaaccagtcggcggccatggcgcactgttctgcaagcggaatgggcacgcagggcggtctccccactgaccggacgccaagcgacagtgccgccggcgacaagaaggacaagaagttaaagccccccaacagaccggtccccatggggcgcaagcagtggaaacagagggggccctatg

SEQ ID NO: 47714 - DNA, 355 bp, Triticum aestivum
  Clone ID: PAT_TA_47714
ataagggaggggcggcccattcacatttacatatatagtcgtgttgttgttgacccatttccgcaatggcatctcactattgatccttcgtaggagagagcgcttaaaccttaacaccatgcgtggagaagatcatacaaccttcagacacaaggagggaaatggattgcacgatgtctacaggatcagcacacagatctgaggatgtgcagagtgttccagactacttatacggcgaacggcaagggtgtggcgatctgtatgaccgtctagcagcaataattgacccatctgaaagccaatattttcggggtgttcttctaaaccacaaacagttccttccagaatgtccttt

SEQ ID NO: 47715 - DNA, 102 bp, Triticum aestivum
  Clone ID: PAT_TA_47715
accacgcgtctgccaacgcgtacgatccaaccgcaacggccgcctagcacccaacacgatgctgtcgcgagcgcgggcaagtctacaccttcggtcgctccg

SEQ ID NO: 47716 - DNA, 142 bp, Triticum aestivum
  Clone ID: PAT_TA_47716
gctccggcagccgggccgtcactatgtctggctggtcacggcggttgtcgccttcatatgtctggctcgtcacctcgcttcatcccttcacggtaccgggtcagaagaacaaaagacatatacttgcttcacgctcaaaaga

SEQ ID NO: 47717 - DNA, 261 bp, Triticum aestivum
  Clone ID: PAT_TA_47717
acgtccacgcgttcgcgtcaaagacgagggtagcacctgatctgcttgcctccagaaacaatggcatgtgctactattgtgaagtcacgtttcattcctaagaaggccaaatggggagccactcgcaaggctgccgtcccaaagccgacgaccgtgtgcatggttgtacgtgccaaagcatacgccgatgagcttgtcaaaaccgcgaaaaccatgagatcgacaggcacgggtatactagacatggatgagtcgaacgcc

SEQ ID NO: 47718 - DNA, 142 bp, Triticum aestivum
  Clone ID: PAT_TA_47718
gagaccacgcttcccgtacagacagacagatcttgagagagcggacgccagacgcgaacgtgcattatcacctctacggataggagcccgacgtagctgtccttctctttcttggcgcgggaaggtgatgaacgacctgccg

SEQ ID NO: 47719 - DNA, 163 bp, Triticum aestivum
  Clone ID: PAT_TA_47719
acggtgagattgatgcaacacagctgtagtgccaattctaaccaacatgagatacaacgctgccaacatctgtatcagccctgatgtgaccacagaggagccacggtatggatttgaggacgagtacactctcctacagaaggacatcaacgggcctatgggc

SEQ ID NO: 47720 - DNA, 367 bp, Triticum aestivum
  Clone ID: PAT_TA_47720
cttcgattgttttcagaaccttcctgcatgactttgtttcttggcttttataccggcgcggttctaatctactctgcgtctagaatgccaaagagaatggatcaatatcagtgttgcagtgcgaaggaatatatctgctgcacacgaatgccggaagaagcgctcgtgtggtataggactacactcggttgggcactgacagcctaactgtcgtagacactgagatacatgagccgctccatgggcatacgcaggatgctgcatggaccagctacacatgtggtggagatggctgaaacgaattgctcatctgcaggtggtgcacacatcattgaatgccccttgtcagttgtgaacatcttaactt

SEQ ID NO: 47721 - DNA, 263 bp, Triticum aestivum
  Clone ID: PAT_TA_47721
ggtccacaaccacacccaaattttatagaagaacggccgccgacggcgatggagttttctggatgaattgtcaacaacagggatggaattttccccctgttctttggcctgtaaggggggaaagaccttaccttcttcagaacttttggaaaggccagccgtaaccttccccaaaaccgggtgaaaggccaagccgggttgttcagcaatccccggttacgggtcaacacccgtgttttacttagggcgattttccggggacc

SEQ ID NO: 47722 - DNA, 157 bp, Triticum aestivum
  Clone ID: PAT_TA_47722
caaggcggtggacgccgagtgaaaaaaaaagtgcacgcgctagtagacgagaaatacgtttctcgagcacgcgcgagcaaatccgtaacatgcatctgcgaagacgggatggcagcgatgaacattgatctgcgaggattggcaagcatgcctacta

SEQ ID NO: 47723 - DNA, 177 bp, Triticum aestivum
  Clone ID: PAT_TA_47723
cctgtgcctgctgatgctggccgccctcctcgccgacgcggctgggcacggggatacctccaggtgctcatgcagcttccacagcagccacaaagaggagcccgacgagcaccatgaccacagtcacagctgcagcggcgccatagacgatatcaatgacgagcgccaccaccacca

SEQ ID NO: 47724 - DNA, 212 bp, Triticum aestivum
  Clone ID: PAT_TA_47724
tcgtttggatatggtgattgcagctgctaccgactgctgcagccatggcgaagccgatatcgatagaggcgcggaacccatgcgggaagtaccgtgtggtgagcacctaattcatgcccagcacccgctggatcaaggtactgactaacaaagaatgccgtctggagatatgctcggggaactaaaccatgatctctgttgatgacatactg

SEQ ID NO: 47725 - DNA, 179 bp, Triticum aestivum
  Clone ID: PAT_TA_47725
ctgcgcatggtttcacccggagcacgcgagggcgccagctgcgcctgcgctacgacaggaccggagaggcactcaagacttgcgtgtgacgagcgacaactactgctgcgcacaagcgcgcgaagagccacagaccgtgccgagcagcaacggcgatcacaatcaggaggctaaggatc

SEQ ID NO: 47726 - DNA, 223 bp, Triticum aestivum
  Clone ID: PAT_TA_47726
acgtgagatccagctgacaacccgtggaagcaaacaatggccgctcgctctcgcgccgtctcctgcgtcagcagcacgccgcactgttccgggctcctgccgtcgcggcgcgcaggaccacgcagcgccgtgccactatcgtcaatgaggagcacgcggccggcggacaggatggcgacggtagcacgttcggtagtcgacgtgccctgggagggcaacacgt

SEQ ID NO: 47727 - DNA, 170 bp, Triticum aestivum
  Clone ID: PAT_TA_47727
gctggtccgcgcgctgtacgtctcggccgactcggatggcctccgccctctgcgccccgggtgcctacgacgtagtagccatccgatgcacggagttcggaggaggaatgatcgaagggaggaccctatgcccatatcgaatcctctcgaagaagaatactgtccacata

SEQ ID NO: 47728 - DNA, 155 bp, Triticum aestivum
  Clone ID: PAT_TA_47728
gacacgagcgaagccgacacgcaatagtaatcagagtcccaaacccgagggggccgcataacaaccgaaggcgttggagccgacaccacacgagagcaccacacgcgtcggcgtatagacgagacggtggatcgtcacgcaacgggatatcacgc

SEQ ID NO: 47729 - DNA, 160 bp, Triticum aestivum
  Clone ID: PAT_TA_47729
acggctccagcccccgaccaaccggcgacgtcgcagtcatgctgcacacgaagcgctaggtatcttcctatctgatcgcatccacgccgagctatatacccgcatccaatcccaacgacgccgagccagtagctcgctcccattcacgccggcgacgact

SEQ ID NO: 47730 - DNA, 250 bp, Triticum aestivum
  Clone ID: PAT_TA_47730
ggtactcgcatggcgagttaaataatgcgatcccagcagaagcccgttgtcataagcaatatcgagtccatatgcacgcctacataccatgttcgccgatcccatacatactgacacagatggtggagtcgccatgttgactcgatcactggcctcattgaaacgccatggtgaactagtatacgtgctctgccctgagatagatcaaactatgctggtggggcatattaataaaaggatagacatgcaa

SEQ ID NO: 47731 - DNA, 176 bp, Triticum aestivum
  Clone ID: PAT_TA_47731
gcggaactgccacgtgccgtactactgtgacatcttgggtgctgagtgcactttgctatatctcagaccgtactgctgggaatctgggtgctgagtgcactttgctatagtgcagagccgctctgctggtcatctaaactacgagtagcactgtgctatccaatggtgtctaaact

SEQ ID NO: 47732 - DNA, 244 bp, Triticum aestivum
  Clone ID: PAT_TA_47732
gcgctcttactcctgattgaaccgcccgacgatggatcccgtagtcgggactggcccgcggtacgccctatctcgtggcctacaccagccgccggtgagggcgatctgtcggcgtacaacgcgggcgagcaaaagactgtagaatgctgatggccaccgctagctcgagactgaacaatgcgctggtctagcaatctcccgagggtgagcgatacgtaagagtcgagaacatgcactacacctg

SEQ ID NO: 47733 - DNA, 285 bp, Triticum aestivum
  Clone ID: PAT_TA_47733
gagttccttgctccgttcctccctcctttctctggagctaggcgaaccgatgctactgctactcgctggtagggagggcaagagaggcgatggcaaggcaggggaggtgaggaatgatattgatgctccagacggcgacgctcatggtggtcttcgacgttgcacactgcaacgccgagccccttatttatttcggtgccgtgcactgggggtactttaagcgagtcaacttcttcgcgcaagtagcaaggctaaatggataacagattccagaaaaattacatg

SEQ ID NO: 47734 - DNA, 405 bp, Triticum aestivum
  Clone ID: PAT_TA_47734
ctccatttctctctgaagcagacactcaaacgcacacagagcgggcgctactgagctgctatcagttttgactggatttgagctcccttgaccaaaagatcccaggaacttctatggaggtggcagctatggcggactctactgccaaggttcaaaatgctgaaacaaccagaacatacttgcatatgctgatgtagaattgcagtcactggtttgtagttgggcgctgtcatctttgatagtgacacggcgatagactgccttggagggaaagagctagttgaggaattgagtgatagagacctgggaactccaacaaggatttaagcaatgtatgggctcctccgctgaaggcaactccctttgctcttgcacactctaggcatttgacgcggtatggaagtg

SEQ ID NO: 47735 - DNA, 412 bp, Triticum aestivum
  Clone ID: PAT_TA_47735
tatgaaagtataattatagctagtgcaaggtgttatacatgccctttcaaagtataagtagcatcacatggacgttaaagtgagaataattgaagaccaacaaccccatcagacattctttatggccatctaggaaatcttccctcagtcagagtcatctgatactatcccacataaatgggaactcgcaatccacatgacctccaacatacaaacttccgccagctggatgcctcaagtccacagaaccttgattcttacaaccaaagcaatgtccattgtcatcagaatccaaaggcttgcagcaaagaacatcacacagttcttcttcgtctgggatcacttcagcaaataatagaacagtggaaccagcctgcttagctgtaaagttgaagtgttcatagaagttcat

SEQ ID NO: 47736 - DNA, 323 bp, Triticum aestivum
  unsure (1)..(323): unsure at all n locations
  Clone ID: PAT_TA_47736
caacccgactcaccaccgcgcctcttcctcctcccgctcacccacccatggcgacggctatgatggctgcagccaccacctcctgctccccgcgccgagcgctcctcaagcccgcggcctcctccagctccgcaccgccgcccaggccgcagtctcggttcttcctcaagcagatcctggggctcgccgctgacttcggcagcggcggccgacgtctccgtgcctatcccggctgctggccgtggtgatggagatggcggctctgttctactttaacctgacactcctggcgatcacgattgagtntctgctgctgatggttg

SEQ ID NO: 47737 - DNA, 221 bp, Triticum aestivum
  Clone ID: PAT_TA_47737
tccgccaaccgttccgaccccccaaaacaaaattaagttaattttacttgaccttagccgaaggtgaattccttccggccgtcccggggaccaaggccccccggccttaacaacttaccggggtggctgtttcttgggggggttccggccgggttcaaacaggcctgtgaaggcactatggaaattttttaagggtatccccgggcccacagggggaaagg

SEQ ID NO: 47738 - DNA, 470 bp, Triticum aestivum
  Clone ID: PAT_TA_47738
ccagggcacaactcctgtcaaaactcaccacttccaccaatactgtggccagaataatcaggatgttggattggacaagtccaaaggataaaactatcagattatatgccacaaaggtcaccgctgaacttgcgaaggacctccgtgttgtcgccttccccggcacaatgcagactgtatctgcacttcttgacgctgatagcagcccaaagagaggaaatccacttctggacacagatgatgaacaagaagaaaggcaagatcaatttctgaagacagaagatagccaagagcaagaacatcatacagtaagggacgtagctgttaaccaatcgcaaagacaagacccacttcaagacaccaattacctgctcgaggaaacacaaacacgctcgacccaacaacctttggtcgacaaaaagaactcttacataatcagatgctggcagcggattaaagaattacattca

SEQ ID NO: 47739 - DNA, 191 bp, Triticum aestivum
  unsure (1)..(191): unsure at all n locations
  Clone ID: PAT_TA_47739
tgcacacctgcgcactcacctgatctctcaacttttgtctgaagcaatggctgaagtagttgcggcgaacattctnacgaacatgctcaactccagcgtaaacttcagcgaagccataaggggtccaacagctggagcaaataatagcgcacacatgattgattgcttcaatgataagttcatgaagaagc

SEQ ID NO: 47740 - DNA, 241 bp, Triticum aestivum
  Clone ID: PAT_TA_47740
tcggtggctctagaagccacgctaccagctcaggaacacaaggcgcgatctggctcgcgaggctatgaaagcgtccgagcagttggctaacggagcccggaacgactcgtacttggggaagggtgggaggcggacaaatatgagtgtgagccacgggatactattcatgagccaataaacctcacgctacgaagacaaggtgtgactacgccgcttcttccggtcaaggtggaggaggagg

SEQ ID NO: 47741 - DNA, 475 bp, Triticum aestivum
  Clone ID: PAT_TA_47741
cgagaaaaaatgagttggtggtgggctggcgccatcggagctgccaagaagaaactcgacgaagatgaaccatcacaaagcttcgagagcgtcgctctcatcatcggcgttactggaatcgtcggaaacagcttggcggagattctccctctttccgacacacccggtggtccatggaaagtctacggcgtcgctcgtcgtcctcgtcctacctggaacgccgatcatccgatcgattacatccagtgcgatgtctccgacgccgaagacacaagatccaagctttcccctttaaccgatgtcacacatgtcttctacgtcacctggaccaatcgtgaatcggaaagtgaaaactgtgaagcaaatggctcaatgctccgtaacgttctccaagcgattatcccatacgcgccaaatctccgacatgtttgtcttcagacagggacaaagcactaccttgggccttttaccaacg

SEQ ID NO: 47742 - DNA, 274 bp, Triticum aestivum
  Clone ID: PAT_TA_47742
taaaacacacgacgacccataccacccatatatggtccaagtggtacgggctaaggaacgtgaattagctccttctgccgcactacacaaaaagcggtgttgtaagggccgttctgtccttagcgggtaaggaaacgcattgctgtgatcaaagtgaagctgcttaagcttacgtggttggctgagacgctctgcagatcatcactttccttagacagagtggagaggtttgtcacatgtggtcaagagtgataataaagggtcgagtactgtg

SEQ ID NO: 47743 - DNA, 329 bp, Triticum aestivum
  Clone ID: PAT_TA_47743
cccacgcattgggcgtgttattgagagaagagttattggaagagacatagggaggcacttacgtcacctcaaacagatgctgaagcaagagctggatttaaagatggtgaataggattattactcgacttactacgccactaaggatgctgctatcgatactgatatcttggcaggatctcaagttggtgctcagcctgaggaagcacccgctgaagcaggtgctgcatcttctgccgaatcatgtactgctgcatggactgctggacggactgatggacttaccagcctaggtcgatgctaacgactatgctctgacattgagcctga

SEQ ID NO: 47744 - DNA, 416 bp, Triticum aestivum
  Clone ID: PAT_TA_47744
gcggcgccacggacccggcggcggtggcggacggcgacgaggcgaccacggccacggccaaggccacggcgccgtcgaggccgcccaccaggaagggcaagaagaagtcgatgcggcgggcgccgagcgcgacggcgcggctgcggacgctctccttcgacgacctgtcccgcacgctggccttgtcggggatgcacgcgttcaccgtcgccgagctgcgggccgccacgcgcaacttctccggcagccactttatcggggagggcgggttcgggccggtctacaagggcttccttgacgacaaggtggtgccggggatgcagccgcaacacgtggccggtaagtatttggacgccgagggcctcgaaggccaccgcgagtggcttggcgaggtgggctaccttggcatgcagctt

SEQ ID NO: 47745 - DNA, 377 bp, Triticum aestivum
  Clone ID: PAT_TA_47745
cactcttctccctcgccaatagaagccgccgccgccgccgcagcagcaacagcaggcgagcgagatggtgtttgtgaagaaccagaagaccagggcctactccaagcgcttccaagtgaagttcaagagaaggagacaggggaagaccgattacagggccaggctcaggctcaccaaccaagacaagaacaagtacaatacacccaagtaccggtttgttgtacgatttgtatccttgagttgttcattgtcacgttttgcactggttaatcgtctattcatctccattggggttatctatggccatagtttttattactagtagatggatattgtatctcttaacaatagtaccttagaccaacaaagatgtcact

SEQ ID NO: 47746 - DNA, 449 bp, Triticum aestivum
  Clone ID: PAT_TA_47746
ctccttcctccaatcgcccccgctggtagctaccatctcaagcgttctcgccgtcgattgttgtttctggtggggaagtgcgagggagcggaggcggcgatggcgagcggcggcggggcggtgagggaggtggggtcgaaggcggagctggacgaggcggtcggcggcgcgcgggccgacgcggtgcacttctgggcggcctggtgcgaggcctccaagcagatggacgaggtcttcgcccacctcgccgtcgacttcccccacgcgctcttcctcagggttgaagctgaagaacaaccggaaatttcagaggcatatggtgttacagcagtgccatactttgttttctgcaaggaaggcaaacctgttgataccttggagggtgcaacccatccagcctggccaataaggtcgcaaagttagctggccctgccaatgttgctgagtct

SEQ ID NO: 47747 - DNA, 435 bp, Triticum aestivum
  Clone ID: PAT_TA_47747
gtcattaaccgctccgcaaagctcttcatcgtccacaagctgaccccgaatggccggctcctccaaatccctccccatcgcaacatcaacaacagtagcgtgagattccatggattcattccacgccgtcgtttccgtgttgcttccccggcccagctcctccctctgtctcccctctcccacaccttctcttggattagtctcgcgctcccgagaggtcaggaggagaaaagtcacagtccaactctctcgccatctctctttttaacgcctgtccaggtctcgccgccattgcgtcagggactctctcggaaccccggttcttgccatactcgcaggtctgcttcgtctgccggggctcccgtcgaggtcgatcctgccatcctggttgagcatcattgagttaaagagaacatgtttcggaaaaagcaagct

SEQ ID NO: 47748 - DNA, 416 bp, Triticum aestivum
  Clone ID: PAT_TA_47748
ccctcccggcgccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggccttccaagattgcatcaaccactacggaagcga

SEQ ID NO: 47749 - DNA, 312 bp, Triticum aestivum
  Clone ID: PAT_TA_47749
gtcagagttgctaattgagcagttgtggcgagggaccatgctcaccacggacagagcctagagcgggacggggatcctgcgcttgtggtacagtaacctagactcggctgactacaccgtcttagtatgactgctgaggactactgatatctccggcggcatcccgagtcagtcctcacgctctggttgcgaccgaccaagcaggcgctcgagtatctgctccatctcttactcgcacatgagcaactgaatggactgatggacttaccagacttgatcgttacagacgactatgctatcacatcgagcctg

SEQ ID NO: 47750 - DNA, 353 bp, Triticum aestivum
  Clone ID: PAT_TA_47750
cccacgcgtccgggacgaggtcaccgccatggtcgagtccgtccaccgcgccgccgccggccccggtaatgaaggaaagccattggtagtgaggaatcaccttgctatggtgtccttcaacaatataacaaggctagcttttgggaagcggttcatgaatgcaaatggtgacattgacgaagaagggcaggagttcaagattattgtcaacaatggtatcaaaattggtgcatctctctctgttgctgaatacatttggtacttgagatggctgtgtccacttaatgaggagctttacaagacccacaatgagaggagggatcgtctgaccaagaagatcattgaagagcatg

SEQ ID NO: 47751 - DNA, 367 bp, Triticum aestivum
  unsure (1)..(367): unsure at all n locations
  Clone ID: PAT_TA_47751
cccacgcgtccgcccccgctccatcctccaccgactatgccaccgtcgtgctaccgaacgtcgaccgacgataaatcggatatgctcttgttcccatgattgccaggggagttatgcttggtgcagaccagcctgttattctgcatatgctggatattgaatttgctgctgaagctcttaaaggcgtcaagatggaattgatctatgccgcatttccacttctcaagggagttgttgcaacaactgatgttggtgaggcttgcactgtngngaatgttgcggtaatggttagttggattccacaggaaggaaggtatggaaaggaatgatgatatgactaaatatgtttcaatttacaaagctcaag

SEQ ID NO: 47752 - DNA, 355 bp, Triticum aestivum
  Clone ID: PAT_TA_47752
ctgcagtgcgccgagtccgtcaactccgacgacctcgacgaggcccagcgcgccctgctggagatcgcggagctggccaccccgttcggcacctccacgcagcgcgtcgccgcctacttcgcggaggccatgtcggcccgcctcgtcagctcctgcctcggcctctacgcgccgctccccaacgcgtcgtcccccgccgcgtcccgcctcgtcaactcgcgcgtcgccgcggcgttccaggtgttcaacggcatcagccccttcgtcaagttctcccacttcacggcgaaccaggccatccaggaggcgttcgagcgggaggaccgcgtccacatcgtggacctcgacatcatgc

SEQ ID NO: 47753 - DNA, 336 bp, Triticum aestivum
  Clone ID: PAT_TA_47753
atgtgccgtcttgtttactccaggagagctcaaaagttgtggaggacggatgccctgagtgtgccgtcagtttcagccctctgcacaagtcaatcaagcagctggagaaggcggccatgaaaattcacatggagaagaaggtatgtgaacaaaaattcgactggaaagcagctttcaccgaaatttccagctataaaacttgcactctcctcatgacaatacgtgctgcaagcagagaaatggggcctaaacacgagggaacgcacactgaaagtcagagagatgaacgaccgcttgaccgcttgatgatgggagagcgagccttcaccaacagag

SEQ ID NO: 47754 - DNA, 431 bp, Triticum aestivum
  Clone ID: PAT_TA_47754
gcaccgccatgagctacctcctctcctacatctccaagatgctctgcatcaggacgccgtcctcgtcggaggaggcggcggcgaagcgtccggcggccggcgaggagtgctgcgtctgcctctcgaggatccgcgccggcgaggccacgcggcggctgccctgcgagcacgccttccaccgggactgcgtcgaccggtggctcgcgctctgcaagcggacctgcccgctctgccgggtgtacgtcgccgacggcaacggcggcggaaggcaggccgcggccaagcacgccggcgagggcgccctggccgacgacctcgtcatctggttctccaccatgctcgtcccagggttctgagacgacgatccaaggatgatgtttctttttgctcttcgctccctcgggttattttctcctttgaaatgatggcga

SEQ ID NO: 47755 - DNA, 331 bp, Triticum aestivum
  Clone ID: PAT_TA_47755
cgagatgagaggtggggcgctcgtctctccgggctccggcgacggggccgtgccaggcagcagcggagtgtccgccccatcatgttgtgtttagtaagtgaccgaatcgtgagcccgtgaccgggagcgaccaaaccggaatcgcaatcctcctaatttgggtccgacctaaccgtcgccactcgctcgctccaaaccctagctagctacctacctcgcgccgccgtctccggcgccctcggcccttccgctccgtcaaaccgccggtggctgcgcgaggttcccctccccagcgtggcgctcttcagcatcgccgcccaccccgagggcg

SEQ ID NO: 47756 - DNA, 367 bp, Triticum aestivum
  Clone ID: PAT_TA_47756
gcgccttgtacttgtgcgtacattcatccatccatgggaaccatggaggagaagccggcccttggcttggggagcctcgtgaggcagtctgaaggtggtgtacaagagcgtcagtaccagtactctgccctggaggcggtcgcagctcaaggggctcatcaggctcctgacggagaaggaggaggagatcttcaacccgctccacgacgacctggtcaagccccggactgaatccttaatagacgaggtccgtgttgtcgtcaagtccatcaagcacacgcttgaaaacctcgagagatgggccgctcctgagaaggctcctacaccgttggtttcctttccggcgacggcgttagtgctgccggag

SEQ ID NO: 47757 - DNA, 192 bp, Triticum aestivum
  Clone ID: PAT_TA_47757
cccggggcggccggcgcgtactacatggtgctcacgtgtgcgtacggttcttgtttcacctttgagaggaatgtcatggggggactgggtaattcagtcttgggcgataccaagatacaatttttattatggattgaactgggataaggaagcatttaattacctggttgtgaaggtaatatgtgaagctaa

SEQ ID NO: 47758 - DNA, 157 bp, Triticum aestivum
  Clone ID: PAT_TA_47758
aacggcgctagcctaaacagcgtcagcaacggtggaaggatcacgttcatgcatgtgtggcccatcgagggcatcaagaagttagagaccctgacttacctgccaccggtcatcacggaggccctttcttaagcatatggactaccttgatccgctc

SEQ ID NO: 47759 - DNA, 176 bp, Triticum aestivum
  Clone ID: PAT_TA_47759
gtgagaattcttaattcaagagttatagggagggacttatgtcaccacaaactgaaactaaagcggggggtggatttaaagctggtgtggaggattataaattgacttactacacctcagagtatgaaactaaggtttctgtaattttggcagcaatctgagtaagttcttaacct

SEQ ID NO: 47760 - DNA, 170 bp, Triticum aestivum
  Clone ID: PAT_TA_47760
gcgggacaaaggattgattttatttcgatccttccatcatatattagcggtcctgaggcaaccaagatattggctctttttccatcagtggagaaggcagccaagtcttcataagcagtgatacttgcagaatcatgcttcttgagcaataaggccattgacagtatctt

SEQ ID NO: 47761 - DNA, 325 bp, Triticum aestivum
  Clone ID: PAT_TA_47761
tggcgcttgaacataggtttgaggtgcttgctagcttcaactggacgaggacggcgacctacggagtatggcaagaattgttgtgcagttgaaggtcatgtacccctgatgttcttcaggagtttttctctgtgcaaccttacatgctacaggcacacattgtttctatacattggtacttttgcatatttgggtgctcgattaattatattcaaactaaattttagtttaactgtcattgcttagtactagattgcttatgtttacggtttatttattttgtagaggatattttgtttcaaagatggatagggttctaacaatg

SEQ ID NO: 47762 - DNA, 474 bp, Triticum aestivum
  Clone ID: PAT_TA_47762
ggctcagtctccattgcccagtctgtcaaaatccagttctaaactagctaaactgtgccctcggggcaatttagacgtctcaaactaaagcaactcgagttgcggtggtggtccgcaactccatcaccgtcttcctcgtcaggagcatccgccgctgctgctcgccgtctgtccacggcaccggtgttggtctccttctcaccttccgtgctctcttcccatcccgcctcccactgccgccaccactgctcgaggatgccctgtggatttggatttttcacaatcggtacacagtaaagtacttttggattggccgggcggtgagctgcagtgccgctagctcgtcgacgacggctacgcgccatctgtggcgtcccttggttctttctcctcgacatcgaccttcttgacggtatggtcttcctcctcttcccctcccttaatttctatggttttaagttggttcagtagttt

SEQ ID NO: 47763 - DNA, 458 bp, Triticum aestivum
  Clone ID: PAT_TA_47763
tcggaagcaactgagcccatgattaaagagctagaagaagaaagggaggaatcacaagatcctgaaattgaatttgccatatcaggtgctgttagggaatgtggaggtctggaaattatattaagcatgattcagagcctacgtgatgacgagttaagatctaaccaggatgagttggcttcagttcttaaccttctcaagtattgatgcaaaatccgtgaaaatagatgtgccttactacgtctgggtgcccttggtttgctacttgagacagccaggcgcgcgttctcagtagatgcaatggaacctgccgagggtattctattaattgaagaaagccttacattggaagctaatgcggtgacataagtatcttgcaaagagtattttacaactaagtggtgaggagactggagcgtgtgagcaggccaaaaaaattgttctcatgtttttggaga

SEQ ID NO: 47764 - DNA, 455 bp, Triticum aestivum
  Clone ID: PAT_TA_47764
cccacgcgtccgcccacgcgtccgtcctcatccaccgccaccgcctccgctccctcgccgcctccccgcggctcccggaccgcccccgccctcgcctccaccgccccgtctcggcctccgccgcgcccaacgggtcctcctccgcgggggagtacgactacgacctcttcaccatcggcgccgggagcggcggcgtgcgggcctcgcgcttcgccaccaccctctacggcgcccgcgccgccatctgcgagatgcccttctccaccatctccgcggacgacctcggcggcctcggggggacatgtgtgcttcgtgggtgcgttcccaagaaactgttagtgtatgcatccaagttctctatgagtttgaagagtctcatggctttggatggacatatgatactgatccaaaacatgacttgggcactctgatagcccaacaaaatacagagctgc

SEQ ID NO: 47765 - DNA, 314 bp, Triticum aestivum
  Clone ID: PAT_TA_47765
tcgcgcccagccgcagccttaaaagagcacgtcgagatgagctctggtacggggaaggtggtgtgcgtgaccggggccttttgctacatgggctggtggctcgataagttcctctctccatcgcggatacaccgtccgctcctccttctggtacaccgcttacctaaagaaaacattgcacctgcttgcctctggatggagcctaggacaggctgtacttggtcaaagctggcttgttgtatgaaggctttttctatgatgcctgcttcggctgttaattgtgtcatccacactgtctatactttttattacag

SEQ ID NO: 47766 - DNA, 142 bp, Triticum aestivum
  Clone ID: PAT_TA_47766
tgggagcaaaaagaattcgccttcacattcttactgatgggcgttatgttttgcatggcagtaggtgttttttttgtagtgacagttgatatacattttgctcacatttacatgcaaggtgatgatgcattaattgcatttt

SEQ ID NO: 47767 - DNA, 257 bp, Triticum aestivum
  Clone ID: PAT_TA_47767
gagagacatcagcttccgtacatggactgctactgactgacctactaccgttactggaagagggggcccttgctctcgccgactgggccgtaccgcatgaaacagcggaacatacacagccactactgcgaaagggcaatgccgtcgagacccacatggaacatgtattgccgatccaaccacaactacttccatgcctcggcgaaacgacgaggaggtgctggcgcacgacaacctcaaggaccactacatgcact

SEQ ID NO: 47768 - DNA, 476 bp, Triticum aestivum
  Clone ID: PAT_TA_47768
cggacgcgtggggtccaatccagccccccctccgatctcgccgagaaatctcctccgatcgaagcgaagccaaggctctctcgtcctcctccccaagatgcagatcttcgtgaagacccttaccggcaagaccatcacccttgaggtcgagtcctctgacaccatcgacaacgtcaaggcaaagatccaggacaaggagggcattcccccggaccagcagcgtctcatctttgctggcaagcagctcgaggatggccgcacccttgcggactacaacatccagaaggagtccaccctccacctggtgctcaggctccgtggtggcatgcagatcttcgtcaagaccctcacgggcaagaccatccactggaggttgagtcctcggacaccatcgataacgtgaaggccaagatccaggacaaggagggcattcctccggaccagcagcgcctgatctttgctggcaagcagcttga

SEQ ID NO: 47769 - DNA, 413 bp, Triticum aestivum
  Clone ID: PAT_TA_47769
tcgtggatttaaagcttgtgttaaagagtttaaattgtcttactacaccccagagtatgaaactaaggttactgatatctgggcagcattccgtgtaagttcttattctggggtttcgaccgaagaagcaggtgctgcagcagctgtcgaatcttctactgttacatggacaattgtttggactgatggacttaccagtcttgatcgttacaaaggacgatgctattacatctagcctgtatgctggtgaagacagccaatggatcttgttaagtagcttatccattagacctatttgaagagggttttgttactaacatgtttactttcattgtaagtaacctatttgttttcataatctttgtgctttacgtttggatgatgctctaatttcctttttttatttaaaaact

SEQ ID NO: 47770 - DNA, 114 bp, Triticum aestivum
  Clone ID: PAT_TA_47770
atagcacataggtaactgaaaaatctgaaatactccctccgtcccataatataagagcgttttttacactagtgtactgttaaaaacgctcttatattatgggacggagggagt

SEQ ID NO: 47771 - DNA, 260 bp, Triticum aestivum
  Clone ID: PAT_TA_47771
attccagctctttcctaaggagcgccaggacgttcctctgcggcaataactggacatgcaactggactgtaagacgggaaaagagggtggtcaacactatgaactctagacacatgatgtgtacgggtggacaacaggtgtgactaactccacactatggtttccttcaaaggtaaagggtaagctgtgggcaagattacacatttatgtttagaagcgatcgaccaagaacgtattttctttcaccgggtactgcaagg

SEQ ID NO: 47772 - DNA, 172 bp, Triticum aestivum
  Clone ID: PAT_TA_47772
tcgagaattgttggtctactcgttacgggaggtattaaatcatggactacctgactgaggggcttgatgagtacggtgcagacgcacaccatttcaggcgcaatgtgaatgactatccctcactcaagggcggttcagtagtgtatttcatgagtggatatgaccatgagtt

SEQ ID NO: 47773 - DNA, 348 bp, Triticum aestivum
  Clone ID: PAT_TA_47773
gacacatttaagtttatgcctgcgacatagtctagtcataaagggatgggaacaaggcatcaagacgatgaagaaaggtaacaatgctgttttcaccattcctaacgaattggcttatggtgaatctgctttacctccaactattcgcgccaacgccacgctgcagatcgatgttgagctgctttcttggaccagtgacagggacatgtgcaaagatggcggcatattcatgaagatattggtggatggagataaatgggcgaactcaaaaggacactgagaagtatttgtgataaataaggcttgcctaaaagatggtactgttggtgtccagtttgagggggctga

SEQ ID NO: 47774 - DNA, 149 bp, Triticum aestivum
  Clone ID: PAT_TA_47774
atcaccgccatgcagcatgaggctgccagttctctatcacttactacaccatctaagcgagccgagatgcatacgtatactacggaccttcgcttcacctttagttttttaaagaaaaacaaccataacgtatccagtgcggtcatgtt

SEQ ID NO: 47775 - DNA, 242 bp, Triticum aestivum
  Clone ID: PAT_TA_47775
atcactgtcattcagcatgaggctgccatctccctatcacttactacactatctaatcgagcggatttgcatacgtaggctaaggcctttgtctatactctgagttttttaaaggtagacatccagggagtatccgatgcggtcttgttaaagatactggtggtgttctcgagatttcactagtatccaaaatagattaatgaaccgccctacaacctaaaatttggtcgtccggcatttac

SEQ ID NO: 47776 - DNA, 434 bp, Triticum aestivum
  Clone ID: PAT_TA_47776
agtcgagcaagatgttggacgccttgaggtcgcggaagatgaccggcgtgtcggcgccgtggaggaaggcgaggcccttggcggcgccgacggcgatcttcatcctcgtcatccacggcatggggccgtcgatgcttctgaagaggtgcttctccaggctggcggtgcccatgtactcgtaggccagcatccggtgctcctcctcgtagcagtacccgacgagcttcaccaggttcctgtgcctcagttgcccaaggaagaacacctccgcctgcagaatcaatcatggagaagttagttggcgcaataatggaggtattttattcgacagctcatgcatccgtacgtgcaacaacaatggtggagtcagtgggtcgacttaccagccactccttatggcccttgcgagcttgagtcgaggtcgaggtacttga

SEQ ID NO: 47777 - DNA, 479 bp, Triticum aestivum
  Clone ID: PAT_TA_47777
tgctgactgttcctgtggggactctgtaaacgagccatacgttgtagctcataattgcttattggctcatacctcagctgtgtcactatacagaagaaagtatcaggtactatcttttcgctagcaaattagtactatggtatttctaaagtgctttcttgatagttagatccacattgttatcatgaaccatcaatggagtagtctgtgatataattgtcaaggtatttgagattagaataaattattgttttgaataattggtctgctccaaaaagaaaaatctgaatgctatctttgttgccgatattctgtgctaattattgtcccttggactttagatatagctggagtatttttcctaaggacgctaaaagcaccatgtttcatttgaaatcggttatatccatggacaaaaaatatactttgtgctgcagacaaagcaacacggacttattggcatgaatatatgtataaat

SEQ ID NO: 47778 - DNA, 267 bp, Triticum aestivum
  Clone ID: PAT_TA_47778
cccacgcgttcgctgagacgactaatccaaccaaaaataagcaacgcctccgacctgtctagtgggggggaagcaaggcaaaggaagagtacagtatcgttttatgaattccttttcaagccgttgcgtttgatgagaatgaaattggtcctgccaaggcctaggccccaacaaattactgggagggtatgacaacgggtctgaaagattctgctactgtgaaagccgtgctacaggattcaactttcttctcttaacattcctgtg

SEQ ID NO: 47779 - DNA, 365 bp, Triticum aestivum
  Clone ID: PAT_TA_47779
atggcttcttccacggacaccgtcgtcgatctattctacgatatctcaccgacgcccgtgggagccatagaggtctgtaagagagggccggctactataactagcttcaaactctcgctccaggccactacggatacaatactgtccgacaccacggactctagtcggtgcctagagcggcaaggtcgcatatgagcgatacgctgacccttaagagaatgatagcggagcttcggcgtcgtaaggcacgcaggcgagctatacagacaaaatggccggtgacattttagtttagattgcaagggcagaatcgtcacaagcaccgcactgagaagcagctcacgcgtttatggagaatggacaac

SEQ ID NO: 47780 - DNA, 355 bp, Triticum aestivum
  Clone ID: PAT_TA_47780
gagaaacacagagcaagaagataagagagaagcaaagcttgagatggcgcaaaccatggcgtccatgagccgcctgtcgcagggcgtgcgtctcccaggcccggccggcaggcgcgccagcaggttcaccgtgagggcgtcgtcagcggaggccgaggccgccggccgccgcgcggtccttggcctcatggccagcggagtcgtcgggagcgcgttcgctcaggtggtgcacgccggcaccggcgcggccatcaaggttggccccccgccgccgatcttcggtggactccccggaacggacaacttggacgaggcaagggacttcgacctgcccctgaagaaccggttctacctg

SEQ ID NO: 47781 - DNA, 460 bp, Triticum aestivum
  Clone ID: PAT_TA_47781
cggagatcctcggatcaatcccgccttctccgtccaccgcccgccggaagaagaaagaaagcatatttgcttctcgccgccgccgccggtgagggaggaaggaaggaaggaaggaagcaggggatcccactgggtgttgccggtttggagccagtgatgagctgcctcacgttccgccgctccgccgccgacgccagccgcctccaggacggcctcctcgtcttcatgttcttcatctcgattcccatacgtagtctgaataccaatcgtactagtagtaattccagtattattactagtagcatcagcaatcttctcttgtaaacaaacgtacgccggtcgtgctcgcggttgcgttcgcgcggacggaggggtcctctttttctgctgctgctccgtctgaatcttcttcttcttctcgccggttgacggtcgcgacggcggccatggatcccaacag

SEQ ID NO: 47782 - DNA, 179 bp, Triticum aestivum
  Clone ID: PAT_TA_47782
cgagcttagacagctaacaagtggttgatttcaccgacctagtacatatctgcacctgcacgaaggggaattgattgactggcggccatctaacacaacatgtgcccgtaatgtgtatatataagaatcaatggagtggagccaatgctctcagtagggaaaataattgtgagacgctc

SEQ ID NO: 47783 - DNA, 155 bp, Triticum aestivum
  Clone ID: PAT_TA_47783
cccacgcgttcggtcgagacgcgaccgaaagaggagagagccatcatccatgggaggaggcgtgatgcgctccgtcgcgaagggcggcctctctgtaggctccgcggttgcatcgtaactctttcacatcgtcgacctttgcttaggcatggacc

SEQ ID NO: 47784 - DNA, 255 bp, Triticum aestivum
  Clone ID: PAT_TA_47784
caacctcatcgagcagctcgggctcacgacatcaaggaacacgtacatcggggacgagggcacgaggggcgtgtccggcggagagcgccggcgcgtctcgatcggcgtggacatcatccacgggccggcgctgctgttcctcgacgagccgacgtcggggctcgactcgacgagcgcgcacagcgtgatcgagaaggtgcacgacatcgcgtgcgcagggagcaccgtggtgctgaccatccaccagccgtcgtc

SEQ ID NO: 47785 - DNA, 178 bp, Triticum aestivum
  Clone ID: PAT_TA_47785
agctaagctgaacacgcaccttatctctcaactatgagctgaggcaatggcgactctcggggggactaagatgctgggggcccggcacaacttcatcggatctctgcaagtatgccacaacggcaccaactggtggcgcacagaaaagtgtctacctgtatgatcgctttaagaagaa

SEQ ID NO: 47786 - DNA, 246 bp, Triticum aestivum
  Clone ID: PAT_TA_47786
catgattgctttttgagcttgtcggtatgttaggcatgtctgcggctgtcactgcaactgtatagcccgactgtgcaaccgcggcggttttcataacgatggccgtgaacacgcgatgcttacacgtgaggaataggacgcacaataggatggggaccaatatcatggtggagataggtacgaagaaccgcaaccggcgagcacccctacacgacggccccggcgtgtacgatgcgcttatttata

SEQ ID NO: 47787 - DNA, 441 bp, Triticum aestivum
  Clone ID: PAT_TA_47787
cagaaatcaaacgcacgataatccctcccaccaagagttggcttggctaccgtcaaaaaaaaaaagagtaggcttggctgggagcagccatgagcatgctggggagtgtgattgcatgtgccgtggggaaacaaatcttgagcaagctttcgtccgagatcactttgcagtgcgggtacagagagaaggtgctgtagatggaggagaagatgaaaggagtagaggccttgctaggcgatgccgacaacaggtctcgtcgacaaggccaatgaggtggaagagtgtttcagagttggctcaccaagttgaagcatgcctgctacgacatggaggacgtgctggatgagctggacgccaacaagctcatcaacaatacccaacctagggtaactaactcctctgctatctacatatgcgacttcgcatctacgctagggtacg

SEQ ID NO: 47788 - DNA, 345 bp, Triticum aestivum
  Clone ID: PAT_TA_47788
cacacgcacccgatccgatcttccccctctgactgcacagctatggaccgcacgttattagaggggggcaactggaaatgcaatggaactaaacaacaggtagagagcatcgttcataccatggacgctcgacagatagcctctacggatgttgccaacgggctctgataggcccacctatgtatttcttaccacagcatggggctcgttgcgcccagagatccaaggtactgctcagacctggtctgtggaaaagggcgacgctttcaccgagcaagtcagtgctgaggatgcttgtccacctaaggggcacctgtgtcataccaagacacttctgaaggagga

SEQ ID NO: 47789 - DNA, 181 bp, Triticum aestivum
  Clone ID: PAT_TA_47789
tccctccaatagatgcgagcggcccaacttcttttatgtctatgctggcaccaaaaatcacatcgccggcggcgaccgattttactaaactacaattaactcgggatttctggacaccggtttgacacaacagattatagcatccattggttacgagagacatatgatcataaccacgctg

SEQ ID NO: 47790 - DNA, 319 bp, Triticum aestivum
  Clone ID: PAT_TA_47790
agttcaacagcgcgaccatacatacatttcgccgccaagaatattcaagggatccaaccaagagagctagtagttaacaatggcgtatgtggggttcggcagcagcgtggcggccggggctccggcaagcgaggacgagccttatgcgccgcagcggacgcggctgcgggcgccggcgacggcgccgcgtcggaataaaggtgcccaggcttcgaccgcgtttcgttgggagttctactttcggccagaagcttgtgggtgtttggtatcttatgcttcaatcatggtactgaggcgtgctgtcacgcgtgatctgagt

SEQ ID NO: 47791 - DNA, 404 bp, Triticum aestivum
  unsure (1)..(404): unsure at all n locations
  Clone ID: PAT_TA_47791
ctgcacacaggggctctccttggttgctcgttcttcttccttccactcgcattttgcatcggtgagttcccacctccccacgcaggttagtgctctccgttgagtctacaacttatcatcgcagatctctccttattcctactgtacatctccatatccctgctgtgcacgtatggcagtggcaccataatagctcgaactggttcgtcataaactgttcgtctttatactgttttatagatatgctttgtgcaaagctcgattcgtttactggcgagaaccaagaaagagctgagcagttaaactgctcataaatctgtaccgacgcttattatcttatctgtataaacttgcagctagttcttttacttttacatncgggggaagcaataacatggcggatg

SEQ ID NO: 47792 - DNA, 485 bp, Triticum aestivum
  Clone ID: PAT_TA_47792
cgctacacgatgctgctagaagtgcttccgacattgagcttaccgagccacgtctcagtccaattatcagagctgtactgaccagaaggtgcattagctagagcatgaagaactccacgacctatgccgcaaccatcaccatcccaattgcgctctgctttatgcttactgccttgctctgaaactcggaccgcgatcccttcatggtccttatcatggccattatcaatggaggtgctatccttacaacgtccatggacagaagcaacccatttcccttgccctacagctgggagctcaacgaaatcttcgacgctgttgttgccctcggagcctaccttgccctgatgactgtcgtcttctctgtggttatccacaagacaaacttcttgacaaacaaattcggtgtcaggttaatcaccgacagcgagtttgatatgatgtctgcactgtaccttccagtgagccttgtaagccaggctctt

SEQ ID NO: 47793 - DNA, 302 bp, Triticum aestivum
  Clone ID: PAT_TA_47793
acggtgcaacgaaaaaagtatcaagaacagagataggagaatcgatggctacgttcgcgacgtcgacggcggcggtgatgggatcggctcgcccggggcgggtggccgggcctcggcggtgcgtggtggcgcgggcgtcctcgacgatggcggcaccggcggccctggcgacgggaaggacgcactacgatgtgctcggcgtgagcgccggggccagcaggggggagatcaaggcggcgtaccggcgtcgggccaaggaggggcacccggacccttgttgtggcgtcagcgaccaggggttc

SEQ ID NO: 47794 - DNA, 487 bp, Triticum aestivum
  Clone ID: PAT_TA_47794
aagaaatggttgcaaggtgggaaaattcgatgtccactgaaggattatctgagattgacacatgtcctgagttccagaattttaccggagatgtcatcgcgagaacatcatttggtagcaattatcaggaagggaagaaaatattcgagctgcaaggggagttagctaaacgactaatgcaggcttttcagacattttttatcccaggctattggttcttaccaacaaaaaataatagaaggatgagagcaattgatcatgagatccgcatgattatgcgaggcattattggaaaaaaagaaagagctattaaaaatggtgaagccagcagcaatgacttgctaggattgctgttggagtcaaatatgcaacaatcaaatgggaaggcaggccaaggaatgagtattgatgatataattgaggaatgcaagctgttttactttgcaggtatggagacaacatcggtcttgctcacatggacactaat

SEQ ID NO: 47795 - DNA, 304 bp, Triticum aestivum
  Clone ID: PAT_TA_47795
cgctcgcagggcggcagacgggcgcgaggccggccacgtaccacacctccacagtgggcgagggacaccatggagcgtcgccggagccgctcgccgtcggcgaccgccgccggagcccttctctgcctggcggtgctggtggtcggggtgctgctgcccgctgcgtcggcggacggctgcccggccggcggcgagcaggggaggagccgtcatcgtcgggagcagctgtgggtgtttggcgactcgtacgcggacacgggcaacctggggaacctggggcgggagctgacccacgcttggtacg

SEQ ID NO: 47796 - DNA, 398 bp, Triticum aestivum
  Clone ID: PAT_TA_47796
ccgccctacccgattccttatcgacccacgcgatccgtgagaattcttaattcaagagttatagggcgggacttatgttatcaaaaacagaaactaaagcgggggttgattttaaagcctgcgataaagattataaatctgacttactacacctcaaagtattaaactaatgatactgatatcttgacagcattccgagtaagtcctcaagctggggttcctccctaagaagcagggcctgtagtagctgtcgaaaattctactggtacactgacaaacttttggactgatggacttaccaagtttgatcgttacaaaggacgatgctatcacatcaagcctttatgtgtggaagacaaccaacggatctgttatgtagcttattcattaaacctatt

SEQ ID NO: 47797 - DNA, 166 bp, Triticum aestivum
  Clone ID: PAT_TA_47797
cggacgcgtgggcagacatattaaatggtcactatcgaagatgagcattattctcgactcgatgcggactaatctactggggccttgtgatagcattagccgcggtaacatcatattcatggcctgagctgtgaatggaggcatgttgttactggcgtggactatt

SEQ ID NO: 47798 - DNA, 295 bp, Triticum aestivum
  Clone ID: PAT_TA_47798
aaaaccggatcggagggggccccccctttttttagctagaaggaacaagatggtttttttgccacccaaatccaaaaaacacccgggaggggcaagcccaatacacactggcagagcatcaatataagatgactggcaaccgaaaaagctgcccaattattcattttattacagggggcatggaaaattaaacacacaaaattttatttgggccgtcttttgagagcgaatgagccttttttttaccggccatgccactaacatggttttttttctggcctctttggcgcgtccc

SEQ ID NO: 47799 - DNA, 388 bp, Triticum aestivum
  unsure (1)..(388): unsure at all n locations
  Clone ID: PAT_TA_47799
cctaaattcccnttacgacccacagcattcctctacatcttctgatttatcactgatcaccagcacagccgttcatccaccggtgctagcaagggcgagcgagcagtacagagatggctgttgcctttacctccaccgtcggggccccggcttctacgtctaccaacttcctcgggaagaagcttaagaagcatgtgacctctgacgtgaactaccatggcaagagcttcaaggccaacaggttcacggtcatggtagaggaaaacattgtcgagaagaggaacaccgacaagtggtagggtcttgcggacgaaatctccgacgaccagcatgatatcaccatgagggaagggcattgtggactcccttttacaggcgcctactggcg

SEQ ID NO: 47800 - DNA, 360 bp, Triticum aestivum
  Clone ID: PAT_TA_47800
ctcaaatcctttgacgtggccagacagatccttatttctggcagagtccagtctcgtaagcaggctggcaatcttcagcatccactcgtctgtatcgatgctgtcgaagaaggtatagtttcagggccacgagccggtcttcggaaggaagccatggcttttcaggaactttttttctgatttacatgcaaaagcttgattcatgtgttcttttcacaacgtgcgacatcaaaggttcctggggtcacatacttaagtttgttgccaaggaaagtatctaaagttgccattgttggtggttgacctatgggttttagtgatcgaaccacgctgattctaagccatttttctgttattctc

SEQ ID NO: 47801 - DNA, 276 bp, Triticum aestivum
  unsure (1)..(276): unsure at all n locations
  Clone ID: PAT_TA_47801
gngcctgctcacgctcctactgtacatggatatctacatggtggaccgcagcctgatgcgtcaggggcgacacgagcttgcttctttccagaggctcaagtccaccggctgggtcatggtcagccgatacttacacggcgatagtctggactgatgctgcaacggtgggagggtcaggtgcatgcatgtgaggcccattcaggggatagggaagtctgagaccctgtttaacctgccacagatcagcacgggaggacctgctcaagggtggcggac

SEQ ID NO: 47802 - DNA, 337 bp, Triticum aestivum
  Clone ID: PAT_TA_47802
ctctccccatacatatctgtatatacctagccataccctacacacacagcgaaggagggggtggacatattgaagcatgcgacgtacgtgtccggcgactagtcacgcaaaggcgcgcgttgcttaggcgagggcttgcgccagtactacctgctatacatgcacgagctgcagctgcagatccgtcagaagacgcacaacctgaaccgtgtcgaggcccagcgcaacgacgtcaactgcccaggtagaatgcttatggtagagctacagttactccatgatcctggctattatgttggtgaggaggataatgacaaggtcaaaacaaaggtgctag

SEQ ID NO: 47803 - DNA, 445 bp, Triticum aestivum
  Clone ID: PAT_TA_47803
gaaattaggcgctttttttggggagaaattttgtgatgctatatattttctgcaatctatattactagcttacatgctttaagaaggagattttaatctgtggccgtgtatgatgaaaaaagaatgttaattgctaatgttttattttagaaaaccaaatctgcaccatgccgatatgcttcatgatgagtgtgcttttagcatccttcaccctctcaggttagtgttttggcccttttaatagttttttattttccttgctcgcgccagattgtaggtctgcatattcctatatatgtgttttattgtttagtgatgcgtcactgcatcaaccttgcagatggccattaggtgccgaccaagaggtgcatcccatgaatcaaactgcaatggggcatacaataattaggagggcatggctatcgctgcggagctaccctccccc

SEQ ID NO: 47804 - DNA, 184 bp, Triticum aestivum
  Clone ID: PAT_TA_47804
tcactatggatacaacgacaccgtcccaggtgtgctatggaactcaccaccgcacgtctcaaacgcagcagcgggtgcccatcgactgcggtggggctaccgtggtcagaggccactcgtaccacatggccagttgcacaactaggtgggcgttaacgcctactttgctccggacaccgcgctt

SEQ ID NO: 47805 - DNA, 410 bp, Triticum aestivum
  unsure (1)..(410): unsure at all n locations
  Clone ID: PAT_TA_47805
atcgctagaagagaactcagaaagcttaaaatggctgcaagagatacagaaaatctgaaggtggagaaggagaaacttgaggaacacgtggaagagctaacaagccgtttaggtttggaaatgaaactgagggctgacttagagaacagcaaagcaggagaaatctccaaattacaggctgcccttcgtgagatggagcatcgagtagaagaagccacagcagtgcaggaaagtgaatcagccaaaagggctgttgaagaagctctagctcaagaaagagaaaaaatcactatattgactaatgaagttgaggggatcaaggtactactatcaagagaacgangagaaaacacttgcaacaaagatgatcttgctattgctcangaaagatgtgaagaccttgatggaaa

SEQ ID NO: 47806 - DNA, 393 bp, Triticum aestivum
  Clone ID: PAT_TA_47806
ccgatccgttggcttcctgttcatacattctcccctcccggcgccgcctccagcctagggtttcctcccgccgtccgccgccatggctcgccgcagcggaggaggaaggtcttcccgccctgctccacgtgctgctccagtgagaaacccaccagcgccagcccgtcaagctcctccacctgctactacccagaatagcggtggtggtatcatgagtggaattgggtccaccattgctcagggcatggctttcggtactggcagtgccatggcgcacagggctgttgatgctgtgatgggtccccgcaccattcaacatgagactgttgtcggtgaggctgctgcatctatgactccaatggacaatgctgctgatgacagtgtggcaaccct

SEQ ID NO: 47807 - DNA, 264 bp, Triticum aestivum
  Clone ID: PAT_TA_47807
ctcactctttctttaagaagtgagggttctgctattggttcaataaatgcaaatgacaccactgcttggatcattgctatgctacaggacagatcaatcgaccggagccggacgcattataaacctagccactgaggattcggagtaagacaccattcgtattttgccaaaccataatgctcttccacgtgcaaaacgcaaccgtcgctaatcgatgaagagatgtgtatagcgcagatggcgttgcttaatccaactgcaact

SEQ ID NO: 47808 - DNA, 320 bp, Triticum aestivum
  Clone ID: PAT_TA_47808
ccacacccacctttccctctatgcggaggcgctcgtgggttgtgcctccgcgggctgacggcgctacaactactgctaggatagcccatcgctacaaacgcttcagccggatgcgtacttaggtaggagacagcgcacccgtggcggtctacctgagggattgcgagattgaaccggtggactggccgtgcatggtgatgaccgtaggggtagtccacgcgctttagctgaaggacgcaaaggcacttatcgactctgtcgagacgtgcatatctgactgcgttgttgtgatttcgaaggtcgacctgatgatcgacggc

SEQ ID NO: 47809 - DNA, 351 bp, Triticum aestivum
  Clone ID: PAT_TA_47809
agctcagccccgagtgatggcggcatgtgcagctgcttacccgggaggggaagggggacgaaaatatcttggccggggtggcacgtaggcgggcggcatggctcccgcgcggcagccattgatggccgcacgcgcagggcaggtggcgggcaggcggccgccatgaccacggtggatgggtgccgtcagcagagcctcgccttcgccacgaagaaaagaaagagagcgaggcaaggcgggcgccggaggcaagccgaacctaccgcctccgcacgcgaattcaatgcgccggtcaacgggttgttggcgccataaagtcgccctctttcccgtccccctcccctcttcttt

SEQ ID NO: 47810 - DNA, 400 bp, Triticum aestivum
  Clone ID: PAT_TA_47810
cccacgcgtccgcccacgcgtccgctcaccgtgtgctgtacatgcttgtgtagtagtatatgcagtgcaggggtgcccggcaggctagtggtcggtagtgcggccaccactccggcccagacaacgcgtgcgcgtgtccaagaacgcctttccccccggctcacacgacagtggtgaatccaccatccgctcgtcacacggtgcgtgcctcacttctctcccttgcaggggagaatcctctgctccgcggcgacgagctccggcggtttgggggtgcgttgcgcgcgcgcatgcagcagatggccaccaccgtcacgctgcttgctcgggcagcctcgttcccccgtgatggcgccgcgcgggacggcgtccagtgctcccgcatgttgccctaggagga

SEQ ID NO: 47811 - DNA, 462 bp, Triticum aestivum
  Clone ID: PAT_TA_47811
gtccccctcccctccctcctcaaggcctatgacgcattccctcgaacaccttgcccgccccctcccattcttgaccctaaacctaaacccgtcttcttcggcagagtcccacggcggcccatctcccctcctccagcccgacggcgcgatcctcggccagggcgtctgcaaccacttcgtccgcacgggaacatgcaagtttggggatgcatgcaggtacttccatccgaagccacatgctgtgaacccggcattagctccgtctgggcctgttccaggagcaatggggcaacagtctaattgtcttggaactcaaccaaattttgttggatatccggcgtgggaaggaaattctttctcaggaaacatactaacaggccacacttcatggggcaacttacctccatcgctgcaacctccccctgaaggtggctatcctccacttccgtttgtcgactgggg

SEQ ID NO: 47812 - DNA, 413 bp, Triticum aestivum
  Clone ID: PAT_TA_47812
cttggaactgcgcaagcgtctttcctttgacaagcttgagactcttcatttttttgggtccaaactatggagacagccattgctaacgtgtttacaaagcagttgcttaatttcaatactatggtctctcaactttcatgagcaattgcttgaattaatattatgaatcctaaagaaaatcttgatgcagatggtaaaacattctggtcaaggtgaagctgcatcggagactgtcgaattttgcttacgagctctggaagattttgacttggcactacatgaatcaccaagcaatgggtcagcatctattgaagccatgaggagcaaaatcattgacatcattgaagctttggacaatatcttgcaaattgtgccattaaagctgatgccgaaaggaaggatgctcggagatg

SEQ ID NO: 47813 - DNA, 262 bp, Triticum aestivum
  Clone ID: PAT_TA_47813
cccacgcgtccgcccacgcgtccgcgcccgcgcttgcccgctccccttcataccacacacgccccgagcgcgagcctcctagccagcctctcgcctcgccatgcactccgtctccatctccgcctcggcctccgtactcggcgatcgccagcggaggctccagatccaaggcggcggcggggcgcctgcccggcgagatccggatctgcgggctacgtggcgatgctctcgcgtgcggctcggtgcgggcggtgcatgcctt

SEQ ID NO: 47814 - DNA, 478 bp, Triticum aestivum
  Clone ID: PAT_TA_47814
gaaatctaggacaagcaagggagctgctaggcgctagctgcttacttagccttggttgagagcaacgaatcgagccagatttcacgccttcctagctcgcccctagcagacacacatcgtgtcagctttcacgttgctggttgggaggcgaggtgaggagggtgagaggttcagggggaagagatcagtggtctcggagatgggtcgcggcaaggtggtgctgcagcggatcgagaacaagatcagccgccaggtgacgttcgccaagcgccgcaacggcctgctcaagaaggcctacgagctctccctcctctgcgacgccgaggtcgcgctcgtcctcttctcccacgccggccgcctctaccagttctcctcctcatccaacatgcttaagaccctcgagaggtaccagaggtacatttttgcttcccaagatgctgccgtgccaactagagatgagaagcagaacaactatctg

SEQ ID NO: 47815 - DNA, 407 bp, Triticum aestivum
  Clone ID: PAT_TA_47815
aaatgatggaggagcggcttgcctcccacaagagagctccgaggaagccgaagccgccgccgaggcggaccaagccgaccgtccccgccgcacctaccagcagcccgtcgttgaccggcccgccacgcccgccaggcgttccaccgccacctgggcctcctccgcggctgcctggaggccctgtcccgccggcgccgtctatgaaagtgcccggaaagggccgtgcgcctgtggctgtgggcggcggtggcgaaagaatgcgccgcgcgcccgagatcgtggagttctaccagtccctgaccaggcgcggcgaggccaggcaggctggctcccgaggccccaaggcgtccggcgggtcaacggctcccaagagcgacctgatcggggagatcaccaagaactccccc

SEQ ID NO: 47816 - DNA, 185 bp, Triticum aestivum
  Clone ID: PAT_TA_47816
atctgttttccttggaagacggacaattcttcttttatccattaccatggcaacaagggcggggcctttgacctaatggccatgggattggatggaacagtttcaattacctattacttggctctccgcagctgttaacactgctcacagtgtggcgaccaacgtatgtggagacatgatcctat

SEQ ID NO: 47817 - DNA, 328 bp, Triticum aestivum
  Clone ID: PAT_TA_47817
gccccttccctggctggctacatcattgactacgagttcacccttgagctggcgcttaagctggggggggggctgcatatatttgtgcagacccttaccgagacgaccatcaccctggaggtggagctatatgtcaccatatacgacgccatggccaacatccaggacaaggtgggcatcacggcggaccatcagcgtttcaagtttggtgtcatacatgttgaggatgggctctcggttgcggactacatcatcgagaacgagttcacccatgagttgatgctcaagctgcgggttgggctgcatagttttgtcaagacccttaccg

SEQ ID NO: 47818 - DNA, 178 bp, Triticum aestivum
  Clone ID: PAT_TA_47818
ttcatttggcttccaccatcctttcatgccctgaatgagaccaggaggagctcctgtggcggactttatgatgcctattgcttatcaaggtcaacatccactgagaccaactgttatgtgagctggtgctggaggaatcgcaccactacatgcatatgggtgagcagctagatgatgg

SEQ ID NO: 47819 - DNA, 153 bp, Triticum aestivum
  Clone ID: PAT_TA_47819
tccgtttcgactccacgcgtccgctgacgcatgggcagactcatggtttcttatgcaccctcacccttattcttcgctctcctttgagtgggatcgcttagatcaacagaaggggaggaaaacatagccaagcttgtaagctcgccaggtaaa

SEQ ID NO: 47820 - DNA, 406 bp, Triticum aestivum
  Clone ID: PAT_TA_47820
cccacgcgtccgctgcagcagctcaagggcatgctggggctgcagcacttcaccacctccaccgacgtagtctacgtcatgcgctcggtattgtaccaaacacaccaatggcaatgggagagcgcggtgctcggctgggatttcctcttcttactacgtgtcacccaatgcttcatgaagaggcagcgctggtttttcctgttattccacgtcgtgcaatgatggaggctatgatcagcagacgtcaccgtcacctttcccaccgccaggaccttggagcttcccatcattgcgtacaccagcggcggcacgaatcttgagtagaggcccatgatgggcggcatgtttgcgagcttggcgtaattgatgccctgttgatggctaggctggcaatggtgataccgga

SEQ ID NO: 47821 - DNA, 454 bp, Triticum aestivum
  Clone ID: PAT_TA_47821
cgccgccgccggctgttcctcacactcttgcggatcctcgcgccgacgctacgtcagcgaccagtccctgctagccccccacccgagcctgcttcgccgcccctcgtctccagaccagctccgccggtgatggcgaccgagcagccgtcggagaagaagaagccgccgccggagaagaaggccccgctccccaaggtggtcacgctcaacaaggcgctcaagttggtccagacatgggtggacggaatgagtgcgctggagccggaggaactgaacgataaagatttcgagggtcggccgtcagggcttggtcttggtgcgagagtggcgccaaatgcgaagcgggcagctcccactgatccagtggagaggaggtgctcggaaaggtgaatgcgcagaagaggaagtctgcggaggaggataaaataaatacccagggggtgggggcgagcga

SEQ ID NO: 47822 - DNA, 310 bp, Triticum aestivum
  Clone ID: PAT_TA_47822
cgccctcgtcggctgtacctaacactcttgcggattctcgcgcctacgctacgtcagcgaccagttcctgctatgccctccacccgagcctgcttctccgcccctcgtgttcagaccagcttcgccggagatggcgaccgatcagccgtcgtaaaaaaagaagccgccgccggagaagaaggccctgctcctcatagagttctcgctcaacaaggcgcttaagtgggtccagacatgggtggacggaatgagcgcgctggtgccggaggaactgaacgatagatattcggagggatcggcgatggggctt

SEQ ID NO: 47823 - DNA, 125 bp, Triticum aestivum
  Clone ID: PAT_TA_47823
gttcatccatgggagcggtcaagcagttcttactgaagaaattttccatggtgctgataacagctgaactgcttaggctcacctagagatacgattaacaacgctgtagtcacggcgcctgatta

SEQ ID NO: 47824 - DNA, 248 bp, Triticum aestivum
  Clone ID: PAT_TA_47824
gatatatgagagaatcacagtacacgacgataacatcgaagcacagctcgggaggcgacataccatggcgctcatgaccgctctgtgctagggcgatgcgtgtcccatacccgggcgacaagcgcgccagcaagctcaccctgagggcgtcctcaccgaacgccgaagccggcggtcatctcgcgggccttggccgtatggtcagccgagatcacgggtgcgcgttccctcatggggcactcgccgaa

SEQ ID NO: 47825 - DNA, 356 bp, Triticum aestivum
  Clone ID: PAT_TA_47825
agttcatctctgtgagctcggatgctgtcccatccaccagggaaatggccgggttggcgctggacgagacgaccagctttgtcggcaccgtcccggggtgtgatgacctcgttcgtagcgtcggtggctctggggggcgtgtgaccatgcgccggaccgtcctgagcgcgcctcagagcatctggttcggtcctgaccgtcccacggacctggtcccgttattccagcaggcgcacgtggtcctgaccgtctatgtcgccgggtactacggtggggacaccggcggattgtcgggtgtcgccagagaccttcgacaagaaccggttgctggacgtgatccactcacggcgggcgag

SEQ ID NO: 47826 - DNA, 213 bp, Triticum aestivum
  Clone ID: PAT_TA_47826
ttaacgcatacacgtgggcttagctcgttggaccatatccaacctaaataatggcgcctttcatggtgacggttgacatgtgaggcgtgcatggactccaaattcctctggaggacgcccaaggatgtgcaggtcataccatgcgtaccagtgcggcacgagatgctcccaggcgtgctttgcggtagtcccctacttctgcttcatcttgtg

SEQ ID NO: 47827 - DNA, 441 bp, Triticum aestivum
  Clone ID: PAT_TA_47827
accacgcgtacgagtacagatatggagcccaccgtgatggcctctgaagtcacctccgccgatgctttccaggggctcagggacaccgtcggcctcaccctcagcctgcgcttgaacggcgctagcctcggcagcctcagcaacggtggaaggatcaggtgcatgcatgagcggcccatggagggcattaagaatgacgggaccctgcattaccttccaccagtcaaaagaggcgcccttcttaagcaggatggctacctgatcccgtacaagtgggtgcgtcgcctgctgctgagcaaggatcagttcatgttccttgagcaccacgcatttcctggggactacgatgggcggtattggacactgtggaagctgcctatgtgcggggcactgactccacacaggtgatcaacgaggtggaggacgtcaagaaggagtacc

SEQ ID NO: 47828 - DNA, 297 bp, Triticum aestivum
  Clone ID: PAT_TA_47828
agcgtttgctcttctttgctgatccacgctgctatgcccgaaaccggcttacccgctgcatctggtgccccaatccgcggaggctgaggcagctgcggattctatcagctactacacgatggtatatcggctgacctgctggacgaaaggtgagcaccatgatcaacatggactacccggctaccctcatggagtcgacaagggtgtacatgcagaagattcagggagcatttgctaaggttgacaaccagaacgctgttaacatggacagtaagtggaagcaactccaggaccatt

SEQ ID NO: 47829 - DNA, 444 bp, Triticum aestivum
  Clone ID: PAT_TA_47829
gcctgctgtaccggacctataacttccggatgcgcgcacccgtacgcgcccgcgccccgtaccctttccaccgtcccgtctcgtctgctcatcatcggccggccgccatgtcgtgcgacggcgacgaggaagagcgccccgtcggcggtgttaccccgacgctgccgcctccggtgaaagtgaaaagcgaatcccccgacgaggtcgattagaagatggggccattctatgccgactccgacgaggtgattgtgaaggtcgaggcccacggtgaggccgaggtcaagagggagcgaatccatgccgaccatggcgaggtgaaggtcgaagccgccggccaggtcaaggtaaagagggagccaaccgaagcggactccgacaaggtgaagattgaatatcccgccgagggccaggcccatatcaagagggaggcaagcgatgccg

SEQ ID NO: 47830 - DNA, 399 bp, Triticum aestivum
  unsure (1)..(399): unsure at all n locations
  Clone ID: PAT_TA_47830
acgcccacccgttcgggactacttgcattatggcgcgtccacccggataaaggagctaccgcgtgcgggataacaccaatgactgcccaggcgaatgccgtgcacaagggagatgagcgagatccaacgggccagacctagcccacgcgctcttggggccacgactgttctctgttgtaggcaagaccgttgacgataaaacccttgacgttngcattccagtcatcgagaaactgtatggcgagaaatggagtcaagaggatggtgtgggacggattattgtgtctgctactaatgatttatgtgctcaaatttaggaagcgggcagaaaagtaggcaagcaccataactttagtggttgggctatcgataagcgcactgttcttggtgctcgagaaa

SEQ ID NO: 47831 - DNA, 334 bp, Triticum aestivum
  Clone ID: PAT_TA_47831
gacaccccacaccacgcacatagagatgctagtacagccgatctgacagagctgctcggatagacgcacacattgacactcatgctggccgtcgtggtagacggatcgggggaaacatcgagggggacaagaaggaggagatggtggagagcgtggtgcagcgcggggtcccgctcgtggtcccgctcgtgatcgggcacgtgatcgaccacgtcgtgcacccgttggcgctgcgggtggccctcccgttcagcgacgcgtccaacggctgggacctcgggtgcgacctcatggccgaccccattggcgatccggtcggcggccaggacatgcg

SEQ ID NO: 47832 - DNA, 377 bp, Triticum aestivum
  Clone ID: PAT_TA_47832
cccacgcgtccgaccacaccaaggtaccgtctatgagcagcaaggggaggaggttgtcggaacgagctggcggctgacggtcttctctttcagaggtaactgtttaaccggcttctgctgcctgtcatgaccacgtcgaggtgctcccgccagtccgtcaccgtcgacagtggatatctcaaccccgcacccgagcaaaacgataatactcctctgggcctggggtacaaagcatcactgacatacgcagacggaacacgaggaggtggctgacggtaacacgctccgctactgcccgatccacgaggagaacaaaaagaccatcgagcagatggggcaggactacctacagaccctgcacggcttctactacgacc

SEQ ID NO: 47833 - DNA, 479 bp, Triticum aestivum
  Clone ID: PAT_TA_47833
ctgttttttgccaacagctagagcaggtagggagatgaagatggcaaagaaaacaggagttgatgagcctttagtgcagtaccgccgtgttggtagtacacacgagagaaatgcaattccaaaacaagtatgggagagaatggatactcggaaaaagactggcttaaatgacacagataatatgtcaggatcagttgacaatgtcgagtcacccaaaccagtggaatgtgataccagtggatgtgaaaagcttgacacaggacgtgaaccactagaccaagcttttgaaaggtccactgatgtttgtaaatcagaaacagatcagccatatggacagcgtgaggaaaatcaatctgcttgttctgatggaactcctatgacgaataaacaaaaatgccactcaacaaataatgaaggttctaagccagacgaagagctcatgacgaactctgccagttctgatggctcatcttcatgta

SEQ ID NO: 47834 - DNA, 477 bp, Triticum aestivum
  Clone ID: PAT_TA_47834
cccacgcgtccgaaacgatgtacacattgcacatctggatgaccgatcaaaaccaagtttgttatccatggcaagactggaccgtgtttaaaacatgacaggactagtggatgcttatagtaaaaatgctatgctaaggacgatgataaaccttgttgtgcgcgctggctacaacaatgtggagaaatgaacggatagagacgagatcgcagacatagagaagatgcatgaacttattaagacatataacttgtttgggcaggtccgctggatctctgtccagactaacagggctcgcatcggtgagctggatcgctacattgttgatactaatggcgcctttgggcacccagatatggatgaagcatttgagctcactgtggcggaagccatgacctgcggactatctacttttgcaacactctatggggggcctggccggattatagagcacgggatctctggttcgcacattga

SEQ ID NO: 47835 - DNA, 142 bp, Triticum aestivum
  Clone ID: PAT_TA_47835
cgccatgctgccctactgctcctcacccgagcccaccccatactccctgcacagcctattgaccgccggggcgcgatctttgtgggggcattatattttacattcattaccttccaatatctgtcttctttgatttactatc

SEQ ID NO: 47836 - DNA, 120 bp, Triticum aestivum
  Clone ID: PAT_TA_47836
tccccactcgttcgcgcacgcgtccggttgttagggcggctgcgtgagaagagaaccgcatgttacggaggtactagtcgctgtggcgagagcatggaaggcgccggcgacttcaccttt

SEQ ID NO: 47837 - DNA, 477 bp, Triticum aestivum
  Clone ID: PAT_TA_47837
caatttcattgctggttgaaattgctttgcgcctaaccaaagatggtgaaaaagtaaagtcaaatgccgttagagcccttggatatctgtcaaggtttatcagattcaatcatcattgtgatgcagtcgatgattcaaggaattcagttttctatggagatcctgtctgtcttcaaacaatggtacaggctttgatgtcttctgtgactactggaaatgtaaaggttcaggggaatgtttgtcatgcttttagtaacttattcatgaatgacaccgtgagactttcagagatgcagtgggcatcaagtgtttatagcatacttctactattactccgggactcaaacaactttaaaataaggttgcttgcagctgttgctttagcagtgccagtcacagggcttgattttggtagctcctttccagatgttgtcagaggcgtcacacatgttcttgaggtattaagttcgaaccgtt

SEQ ID NO: 47838 - DNA, 405 bp, Triticum aestivum
  Clone ID: PAT_TA_47838
cgacttatcaggagggacttatgggaccacaaacaggcagttaagctcgtgtgggatttaaagcggttttaaaattcaaaaatagacttactacaccccagagtgtgaggctttgagttctgaaaggtgggaggattgtatgaaacatgaaactgggttccgaccgaagaagcaggggctgtagtaactgccgaatcgtatactggtacatggacaactgttcggactgatggactgaccagtcttgatcgttacaaaggacgaggctatcacatcgagcctggagctgaggaagacagcctctggatctgataagtaacttatccgttagacctatttggagagggttgcggtactaataagttaacttgcagtgggggtaacgtttctggattaaagccctac

SEQ ID NO: 47839 - DNA, 427 bp, Triticum aestivum
  Clone ID: PAT_TA_47839
ctcacgcgtgcgcgaacgcttgcgctaccgctcgcggccgccgccatgcccgacgactagcgcacgggtgcaggacgagggaggggaacgccgacgagtacatcaccaggaccaaggcgagcaacaacgtggagatcaacctggacatcaacaggaaactatgcatgataaaaggcgtggttaacggagagcccaacaggaaggccgaggagaaccacaagacctactaccacatctacgacatcatcttggttgtcgacgaccttgtgattgagaatttgatagagatgatggtacacagcaagaaagtcagaaaggcagtggctaaggatatcggggatctagctgacaaattgttggaccgatcgccgaatcacacactggattgacaaatgattggaagaaatccggatggagtggagctttc

SEQ ID NO: 47840 - DNA, 255 bp, Triticum aestivum
  Clone ID: PAT_TA_47840
ctcatccagcaccagcaaccagcagtgcttctctacaaaacttgaactcgaattcagctgaacaatgtattggggctgggagagagagatcgagcaggatgggcatcgagggcgtggagttggagtactgctggctgtcacggagtcggcataacatgaagaggcggaagcagttccagagggcggagatgaatgttcggatcgactgctagggctgggagcgcttggccaataaggcccccggcgacgtgaaag

SEQ ID NO: 47841 - DNA, 391 bp, Triticum aestivum
  Clone ID: PAT_TA_47841
ctaccctacccctatctactacaataaaacttctttattccaaactacacccggttggaataaggccccgctgagcgcccccagccatgaggtgctgagagatctgaaaacactactagaaaatgcacgacgcgttcaacacctggtgacacgaggtatctacatacatgcagagctaaaacgatcacccactgccaagctaatataccaacaacaatggatcgcgatatctgcgcctaccctgtgaagcaccactttccgtcttctataggagctcggatagaataccttcgaagctttggtgatgttccttttagttataatactgtacaccggcatcatcaaccaacaccgtcatttggaccgtcgtttgaatctagctatttgcatg

SEQ ID NO: 47842 - DNA, 437 bp, Triticum aestivum
  Clone ID: PAT_TA_47842
acgcgtccgcccatacatccgtagagcgagaaccagcaactacgcattggtcttctccgaaccacatacacaggtttgctagatcttgcgcgcctggccgccaaaaaagacaacaaccacctcctactcctaaaacctcgaagcccccttggatgctttcctagacgacatgcagacggcctcccggagggccgccatcaagaaccacgccgacacgtgccgcgaccacatgatgttcaaggacctagttcaaggtgatgatggcctgacctttcctgacaggcggccgaactttctttaacatggggcggagtgcctacccgcgagtcaccggcagggggaggaatgcattaaccctattgccaacccaaatccatcggtcgagctggcattaactgcttaaaatgtggagttggcgttagatgaaggccgacctt

SEQ ID NO: 47843 - DNA, 232 bp, Triticum aestivum
  Clone ID: PAT_TA_47843
ccaaaccgtcaccgacaacacacgagtccactttcaaccacaccagaagaaacggagatggaggaggcgaacggcgtcgtgatccgcgggcgtcacggccgaagcgggggtgggggcggaggctggccgcccgccgaacgtctccatgctggtgacgcccggtattgggccacctgatcccgttggcggagctggtcaagcgcctcgtcgcgcgtaagggggccacggtcac

SEQ ID NO: 47844 - DNA, 214 bp, Triticum aestivum
  Clone ID: PAT_TA_47844
ctccgcgttccctaaactgataccgactacacacgattcctacttcatccacacgacataaacggcgatggaggaggcgagcggcgtcgtgattcgcgagatcacgtcctaagcgggggcagaggcggcggtctgcccttctactgttgtcgtcttcggtcttaccatttcatggtgagactgtatcatgtttacacagctgttaaaaaggttc

SEQ ID NO: 47845 - DNA, 478 bp, Triticum aestivum
  Clone ID: PAT_TA_47845
gctggaactggaattggccttgagttccgagaatctggcttaaacttgaacggcaagaatgaccgtctgataaaagagggcatgattttcaatgtcaaccttggtttgagtaatatgcaggcagaaacaaacaatgagaagacaaagcagttctctttgttattagctgatacagctttagttaatgacaaggctgcagagatcttgaccaattgctccaaggctgtcaaagatgttgcatattcatttaatgaagatgaggaggaagttccgaagcccaagcgggctaaggttgagccaaatggcgcggaagcactaccatccaaggcaacacttcggtcagacaaccaggagatgtccaaggaagagctccgtagacagcaccaggctgaacttgctcgtcaaaagaatgaagagactgctagaaggcttgctgggggtggttctggtaatggcgatggccgtggtccttttagga

SEQ ID NO: 47846 - DNA, 375 bp, Triticum aestivum
  Clone ID: PAT_TA_47846
ttggagacacaaaggttgtcaatgccatgcacagacgcacaactgtgtgcgttcaataatcggcttacagtggatgacaggggcggtaaacgtacacaagccgctctgccgactgtattaccagttcggattatgacaagacaacagcatgcttgagactctattacggagacattgtttaaattctcaagttgaggcaggcgtcgaaaaagaagatgatgaagattattaggcggaggtgcccacggctgcactggcggatagtctggatgagcctaagagggtctactctaagcggatgatcttgtgcttggagccgtatggcatattgggtctgcttgttcaggacggtgatcaccttgtacagcaccgact

SEQ ID NO: 47847 - DNA, 316 bp, Triticum aestivum
  Clone ID: PAT_TA_47847
ggacgaactgctgccggcggcaaccgtcacgccgcaattgattgattgattccggcgggttcgacggcgccggacagcacggattcatgctaggtcacccgggcggggtcggggtggtacgggcttcggtggccagagagcccctcttgaccttgagcatcatcgccgacgtgcagtacgccgacataccggacggccgctccttactcggggtgccttggtactatcgccacaggatcaccgcgctgcagagggcggtccgcagctgaaacagccacagggtcggaggtaagttctgcgtcaactttggggacat

SEQ ID NO: 47848 - DNA, 384 bp, Triticum aestivum
  Clone ID: PAT_TA_47848
cccacgcgtgcggccacgcgtacgggatgttgcctaacagaggttacgagggtctccgcaccaaatcctccgtacgaggatgaatgtgtattaggggagtgttcacagtgtttgtggacgctttctgcaagctggatgataccaaatgttcagtcttttgcaaatcgagtttgcatgctgcaaaccattaccagggcgagcgcttgtttcttaatgtgggaccttgtctgtgacaactagatccaggatacatagagacactttttcaggatcataagccaaacacttcaagaagctgtgggtaactttatggaaactataatgatgtttgtgatccaagaaagtgagcctgtccatccagcagtgctatgtggcctacttcgg

SEQ ID NO: 47849 - DNA, 442 bp, Triticum aestivum
  Clone ID: PAT_TA_47849
gcgctttttggccgaggaaggataaagagagacgccatgggaagaagacctgcgaggtgttaccgtcagatcaagggtaagccatacccaaagtctcgctactgtcgtggtgtgccagatccaaaaatcaggatctacgatgttggtatgaagaggaagggtgttgatgagtttccattctgtgtccatttggtgtcatgggagaaggagaatgtgttatgtgaagcacttgaagctgtccgtattgcttgcaacaagtacatggtgaagtctgctggaaaagatgcttttcatttgaggattagggtttatcctttccatgttgtcacgattaacaagatgctttcgtgtgctggagctgataggcttcaaactggtgtgagaggtgctttatgtaaagctttgggtacttgtgctcgtgttgctattggacaggttcttt

SEQ ID NO: 47850 - DNA, 293 bp, Triticum aestivum
  Clone ID: PAT_TA_47850
atcagatggtcgcgagacctcgtcacaccacaatactctgaccgctcccgtcgggacacccggccactaactgcaccatcaggatgaggtcaagaagaaccgattgccgatccagcgcctccaatgaactgtcgcccctccggacctagatcatcatcgctgctgccgccaccaggagggcaccctactggctcgccttcctcgggctgctctccaagcccgcacactggaccagccactgtcccgtcggcgctccgcaggggaaacagtcctcgggtctgggggccaggact

SEQ ID NO: 47851 - DNA, 468 bp, Triticum aestivum
  Clone ID: PAT_TA_47851
acctacccttccgatcttgcgccatggcacaaaggcagacggaagtgcaccgtcgctagcttggaccatccacccgcgtccggatgaacaaagattattttttgactgtaagtgctcggcatggatatctcgaccatcttcctttggatgaaggctgagatgcttttaatctccaccgctagctattttcgaccgattttgaatggcattaagaccacaggcataggcataggcaaacagtgatattgatgaggggcgcttgctgctggagaggtcttgcttatgataatttggacggcccgcttgacatcaccagatggattgttcttggagactccctgtttctggcgcccacgggcgaccgaaaacatgaatccttgctcagctgctacgatttcgtaatggcatgtactcatgatgtactactactacatcaccattggaggctactacttggctcctgttttc

SEQ ID NO: 47852 - DNA, 374 bp, Triticum aestivum
  Clone ID: PAT_TA_47852
gtctaagccgacagccggagatagctattgactctccctactttgatgcacggcaatctatttttgaggatccaagtgaatcaaaaggccatccttttgggaatttgaatcttagtacaggtccttcgatctctgggactcagaatttagcatctcctgttggggctcagtcatcatctgagcatatgtatctgtctcatgaagcaccatcacccagctcagtgatagatgctcgtgcaaatgaaggaattgggggttctgaagcaatcaattcaagaaacagaacagattggggtcagatcgaagcacctggaatacaccaatctatgttactgagtgatttccttgcggttctctgtgattcaaaaaacaca

SEQ ID NO: 47853 - DNA, 389 bp, Triticum aestivum
  Clone ID: PAT_TA_47853
gacacctgctgccttgtgctccacagtaatggcctggccttctaccccagctaacttcttggcgctgacgctaaggaagcaggtgacctcggccgttaactaccatggcacgagctccaaggccaacaggttcacagtcatggcagcggaaaacatcgacgagaagaggaacacagacaagtggaagggtcttgcctacgatatctgcgacgaccagcacgacattaccagagggaagggcatcgtggactccctcttccaggcgcccacgggcgacggcactcacgaggccgtccttagtttctacgagtacgttagccagggactcaagaagtacgacttcgacaacaccatgggaggcttgtacatcagtcctgctttcatggaca

SEQ ID NO: 47854 - DNA, 454 bp, Triticum aestivum
  Clone ID: PAT_TA_47854
cccacgcttggtctctcaaagccagcgcacgcgacgttccacatatgatcgcggtggagtcttgcttgggacataataccgtcggcgcagcgctccacaggaataggactggcctgtcgatctgagacgcctacttggagcagatggtaaggctgccgatgtacgtggccactcacttggctttacaggctgtgcccgcccaccatcttatgacccaagcacctaaagaagctcgtggagcggatgatcgacgtgcaccgtgccatggaccactaccgagctcaaccacgcccttatgacactcgacattggcgaggaatatgagcttaggagggatctcaaggtcagggccttgaagacctaccataccatacccagccaggggaacctgatatactcagtggagtaaaagctgaagacggattatcttgggctgccgggaagcgagatctaa

SEQ ID NO: 47855 - DNA, 436 bp, Triticum aestivum
  Clone ID: PAT_TA_47855
ccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctggtttgtagcttatccattagacctatttggagagggtgtccgtactaacatgattacttccattggaggtaacgtatttggtttcaaagccc

SEQ ID NO: 47856 - DNA, 207 bp, Triticum aestivum
  Clone ID: PAT_TA_47856
acgcgtccgccctgactcgaatgcccccatcaggggactccataacaccttatcccgttccctcgcctgcagtgcttaatggtgggcttcgctccatagacattccgtgcgtctcagaataaccgtgcccttacggtcccagagcttacacataaaatgtggtatgccaagaacatgatgtcgctcctgatgatccttcgccatggc

SEQ ID NO: 47857 - DNA, 269 bp, Triticum aestivum
  Clone ID: PAT_TA_47857
acaaggggtgttttggaatgccaaaaacacaaaaaatgtggggatggcaatcgataccgacctgggaatttttccccatgcaaaatagggagactgtagggttccaacaaagctgttacaacagatcaaagacttaaaaaagtgcgacactttaataaaacccattgtacatgaataaatagcagaagggaactgtttaccttatgagtcccaactgtgaataaaactatttaaatgtccagctagggagctaatgatctggacttcta

SEQ ID NO: 47858 - DNA, 333 bp, Triticum aestivum
  Clone ID: PAT_TA_47858
ctagcttctaccaaagtatgcagcggaagcatacagaagaagattcttgcgcaatacggggctgtgcggagacattgccggtctgtgcatctgactctcaaggaagttcaggaaaccactgtggcattatttgaatgatgcgctggatattgatattagcggctgacgtgtaggtaggcggcgtagcatggctctactgaaggtacaggagcgtgaacaaagcgaagctgaaagtcgagcgctctaattggacactgacatgcttccacagggtgtcgatcatcgagcataatatcctggactgcaatgatgaggacaatgtcattgtctgtg

SEQ ID NO: 47859 - DNA, 291 bp, Triticum aestivum
  Clone ID: PAT_TA_47859
cggacgcgtgggcatgcaccaactgtccattgtttgaacatttagtgtgcgtctatactaattatgatttcctatgtccgtacatttagcttgcaataatgtaagcaccagtccatttaattttggaagttcctgctattcaaataggggttattggggcttgagaatgcacgattaaatgtgccgatgtctcttaacttactaccattcatatgcaaatcaaaaattataaactcgaaagacctggtagaatgagtcacacatttttaagttagggatgcccttgttttt

SEQ ID NO: 47860 - DNA, 315 bp, Triticum aestivum
  Clone ID: PAT_TA_47860
cctttcgacccatctctcctcagaataacctatccctacattctttcctcctgtttctcacctccagctccaacatcggctccttctgcacgcccatcggcaacccatataaccttgtcatcgccgtcaccagcggcatcttctttggctccttccttttcggcatcttcccggccatgatcgttggagtcatcaccaacacctgcatcctcctctgttacttctggaagcacctttccgtcgacaaggagcggcaccaagagtcggctgttggccaggacttctttgtggccgacgacgaggtcacctcgtacc

SEQ ID NO: 47861 - DNA, 241 bp, Triticum aestivum
  Clone ID: PAT_TA_47861
tcgtagctagcaccttgagctagaggtcagtggcaggcatgcaagcaagaaaggaaggagaagaagggcggacatggcatctgctactctcctcaagtcctccttcctccccaagaaggccaaatggggcgtctcgcgccaggtcgccgccccgagggtgtgcatggtctgacgtgccagcacctacgactatgagctctgtaagaccgcgaaaactatcttgttgccggggcgcggcatt

SEQ ID NO: 47862 - DNA, 396 bp, Triticum aestivum
  unsure (1)..(396): unsure at all n locations
  Clone ID: PAT_TA_47862
cccacgcgtccgggacttcattcgtgtgacagaaatcccaaagaagcacattgtgaaaaggtggacacgagatgcgagagatgtgcttccagcccacctgatgcagtaccagagagacaacgctcaggaaaaaccatttagtttccggcatttcaatatgtacaagcaagccatggagcttgtacgcatgggagactcaagtgtggcagcttacgaccgcttgacatcactattcaatcactgtgcagccgagatgaagccgtacacggatgtccgagatggcctangtttggaggacaggttagtcggcaatggtactgttcataaaatgatacaatcaggaggcgacgtatgcaatccgttcgaagctacacaagtcaacgacggaaacgatga

SEQ ID NO: 47863 - DNA, 172 bp, Triticum aestivum
  Clone ID: PAT_TA_47863
cggacgcgtgggcggacgcgtgggtgctaatgccgctgcctcgttgagcttccgggtgatccacgtggagaagcttgagaccggcgaaaggggcacgaccatcggggtcatccacgctgcctgcaagaactggcgattatttgagctggtgaaccatggcatttgcaggcga

SEQ ID NO: 47864 - DNA, 455 bp, Triticum aestivum
  Clone ID: PAT_TA_47864
ctccggcaccggcagtctccttcgcctgacaaaaccaggaacgccacagccccagttcttctgccctccgccgtctcgctcccacttccaccttcgaacccgccccgccaaggcaaagagcccaatcgccggagccatcgcctcctcttccatggcggcagcccagccccagacgtgcgacggccaacaacaacgggcggaggaggccatgaagctgctgttcgtcgagatgggcgtcgggtacgaccagcacggacaggacatcacctccgccgcggtgcgcgcctgcaaggatgccatctcctccaactccatccccgccttccgccgcgggtcgataccaggggtgaacagtgaacagatgaaactggagatcaagctgggtgtcccgaggccggtgcagcatctgttggactttgagagaatcaaggccggctttccctatggtgagatca

SEQ ID NO: 47865 - DNA, 284 bp, Triticum aestivum
  Clone ID: PAT_TA_47865
ccacacgtccgctctctatcattcacgtcaggctcggtggatcacggtagcactagcttcaggtagccagcctctggcggtccgggcattttcttgcatccacgacggcaatggccaccgcttatgtccagaacccgacggccgctctgactgaggaggcgcccacggtggagacgcccgtcgccggcgaggaggtcgcgaagacggaggaggccctcgcgcctgcccaggcctaggtcaaggcgcctgctgcccccgtcgaggtcgaggagaccaaggagggg

SEQ ID NO: 47866 - DNA, 286 bp, Triticum aestivum
  Clone ID: PAT_TA_47866
ggagctgcatgagaggaagatcatgcataatattcgccagaaccagctacctctgcagcggtacatggctatgatggaccttcaagaggggaatgagaggcttttctacaagctccttattgacaatgatgaggagctgattcctattgtgtacactccaactgaaggtgaggcctgccaaaagtacggatttatatttagacatccgcagggtctgtacatcaacttgatagagaagggaaagatccttgaggtgctgaagaactgatgctgagatgagcattca

SEQ ID NO: 47867 - DNA, 228 bp, Triticum aestivum
  Clone ID: PAT_TA_47867
tctttcattatggacgactcctactgtagctattcgctaaaggagcagatcggtggtttcactgctaacgggggttgcgttgtcaagggcggtcacgataatgttgctgttatggactcttctcgcaccgcccgggctgttgtttttgacaatgtacggcaaggagaacggtgacctcaactacggggctcttctatgtaaattccttgtgtttgaagactggaggaa

SEQ ID NO: 47868 - DNA, 145 bp, Triticum aestivum
  Clone ID: PAT_TA_47868
cccacgcgtccgcaccgaaagaggagagagccattatccatgggaggaggcgttatgcgcaccgccgcgaaggtcggtctcgccgggtgcgccgtggcggcgtgtggtcctttttctcaacgatttcttgttctttgccacggtc

SEQ ID NO: 47869 - DNA, 260 bp, Triticum aestivum
  Clone ID: PAT_TA_47869
cggacgcgtgaggaaaaaggagagaactccatctcagccgagggtttcagcggcggctgcggcggcggccggggaacaccgttgcctcataacccaagagagcgcggatcttccaaactcctcaccggcttgccatcgtgaggaaacttctcctcaagtgccatttcttgcaatctgggaggcctcatggtatatggctgcgagcacgacacaaatccttcagagggacaagttgattgagacggatactacaaatatct

SEQ ID NO: 47870 - DNA, 227 bp, Triticum aestivum
  Clone ID: PAT_TA_47870
tctagaaccccaagaggccagaaccctacccccatggcggcctcgctcctctcgcgcgccgcctcggccgccttcgccctccgcggcggcgcccggctcctccccaagggcagggtcggatgggcgcgcgcggcggaggtcggctgcggggcgtcgctgtcgccgtcgatgacgcggttcgggatcgccgcgcgcttcaacgccacctcgtcggccgtgtaggaggc

SEQ ID NO: 47871 - DNA, 156 bp, Triticum aestivum
  Clone ID: PAT_TA_47871
ggcgacctaatattgataaaatcctaaacctacgactattatggacgtactcatctcacgccacaccgagaccgggggcgccctccgtggtaaagctgggcttttacacaatgaatggacttactagacgccagagtatgaaatttatgattcttg

SEQ ID NO: 47872 - DNA, 393 bp, Triticum aestivum
  Clone ID: PAT_TA_47872
cccacgcgtccggccgtcttcaacaccgccacggtgaaggagccgtcgttgccggcgaagatgaacccggcggggggcttggcgtggcagtcgtacagcgaggacaccaacgcgctggactcgagcgccttcaccaaggacggcctggtggagcagctgagcatgacctgggacaagtccgactacctgtggtacaccacctacgtcaacatcgactcgagcgagcagttcctcaagtccggccagtggccgcagctcaccatcaactccgccggccacacggtgcaggtgttcgtcaacggccagtccttcggcgttgcctatggcggctacaacagcccgaagctgacgtacagcaagcccgggaagatgtggcagggcagcaacaagatc

SEQ ID NO: 47873 - DNA, 263 bp, Triticum aestivum
  unsure (1)..(263): unsure at all n locations
  Clone ID: PAT_TA_47873
ncgttcgtccacgcgtacggccgtcttcaacacctccacggtgaaggagccgtcgctgccggggaagatgaaccctgcggggggcttggcgtgtcaattcttcagtgaggacaccaactctctgggcttgagctgccttcaccaaggacggctggggggtgcatctgatcatgacctgggacaatgttgactacctgtggttcaccatctacgtgaacatagactggagcgagccggtctctcaagtgcctgtcaggggctct

SEQ ID NO: 47874 - DNA, 436 bp, Triticum aestivum
  Clone ID: PAT_TA_47874
cccacccaccccccagccggaaaccctagcccgccgtcgccgccggcgatggccgcatgagcgatgcccctccgaggaagcgcccgccagccagctccgtagctcgagcagccgccgccgtcgtcgtagccgccctcgcgtcctccttcgtcgccctgtcccctcgctgcgctccggccgacgcgggatccaggcccggcatgtcgaaggcgagggtctacaccgacgtcaacgtggtgcgccccaaggagtactgggactatgaggcgctcaccgtacagtggggtgagcaggatgactatgaagttgtcaggaaagttggaagaggtaaatatagtgaagtgtttgaaggcttcagtgttaacaatagcgagaaatgtgtcattaagatactcaagcccgtaaagaaaaggaagattaaaggggagataaaaat

SEQ ID NO: 47875 - DNA, 328 bp, Triticum aestivum
  Clone ID: PAT_TA_47875
cccacgcgtccgggcacactctccagcaccagcaggccggcggcaagcagcgcaagcacaacaaccaaatggccaccatcagcgccgccgcggcgaccaccgtcgtggcccgtgccgtcatcgtcaggccgcaggccctaggtctgccccagctgaggacgaggagcgagagggtgaggtgcagctactccaaggacgccaaggaggcgacccctgccgccgacgtccggggggctggcgcgtccctactcgccgtggcggtcgcggagaccgagtccgcagggccggcgctggcgctggtcgacgagcggatgtcgacggagggcac

SEQ ID NO: 47876 - DNA, 460 bp, Triticum aestivum
  Clone ID: PAT_TA_47876
cggacgcgtgggcggacgcgtggggccgccgccgccgccgccgctcactcaacgcgtgggcggccaactcctcctcaagacgctgccgaccgccgcctcgacgccggtgtacccctgcggcatactggacgtctccccgtcgccagcagcctgggttcttgttggggtggacaagttgcctccatcttgggatccaattgtcacgcctaagttcggtgaactgtggcaagcaagatggccctctcatcagttttcaggagagtaaacatcaaagaactgatctcaaatgttccagtgtacactagctcaacagagacatctggaggaatgagcttggtgtttaggcgttgggccacaaaaaagactgctgggtcaacgaaaaatggccgcgactctaaccccaagtatctgggtgttaagaaatttggtggagagaaagggaaccaggaaacatcatcgt

SEQ ID NO: 47877 - DNA, 337 bp, Triticum aestivum
  Clone ID: PAT_TA_47877
cggacgcgtgggcggacgcttggggccgccgaccttttcgccgctgactcaacgcgtactcggggaactcgggctcaagacgctggcgtccggggcctcgacgtcggtgtacccctccggcatacagaacgtctgccacgcgccagcaggctgggttatagttgggttggtacaacttgcggtgcatcttgagatccaaaagccacgcctaagtacgatgaactgtggcaagcaagaaggtcatttcattagctgttaggagagaaaacatgaaacaactgttctcaaatggacaagggtacacgtagctaactgagacatctggggggatgagctt

SEQ ID NO: 47878 - DNA, 462 bp, Triticum aestivum
  Clone ID: PAT_TA_47878
ccggacgcgctgatggggatcttgcggatgccgggaagaaccgccgctgccatccatccatggccgacacacagctcctcaaggtgcacgacagagccagctgtgtgtggtgtgcgcgggggattcttcttccaccccagcaatctggtccatcccgtttctgtggcaaaggagatgctgcccctgtggacctccagattgctctggccaccaacttatctagtgttaaagggttgcaagcgaacctttcagaaatgatatttagattctagaacggaccgaggaaccaagtgaacttgatgactatgtgattcccgagccagggtttgagtagctactgttctaccaagtgaggatgatgttacggtcgatgatggcaagatcagcgccttggcatacgacaccgcgtcggtcgctcttgttcaagatcccagccatagcagcagttggagcatgttagcc

SEQ ID NO: 47879 - DNA, 180 bp, Triticum aestivum
  Clone ID: PAT_TA_47879
acgctaaaacactctactttagttttcatcactaccgtggtgcgtgcacgcaacgcgggtttattgcacaaatgagcacggttcctccttcattacctatcaacgaggacataccttaatcccttgtctgcacggtcctggttccgtctacttgagcacacctttggtcgatgcaccagt

SEQ ID NO: 47880 - DNA, 181 bp, Triticum aestivum
  Clone ID: PAT_TA_47880
ctcacgcgtgcgcgatggcggacaagcatgttaccgtagtggaaggggccttgccggaaccaggtgttcgtccatggggcgaggaacatactgtaccaggtgaaccgtgtaataagccgtcttactagtactaccgcattgccaacgatccatgtcttgactaatatattggttcaggtct

SEQ ID NO: 47881 - DNA, 219 bp, Triticum aestivum
  Clone ID: PAT_TA_47881
gaaccccactaccacagcacactcgagcgtactgatgtgcatgtcggaggcgcctgttcgttgagaagaggaagaaggtcgttaggtaaaaccttcctctatcttgccaggaactcaccgccaagagccgttgataggaagagagtactagactcatgtgcagctttggctgatgaaaaaatatatagagtacctattgctaaacagaaaagtatctga

SEQ ID NO: 47882 - DNA, 175 bp, Triticum aestivum
  Clone ID: PAT_TA_47882
acctacaacaaagaacatacatcatagccgtgagcgtcaccaccggcgacgccgagaggtcgcgcgccgtcacgcgacggcgggtgggctcgcctgctctaccaccacaacgtctgcgtcgtagccgtgctcgatttgttggcccacctatgtatacccggggatcgcgccgcta

SEQ ID NO: 47883 - DNA, 298 bp, Triticum aestivum
  Clone ID: PAT_TA_47883
gtcgccatagccagcatccgattctggccgttgagagcgctcatatatgctccacacctctagatctgcggcgtgatggagtctgtgcctcctcagatcaacaagcacccgcagaccctcccgaatcggatggacatcgacatgcacacggccgacgttgataacttgtgcctccccgactccattcacccggatcgtgggcacaggcaccgagggcattatttgcggaatgccagacttgaagatgggtgggaagaggggcgctgaatctgcccttactgtgcctggtgatgaagac

SEQ ID NO: 47884 - DNA, 443 bp, Triticum aestivum
  Clone ID: PAT_TA_47884
cccacgcgtgcgcgtcttcaaaagaaatttgactatttattatatggggaactatagttagtagcgcgtaactagactcctatttggagcaatggcatcgttgatactggtctctgatttatgatttgatccaccgaccctccagcctgcccctacagtaccgcaggtttttttttagcatgcggtttctgcataattcgcaacctggtcgcggccgtggcagagggttgtctctgctttcgaccggagagggagcacactacaggagcgacctcgtccccactggtcacgacatttacctgctaatctacaggctatggcaccagcggagtcactgccatgatggccctctcaagaggctacatatcgtcatgaccgacctaagggaaatcatgccaacgaaacggtgcctaatgaggtcatagacatgtttgtggacactt

SEQ ID NO: 47885 - DNA, 115 bp, Triticum aestivum
  Clone ID: PAT_TA_47885
tcgacattctgctacgaacttagtgaaatacagtttgctcacactgtacgattaacgggggatggaggtaagtaatttatgaagctacttacacgtcacatgtgtagtttaccgt

SEQ ID NO: 47886 - DNA, 104 bp, Triticum aestivum
  Clone ID: PAT_TA_47886
ccttccctctacgcgctcgatcttgccgaccgaggcgattgcatcggtacctgcgttgagggttcagttgttcgaactcttacgatatggtcggcgcagaccga

SEQ ID NO: 47887 - DNA, 209 bp, Triticum aestivum
  Clone ID: PAT_TA_47887
cccacgcgtccgatcgattgagggtatcagagggggacatgcaattagaacaagtgagagtatgcagtgagatagcgatagagtgcatggacttggacccagcgaagagaccagatgcatgccatataattgatagacttgataaaattgagggtcctgacaaatcagacaaaactggcatcaacaattcattcactgagctgcagggt

SEQ ID NO: 47888 - DNA, 267 bp, Triticum aestivum
  Clone ID: PAT_TA_47888
ccagagaagaagaagaagaaggtcgacgacgatggcggtgttggtggagctgaccaaggagtacggctacgtggtgctcaccgtggtggcctacgccttcctcaacttctggatgagcttccaggtcggcgccgcccgcaagaagtacaaggtgttctaccccacgctgtacgccatcgagtcggagaacaaggacgccaagcgcttcaactgcgtccagagggggcaccagaactcgctggagatgatgccgctcttcttcgtcac

SEQ ID NO: 47889 - DNA, 213 bp, Triticum aestivum
  Clone ID: PAT_TA_47889
tgcaagaagcggaagctagcacagcagagcaaagcaaggtgcaatggcgccggcggtgaaggtgtacgggtgggcgggggcgccgttcatggcgcgcccggtgctgtgcctggaagaggccgtctatcactacaagctcggcctcatgagccgcgcggtcggataccactgtctgccggactttctctcccgtaacctcttcgggcaggtccc

SEQ ID NO: 47890 - DNA, 410 bp, Triticum aestivum
  Clone ID: PAT_TA_47890
ccctccctcaagcccctcttacctccccgatctgctagcgatgcatccaaatcgatggcctctatgcacgtcctaagagaaagtgaggcagagggagcgacccatggctggattatgttgctgcgaagctcaatgcctgtgctgcgagcctgcagagatgagagtatggacgccggctgacaacgggatactgtgggcgtcggcggccggggctacaatggagctcggcaccacggcacccggagctgcaatggagctcttccggggctgcgatggagcccggcaccacggcgcccggagctgcaatggagcttcgggagggctgcaatggagagcgggcgctactgccagcggcatggcaagttgaggtcggcgacgctcgccatgagtgctgcaatgaagcgagcgtt

SEQ ID NO: 47891 - DNA, 451 bp, Triticum aestivum
  Clone ID: PAT_TA_47891
cgcgacgcacagagacagagggagagggtccgctgtacttgcatccttacctgcccccttcccctcctcccctccaagtccagaaatccgttcccctctccccctctcgtctgcacccgagacgctcctctagatcagttccccctcggtgcggttacctctcgccggaagccaagccaccatggtgttgccggacgctatccgcaccgtcatcggcgtcataggcaatggaaccgtcttggtgctcttcctatccccagtgccgacgttcatcagtatctggaaaaagaagacggtggagcagtactcggtggtgccgtacctggcgacgctgctgaactgcatgatgtgggtgctataccggctcccgctggggcacccggacagcatgctcgtaattaccattaaaggcaccggcatgcttatctagctcattacattaggcttttac

SEQ ID NO: 47892 - DNA, 238 bp, Triticum aestivum
  unsure (1)..(238): unsure at all n locations
  Clone ID: PAT_TA_47892
ccgcagaaccaaaccanaattcaccgaacgacccacgcgtccncctttctccataagaaggccgaatggggcgtctcgcaccatttcacctacctgagggtgtccatggtgtgtgcggactgtcacctacgacgatgatcttttcaagaccgcgaaaaccattgctaattctgggtcgcggcattctggtcatggacgagtcctacgccttctgcgttgaagcgcctatacttgatcg

SEQ ID NO: 47893 - DNA, 413 bp, Triticum aestivum
  Clone ID: PAT_TA_47893
cccacgcgtccgcgagtctcctccgctgccgggcatcgagtccttctcccgcttcccaagccgcgtgcgtggttctcacggccggggaccccgataccccgcggaggaactggcggttgcttcccacgcgcgttccctcctgatccccttcttcccagttgccgtgccgcgcgatggcggagccgacttccacctcctcgccgttcggggaggtccccgttgagaaatctcctactgacctaaccggcggggacgaccacggccaggcgtcaccctcgagggccgaactgcttagtatggcgaagaagcattcacatttgatcgggtggaatggtggtgtgtgtgatgatgatttgttgggacggagaggacccccgaccaaactctggcctgaggatgctagatttttttaa

SEQ ID NO: 47894 - DNA, 452 bp, Triticum aestivum
  Clone ID: PAT_TA_47894
cactagtgttggactgttatgcagaactggggaacccttggccaagtgcaggagaggaactgggatattacagctgggtaattccatctggacgccggacgccctctgccctttggaggtggaggtaggcaccaacgaccccggcttactcagcatctgctctgaagccattgctgccgcccacctatccatttgtgctcacagcggtctatccctgctgcagagaacgctcacatacatggtacagattagctgacaccttgcaaaaatgaggcagagctcatgggagcggacaattacaaggagcacgttctttgagaccaacgtctcgctgggattctcaacgagcgtattttgatgacggatgagctctccagtagctgactgactaacgttgaactactactggtaccgctgtgagttaaaaaggaattgaacgtgacttcagggcc

SEQ ID NO: 47895 - DNA, 395 bp, Triticum aestivum
  Clone ID: PAT_TA_47895
ctaccaagaggataggagacgatgcaacaattacgttactgattggaaaagatctttctgaatctggtggtgtatccatggaaggtgactctgcaaaaagagcgccgctttcgcgcaaaaattcactcaagctggacacagagaaaggaaaggaacctgctaggccaatgccaacaccattgacattgaatgccctgaagaatcaggcaccacctctttgtggtccactcctgaagtccatttctttcaagaactcaaaggtcccgaaggtgaaacaactggtcactgaagttcctcaaaagcccaaaaatctgaaggaacctatatccttaattacaaaacaagacgggccagggatcacacttgctaaggcgacatcaggcaaaaagctgaac

SEQ ID NO: 47896 - DNA, 474 bp, Triticum aestivum
  unsure (1)..(474): unsure at all n locations
  Clone ID: PAT_TA_47896
gtttatattagctgattcctgaatgttagattggaatgcaagagtagtatcacaacacgggggtggagacctgaagcgaagcagaggggcagcgaacgaaggaaatcagagtcgcgctatttctatatcctaattctgtgctcttatttttttacatatttaatttacaatcttgtgttccgaataattcttgtggcttgacaagacagagtggaggatcaaggaatgaaatcaaaacatttttctatttaaatatatccaaaggatgataattggccgtgtcaagatgagtgcacaagaaggattgtgaaaaagaaagttcaatcaacgagaccataatttagtggcgaaacatattaaacagtacagatgttgcccacacatgagcgcccatggggaagcccagatccatcatgtcgctttgcgtggaaagcggntcaattctctatttttcctgtatatagagtatcatgc

SEQ ID NO: 47897 - DNA, 342 bp, Triticum aestivum
  Clone ID: PAT_TA_47897
agacactgcaacatacctgaatgtcttaagctgcatttattgtgggcttaacgattataacaagggtgttttcaacgacatggtacttacatagtcaccttataaacttactgaagagaacatttatgatacgggagtcacagtaaacaacggcgacctacatgcacgatactgatttaatgatcggatgagccaaaacatgaccaagtatgccaacaatcttgaagtgaactggaagacaccaccttggcatgtacactctactacagacaacgttcttgactatggaaagcatcttggcgacatgttgattgaaaaagaggccactcttacctatgcatg

SEQ ID NO: 47898 - DNA, 382 bp, Triticum aestivum
  Clone ID: PAT_TA_47898
tgcagtccccctgcttatcccctcccgagttcgtcgcctcctcggcattccgtcgaacaccatgacgagcgtggcggcggcggtcgccctcctccgcctccctctcgcccgcctctcctcccacctccggtccctcccttcccgtcccgtcccgtccgctcgcctccgcctctccgccccccaccgccctctctgctccctcctcaccagcggccacggcctcgtcgtagcggccgtgtccgaggcggtggccgcggcggacgaagaggagttcgaagcgacggaggagcagcaggaggaggcgcccccttccttcgtgctcccgcggctgccgctgccgaaactcgacgtgaaagaacggaaggagctcgcctcgtacgcg

SEQ ID NO: 47899 - DNA, 471 bp, Triticum aestivum
  Clone ID: PAT_TA_47899
cccacgcgtccggaagtataaaagctctagagagaagcatgcaagcactgggttcattaatcgaaggacatggcaacctgcaaattatacaagtggtagctcacagatcctcggttaggtacggtggcacttcaaaagcaacaatttcatgggacatcttggcacctcccccacatctccagagatttgaatgctcgccacacagccccatcatattttacggaatcccaaggtggatggagcaactcaggaacctatgcattctgaagattgctgtgagtgaactgctgatatatgatgttagtatccttggagggttacccgccctcagtgctctgtcgctgtatgtggagaaggcgccctacgacaagattatctttgacaaggccggtttttcagttgtcaagtacttcaagttgaagttcagtagtggtatagcttggctaaaaattaaggcggatgctatgccta

SEQ ID NO: 47900 - DNA, 470 bp, Triticum aestivum
  Clone ID: PAT_TA_47900
caagaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccaagtctct

SEQ ID NO: 47901 - DNA, 478 bp, Triticum aestivum
  Clone ID: PAT_TA_47901
tttttatttctaggtactgcgttgcttggtatcctgtttatcgcgtacctcatgggaacttccgtgcatcattcttgacataccattcactgggtaaactggttccacaaatatgctccccagattctagtggtggtcaggacacccgaattgtttgcccggctgttggtctgcaaagttacaatgacaaggtaccattctaacttttttccctatgagggtagcgatttttttcagtactgagtgtatccagcatgtagctctaaacgaagtgaaaattccagaatgtaaggtgcaagctgaacttgctgcctggccatagtttgattctagtgcttggttcgatttgagttattgagtcagtacatgacagactccccagtctaacatgcaaggtccattttgtagggtgagcaatggtttgagctgagatgtcgagattcctcgaagcccactggcgctgaaattgtggaggaaa

SEQ ID NO: 47902 - DNA, 171 bp, Triticum aestivum
  Clone ID: PAT_TA_47902
gcacccgcgcgctcgcctttcccactacaggcacagtcagcgagcgcactgatggaacaacgatggcactggtctactcctactacgccaccgacgaagcggcgcttcccaataatgggctggccggtgccctgagctctttccttggcgctgccggcaaggaggtggggt

SEQ ID NO: 47903 - DNA, 472 bp, Triticum aestivum
  Clone ID: PAT_TA_47903
ccaagagactccttttctaggttcaatatcagtaagcttgctcgactcgcagagatttatcatgaggatttctctagttatgaccgtgagcatatacaagatcaccttgagctattcattatttatatgagaagaattgaagattttagagattgtcatgatattgcaagcctagctaaaaagatggttgaacttgaaaggcacatcatgtttcccacggtttatcgcctcattgagctcgcattgctactaccggtggcgacagcaacagttgaaagggctttttcagcaatgaaaatcatcaagaccgagttgcgcagcaagatgtccgatggctggcttaatgacttgatggtgtgttacattgaacgagggatattcaaaagtcttgatcttggtaaaattaaggaagattttcacaagaagggtagggaactaccattgcccgggtcttccactcgccattgaaact

SEQ ID NO: 47904 - DNA, 265 bp, Triticum aestivum
  Clone ID: PAT_TA_47904
cccacgcgtccgcggacgcgtgggcccacgtttccccggccggcacaggctaaaagctaagccaggaccagcgcccagctctggtcacggggagcgtgtgtgccggtgtgcggctgcggcgggccggagtgagcgaggatggggaactgccaggcggcggaggtggcggcggcggtggtgcaacacccgggcgggcgggtggagcggatctactggtccacccccgctgcggaggagatgcgcgccaacccgggccactacgttg

SEQ ID NO: 47905 - DNA, 342 bp, Triticum aestivum
  Clone ID: PAT_TA_47905
gggaaaggaaccttgtttgtgtagccctaaataaagctggcacaaattattgtcaatcctccttgttttggggattgggcggtctctcaattcaatctgcatgggagagagtgaagatgagagggaaaagaaggaaggcgaggagggtgaaattgtggaaagaagatagggaggtgcaggtttttatgggatatggtatttcgatggggctggcgtgcatccacactgccccgcggggcaaaaccatgagtgattgctccaacgtctgataaagggtagggtaaccttaacgcttctatttgccgacccccaaaaaccaaattctctcgggtggtttttttt

SEQ ID NO: 47906 - DNA, 315 bp, Triticum aestivum
  Clone ID: PAT_TA_47906
catctctgtacccttactctctcacactctacgaccatacattttctatctagctagcgaccgatgtgcgtgtgactgagcattcgtgacccgtgcgccgactcggcgatggactcgctccgactccgggcgtccttggttcgctccgcgcccggcgccgccggcgccgaccggcggcgagaagatattctaccatcattcggttccatccaactgaatgttgaaaggcgagattctttgtacatccaagcggtcaatggccctactgttgtaccgtatcaaaaatagttggatgggaaatattctaactattgg

SEQ ID NO: 47907 - DNA, 160 bp, Triticum aestivum
  Clone ID: PAT_TA_47907
acgctcctaccaagctatatacctacatagtacatccatggtctccaccgagatggcctcggggggcacctccgacgatactgtccaggggctcaagtccaccgccggccttcctggagccgtcgttccaacggcgctagtctaggcagctttagcaacg

SEQ ID NO: 47908 - DNA, 413 bp, Triticum aestivum
  Clone ID: PAT_TA_47908
gacccacgcgtccgaccacgtgtgcgccacacgcgtccgtccacgcatccggccgtcgtttcgtgtcgacgcgacgccctaccgaccttcatacttgttctcggcctcatggcatattcggcaggacctcgagcgcatctcgcccaaacggccgcaatgtgactcgtgcatgtctagggttgcggcgcctgatttgtaccatatatgccggacccgtggaggatcggaagaacagcggagagatgacgggaaagaaccgcatgggggaggctgggcgggtggactagacggaccggtgcatgtacggagcgtttcggagcgccgccaactcgctctcggaggtctacacgctcgacatgggcggacagaagctctctttataagccggggtgcgccacgccatggaaaagctg

SEQ ID NO: 47909 - DNA, 391 bp, Triticum aestivum
  unsure (1)..(391): unsure at all n locations
  Clone ID: PAT_TA_47909
cccacgcgtccgcctccctccacgacgcgcacggtcaataccaccaggcgtcctcggatctcctccgcttcggcggtggcggtggcggcgaaatggccgtccgnctaaaccacctactgtcgtcttccaacgccccgtcctttcttcatctgccacctccacaagtgccgcccttccaccttgacttatcgcaggagtttgtcgacggaaatggatcgcccgtgtacttgcatggcaaaccgttccacggccttatgcaactttccggatcttcagagaaacaggttcttggagcacgtaatatttaagcttctgtatattattaacctcggatacatacgcaacagttgccaatatgttcgtgatcttttaccaacgctcattctatttt

SEQ ID NO: 47910 - DNA, 399 bp, Triticum aestivum
  Clone ID: PAT_TA_47910
cagccattcaatgctccaccaaacgctcatcccttcttcccttgccttctccgcctccgcttccccttcccccgaccctctccccttcgcctcgaacgccgccgccgccgccgccgccgcgaccccccttcgctcctcagccatgccgtcctacgcgcaccaccacagctctctggacgagaggatggacgccctcaagggcagtagccgcgaggaggagacgcccgacgaggccgccgccgaggcgccggcggcctggggcttcgccgagagggacggcttctccgtcgaggacctgctggacctcgaggagttctgcgagccggatataggcggcgccgacgagcccgaggaggctccggccgccgccgtgaaagaaggagaagtgaacgacgggcc

SEQ ID NO: 47911 - DNA, 425 bp, Triticum aestivum
  Clone ID: PAT_TA_47911
tttttcaacataaatgccttgcacttattttgaatgttattaaacgcctcgcagcttctcattgtacacatccttttaacccaaataaatgtatcagcagcagcacacaggcatgatcagcagaatactagcatacatatcctagatgtgacagcagtgcgtatacatcatcatatactactgcaaatactagctagagctgtgcgagcagaggagcatcatcagccgctcttctataactagaagcacgggacgtcgtgcagcgggtggcccttgaggttcctctccatcaccctcctggccagggacacctgcttgcccaccgcaaacacgaaagccttgccgtcgcccgatgcaccaagggctgtcctaccaaccctggggacgtactcactcgggtcgcggggatagtcgaaaagcaccac

SEQ ID NO: 47912 - DNA, 474 bp, Triticum aestivum
  Clone ID: PAT_TA_47912
atcacacaggttttatttctcctttttctttaccgaatgctattaacctttctgcgcaatggcagagtcgcgtgggaccagttcaatggcttaagccatatactgatgaagttttagttgaacttggtcaaaagggtgtaaagagtctcctggctgtcccagtaaggtaatcatcaactttaccatttatactctaccagttcagtatttttaggacaacaataagggtgtttgatgcagctttatctgtttttttggttttgtggacttctgttcacactgatcaccggaaccaatttcaagtgcatctactactctttctgtagcaatatttcctactattataatatcatcatcactttatcaggccagctctaatttatcttaatttagcattttgggtgcttatgtgaattctacctgaactttccatcatgtacctgtttgcaacttgcttaatgggggtttggttgg

SEQ ID NO: 47913 - DNA, 410 bp, Triticum aestivum
  Clone ID: PAT_TA_47913
gttaaatccgtatatgttgtttgagtgccttttaattaagatactggactatgttggtacacatatatttggatgcttgtgattggctggaaagaacagaaacttagatttgttgttggactaaactgagactgagtagtcatagccttttggctgatgcatccttcagtataccaaaacacttgctatttttcatgttcttgtacgcgatgggtttaggacacaaacaattatttgttttatctacaaaaaacttttgcttcaagattacaatgtgttgaatgcctttcgtgcttagttaaagtataagtattgcttatatgtgatttcagttcagcttgaccaattttctttgctctgctttttcccttcctctccactgaatatgaccatgttcaaaataaaatgcg

SEQ ID NO: 47914 - DNA, 422 bp, Triticum aestivum
  Clone ID: PAT_TA_47914
cgccaccccctccgccgtcgtcgacctgccggagccacgcagaaaacagagtgggagagatgtggtacctttgcgtcttctaccacaggctcctcgactaccggcggccggaggtgcagtcgctcgccgagctcttcggcggccccggcggcggggccgctgtagagtggcgtatgcccgagaatcaccacgaagactcccccttccacctcgtccgcctccccggcgacgagcgtcttgccgcgcagatcgccaaccgcagcctgctcgtgaaggggatctatgagctgtgggggcagggtgccacctacgacgaactggagaaggcgatacgggcgtacccggacgaaaggaagctgccgtacctgacgccggaaagctcgttcaagattatcgtcgacagcttcggcaaggcggtcagc

SEQ ID NO: 47915 - DNA, 383 bp, Triticum aestivum
  Clone ID: PAT_TA_47915
ccctttctaaaggtatttgagagaacattagaaagagaatccatgggaggaaggggtggctaccgccagtgttggatttaaagctagtgtctaagattataaattgacttactacaccccgaagtttgaaactaaagatcctgatctttttgcaccatttccagtcagatcttaacctggggtttcggctcaagaatcctgtgcttgaagtgctgcctaatcttactctggtacatgaacaactcgttggacttcttgttcttcacggtggtcaccgtggtgcagttctccctgttcgccgaatgctatatttctagaggagatcccgagcgtagcaattgcttcatgaacaagtcttacattgacgcagtgaagttttacct

SEQ ID NO: 47916 - DNA, 453 bp, Triticum aestivum
  Clone ID: PAT_TA_47916
cgttggaagggcttggatgattcaggagtggaattagatgatggcctttcaggtttgcagacagaagttgaaaatcttaatttgcaggagcaagccttagatgagcgtataagtgatatgcgcgaaaagctaagggggttaacggaagatgagaacagtcaaagatggctctatgtgacggaagatgatatcaagggattaccctgctttcagaatgaaactctaattgcaataaaagctcctcatggtactacacttgaagtaccagatcctgacgaggctggtgattatctccagaggagatacagaatcgtattaagaagtaccctgtgtccaatagatgtttacttagttagtcaatatgacgatggatttgagaatttgtgtggtgctgcaacacctgcaaggcatacaaatgttccaaaatctggaccttgtgaagacttacatgca

SEQ ID NO: 47917 - DNA, 393 bp, Triticum aestivum
  Clone ID: PAT_TA_47917
caccgttccaccttagctcctcatcttccccgcgtgcccgagctcctcctctctcccgcgtgcccgagctcctcgctgtgtgccgctcgggagggcttgcgttcgccgctcgaccaaagccaccgcgagctggtcgtcgttgcacttgctggcgacctggccgtcccctctgcaacactttcacctcaaatttggacgctcatgtgcttgtggatgttctcagttattttttgcacacaaggtgtttgtgtgtttgtctgaacctgtttcagtcacagatccttgagccgacctaattgagctatcggaggtgttgcggtcttttagcaaacatgccctatattctatggtttggcatctacaggatgccatctctggtcatggatccactat

SEQ ID NO: 47918 - DNA, 344 bp, Triticum aestivum
  Clone ID: PAT_TA_47918
cccacgcgtccggtgaaaaaccaagctcttagagaatatgaaagtattaaggtaaactgccaaaaattgtgaagtgatattgttcttttggaaaacttatggagcatgaagttatatggaaaaatggaaaatcatatagaagaaaacaaaagcttaagataaatgttctcattggatggtttattaatgaaaactggcgcacgtcctcaaccaagtctgttgaccaagatagtagtacatgctagaataattgtcctaaagattaatattcttgtgatagctgcacacataatcgaataatattaggcatgagtagcatatttttgaagcttctaaacattata

SEQ ID NO: 47919 - DNA, 454 bp, Triticum aestivum
  Clone ID: PAT_TA_47919
tggtgatccaccgctagcgccaccaatagaatctcctccggatgccacgggatatgatgtagaatttccctatccacagttaagtgagtgggaaaccggcatgtctcagtaggctgaaaattatttcagtacagctcaaccagcatggttggaaggcatcctcgaccaatcattactctgcttccttggcctacagtttgtagtttcttggctccattgaccagtcttccctggaaaaaatctggcacatcaaggctgaagaaaaagtgagatttttcatttggctgctggcacaaaataggcttcccactgctgacagattacaagcaagaggctgcaaccacgaagacacatgttctctatgatcagacacttgaaaccgcggctcacctgttctgccactgtccgtttactgccgaagtgtaattcaagctgcactgtagactgcacccca

SEQ ID NO: 47920 - DNA, 437 bp, Triticum aestivum
  Clone ID: PAT_TA_47920
cccacgcgtccgcacccatcttggtggggaagattttgacaacagaatggttaaccactttgtccaagagttcaagaggaagagtaagaaggatatcaccggtaacccaagagctcttaggaggttgagaacttcctgtgagagagcgaagaggactctttcttccactgctcagaccaccatcgagattgactctctatacgagggtatcgacttctactccaccatcacccgtgctagatttgaggagctcaacatggatctcttcaggaagtgtatggagccagttgagaagtgtcttcgtgatgctaagatggacaagagcactgttcatgatgttgtccttgttggtggttctacccgtatccctaaggttcagcaattgctccaggacttcttcaacggcaaagagctttgcaagtctattaaccctgatg

SEQ ID NO: 47921 - DNA, 316 bp, Triticum aestivum
  Clone ID: PAT_TA_47921
agcaacactgcgcaccctgaaatccgaacccgcgcgcgcgcgacgccctccttccagaagcgagcgtctcgcagatccgtccggccatggccgcgggcgcggcgggcgtgccgccggcgcagctggggtcgctgtggtcgacgctggaggaccagcggggcgcgcggggggacgtcccgctgctctcgtcggcgtggagcctgccgggctcccaggccggcggcggcgacggggggcccaagcaggggctgcttcgccgcgccggcgccgccgtggcgggggcgtggggctcgctctgcgacggggtggccgagat

SEQ ID NO: 47922 - DNA, 184 bp, Triticum aestivum
  Clone ID: PAT_TA_47922
tttcttctacttttcctccactcgtgctcatgcctttttttttccccacacaccacccactagtctgctcccgcctgaacccccattaattcctcggcaccggagaagagatcccccgtcctctgacgccagcggccatgtccgtcatgcgggttcttgcgctgctggcgggggctgcgctggt

SEQ ID NO: 47923 - DNA, 421 bp, Triticum aestivum
  Clone ID: PAT_TA_47923
aatgattttggacctagggcccggataataatgtacttcccttgtgaaggctcgcagtatacccctccacactgctctgtcaatttcttttggaaagattattgtcctatggtcttccggaatcttcgggaaatgtttcatattgatgccgcagattacatgatgtccatatgtgggggtgatagtctaaaggagctttcttcacctgagaaaagtggcagtattttctatctttcccaggacgaacgatttgttataaaaacattgagaaaaagtgaactgaagattggtttgatgtaatacgtcctgcagatactgttgaagatgcttccaaaatattacaatcatgtcaaagcttatgataatactctcattacgaaattttttggcgtgcacaggattacgctaaaagctggaaaaa

SEQ ID NO: 47924 - DNA, 432 bp, Triticum aestivum
  unsure (1)..(432): unsure at all n locations
  Clone ID: PAT_TA_47924
cccacgcgttcgcccacgcgtccgcccacgcgtccgcccacgcgtccgcccacgcgtncggagaaacacaagctcagcaaaaatggcacccacccaagaaaagcatagctctgaggagttgctccgggctcaagttgatctttggcaccacgcattgggatttgtcaagtccatggcactcaaatgtgcaatggaattgcaaatccctaacaccatccagcaccatggtgggtctatgaccccttcagaattggccgcaaagattgggctccatccgtctaagcttcctcgcttacggcgactcatgcgtgtgctcattgtgtcagacatctttgttgttcatgaagtagcctcgccaaacaaaggagttgcttacgggcttaccccaaccacacgcctacttgctatcgatgaagttagatcaaacctatc

SEQ ID NO: 47925 - DNA, 396 bp, Triticum aestivum
  Clone ID: PAT_TA_47925
caggcggccccactcgctcctcgccttggacggtcgccatgccaccaagcggccccgtatctttctccccgccgcggaccgtcaccacgccacgaggcgcccacgctcgctccctgccgcggaccctcgccaccgcacgagtttgccctgctcgctccccgctgcggaccatcggcaccgctagctcctcgccgcggaccgtcgccgagccacgaggctgcccagctcgtgccctgtcgcagaccgccatgccaccaggcgacactgctcgtgtcccgccgcggactgtcgccatgccgctccacggccgcgctcctgccttcgaccatcatcttccgatgctcctgccactgggcgatgatggagatggaacaaaccaggtgtggacagggggag

SEQ ID NO: 47926 - DNA, 447 bp, Triticum aestivum
  Clone ID: PAT_TA_47926
cggggtggtcggggatgagctacttctacttctccaatgcccagagcctctgctggttcctcgacccggagttcgagcgcgaggtgcgccgcgtccaccgcctcgtcggcaacgccgcggtcgacgacggctaccacctcgtggtcggcaccggcgccacccagctcttccaggcggccatgtacgccctgtctccccccggcgccgaacgtcctgccggtgtcgtctcgccggcgccctactactcgtcgtacccgccgcagacggacctcctgctctcggggttctaccggtgggccggggacgccaacgcgttcgacggcgacggccacatcgagctggtctgctcgcccaataaccccgacggcgccattcgcgaggccgtcctgagctccgagtccggcaaggcgatccacgacctggtctattactggcctcagtacacgc

SEQ ID NO: 47927 - DNA, 452 bp, Triticum aestivum
  unsure (1)..(452): unsure at all n locations
  Clone ID: PAT_TA_47927
cggacgcgtgggtgatccgccggggccgcaaagcaatggccgccgcagcggcagcagcaggcgcggcatcctcccttgtcccctccacttcccagcgccgcctccccttccgtcccaccccgacccgccaacccctcctagccgccaacaagaccctgacgctctccccgaagccaccccgcctcctgcaccccctcgccgcgtccccctcctctccgcctccgcctgaggatgctgagccaaccgaccccgtcaagctcgccttcgcccgcgccgccgcctacaagaaggagagggctgatcccaagccaccgncaccggcaccgtcgccttcccctccgccgcagccttccgcgaaggagtccagcggcagcaaggaggccttcgagcgggcgctggagtacaggaacggcaacgggggaggactggacggcggctcctcgcttctcaat

SEQ ID NO: 47928 - DNA, 395 bp, Triticum aestivum
  unsure (1)..(395): unsure at all n locations
  Clone ID: PAT_TA_47928
tctgccggcccaatcccgggacgacacagcaagcgaccggtccttctttcggggtatatatatagcttggcattggaggtggtggagcgtgatgaataaccagtgcgtgccgagctgggatctggacgagacggttagcgcggggctcaacccggtgtccgccgggtcgacgcagcgcatggcgcccggagacagcggtctgacggggccggttgccatgcccatgccggaccagtacgacgaggtggcggagctgacgtgggagaagggcaacatcttctggcaggggctgctcaaccggtcggtgcccaagtacctccggccgcgccgcgncggcgcagatgcacgccatcggcggcgcgggagatcaccgggagacgcttcgagcagtggtg

SEQ ID NO: 47929 - DNA, 308 bp, Triticum aestivum
  Clone ID: PAT_TA_47929
cccacgcgttcgcactgtgtctataaccgagtccagaagctacccggcggctacaaagacggcgaacgaaccgatgcgcgtgctcgtcaccaacaccgcatgacaaatcggatatgctcttgctcccatgattgccacgggagctaagcttggtgcagaccagcctgtgattcagcataagctggatattgaatctgctgctgacgctcttaaaggcgtgaagaaggagctgatcgaagccgcatatgcacttgttaagggagctgatgcaacaactgacgttgccgaggccaacactggtgtgaatg

SEQ ID NO: 47930 - DNA, 454 bp, Triticum aestivum
  unsure (1)..(454): unsure at all n locations
  Clone ID: PAT_TA_47930
ggtgctggtgtgacattcatccagaggggtatgttgagttttgaatctacttgttctcggtgcggtggaagcggaaaaattgtgaagaatttttgcaagacatgtaagggccaacagcttgtcaaggggaaaaaatcagtcaagcttgacataatggctggaattgatgacaatgagactataaaggttcgtggtcagggtggtgcagatgcggagcgcaataaacctggtgaccttcttttgactatcaaggtcagagaggatcctatcttccgtagagaaggcaaccatgtgcatgttgatgctgttctaagcatggcccangctgtgctaggtgggactgttacaatacctaccctcaccggnaatgtttcagtcaaggttcgccaaggtacgcaaccaggagagaaggtgtcctacgggcaaaggaataaaggcgaagaattcgtcatcg

SEQ ID NO: 47931 - DNA, 386 bp, Triticum aestivum
  Clone ID: PAT_TA_47931
gcaccatcccggagtccctcgccgccgaaaccccttccctccccctcctaccgaagcgcgcctgccatctcgaagcggaggagctcgcgcggttctctcctgatcttcctcctccgatcccttctgcagctgctggtgtggcgtggctcgacgcgattcattttgttgaaaaaaattgggggttcaactgaacccccatgccccgtgttaagcccgcccctgtgaggagctggagctggtgctggtgctggtgctggtgctagtgctggggctgtggagaagagcgcagcataggaggagcaggggtggaggatgctgagcgtggtacgggtgcacctgccggcggagatcccgattgtggggtgtgagatcaccccttatgtgct

SEQ ID NO: 47932 - DNA, 167 bp, Triticum aestivum
  Clone ID: PAT_TA_47932
tataagcatagacagaaaccaggagatatcgcggcgcacgcgaccaaaccgtaccgaggtctatagagcgagagatcgggaggagctctggctattaagcagcaagaagtcgggcctaggagccaccggagtgacctgccagccggtgagcatagaagagccggtca

SEQ ID NO: 47933 - DNA, 446 bp, Triticum aestivum
  Clone ID: PAT_TA_47933
cggacgcgtgggtcttcctgttgttgtctcaccgcagcaaggagcagtcagcatcgagagagcaacaatggcgatggcgtcgtcgagcgggctgaggagctgcagcgccgtgggcgtaccgagcctgcttgcgccttcatcccggtccggccgctccgggctgccgttctgcgcctacgccaccacctccggccgcgtcaccatgtccgccgagtggttccccggccagccccgccccgcccacctagacggctcctcgccagggtgactaagcaacaaagctagctagctactagtagccgatcgagcagtgaccaatcgactcgacatcaatcaatctgaccggcgacttatattctccccgcagggactttgggttcgaccccctgggcctcgccaccgtgccggagaacttcgagggttcaaggagtccgagatctaccact

SEQ ID NO: 47934 - DNA, 290 bp, Triticum aestivum
  Clone ID: PAT_TA_47934
gacaactgtttggactgatggacttaccagtcttgatcgttacaaaggacgatgctatcacatcgagcctgttgctggggaagacagccaatggatctgttatgtagcttatccattagacctattgaaaaggttccgtactacatgttacttcatgtagtaacgttttgggttaaagcctactgctctcgttggagatctcaatcccctactatcaaaacttcaagccgctatgtatcaatgaagaatagtgacagttggctcttatggatgcataaacaaatggatat

SEQ ID NO: 47935 - DNA, 374 bp, Triticum aestivum
  Clone ID: PAT_TA_47935
cggacgcgtgggcggacgcgtgggcggaccggccggtgtcgccgcttcgtggaccccgccgtcgatactcccgatgcgccatcactcccccgcgcataaatgtggcaaggtcacttcttcccctcagctccaccccaccccacccacccagtccattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgatgagatttgctgtttgctgctcagcaaagcaggatacagt

SEQ ID NO: 47936 - DNA, 347 bp, Triticum aestivum
  Clone ID: PAT_TA_47936
atccgtccggcttgttcattcatagttaactcgttatcgctagaagagtggtacctcaggggggggtgccgcgttgttagcaccaattccatgccttgctcaccggggatcaagctactcactgacagcaactgccggctcgagatatgcacggagtataagaccatgctagctgttgacggacataccggcactcattgtggattactgccaaggtgtcattggcctgctaacaaaggactgtggggaagagctattttctgtgctcaagcttgctcgtttgtacaacctttaacatacatgttcgttggttacaacaacgtttatgacaatttctgcaacaagaa

SEQ ID NO: 47937 - DNA, 238 bp, Triticum aestivum
  Clone ID: PAT_TA_47937
acgaacaaacaccatacgtagagtattaactttttgagagacaaacgttctaaacataacgagggtagactttgatccggataaataaagttgttaaaacataagcccgataacttctttgtaaatagcattgtatttttatggaccagagtcttcttatcgtcgacgggagtggtctggcagtccggcacacgcgggtgggtcctcacacaaacgcaaactgcaaagttatatttat

SEQ ID NO: 47938 - DNA, 427 bp, Triticum aestivum
  Clone ID: PAT_TA_47938
cggacgcgtgggcgctgctactagattattttttttttttgagacaaacgctgctactactgtagattgcagttgtagctagggagggaccttgtttgcccactttgctgtggcctctaaatgagccctgcaggaggggggctagccggtgtctcctcatcataagccaagagacgctgccattctagtctagcttgaggcgacggggaaatggctgcggcgacggcgatggccatgctggcggcgctggcgatcctcgtcctcatgccgtcggcgcgagggctcggccgcgccgagttcccgccggggttcctcttcggcgtcgcgacgtctgcttaccagatcgagggcgcgtacctggaggacggcaagggcctcagcaactgggatttcttcacccacacaaactctaggggaatcgatgatg

SEQ ID NO: 47939 - DNA, 389 bp, Triticum aestivum
  Clone ID: PAT_TA_47939
ccgacgagtagcgcctcaagaccggcttcgagaagttcaagaccgacgtctacgacaagaagctcgatttcttcaagcccctcaaggccggccaggcgcccaagtccatggtgttcgggtgcgccgactcccgtgtgtgcccctgcttcaccctgggcctggagcccagagaggccttcactatgcgtaacataagcaacatggtcccgtgctactgcaagaacaagtactcctgtgttggatcggccattgaatacgccgtgtgtgctctcaaagttgaggtcatagcggtgactgggcacacacggtgtggtggaatcaaggctatgctctcactcaaagatggcgcagacgactcattacactcggtcgaggactgggtcaggatc

SEQ ID NO: 47940 - DNA, 114 bp, Triticum aestivum
  Clone ID: PAT_TA_47940
tggattttcccctagctagctagagccacatctacagcaatggaagctctcgcctcgtcgccgcgggctcgtttcatccgcaccgcctatccgaccactgctctatttacgcca

SEQ ID NO: 47941 - DNA, 431 bp, Triticum aestivum
  Clone ID: PAT_TA_47941
cggacgcgtgggccctgccctctccacgcaccacccacaaaggtttcttcttcttcttcttctggtgcgcgcgtccgtccgtccgtccgatccacacacccagacgtctccttctccctccctgctcttcaaggctctatcttgcggaggtgggacaacaagatgtcggtgctggcggacatgctggcggagatcttccgggagcccacgctggccggggtggcgcgggagctggccaccctcgccgcgccgctctggctcgccgccctcgtgggcctgctcatcggctgggcctggcgcccgcgctgggccgtcgcagtcgtcgacgtcgccgggcaccaacagcagccggtgccggctgcagcggtagcgcatcaggcccctgccccgcagaccactgttgccgaccacttggccgtcgtacctagagc

SEQ ID NO: 47942 - DNA, 438 bp, Triticum aestivum
  Clone ID: PAT_TA_47942
gtgcatttcatcattctattaccctacaatccttcactgtcttcttccttcttgctgtttttgtagcagattatcatgtccagggaggagatgatggatgctcactgttctcctgtggacatctccgagacatatcatatcctttccgtcgacgaggtgatcctcgtgagtgtggtgttgaagaatacgagctgggttgcaccagtagcaaggctacgattcacatcaacacaggaacatactatgtgactgccatcaagtacactggttcctacttctgggtcatggatcctaacttcaataccagtaccagctgccctcttccactgtggaatcaccttccttacagtggatctggcataattgattcaggagagcacggcacaactgattcagcctcacctgtctttcagtatttggccactcaaagcgactact

SEQ ID NO: 47943 - DNA, 420 bp, Triticum aestivum
  Clone ID: PAT_TA_47943
tgggtttcgatctgatctgaacatttggcgctcgatcgatgagccgctgggaagcttcgaatttgtttcactagatgattaggtttcggcggcgaggcgacacatgccgaagctgccgcggatggatgacgcgatcgggagaagtttggttggtttgcagaatttgggggggatttgccttgcggcacgtgtgtgggcagcgatttgtttggtgggggcgacgccgacgccgtatcagctcggaaggtgaaggaccgtgcgggtgactttgtttgttacgacatgcacttaatacggctgaccgacaggaacgggagggcccgtctggttaatatcacagttcaccgtaggttggaaactgattcttgcacggtccgtctccctctggttagcttttgcttgggtttgtagatcacaaca

SEQ ID NO: 47944 - DNA, 300 bp, Triticum aestivum
  Clone ID: PAT_TA_47944
ttcacgcttacgtataccataaaccaagggacatttgccgagtcatctgtcaatgcaagtgacgatgttagccaaggtctccaacaaggtcaccctactaatacagactctaacacacactaggtcgacccggagctagtcatagctgctatgctaactgtggcggcagcagagcttgttgatgaccttatctatgctgacgcgccggcagaccagcttgaggcccatattctgactcatactctgagtcatactcaaaagcctgatcatgagcacgagattgctgaccatgctatagtg

SEQ ID NO: 47945 - DNA, 444 bp, Triticum aestivum
  Clone ID: PAT_TA_47945
gcagcagccgccgtcagcagctgcgcaaaggctcctcaaaccctaaccctagtcctagcttagcttccttcttctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccccggagcgtctcatcggcgatgccgccaagaaccaggtcgccatgaaccccatcaacaccgtcttcgatgcgaagcgtcttatcggcagaaggtttgctgatgcccctgtccagagtgacattaagatgtggccgtacaaggttattcctggccctgcagacaagcctatgattgtagtgcagtacaagggtgaggacaagcagtt

SEQ ID NO: 47946 - DNA, 438 bp, Triticum aestivum
  Clone ID: PAT_TA_47946
gttccggcctagtaattgatgatcggatgagcaagtttattaactctctggctaatgacgcggatcagcagctcaaggtggtgtctattcatggatttggatgtcttggtaaaacaatgcttgccaaagtgttgtacaataaaattgggaggaaattccattgccgggctttcgtccgggtgtccaaaaagcctgatatgaagaggcttttccacgacatgctatcacaattacatcggaagcagccccaagcaagccaagacgcttctgatgaacttcgcattactgctgaaaatatcggcaattgtctacatggcaaaaggtatctagttgttgttgatgatttgtgggatacatcagcatgggatgttattaatcagctttttcccaagggtagtcaaggcagcagaataataacaactacacagattgaagatg

SEQ ID NO: 47947 - DNA, 422 bp, Triticum aestivum
  Clone ID: PAT_TA_47947
acctagagtgtgagcgacttgaatgcgatactgctgccgggcggtgccggacggagttcctggtcggcggtggctgcgtttgcaaggcaggataccgaactatggaggcggagggaatggagttcctgctcgacgcagtggacagatttcccgtacgggaagaatttgctgacagccttgagcaaccagatctagtgtcgctcctctatctgctgcagaatgggggtgcaactgaaggtcgcgttgaggccaatggggaatctgggctagctcaggtggatgtcgagggcgtagctgcagaccgaccacatggtgaacgtcgtccccatgctgaatctccgatgaggtctgctcagtcaactgacagggtgaatccgcaagcccccgggtggacaaaaaggctgcgtctcggaagcgcgcca

SEQ ID NO: 47948 - DNA, 425 bp, Triticum aestivum
  Clone ID: PAT_TA_47948
cattgcttcatcattaccaaatcatcaacttaatcgtttctctcaaatttagggttttctcttttctcgaaagtcttgcggttttctgaatcatctctatctggtttgagggtttcgtttgatatctggagaaaggggtttctggaaacaaggagttcataattcgcgatcttgatctatcgatcttcatttatatataaaagcgtgaatgagattatgatggagtcgaaaggtggtaaaaagaagtccagcagtagtagttccttattttacgaagctcccctcggttacagcattgaagacgttcgtccaaacggtggaatcaagaaattcaaatcttctgtctactcaaactgctccaagaggccatcctgagtaccagcgtgcaccgatcttcataatatagttatagctttctttacttt

SEQ ID NO: 47949 - DNA, 412 bp, Triticum aestivum
  Clone ID: PAT_TA_47949
acgtgattaacacgacgacggcgtgtcgcgccaccgcagactcccactcctaccgcatccgactccacctcgccggagagccgtgagcgatcggaaaccgggccgagggacggccggcagcatcgcgtggcggcgcaagtggcgagaaaatccgcccacctttccgccgcgctttccaacgccaccaccgtccccaccacccgcacgggcgggccaccaccgcaccaccaccaccactaggagttgtgtatccacgcccgccccggcctaggcctccccgccggcgcaccacgctgccacccatcccctcccctccgcccgagcacggagagagactgagagagaccggcaccagcaccactgcagtaggaggagggaataaacaaggggcgccaccgcgcgggccgaggcg

SEQ ID NO: 47950 - DNA, 427 bp, Triticum aestivum
  Clone ID: PAT_TA_47950
ggtcaaaggccacaagctaaccctagccgccgccgcacccccgcctcccatctcggcccgcgccgccccgcccctatcccctgcatcaacgcctgctcgggtccctgcaccaagatctgctcccccgtgtcgcccaaaatccccgagcccgcatccaccaatccacaaaaggtccgcccacaacctgagtccgcctccagcagatccaccgcatacccaggggaagcggagtcagacctttggtgatgggtcgaggcaaaaaggatccctgggcggcacgcggatccgtcgatccggcggaggaggaggcggcagcggtgatggaggttgaagaggaggaggaagtcaagggagactaataggaggaagtcaagggagacgacagaggaggagtggaatcaccacgaggatgaggcgggaggaggag

SEQ ID NO: 47951 - DNA, 419 bp, Triticum aestivum
  unsure (1)..(419): unsure at all n locations
  Clone ID: PAT_TA_47951
gcgctttcagaaggtaaactggacgaagcagtcgagcacctgacggaggccatcttgctgaaccccacttcagctatcctctatgcagccagggctggtgtttttgtgaagatgaagaaaccaaatgcagcaattcttgatgcggaggcagcattacagataaatccagattctgctaaaggatataaatcacgagggatggcgaaagctatgcttgggaagtgggaagatgctgctcatgaccttcacttggcagcaaaattggattttgatgaagagatcagctcagagcttaagaaggttgaacccaatgtacacaaaattgaggagcacaagaaaaagtatgaacgcctgcgtaaagagagggacatgaaaaaagctgacttggaaagacaacgtangcatgctgaggaggtttc

SEQ ID NO: 47952 - DNA, 407 bp, Triticum aestivum
  Clone ID: PAT_TA_47952
cccacgcgttcgacgggggctaccagggatgaaaaccaggatgccatggatgctatcatggctgatattcttgctgatcctaatgacgtaagagctggtctcatgtaactgcactacttgccattcaacccaactgacatgaggactgttcttacttacattgactctgacggtaactgccaccgtgccaccaagggtactacaaagcagatcatcaccctgtacgactgcaaggaagatgtgcacagaaaggtgcactatgacactgagaagtacgctgagcgtgtgcttggttcgctagctgaagcaagacagaaagtccctgataaatccaaggatccttctggaggaccatggcaatttattgatctggagcccccgagagatcacccaagtcatgacattgc

SEQ ID NO: 47953 - DNA, 399 bp, Triticum aestivum
  Clone ID: PAT_TA_47953
atctcgcgtatggtattgctcgtggtgactcgcggcctgtcaacaaacctgtatacttatatgtgtgctaaaacttgaatcagatgttggacgggatgataacatacctgagaccatagaggggaccaccgagggtcagtctcattgttattatcaggggtgctttacctcggccatgagcattagcatggcaataaccactctaggatccagtcgaggattatgcagatgatgacactgatcatgacactatccagaatatgagcaagagctatgggcatctctaactacctcgcagacaaagtagctgttattacagatgtttctacagatcctacttggaatactacttgcaaattcttgatcgtctacgctgaagtacatctgtaattgctcatg

SEQ ID NO: 47954 - DNA, 332 bp, Triticum aestivum
  Clone ID: PAT_TA_47954
cttttgcaccacacacctattggcctcccccaccaactgaatccgagagcaatgggtacttgcgtgtccgatgcaatggtggcttgtcccaacaacgaagtgcaatatgtaatgctggcgctctatccatggattccggcattagctcgaaacgctcaggacaaattaggtctcggccaatggtggagaagacggagtacagggatgagccgctcgagcacggtttgatgggatgttcgcgcgcaagatgcagaagttcgctagaaggaaaaagagctgggcgtcgaggaggagaagaaggtggtatgcaaggtgcttgcaggcccagcagc

SEQ ID NO: 47955 - DNA, 323 bp, Triticum aestivum
  Clone ID: PAT_TA_47955
accacacgtctggaatcgctacgtggtcatgcgggctggtttcactagattcacaactttactcagtctggctccgttccaccgaaatagatggccgcattgttcctcaagggtacagggatcggtcgaggctggttttgtaggtgatgaagaatccagggcctctttaccaagtatttgtggtcgccactgtcacactcatgttatggtcgggatggggcttaaagagtacaaatattggtgactatggcccaatccaagagttaatttaatataccttgtactgcccgatcgagcatgtaatcgttagtttctgggattac

SEQ ID NO: 47956 - DNA, 362 bp, Triticum aestivum
  Clone ID: PAT_TA_47956
cccacgcgtccgagctaagctaaacagcagcgagcaatggcgtccacctcctgcttcctccaccagtccaccgcgcgcctggccgcctcggcgcgccctgcgcccgccgtcgggcgcacccagcttttcgtctgcaaggcgcagaagaatgacgaggctgcatctgacgctgccgtcgtcaccagccggcgcgccgcgctgtccctcctcgccggtgccgccgccatcgccgtcaaggtctcccccgccgccgccgcctacggagaagcagccaacgtgttcggcaaggcgaagaagaacacggacttcgtggcgtacagcggcgaggggttcaaactgatgatcccggcaaagtgaacccc

SEQ ID NO: 47957 - DNA, 400 bp, Triticum aestivum
  Clone ID: PAT_TA_47957
tgctcagctgcgtgctcttgcgacccggctgctagatcttcctcccctctttccctcgcaagaatctgcacccgatttgcgtgctctgcttgattagctccgaggactggtaaaaaggcggtgcgtttgaggagattcggcggagccctggtgccggcaagatgaacaaggactggtccaggatctcgatggatggctgccgcggcgacggcctgctgttgcagaacttgcgcctgtagatgactcccctgtcggagtacgacatcatgcgcatgctggacttccccaccaggaacccggtccaccggcgcgcgcacttcgagatcctgaggatggccgactacctcgaactttgcgcgcccggaggcggcgacggccccttcatgtcaggacgagaacg

SEQ ID NO: 47958 - DNA, 302 bp, Triticum aestivum
  Clone ID: PAT_TA_47958
acccttccgggccccaaccatgggggtaatccccaatccttgcaaaacctgggattctttcaacttgttaaccattggattttggcccaacctattgaccaaggggaaccggttaaccaagcccacttccccggtttgccggaagaagcagttaagggagttcgcgccaaaaaccctgaaggccgccagaaaggccacacccttaaagacacttactctgagagagcactttttgttcgccacctttcccgcttcaaacttggcgaactggccgaacttgaccaccactataggcaagtgat

SEQ ID NO: 47959 - DNA, 358 bp, Triticum aestivum
  Clone ID: PAT_TA_47959
cccacgcattcggacgccttcatcggccgctgggaggggaatagaaatcgtgtgtatcgcaaggttgcgcgtatcgctgagtccagcatccaatccccaacccttgagctatctaactatccggatccggatctcgtaccatggtgtccgatgccagcaagaagaaagccgcgcagagaaaggccgtcgcttgcgaaaagaggggagccaagtccagcgccactgcctcgacttcgtcatcctcttcagctgcctataaggcctccaatggcatagcgttccttaacttatccgagaggacatatacctgcgtcctggctacgaatgcgctctctggacaatgcacatgctgtctatt

SEQ ID NO: 47960 - DNA, 354 bp, Triticum aestivum
  Clone ID: PAT_TA_47960
agatcgaggagggagcaagcccagaggagaggggagacgatggttggtggaggccaggcatcagcagcggagacgaggaagagcgggagaggtgacgccggccggatgagatgtggcagcggagccctagacagagcagcacatcctcgtcacccttctccttgcctccacccaagcggctgcctgcagaggagaactcgatgatagctcttaattcgtggagagaaggctggcaccagtagagaaatttcacgggtagatgagaaacatgtttttggtcttgaatccccttttaaattcagattgacacttcaatgtctcattgagatgaaagtgccaacgaatgattcccag

SEQ ID NO: 47961 - DNA, 459 bp, Triticum aestivum
  Clone ID: PAT_TA_47961
cattagtttgttatagtgatattttgagaaaatggaaatgacttggtgcggatctgaatgtgctaatgacattactgtccaatataggaaccaatgtgctcctggtctgatccatatttctgaaggtcttttttgggtggtcattcaggggctggacttctccttcaggttaatggtattctttctcacatgaagcataggattataactaccgggaagcacatgatgttgttcatgaattcgacagtaattttggtgaggatgtgaaatcccaccttctgctccttccaatctttcaaattgatttattcattgttgtagctttccttgatcttatattcattccgatcaaatttctcaccgcttctgcaaatggtccacccaattaataagagaaaatagggagaagacaaatgtatgacacaagaagagatacctctagaagcagtggaaacaggt

SEQ ID NO: 47962 - DNA, 417 bp, Triticum aestivum
  Clone ID: PAT_TA_47962
cccacgcgtgcgcccacgcgttcgcggacgcgtgggctcgacgcacaagaattcctgaccacccctaccgacttgactgcgccaccacagatcgataggaaaaaaagagagagccgtactcgttgggagtgctcgagatctgtgtcgggagagggtgaattcttgagatcggaatctgaacaagcgggcgcgctcgggatcggggttaccatacaatttttgccaagaacctttagtgaatgtgctaatggagtcaaagggtggcaaaaagtctagcagctgtagttccctgatgtacgaagctccgctcgattacaggattgaagacgtccgacctgctggaggcgccaagaagttttctgctgcatacttgaactgggcgaagaagccatactgatatcgattttggcatcccct

SEQ ID NO: 47963 - DNA, 390 bp, Triticum aestivum
  Clone ID: PAT_TA_47963
cccacgcgtgcgcggacgcgtgggcgaacgattggaagttcggaacgggcccggcggtgccagagccgtgcaaacactacccccggcaagcttatatcctccgacgcggcgactagtaacttgctgcacctctcgcgtcggggatcctcatttgctgctgccaggggtggttatagaacaatggacgtcggtgccccgactccattctgagatccgtctgctgttgatgttactccatacggtgaggacgacggccagactgccttgacccatttaggctacaagttctgcatggacgtctactgatacaagctaatctagccgctagaggaagctgtatgcgtctgatactggctacgccatgggtgctaccgaacttgttatgtgaga

SEQ ID NO: 47964 - DNA, 472 bp, Triticum aestivum
  Clone ID: PAT_TA_47964
gcccaacctgccatttgtttatgctggcgacttcatcaaagtgctatggcaaaagcatgcttccaaaagctattccaatatgatcatatatgttgaagcatgtgaatgtggcagtatctttgagggattaatgccacaagatcttaatatttatgttacaacagcagcaaatgcggaagaaagtagctggggagcatactgccctgggatggaaacaccacctcctgaatatatgacctgcttgctgcttggatgacgcatacaatgtttcttggatggaagacagtgaaactcacaatctacagaaggaaaccatcaagcagcagtacgaggtggttaaagcaagaacggcacccccaaatgactccaatatcggttctcatgtcagggagtatggtgacaagacattcaaggatgacaagcttttcctttatcaaggtttctatcctgcgaatcaagcatcacaaacagg

SEQ ID NO: 47965 - DNA, 385 bp, Triticum aestivum
  Clone ID: PAT_TA_47965
gtcgcacacttaacagctcgcacaccgtcacccggctaaaccaaagctgaaacggttcccgtactgttctgctcccccggtcgagcagaggtgaccagggcctcatgcgttctcccaagcaaccggcgaagctcgtcatgcttttactgttggcactgctgctgctctgtaacggagttggcaacgttcattgcacaaggatccacgagaacagcgtcgatctgcacgcgctgctagacttcaagcagggcatcaacaatcctgaggaagccttgagcaattggagcaccaccacccacttctgtcgatggaatggtgtcatctgcaccaacgacacggcccgtgtcgtgtcttagtcgcttattacctcactgaattggactta

SEQ ID NO: 47966 - DNA, 484 bp, Triticum aestivum
  Clone ID: PAT_TA_47966
cccacgcgtccgggagaaggagctctccacggtggacatcttcgacatgtccatcgaggcgtgccaggccttcgtgggctgcgtctacggtgtcgccatgtccgaggaggagctgctcgtgcaccggagcgagctcgtcgtcgccagcgacaaatacggcgtctagaacctgaagaaggtgtgcgaggagagcatgattgtggacgtcagcacggagaacttgctcgagaggctgcagatggctcacacctacagcctgccggcgctcaagaggacctgtgtgaggcttctcgtggatttgggaggatgtacgagattcccaatgatttcgaggagttcatgaagactgcagaccaggatattgtaggtgaaatccgctcaactgcaatgctcagagggagaaagcttgaggacaggcataagccttcagctgaaaagactcgccggcggaagtccatgccaagccaggattccgatggcggcg

SEQ ID NO: 47967 - DNA, 284 bp, Triticum aestivum
  Clone ID: PAT_TA_47967
gcgcctccgggcccatggccgttctgctactcgtgctatttgcggccgtctcctcgtcgtctacagggaagggggagtcttggcgggcggagcaggagcggcaccgggtgccgtggttgccagggcaagcgttcaacgccagcttcgcgcactacgcgggctacataacctgtagagaggagcgcggagccgcactattgtactggttcttcgaggccgcgcactacccaggctccaaatcgctcatgctctggctcaacggagggtctggatgctcatcaatc

SEQ ID NO: 47968 - DNA, 368 bp, Triticum aestivum
  Clone ID: PAT_TA_47968
cggcaacgacgacgagaatggccaggtcgaaatcacaggtgcgtgacggctggagacggccgcagggtccagagatggggcgcacggcggatgtgttctacttcccattgagagaattctggtgggtttctctaatagtatgccaaactaactaacaattgtagttaactatactgcagcggcgcacttcttattttgggattaagcctaatgcttgctctaccaatcaagtagtactgttgtgaactcataggtaacaccattctctatccaatacagtgcatagctttacgtagattggcatggctgatcttctcttccattattattgctactttatgttttaattccattgttcttcacttgat

SEQ ID NO: 47969 - DNA, 442 bp, Triticum aestivum
  Clone ID: PAT_TA_47969
tgtacacgtacaactcactgatcctctacctggggaaagcgggcaaggccgcggaagccggcaaaatgtacgaagaactgctggcgaaaggctggaagcccaatgttttcacatacaacgcacttatccggggctacagtgtttctggcagccctgagaacgcctttgcggcctacggtcggatgattgttggagggtgccggcctaattcgagcacctacatgcaacttccaaatcaaatgctgtaactgacaagttagttactgtgtgaactgctttctgtatagtcctgttctataatcggggaaatgatcaaccgtagatagtgatcagcagtgacacacctgagagtaatcctagatcgcattctgcactaatgtaccatttttgctggcagaaatttatgccatacgatacgcagtttacggggatcgtctttgcc

SEQ ID NO: 47970 - DNA, 438 bp, Triticum aestivum
  Clone ID: PAT_TA_47970
atccggcgtgcctttccctaccgcgatacctagcgagaaaaggcttgagtgcagtgcagagtgagtagagatggctccggtgaagctgatcgtcgcgaccctgtcgtggaacgtcaccaggtgcgtggcgacgctggaggaggtcgtcgaggagtacgagctcgtccacatgaacttgggcaccgacttgcacaccagcctgaactacatcacctgcaacctgtttgggcacttgccagctcatgcggatggtgactagaacgtctacgacatcccgcgctatttccatgtatgcgtgccactggaccaacccacagctcatgtaggaggtggacatcaaggactaagtgaacggtggatgtcgtggatcgaggtgatggtcgatgagtactcctacgagatgaccgccattctattctagagccttatctattctat

SEQ ID NO: 47971 - DNA, 483 bp, Triticum aestivum
  unsure (1)..(483): unsure at all n locations
  Clone ID: PAT_TA_47971
ctacacctgcaagcgtgctccgcctccccgctcgctaggctctctcccctctccagctcgacctcgcctacaagccgagcgcccctctctctacacctgcaagcgtgctccgcctccccgctcgttgggctctctcccctctccagctcgacctcgcctacaagccgagcgccttgggctgcagcttgtcggccatgctctccgactgttgtgccttccctcccggccagcagccgggtctccatctctggcctcgacgcacacgaccacgcgcaagctggagtagtagggaggttgggccgtgatattcgaatccgccgccctcctgcctcgcctgccgacgggaggaggacgtcngagaggagcgcccgttcgtccaccgcgtgggccacgcagctgcctcggcccagctcggtcgtgaagccgtcgcccaccatctctttggcctgctcgagtggaggttcttcagttccgcgctgggag

SEQ ID NO: 47972 - DNA, 381 bp, Triticum aestivum
  Clone ID: PAT_TA_47972
cccacgcgtccgcccacgcgtccgcctcgccgccgcaaaccaacccctcacctctcgcaatcacgagtagacagcgatggggcgacggggcggacagcgatgccggcgttcttctcgagcgaatttgacctcgacctcgacggggcaacgaggtggaaagcgtcgccggcttcctcctccggcgaattcgtttgtcagtatagctgagtcaccgcccgacgccgttctctacttaatccatcggacgccgaaagaaaccctagcttattataccacatgtagatgtggcaaggctatttgtgctctaagaaaaccaagttggcttggatcccggaagccccgctcgagtcaagttgcgtggatagagaaggggcaggcttt

SEQ ID NO: 47973 - DNA, 350 bp, Triticum aestivum
  Clone ID: PAT_TA_47973
cccagcctacccccaccgatggacgcggcggcggcggcggccggcggccaccgctggacggaggaggtggacgacctggtcgacgccggggacgtcgacggcgccatctccctcctcgagtccgtggtctccagcctctccaccgccgccccctcgcctccgccggcgggcgccgatctccggctcgccacggcgctcggcgaccttgccggactgcacgcctcccgcgggaacaccctccaggccgacgccatccgctcccgcgccatcgttctcctgcttcgcgccgagatagaagcccctcggccccaggccctaaggtttgtttctccttctattccaagctttgt

SEQ ID NO: 47974 - DNA, 368 bp, Triticum aestivum
  Clone ID: PAT_TA_47974
agaagctgatgctgatgctgtctgtgttttgcttgcatgattcagtgcgactttccggagggtcgtgcggaacaagagcacggaggaattccggtggctgccgtacgtcaccaccctcctctacacctccctctgggccttctatggcttcctcaagcccggcggcctcctcctcatcaccgtcaacgccgccggcgccgctctgcaggtcacctacgtcgctctctacctcgcctatgcccccagggacaccaaggtgaagatggccaaggtggtggtgggcgtgaacatctgcttctttgccgcggtcgtcctggtggggctggtggcgctgcacggcgccgtccggctgtttccggtgggggttc

SEQ ID NO: 47975 - DNA, 345 bp, Triticum aestivum
  Clone ID: PAT_TA_47975
gccgatcggatccgttatccgggtgcggggccgcatggcggtggaggtctccggccgcggtgccgagagcaggagcctccgcccccaccctcactccctccacctgtctccaccgcccccgccgaagctccatcttcgccgccccgagcccgaggcggaggccctttctgccgccctccctccccacgcgatccactcggcggcggcgccgagcgatcgaacaaattccgtagctccgacgcgttacagccgccgagatcgatgggctctctggagcctttcaaccggctggtgaggctgacggcgcgcgccttctacgacgacatcttcatcaagggcgacacc

SEQ ID NO: 47976 - DNA, 359 bp, Triticum aestivum
  Clone ID: PAT_TA_47976
atataatcccttctttactcactggtaaaatgtcccgccgccgcccggcgacagcacggttataaggaacgcagttatgcatatgtatgccaggcgtggcgattttgtggcgccaagcggggctttgcttaggtgggccggtccgacacacttccgttggaacggattgtggggagccaccaccaccaccaccaccctatgctcctttgcccgcctggtaagattgatcaaatgtaatgttctgcaaccaaaagagagtaccatttgattttgtgatgactgcttgcagggttaaaagccttatcagaaaaaggtttgtacgcacattaaaaattaatagcaacactgtgttatattta

SEQ ID NO: 47977 - DNA, 363 bp, Triticum aestivum
  unsure (1)..(363): unsure at all n locations
  Clone ID: PAT_TA_47977
ctcctgcgtgccactcagcccagcgacacgcgcccagacccaataggaatataggcgcgcgctccctctcccagatccctttctatatctctctccatccctttttttacccttgcccccgatcccgcaatctactcctgcggggcgatgcgggggaagctccgcaccgaggtgtacaaccgcgtgcccaaccgcgacgccgccatggatcccgacctggagacgccagagaagacgcccgacagaacacgaggagcaggggcagcaggggcggccccgtcggggcgcccgtcgctgccgcacgtgtgcgtngacaccggcacctccttcctnttcggctaccacacaggggtggagaacgag

SEQ ID NO: 47978 - DNA, 438 bp, Triticum aestivum
  Clone ID: PAT_TA_47978
agacaatgcaggcagatgcacggctacattgtcaggctaggttacggggagagcactctcatcatgaacgcagttatgcatatgtatgcgaggtgtggcgatgttgtgtcctcaagggagatatttgacagaatggcaggtaaggatgtcatctcttggaacacaatgataatgggctatgcgattcatggtcaggggagaactgcactggaaatgttctctgagatgaaatgtaatggcctgcaaccaaatgagagtacctttgtctccgtgttgactgcttgcagtgtttcaggcttgacagatgaaggctggacgcagttcaactcaatgcaacgtgactatggtatggtcccacagattgagcactacggatgcatggcagatctgctcggtcgggcaggtgatcttaaagaggttatgcaatttattgaaaaa

SEQ ID NO: 47979 - DNA, 430 bp, Triticum aestivum
  Clone ID: PAT_TA_47979
cacccggacctgagcaaggcggacaggaagcggctgtgccggttgatcgactgccggaagctatcgccggacgtgcgggctcaggcggtatccaatgatcggatgccgttgcggaccatcgtgcagcttctattcgttgagcaggagagaacaatcggcgcgggcggcagccatagcgtcgcgccaccggaccgggcctcagtcgatgccgtctccaggctcacggcaacaggcagagaggacgaagcggcggccatggaccacaggtcggatgtgcaccggccacggcgggcaggccatgaagagcgcgcccagggcgacgcggctgcaatgacgaggtcgctatcggcgtcgacgaagacggcggcgaggaaggacagggcggtggaagagagggggagcaagctgaggaacaagtgaagcataactt

SEQ ID NO: 47980 - DNA, 440 bp, Triticum aestivum
  Clone ID: PAT_TA_47980
agctctctctccctctctcgacgctggccatcgtagcacgccgcctacagccgctgccgccgccgccgtgctcctatccacttctcccctttcatctcctgtcgccgagatcgttgccgccgcgctgctctcccgtcgagctcgcccctcaccgttgctgggaggagacggttgaccctctgattgtatcgacgccgacgagttcggtgggcaccgtgtccttctacaccgtcaccggcgccgcctcctcgtgagatccccaccatggatttgtggtgatgtaggatctgtggtgatgtagaagggcagcagggcagcagcctcaacgccacaggtaaccgctgaggatgtttaaaaaggacaccaccaatagcagagcactctattgctgcaattatatgcaacgtgtgtgtatgatggtggttgggtgttgacatggc

SEQ ID NO: 47981 - DNA, 364 bp, Triticum aestivum
  Clone ID: PAT_TA_47981
cccacgcgtccgaagcccactcccacgcgcccccaaacccaaaaccctaccacgcccatggcccctccctcgccgcagccgccccgcccctccgccgccgccgacggcggccccgccccctccgcggcgccggtcgactcgctcttcctccagaacctgatgagccgcgtccagctccgcccgcccttcctcgacaccaactccttcctcacccaggacctcgacgacttcctcctcaacgagttcgccgcgctcaccgccgcgacgggcgagtccgacgatgaagacgacgaagaaggggaggacggcggcctctccgacggggaggcctccggggaggccaggcggcgccggatgctctcgc

SEQ ID NO: 47982 - DNA, 416 bp, Triticum aestivum
  Clone ID: PAT_TA_47982
cccacgcgtccgggagatgcttcgccctttggacaggaaaatcatctggtgacagccaggtttattggcaggcagatttatatcagcgccgaggagcatgtgcttaagcagaatcttgctggaaaaacctggggagggcagtttgaagcaaaagatatttatatcattctgttcagccgcacaagtatcttgtgcctgatccgaccaagtggagaaacccttgtttgctctcctgaaaatagggtcttggacatcaaaaagctgcacgaaatcatgtctgtgaagtatgaacttgccggacacttccctccgcacttcaaatgcctggatgacgatatatctctcttggacgctaccaccattgatgtgagctcagtggtgcagtatctcccttaatacgttgcactcatgccatt

SEQ ID NO: 47983 - DNA, 372 bp, Triticum aestivum
  Clone ID: PAT_TA_47983
gacaaaactaggtgggattgtcctgaagcaaaagatcccagtcgaggtacatgcatcgcaggtttacaccagaacaatgtttgagaaatttggtgaagcattgcacgtgtgtgggtcgtatgatcttgtagaagtcaagccccaattggagtacattgctaggcacataaaattccagtcaagggaaaagtggtgcaagaatgagtttgtcatctccctgagtgagacagccaatgagttcaggtcatgatacacctaaaactgcatgagctccctccgaaacatgtgctcaagcgatggactagagatgcaagagatatactactaccggagtatttgcgctaccagaaggaccatgggcccctgaagtat

SEQ ID NO: 47984 - DNA, 371 bp, Triticum aestivum
  Clone ID: PAT_TA_47984
gccgcgcgtccgggggtcattgaatgttctattggggcttggcggtgccggaggatatgccatacgaaatgtctcacgatatacatgatatgagacaggactagcactcggccataagctgcctgataataagccctataatgactactatgaatacttcactccagatgacactcttaatgtcacgccaaacaacattgcacactatgatccacactatgtactaactaatctaatagccaatcttttagaccttctacatgaacttagacatgcccctaacgagcaacctcatgagccaccttctgataccccgtttcatgatccagatgaacatgaagaagatcatgatgaaccgcatgatgaccatg

SEQ ID NO: 47985 - DNA, 348 bp, Triticum aestivum
  Clone ID: PAT_TA_47985
tggatattcctcaagataagatatctgatgctctggatgatgagttacttagcaaagatggcaaagccacagagcctgtatctaacttggttcaggaattgaatgagcatccaattggtcgtgtcacaccaactgccccaaggacgtcctaccatcggaacaggtttacatccatatcacgcacatttggagatggttcaaaattatggccagaagataacatgtcaactggcagtgctggtggttctaagaaaacacgaacccatgtttcatactcagtttctcctagaagtgatgaattaggatcaaaacataaaggacatttccgcaagatacaacctcacaaca

SEQ ID NO: 47986 - DNA, 373 bp, Triticum aestivum
  Clone ID: PAT_TA_47986
gatggctagcatacggagagatcatcaacggacggttcgccatgttgggtgcagctggagctattgctcctgagattttaggaaaggctggtctgattccagcagagactgctcttccttggttccaaaccggtgtgattccaccagcagggacatacacttactgggcagacaattacacactctttgttctcgagatggctctgatgggattcgctgagcaccggaggttacaggactggtacaacccaggatctatgggaaaacagtacttcttggggttagagaagggtttggccggttcaggtaacccggcttaccccggtggacctttcttcaaccctcttgggtttgggaaagatgagaagtcact

SEQ ID NO: 47987 - DNA, 471 bp, Triticum aestivum
  Clone ID: PAT_TA_47987
ccggtcactcccgactccggtgcggtgagctcctcgccgcccgccggcgatctccgtatacgagaggagataaatagcgagcccgcgaactctcccgcactccgactcgttagcctttccctttccccgttcggttggtccaagcgctcgcgctcctggctagctggctggctggatctagtcggccagaaccctaacctaaccccgcgggactccaatcctgtccgcatggagccggcggccaacggcgacaagccctccgacgagcagcagcagttcgatcccagccggatgattggcatcatcaaaaggaaggccttgattaaagacctagccgctgcttaccacgctgagtgtgtagcatgttgtaaagagcttctcgaactccagaaaaagtgggaggaggagcaatgtgtcgaagctaagatgccttgagtgccaaaaccatcttcgacaaagccttctaagcgc

SEQ ID NO: 47988 - DNA, 421 bp, Triticum aestivum
  Clone ID: PAT_TA_47988
cacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgattgggggtgtgggcatgatcgccccggaggccctgggcaaggtgggcctggtgcccccg

SEQ ID NO: 47989 - DNA, 431 bp, Triticum aestivum
  Clone ID: PAT_TA_47989
cccacgcgtccgcactgacattcctcttcaacctgcaagtagacctggagagattgataacagaaagcttgttttggaggaaactagcagtggcagtgaagatacagagctccaaagaaccttaagagaaggggaggactacactttggtgccacaagatgtctggagaaaactatatgactggtataaaggtggaccagagatatctaggaaagtgatatgtgaggatccaacttccaggagatatatagtcgatgtctacccccttcatttgacactaattgatgaaagagacaattctgcgcggaccatcaaactaagtaggaaggccaaagttaatgagctttatagattggtttgctcacttctgtctgtggagcagtccaaggttcacatctgggatcattaccaaaagatgaagaacaaaaagt

SEQ ID NO: 47990 - DNA, 376 bp, Triticum aestivum
  Clone ID: PAT_TA_47990
gttattgtgagaattcttaattcaagagttatagggagggactctatgtcaccacaaacggaagctagagcaggtggtggataaatagcttttgtaaaaaattaacaattctctaactaaccttaagagaaggggaggactacacttttttgccacaagatatttggagaaaactattttactggtataataggtatctcaaaatatctattaaattgatttgtgatgattcaactttcaggttatttatagtcgatgtctatccccttcatttgactctaattgatgaaagagacaatatttcacttttccatctatctaaggtggaggtccaatatttaatgatttttttagattggttttttaattttctgtt

SEQ ID NO: 47991 - DNA, 359 bp, Triticum aestivum
  Clone ID: PAT_TA_47991
tgtgtttcctctgtgtactatgtgagcttaagcgagcggaacaccaaaggagggtcttggggatgacggaggcttcgacgacaacctcaaaggcgagaggtactgagactgcaaattgctttcatgtctctttgtttcttactttatgcaactccgtcggtattaaggtcgtatagtcggtgcggagcaacaaaaaactgaatttgttgatgtttacaatttggacgatctgtttgatacatctgcattggtgatgcggaacattgttcaagacagtgtgggttcagaagtgaggaaaacaatttggcttgcagggtgcaggctactctctcgtgacgctggcttaggaaaagttattc

SEQ ID NO: 47992 - DNA, 146 bp, Triticum aestivum
  Clone ID: PAT_TA_47992
agcagttataaaggtttcagagcatgcgagttggtccggctgtttttattcccgtatcatacaagcagctctgttagctgttggtgccccagataatctggttcacatagtaactggttttgcggaaacgggtcaagctctgtatc

SEQ ID NO: 47993 - DNA, 400 bp, Triticum aestivum
  Clone ID: PAT_TA_47993
gctacctcaatccccaattccctctccaagttcctttccctggagacctagttcgtcacaattggtattcagagcaaccgatcctgcccactctggcgccgagcaaacagaaccagcagatcgaggccatgagccagagagtggaggagatgaacgagcagaatcagactatggccgatctgatgaagcagctgctcgtggagttcaaggacggcctcgaccagggggccgccgcccgcaagcaaccaggacgcggggcctggggtcgagcagccggaggtcgaccgcggaggagtgaccactccatctccaagggctgcaccggtgccgcccacgcacctgctgcgcccgcatcaggatcgtgccgtcgccgaccactaccaccttgggcgtgctggat

SEQ ID NO: 47994 - DNA, 397 bp, Triticum aestivum
  Clone ID: PAT_TA_47994
gcccaaagcccaaaccaagcaaagaagagaaagagacagagagtcgtcggcttgttcccggagaggaaaacctcgccgccggcatcgaccggccgcccccgccgtgacagtagacgcgcgcatagctgctgcggaagccatcgatcgattcctcaatccccagcacttgttaccgaatcgcccgacccaacttggaattcctaggttttcatcttccccccgagagctccggaccaccgcgcgagcaggaaccagaaaggtaatggacagaggaggcgacggttctgatctggagctgcagaagcaacaattgggcgaggacgcatgatgcgctcaagggcaggctcgttctcgaggatggattcgagtggtctttaccttcggtgagcttgaactc

SEQ ID NO: 47995 - DNA, 457 bp, Triticum aestivum
  Clone ID: PAT_TA_47995
gttttatttcacatgttggttcttccgtgatatttattggaatgtggaatcttgagtgtgctgttcttccaccttggagcagcaaagctgcaatgccagatgatgctaccgcaagcactatctttccctctgatcgtagtttcgttgtaattgctttccattgatatgttttgcctgtgccaccatagccttctacaaatatctgttttccatgttctctctcagctgactctattattgcatcaaaggccattttctggtcatggttaagattgcttattatggttttgtgctcacctttagtgtttccatgtcgtagctaagttcttcatttatcattctgttcccaagttgttcaagttctgtagcatttggtagttctatgtctggatagtcctttagtgtcttcctgcttgcctcattagttctctatctcgacagagcatatgcttttttt

SEQ ID NO: 47996 - DNA, 375 bp, Triticum aestivum
  Clone ID: PAT_TA_47996
acgggctctctcaggaggcgcgctaagggcgcgccccagcctctagtatggcattgatcgtacgacctgaatccatagctcatgttcaaaaggacatagacgccgcgaaagaaactcaatggtatgcggaatcgcaacatcaggccggtcttcgggttctaaaacgaagccaggaggagaccaacaaactgaaggcggtgaaccagcagcaggccgaaaaactagagggtataaaaactcaactggcgcaggttcgcggagaaaaccaaagttggagaagcggcatgttcagtctcctgactggccgacccggagaggaggtccaatcccttggtgggaacgtgttgaaggaactgtccgtggtcatgagaaagc

SEQ ID NO: 47997 - DNA, 233 bp, Triticum aestivum
  Clone ID: PAT_TA_47997
ccatttgaaccagcggaggccaccgcattcctgcggcgcaacgaggccacctcgcccaccacacgcaaagccaggcagcgtcgggcgcgagggagacgggagacggatcgaccgaccgacccgaccggcgccgatggcgagctcgctggcccgcctgggggcggcgctgccccgcgcgcgcccgctcgtcgccgtggcggttgtggcggatattctgacctttttcttggtta

SEQ ID NO: 47998 - DNA, 209 bp, Triticum aestivum
  Clone ID: PAT_TA_47998
tccgttcggctttacatgttctatgtactctctgcagagagagaagggagataatggccgccggcgagagaaacgagtcttcggcggtggccgccgcgccattgctggcagcagcgagggagaggaatctctgcacggaggggcgcccatggtgcacgctggaccagatctacaagagcatgaccggcatccactacctcaactttttc

SEQ ID NO: 47999 - DNA, 371 bp, Triticum aestivum
  Clone ID: PAT_TA_47999
ttattgtgagaattcttaattcaagagttatagggagggacttatgtcaccacaaacagaaactaaagcaggtgttggatttaaagctggtgttaaagattataaattgacttactacaccccagagtatgaaactaacgatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaagacgatgctatcacatttagcctgttgctggggaaagacaggcaatgggatctggtatgtaacctaatccattaagacctattt

SEQ ID NO: 48000 - DNA, 317 bp, Triticum aestivum
  Clone ID: PAT_TA_48000
gcaagtacgttggggccgctgcgtggctcccgctctgcgtcctgccaacaactcggccgagcagagctagctccacaggaacagcgtagcagtagcatgttgggcgcggcaaggcaaagccaagccagcggcacgatataagctaggaagaggaggagacgccgctgctcctgcccgcttacgtacctaatagccgccagcagtgttctgcttgctcgctctcatcgcttctgcccatacgcgcttgatctgctccgctagcttagctgcgtgctccctcggttggccgtgcggtccgggtcgacgatgcgtgcgcc

SEQ ID NO: 48001 - DNA, 285 bp, Triticum aestivum
  Clone ID: PAT_TA_48001
ttcatgtgttcgttttgctactgatcctgaaccagagacgaacccagagagaggcagggcatcggaggaggcgagggaagcaccgaggccaccacgcacacacgacagcacacaccacaatctgccccaggatctgacacaggactcaagatcacgaagatgttcactcagctgttcagccagattgagatgaggatcgtgatggtgattctcaatgccggtgtgaagaccactattctgtacacgctcaagttcaaagagatcgtcaccaagatcgtcacaatc

SEQ ID NO: 48002 - DNA, 404 bp, Triticum aestivum
  Clone ID: PAT_TA_48002
caagtaccaattggtcagccaaatacaaggagatagtccatgaagcaaaaccagtggaaattagctcatcgaacagtcgcatttttcaccttcaagatgtgccaggtgaaaaatgtagcaaaccaccaaaagtcgtgcttaaagcaaatgccgacagtgatttccttgctgatggcaatgcaggaatatgtcatacaccaggactgatcccactcgctcagctgggagtgcaggtctccaccttttctccttatgctttttcacagcatgtacataatttttctgtgaatccatcttatcctttatacataaacacaaggagaaattctttaggcagttcaagctcaaaagcctggcaagtggagggtgcactaaaaacttaccctatcttggtcaaaaaccca

SEQ ID NO: 48003 - DNA, 255 bp, Triticum aestivum
  Clone ID: PAT_TA_48003
ctaatgcgtccgctaatgagacgcctaaggcgaaaacccatcgccataccaaacgctaaccctaaaacttacgctataacgtcggcgctgccgccggattcccctcccgaggccccgcatcaggcgtccggtttgaacgatgtcttgcgacaaggaggtcagggaggagaaggagctcgacctggacttcgacgtggtcttcaccaaggtcaagaccgactgcgagatcatcaacgaggttatgaagatggcttt

SEQ ID NO: 48004 - DNA, 381 bp, Triticum aestivum
  Clone ID: PAT_TA_48004
cttattcctttagggactctggaaggcgacgtatgttacagccgatgttctctagtgcaatcaagaatgatgtctgtaagatccctaaaggtatcttgaagccaaggatggcttcatttcaagaggggcaggatgatgtgaccatctatgccaagactactgtcactcgtccaagaaatattaaagttacaccgatgcatgagaagttgaccgtgacagttccaaaagggaaagaagctggtattttagaagctttttcatatatacagattggttctatgatacttcagatttctccaccgcaagatgaagttaaaccaaattttaggactccaccgaaaaaactgtgatccgatcggcacaaaaaatactaagtttggt

SEQ ID NO: 48005 - DNA, 357 bp, Triticum aestivum
  Clone ID: PAT_TA_48005
caacttgcatatttcaggtggaacatccttcaggaccacgggaccagccacctatccatcgtggacggcgagaggaacgccgtctcgatgacgagcactgtcaacgcctacttcggatccctgatcctgtccccgagcacaggcgttctgctcaacaatgagatggacgacttctccatgccggcgaacaccaccgcgaacactccgccgccggctcccaacaacttcgtggcccctctgaagcgccccctctcctccatgtgtccaaccatcgttctcaaggatgggaagctgaaggccgcggtgggcgccagcggcgggagcatgatccctgccgggacgatcgaggtgctactc

SEQ ID NO: 48006 - DNA, 288 bp, Triticum aestivum
  Clone ID: PAT_TA_48006
atcgatgatcaccaactcagtcggtcatgcacagaggctagcaagggagaccaagccacaccgagagggctgctgccttctgctccaccgtcggtgcccacgattgtacgccgaccaacttggtcgggaagaagctcaagaagcaggtgacctcgagcgtgaactaccatggcaagagctccaaggacaacatgttcacagtcatggcagcggaaaacatcgacgagaagaggaacacagacaagtggaacggtcttgcctacgatatctccgacgaccagcaggaca

SEQ ID NO: 48007 - DNA, 129 bp, Triticum aestivum
  Clone ID: PAT_TA_48007
cccacgcgtccgcccactcttacgcgtactcatgggccgacgcgtgtacactcactagttaacgtgaggattttacgtttcatatgagcatatacagctatctccataatttcaagatcatgggtcgcc

SEQ ID NO: 48008 - DNA, 351 bp, Triticum aestivum
  Clone ID: PAT_TA_48008
cccacgcgtccgcccacgcgtccgcccacgcgtccgcggacgcgtgggtgcgaattccgatggaggcagcgaacccactatgaacccagctgcaaaagcagccgctgattgtctcgtgaggctagcgctgtcgaaagggagcggggacaacattagtgtcattgttattgacctgaaatcaagaaagaagaccaagggcaaaacctaacatacccataattcacccgactagctgaccatgtctggagtttcgtccgctagtctgcttcccttgcaagaacggcacacctactttttttagttcttcagtcgtctgcaaaagctgtatgtgtatatgctaatagggctact

SEQ ID NO: 48009 - DNA, 342 bp, Triticum aestivum
  Clone ID: PAT_TA_48009
cccacgcgtacggatcgccgcagtgacccgcgccgcgctggccggcgcgttcgagcgcactcctaggggtagctggacgcgtaggggggcggctagtggagcccgctcggcatggacctggccatgcgcgcggtcaggtccggggtgccgacctggaggccgaccgtaggcacgctcgaaggcaacgacacgttcggcggtccatttgccgacaagctcgtcgacgagctgctgtagctcggtcagaaaatggccgagtgcggggcggctcgcgaggtcgacatgcagttcagctccgttagacgcctggtcagccgtgcgctcattttctagatcactcta

SEQ ID NO: 48010 - DNA, 476 bp, Triticum aestivum
  Clone ID: PAT_TA_48010
ctcctttctcctgctcgatctgctgctcccgagcacaaccacccagtccctgagctccttcttccgccgatgaccgaagccaccgagcgggcccccgttgtccccctgcattcctttccccgccatctccctcttcccttattctcatttcccagtttactgtcatctccctctatctctcttgctctctattgcagggaggccgccatggacgcccgaggtcctccgctccgacccatgccccggcggccctgccgaagtcgtcgcctaggaagaccaccatgcccactgcaggaacttcgagccgaccctgcagcatggagaccgccaccgcccatccgttgtcgggaaatcgccgaatccggcccttttcgggcttgcttggccgtccttaatccgtcccgaatttttcccggcgccaagaacttaagccaaccccggcacaagaacctggcttcttttgcccgtaacttggc

SEQ ID NO: 48011 - DNA, 340 bp, Triticum aestivum
  Clone ID: PAT_TA_48011
cccacgcgtccgcgcctcctggccaagaacacaccacttcccagtcgtcaactagctgctagctaaagcttgcgctgagcttaagtagcacctcacacgcgcctaactcgatcagttctctctacgagaagtcaagctagctgaggattgtcgagtacgtagtagcacaatttaagtgatggcggtaggcaacggcggcgccaagaaagtggtggcgcccatggaggtgtccgtggaggccgggaacgccggggacgcggcgtggatggacgacgacggccggccccgccgctccggcacgttctggacggcgagtgcgcacatcatcaccgccgtcatc

SEQ ID NO: 48012 - DNA, 455 bp, Triticum aestivum
  Clone ID: PAT_TA_48012
caagcgcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtcgacggctacagcccaatctacacgccagaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacaaggccgggtc

SEQ ID NO: 48013 - DNA, 273 bp, Triticum aestivum
  Clone ID: PAT_TA_48013
gcagagccgcccacgtcgcccctcccccctccccccctaccgaaatccccacgcaactgcgcaccaccggaggccagcagccggccgcggagggaggaagaaaatctgcgctcctcgccagtcggcagccagtgcccgctacttatacgcccggctcgcctcgcccccctcccctcacagtccgcccccttcccccctcccacctccggcccggccccgatccatcccgtctcagtgagcaaacatggcgccatccatgagtcttgctgcaaa

SEQ ID NO: 48014 - DNA, 144 bp, Triticum aestivum
  unsure (1)..(144): unsure at all n locations
  Clone ID: PAT_TA_48014
acgcagantagtatatcatagcactgacttcaccgtcgcatccgctcacccgactaggatgctcctcagggggctgtagtaacgagcgagcgatccactcaatccgaccatgaccaatcccaagaacggttgccttaagatcct

SEQ ID NO: 48015 - DNA, 257 bp, Triticum aestivum
  Clone ID: PAT_TA_48015
cccacgcgtccgcgcctctcctcgacaaggacgccgaagccgttcgagaggacgatgggctgaagttggagattgctgaattgaagtcgatgtttattgagagagcgcaggctctgattcatggagatctccataccggttccatcatggtgaccccagattccactcaagtgattgatccggagtttgccttctacgcgccgatgggttacgaccttggggccttcttggggaacctgattctcgcatactttgca

SEQ ID NO: 48016 - DNA, 336 bp, Triticum aestivum
  Clone ID: PAT_TA_48016
ggggagcagaaaactccaccccgacggaggccatccggttcgctgccggcccgctcctcctcctcctcgccggcgttcccaaggtacgccccccccactcccgacccccccgctacgccccgcgcgaatccgcgcgattgctatttcgcccggtcaaattcggcggcagatccatctgcgcccgaaaccagaatgttttctccgagtgacgggcgcaatctgctcccccgaatttcagaggtcccatggaggaggacggccctagccggagcggcctgccgccggtcggggagtgcgaatggagggaggagctgaggcagcagcagtcccaggtcg

SEQ ID NO: 48017 - DNA, 339 bp, Triticum aestivum
  Clone ID: PAT_TA_48017
cccacgcgtccggccagattgccaaaatggttctagcaggagtacgccagtcccctccccaggtttgggtgccaaggcagattctggagtagcaccagattcaaaaactgaagaggcaaacagtgttttggaaggacctacagaggcacaaatagcagacagtgagcaggcgacctatgcttctgctaataatgacttgaaaggaacgaaatcttaccaagaagctgatatttcggggctttataatcttgccatggcaataattgattacagaggtcacagggttgtagctcagagtatcatacctggtattcttcaaggagacaagtctgactccct

SEQ ID NO: 48018 - DNA, 188 bp, Triticum aestivum
  Clone ID: PAT_TA_48018
gcccccttgccaagcaaattgacaccaggcagttgtggttcgcgtccaagcagtccttaacttacctggacggcacgctgcccggtgactttggcttcgaccccttggggctgtccgacccggagggcaccggcgggttcatcgagcccagttggttggcctacggggagatcttcaacggccgcacg

SEQ ID NO: 48019 - DNA, 361 bp, Triticum aestivum
  Clone ID: PAT_TA_48019
catggcctcagtaacctcagccaccgttgcaatcccatctttcaccggccttaaagcctcaaccatcaaatcatccgccaccgtcagaatccaaactgctgctgttgcatcaccgaagcttacagtgaagtcatctctaaagaacttcggagtcgcggccgtagcggctgcagcttcaattgctttggccggaaacgccatggcaatagaagttctcttgggaggaggggatgggtcgttagcttttattcccaacgacttctctatagctaaaggagagaaagatgtgttcaagaacaacgctggatacccacacaatgttgtcttcgatgaagacgagatcccaaaggggcgtcgacgt

SEQ ID NO: 48020 - DNA, 165 bp, Triticum aestivum
  Clone ID: PAT_TA_48020
cacggccagcaagatctaaggcacggtgacggatacatttttcaccgacgacccagtctggaacatgaaggggtacgcgctggggagacagtaaattcttgctgtcacataactgttactgacactgaagtgattactcaagtacttgctagtcctcttcaaagc

SEQ ID NO: 48021 - DNA, 385 bp, Triticum aestivum
  Clone ID: PAT_TA_48021
cggacgcgtgggcggacgcgtgggttttttttttttttggcgataacacggtgtattatgaaacaaagtaatgtacttaagctcccatcatacaagttacaacaacacaagtttgagaagctgcctgcctcgcctgctcatggcatggcggcagcgagaaaaaacaacagtagtatcaacttaactaagtacaatgaaacgtagatataccaggaacctcccgcttcacagtcttgaaccacttctatattcactttgtgtgtacgtgttttcttttcctttggtgttaccttgtctcgtcggctgctcagcagagcggcaggggctcgccgttccactccttgaggcactccagcagcgggtcgatgggcttgcgctcgttcat

SEQ ID NO: 48022 - DNA, 313 bp, Triticum aestivum
  Clone ID: PAT_TA_48022
gttgcaagcgagcaaaaacgaaccccacttcgacggccgactaccgctgaccgccgccttgatctgcttccggcgccactacgccggccatgggctgctcgtcttctctgtcagcaaacagtactggaggcttgggcaatatcaacaacgagaactctgcaactgactcaaagaatttgaaagtgaagttggttttactgggggattctggtgttgggaaaagctgcattgttcttcgctttgtccgtggtcagtttgatcccacatcaaaggtaactattggtgcatcatttctgtcacaaacattggcatt

SEQ ID NO: 48023 - DNA, 419 bp, Triticum aestivum
  unsure (1)..(419): unsure at all n locations
  Clone ID: PAT_TA_48023
tctctctctttcccctccacactaatcgcagccgccgccgctggggagcagagcacctttccttggcctgctgccggccaccagatctggtgtggggagactggccgacctccagttctctccgccgtgcgccgcatgcgcctatttctggatttcttaagccagattgggaaattgaaatatggagcccgatgtgctggagcgtatacttggcggaggcgagaagcccacgaatctaccatttgcacttctgaataacatcaccgggaatttctcggaagagcaagaaattggcgagggtggatntgcaacagnttataagggtgtcctcccaaatgggaatgtcgcttgtgaaaagaattaggaacagccatacaattgacgagaaactggtttatcgcgaaatttgatagcctttt

SEQ ID NO: 48024 - DNA, 428 bp, Triticum aestivum
  unsure (1)..(428): unsure at all n locations
  Clone ID: PAT_TA_48024
cccacgcgtccggtacgcacatggtttgtggatgtttatagtgggttgactttgtttgcaggacaagcccgagcctcctccagaaggccgtcttcctgatgctacccaaggctctgaccacctcaggcaggtgttttccactcagatgggtttgagtgaccaggacattgttgctctttctggtggtcacaccctgggaagatgccacaaggagagatccggctttgagggagcctggaccgccaaccctttgatcttcgacaactcttacttcactgagctccttagtggggagaaggaaggccttctttagttgccgaccgacaagaccctnctgactgacccggcctttccgccacttgtggacaaaatttgctgcggatgagggatctttctttggtgactacgctgaggcacaccttaagctc

SEQ ID NO: 48025 - DNA, 395 bp, Triticum aestivum
  Clone ID: PAT_TA_48025
cgcccttgaacagcgggatctgccgcctcccttggacttcgccggcaaggcgtgatccgtcgtcgccaccccactcttcccacgggaggatgcggctgctatcatcaacctccgctccatgggcgtactctcaaattcaatatgttagatttgcagagactaatgttgcatgacgcaagaagaaacatgtggttctgttgcgaatcaccacagcgatgcagtaggtttccagattgatgctattgttactgcacatgagggaatacatggttattattttgaccatatcggtgccatggaagctggagaatttttatctactatacttgttcgttgcctgcatcatattgcagttccaaagtccacataagtttgggcgcaccatgttttaactg

SEQ ID NO: 48026 - DNA, 272 bp, Triticum aestivum
  Clone ID: PAT_TA_48026
accactcgtgcgtcaacgtgcgacgccctcagagcatggctgatgtacaaactgcacggggtgcaagaaaaactcatggagctccaccctcacgtcatccacggccaccctgacgacgtcaactcgtactgctgcgcttgattgcaagggcacatctaaccaagcgccatgtaatgccgagccaattatcgtggagggagccatgagtaccgatgcgttggacgtcactataccagacatgcacgcaacggagacttacaaggatgactgcg

SEQ ID NO: 48027 - DNA, 356 bp, Triticum aestivum
  Clone ID: PAT_TA_48027
cagaatgcataacaatggtggatgtgtacaacgtgtgtctggtcctattggaggcatactatactctctctgtacctctccttcaggactgattgctgttggtggaactgatcgtgctgtcacaatctatgatcctcgcaggtggtcggccttatcaagatgggtgggctgctcgaagtatgagattactggtctttcgttttcgtcagtggaccaatccttcatgtacgtccaaggtgttgattatgagattacttgtggacgctggagagaaagtaagcgcgcattctcatttcgaggtgattccaactggctgggcttttcaaagtgtgcaaacacagatgtggttgcttggt

SEQ ID NO: 48028 - DNA, 318 bp, Triticum aestivum
  Clone ID: PAT_TA_48028
acccagccaaccacctctcccctcccctgcaagctcagcccagatctcgtctccttccttcctcgaaccaagcatcaccaatggcgaccacggcagccgacgccacggccgcggcgcccaaggagcagcccgccagcaccggcggcgagcaggtcacgcgtcactccgaggtcggccacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacg

SEQ ID NO: 48029 - DNA, 286 bp, Triticum aestivum
  unsure (1)..(286): unsure at all n locations
  Clone ID: PAT_TA_48029
cggcctctgccccaccctcgtcctcctcctcctccttccccgtctcgtcgcctccactccaccagtcccccgccgcccccaccgccgcctccgcctagggcagaggggctgcccatggagctctccaggatccggaccttcgagaagcgcctcctccggccgctcctctccctgccgtcgcgctcccggtcgttccagaccctggcccgcgcctncccttcgccgccccgcgccccctccctcctactactgctccgcacgcgccacctngctccccatccccacc

SEQ ID NO: 48030 - DNA, 466 bp, Triticum aestivum
  Clone ID: PAT_TA_48030
cgccgatcgcatgctgctctccctcgcccagccccgcctgctaccccgcctcccctccccggcgaccgccaccgcgactacagcccgccctcgcgccctcgccctcgccctcgccccgcgccgcgcgcactcctcggccgccgaaaccgccgctccaggccggctccgcgcggtggtctcggagcgggctgttgacgggatggcgccggccgcggcggggcaggaggggcggccgctccgggtcgggctcgtgtgcggcgggccctccgccgagcggggcatctcgctcaactccgcgcgctccgtgctcgaccacatccagggtgatgactcgttggtgagctgctactacatcgactgtggcatgaacgcgttcgccatatcgccagctcagctgtattccaacaccccttcagactttgatttcaagcttgaaagtctagcacaaggaatttccaccctatct

SEQ ID NO: 48031 - DNA, 221 bp, Triticum aestivum
  Clone ID: PAT_TA_48031
tcatcatcatgcttgacaccaaagctcatgttctgctgctagaaatctttgcgggttcatcagatggggaggatgtcttgcagctgtggatccgcatgcagctgcggctcaaactgcacgtgcgggatgatatacccggctctggcggagcagggtagggcgtgcggcccatggcgtcgtcatggtacgggctcgcgtggcgcctgagaacaaggtggggc

SEQ ID NO: 48032 - DNA, 436 bp, Triticum aestivum
  Clone ID: PAT_TA_48032
cccacgcgtccggcattgcggccggcaacgatcgagcttggccggtggcgccccatggaagccgcaggttggccggagccggtggtgcgggtgcagtcgctgtcggagagcggcgcggccaccatcccggaccgctacgtgaagccggtgcacgaccgcccgtccgtccacaacggcaccgccagcggcggcgtgagcatccccgtcgttgacctctcgtcgccggaggggagcgcggcgacggcgcgggcggtgtcggaggcttgccgtgagtggggcttcttccaggccgtcaaccacggcgtgccgggtgacctccttcgccgcgcgcgcgccgcgtggcgcgggttcttccacctccccgtggaggccaagcagcggtacgccaactcgtcggcgacctacgaagggtacggcagtcggctcggcgtggaga

SEQ ID NO: 48033 - DNA, 206 bp, Triticum aestivum
  unsure (1)..(206): unsure at all n locations
  Clone ID: PAT_TA_48033
gccccaaactcaagatggcggacggtcttgattcccctccgcctggcctaacccatgccccgtgcccggaaaccctagcccctactccgtctcgccatgccactgtggtcgtccctacagttgctcctcctnatggcagcctgcacctacgcgggcgcctagggctcgggccttctcctcgccgagcgcccaggattcacctggca

SEQ ID NO: 48034 - DNA, 437 bp, Triticum aestivum
  Clone ID: PAT_TA_48034
agacacgcaaccgcagattgtaccatctaatgtagacgtaggtgccatactgattgactttcagctggaaaaaaatttccacaccagacatctcattggttttgttccttctcaaccaaatgattgattgattgcttgcaactctaggaacatggtatagcttatctgcaaatttcgtacagccattcccatttcatacacttgggggtttagtcactaatcaactaggtcattaatagagcggccatgtgtctccctattttatcatgtccctagtctgagttaactgaattactcgaaacaaacctgcattcatcagaactggacctgtatgataatgttatatcctgtaaaggaaatacagtgttaagtactagttggttagcttttgtgagctaatgttctcagaattgtactaattctcttgtctttttggt

SEQ ID NO: 48035 - DNA, 273 bp, Triticum aestivum
  Clone ID: PAT_TA_48035
cccacgcgtccgatgtcgaccgccgaggctaactggtgctacgcaaccgtagtcgcgccccgtgcccgctgctccaccatcgacgccagcctcggtacccacgcgcgctccaactgctgctacttgcgacccaagctcatcaagaacacccgcgttcaggccggccccgttgcacccgaattgatggacgccgccgtggagcgcctcaagaccggtttcgagaagttcaagaccgaggtttacgacaggaagcccgattgcttcgagccccta

SEQ ID NO: 48036 - DNA, 246 bp, Triticum aestivum
  Clone ID: PAT_TA_48036
ggaccggaacggcctggccgggccgaccgacgcgtccgccagcgcttttatgacccacagacggccatctacagttgtttgtatggccgaccaagcggccaccgaaatggctgctgccttctcctcaccggacaagccctcgctactacaccacctaagaacgttggtacgaaacatgtagatgaggatcctcaggatgtggtcaaccatgggagaaactctaaccccagcaacttctcatttatg

SEQ ID NO: 48037 - DNA, 318 bp, Triticum aestivum
  unsure (1)..(318): unsure at all n locations
  Clone ID: PAT_TA_48037
atccgcaccacgccggacggacggcgctgctacgtccgacgcggacagctgaatgaatcatcacttcatcagtagtgggggggaggctgtccctttacccgaattcatcatcatcaataagaaaagatatatcccctgtggcgccggcgccggcgcataataaaaggagaagtttctttcgcttattctggaatcggaaccccagcaagcaccattcatggcggccatgtcgtccttccggcttcttcccctcgcgctgaatgatcgtnctgctcgccatgaaggacgcgctgctcttgctccattggccaaatgacc

SEQ ID NO: 48038 - DNA, 350 bp, Triticum aestivum
  Clone ID: PAT_TA_48038
acgacaatttccacaaccagctactataacatacagggtcgcccatatcggaccatatggccgtcgggagcgggagcggctacccggccgtcgctactggatggtgcactcgtggctgcgctaataatactgagaccagaggctatgaggatcaaaatgccggccactgcgaccaactgcggatgcgacgagattcaagccaacctgattgccgggcgaatactacataatcaacatctaatgccacttccaactgacaaagcaaaaggggcgacaaagtgtcgttaccatatatgagtactatatatcaaaaaaaacatgccagattattgcaaataggatttactact

SEQ ID NO: 48039 - DNA, 297 bp, Triticum aestivum
  Clone ID: PAT_TA_48039
cccacgcgtccggctagctcgctcgatcgatcgtcctctcaaccaccatggcctccaccgcgctctccaccgcctccaaccccacccagctctgccggacccgcgcgagcgcgctgtgcaagcccgtcaagggcctgggcttcggccgggagcgcgtcccgaggaacatcacctgcatggccggcagcatctccgcggaccgcgtgccggacatgagcaagagggagctgatgaacctgctcctgctgggcgccatctcgctccccaccttcggcatgctcgtcccctacggctcct

SEQ ID NO: 48040 - DNA, 234 bp, Triticum aestivum
  unsure (1)..(234): unsure at all n locations
  Clone ID: PAT_TA_48040
accggccgaatcccggtcaccacgcgtccgacgctggcagancagaatggccgccatgcgctctcgccgcacccgcatccccaccagcgcccgtctgcacagcaaggccgactcaagcaaaaggtcgacttcgccgacttctccgggctgaagccggggtcgtgctccgtcagcgccgccggcagggaagcgtccttctccgatgtcctcggcgcgcaactcgtcgccaggggc

SEQ ID NO: 48041 - DNA, 269 bp, Triticum aestivum
  Clone ID: PAT_TA_48041
ctttctttcttccccgacacgggcacgcacgcacacggctgccctgcgcccacacacgctactcttcggcccttcctcccaaaatctaaaccccactccgaccgccccccctccggcgatgctgatgcgtcgccgccacctgctgggcccggtcctcccccgccttctcctcaccgccctactactcgcgtcggccgtcgcattcctaccccgcgcggccggagacgacgccgacgaggcgggcgacaagcgccgcgtgggcgaagcgg

SEQ ID NO: 48042 - DNA, 287 bp, Triticum aestivum
  Clone ID: PAT_TA_48042
cccacgcgtccgcccactcatcttgggtatctggggaggcaagggtcaaggaaaatcgttccagtgtgagcttgtcttcgccaagatgggcatcaacccaatcatgatgagtgccggagagctggagagtggcaacgccggagagccagccaagctcatcaggcagcggtaccgtgaggctgcagacatgatcaagaagggtaaggtgtactgcgtggtcccgaccattcgacccgcaccggcgtgcggactcgtgggcacacgcctggactcattggtgatcacca

SEQ ID NO: 48043 - DNA, 282 bp, Triticum aestivum
  Clone ID: PAT_TA_48043
acggcgacggacaaggagttcgtggtcttcatcgatggcgagcaccttatcatctatctcattatctacatggtatactgctactactggcaaagcacattgccaaaagctgtgtatatattggacggggacaataatacagatgctgatatgaagatggtatccgagatctatgagcaattttgaagaatgtatgattgcatgagtgaggataagacgcgcgtcaacatcgcggatgactaactttatctgaagatagatgtgaccgctgatgtaaaaaca

SEQ ID NO: 48044 - DNA, 197 bp, Triticum aestivum
  Clone ID: PAT_TA_48044
atctcgtgtattatatccaaagtctcacgaggaagctgacaagatgatgggctcaaagagttggagaccattattgaaaacttaactcaaatcttatcctgagggagagacagagctagtgcaagagcgctgacatccaacacgttacgcaacgccaacggtctgggatataattgaacgcctgaacgaaatctttg

SEQ ID NO: 48045 - DNA, 421 bp, Triticum aestivum
  Clone ID: PAT_TA_48045
catcgtccccatccctccctcctctctcctcctcgccgccacaggggtccctctccttcctcaagcagcggcggcggcgtgaaatacagtgggctcggccttcgtcggcggccgggttcctctcctccgtcgagcagaggcagcggcggtggcggcggcgtgagacgcagggggctcggcccttcgtcggcggcggggttcctctcctccgccgagaagcggcggcggcgcgggacgcagcgcgacctgactgcgtcggcagcagcggggtccctctcctccgtccaagggaggtggaggtcgagcgcatcgtggccgctggagtaagaaaaagcacgggcgggggggctgaagatgccggcgagccggaagaagcgggtgaacgcgtgccgcgggaacccggcggccgggtcaacctggc

SEQ ID NO: 48046 - DNA, 419 bp, Triticum aestivum
  Clone ID: PAT_TA_48046
cccacgcgtccgggttggggcatttcaccgcgtggtgccggatacacatttggccaggatatttcagaacagtttaaccataccaatagccttaagctaatagcaagagctcatcagttagttatggagggattcaactgggcacatgagcaaaaggttgtgacaatatttagtgcacctaactactgttaccggtgcggtaacatggcctcgatcttggaggtggatgactgcagggagcatactttcatccagtttgagcctgccccaaggagaggggagcctgacgtgacccgaaagacgcccgactatttcttgtaaatgtagcctaagccattcgtttttgtttttattttacggtatagcttaagttattccgacagcaaacaaaaaaaaaagcgcgtgataactagatgcgc

SEQ ID NO: 48047 - DNA, 388 bp, Triticum aestivum
  Clone ID: PAT_TA_48047
gctgaacctcgagaatgccggtagccatctctgcacagcagtatcgaagggagactctgatttcattcggggggctctagcttatggtgctgacccaaactcgaaagactacgaccaccgcaatcctctccacatagccgctgcagagggcttgtatattatggcgaagttgctggtagaagctggcgcaagtgtgcttgcaacagacagacgcggtactactcctctggatgaaggacacaagtccgggagtaagccacttataatgctgcttgaacaggcgaaagccgacgagctctccaagttccccacacgaggcgaagaagtgagagataagatgcatacacgacgatgctccgggttcccttaccatccatgggatactgat

SEQ ID NO: 48048 - DNA, 363 bp, Triticum aestivum
  Clone ID: PAT_TA_48048
gacccacgcgtccgcccacgcgtccgcatctccatctccgcgctgcttccgctctagcttctagctagctaagtaagatatggctgcaatggcgacgacggtgttccaggcggggccaatggaggtggatgtgaagcacgtggacaagagtatgatcccgaacctggccaggccgttgatggtggtggcgcccaaggagaccggcgcgtaccccgtcatcgtcttcctgcacggctggaacatgctcaacagctggtacgagcagctcctcacacacgtcgcctcccatggtttcatcgccgtcgcaccacagctctactggatggtgtccgagcccgatgcggacgacatagacgccacaaa

SEQ ID NO: 48049 - DNA, 390 bp, Triticum aestivum
  Clone ID: PAT_TA_48049
ggtgcgaccaccgcgacgagttcttgcacgagctcgacgaggccgtgcggctcaccggcggcgtcaacctcgccgacctgtacccgtcgtcacggctcgtgcgccgtctcagcgtagccgcgcgggacatggtcaagtgccagaggaacatctatcgcatcgtgcagagcatcataagagtaagagaacgcgccggcgcgccggagccagagagagatgaggacctgctcggcgtcctactcaagctgcagaaggacggcggcctgcaatttgaactcaccaccgagatgatcacagccgtcattttggacatttttgctgctgggagcgagacatcgtcgacgaccttagagtgggccatgtcggagctgatgaaaaacccacgggtgc

SEQ ID NO: 48050 - DNA, 252 bp, Triticum aestivum
  Clone ID: PAT_TA_48050
ataggaatatggcactgacaaatgaatggctggcacgaagtacttcgatggcctcctcggcggagcgcgcatacccgtcgacactcgtaacaccggcacgagctaatgcggcttactgcatgaagacaacatgaactcaatccgtctcaaagatgcgcgcatgccagccctgcttaccgtgaaagacgaatccgacaacacgtgggagaacggagacatgatcatcaaggacatcaaggggaagtggcaggc

SEQ ID NO: 48051 - DNA, 382 bp, Triticum aestivum
  Clone ID: PAT_TA_48051
gtgttcacataatcttaaaaaaactgtaatcacaaaaatgtgttcattgtgtacttaaaagtggtcatcatgcacaaaaaaatgttgagagtgtatgagaattttttatcatgtaatacaaaatgttcacccacattatgaaactaatcatgcgtgtataatcgctgcatttcgggtgagtacaaaaagcattcattgggtcctttaaaaacatgatgttttttcaaaaaaaatccaatggtgtttttttagaaggttatcacatatttttttaaaccatttttttaaaggggcaaccattttttaaaaaattttcccgttttttataaaaactgcatttgttaaaacgggggtatttttttttcccatatttttttttttt

SEQ ID NO: 48052 - DNA, 285 bp, Triticum aestivum
  Clone ID: PAT_TA_48052
gttattaaacaacggctatggctaacacgactgctattgtcgacaacaatacctgggacaacgctcacatagcaacaagcggtacagcaatgtcatgcgcagaaaaggcaggaggggagatctttgagtctttaaatgacaaatatgtgcttggcgtattcggaagactggttggctaccctagagatgatattaacaagctccttaggatggttcgcatattatgtggcgaatccccttacatcaaggagccagattatcttagagatggccagtaccgtgttg

SEQ ID NO: 48053 - DNA, 162 bp, Triticum aestivum
  Clone ID: PAT_TA_48053
ggagcgccgcgggttcgtggcgccggcgtcggttggcgggcggtggccgggggtcgtcggtccttcgctggttctctcgtcatcggaaaaataaatcggtcgatctggctttggtgagggatttctcaaattgcgtcgcgccggtgggttcttccgtggggc

SEQ ID NO: 48054 - DNA, 207 bp, Triticum aestivum
  Clone ID: PAT_TA_48054
acgggagcgccacgtattcctggcgccttcatccttacacggtctatggccgggcgtcatcgggccttgggtgtttctctcctcagcggaaaaataaatcggcctaactgcctctggtgagtgatatcttatatatcgtcatacggttgtattctctgatggggcaaaaccatgatatttatccattcatactctaaaatctaatct

SEQ ID NO: 48055 - DNA, 349 bp, Triticum aestivum
  Clone ID: PAT_TA_48055
ggatgcctgatggcagaattctgtggctcgtggtgatctacaaaactacgtacttcttgacgtaattctgtggctctacgtaattctgtggctccatggaaagcaacatgcatacatgcacactctaagtctacatgatgaatcatcatgcttatgcatcaggatggtgtatagagactttgtaagaaagattcagcatgatgtgcaagagttaactgcattgtgagttgagcacgtgttagtaaggacatggccatctacattggaataactaagatgccatttttaaagtttatataaccattactcagatcaaccgacaattcattatttgcatcttaactgactt

SEQ ID NO: 48056 - DNA, 247 bp, Triticum aestivum
  Clone ID: PAT_TA_48056
ggacggcggaaaccgcctcccaaaacccgcacccgctgcccctccgccccctcccatgtcgggcccgcgtcccgccgccgcgccgaaccctagctccgcgtcgccctccccgccccctcccccgccggccgccgtcgccagggtcgcggccagggtgcgcgaggagggcgaggtctcctcaggcccctccgacgacgaggctctgcaatctcagctgttagctctatccaatgctgggaaatatgtg

SEQ ID NO: 48057 - DNA, 394 bp, Triticum aestivum
  Clone ID: PAT_TA_48057
gaattcgcagattccggcctacgacccacgcttgctattgctcgtaagcgtgcagactgttagttctcgactcggagcaccaaaatccaaagcggccagaaaccgatccttgttgttgaatacagacatgagtgtcctctgatccagttctgaacgactgcgaacatttatgtgctgaccatccaaaacatgttgatcggcccatgccatgtcccaccaccgaccgacgacaccatcatcatgtgaagaacatacttagggaggacgctgaactgcatcaagaacccactgctgtatccgtacactctgagccgactgcgatcgatgaagtgaggactgctacttactggtcatctttttgaccatcaactcctttttggctgggagatggata

SEQ ID NO: 48058 - DNA, 414 bp, Triticum aestivum
  unsure (1)..(414): unsure at all n locations
  Clone ID: PAT_TA_48058
ccgccaagctcggcgacttcgggctcgcgcggctcatcaatgatggccagatatcgtacatgactgacacagccggcacaatggggtacatcgacccggagagcgtgctggccggcacagcgagcgtcgagtcggatgtgtacagcttcggggtcctcctcctcgaggtcgcatgtggtcggcggccagctctagtccaggaagacggtggtgccgtccacctggtgtcatgggtgtgggacttgtacagcggaggatcaatccgtgccgccgccgacgagcggcttangggggagtttgacggtgcggagatggagggtgttatggtcgtggggctctggtgtgcgcaccctgaccgtggcatgcggccatccatcaagccagcgattaacgtgctgcggttcgaaacgccat

SEQ ID NO: 48059 - DNA, 186 bp, Triticum aestivum
  Clone ID: PAT_TA_48059
acgcgaacgcactcacattcgatgttgctattgcggaacatgtcggatgctgaaactatagatacaggcgtctattacggtgccgttggacaaggggaagaatgtcaataccgacaaccactgtggggatgagaacgagcagatacacggtgtgcttgtcctttacatggataggctcgatgaaat

SEQ ID NO: 48060 - DNA, 337 bp, Triticum aestivum
  unsure (1)..(337): unsure at all n locations
  Clone ID: PAT_TA_48060
nggacacataangtgaacacaaaaacattgtattttatttataaaaaaacttactggtcgcgggcgctatggtgtacatcaagaaccaaaaaacaagggccttcttcaaacgttttcaaatcaaatttaaaagaaagcgccaggggaatacaccactacacagccacagtgtggctctcaaaccccggcaagaacacatacactacccccaaataccgcttttttgtgcgctataccaacaaggatgttactgtacaacaattgtatgctaccatttctgctgatattttgataggcgctgtctactcccatgagttacctctctattttcttgaaa

SEQ ID NO: 48061 - DNA, 267 bp, Triticum aestivum
  Clone ID: PAT_TA_48061
ggcttctccttcccactcactcctcggttaccggtccggttcggttccgttcggttcgttagggtttagtagcggggaagaggacctcaagggcgtcgtcacaaatgtcattcaccacccggggccttgtgcggcgcttggcaaagtaaactttccacaaccccttatgtaacaacggcgacatgatcttcttcaagatcatcactggcagggagacgggccgtttccgcgggttcgggtttgtcacctttgcgtcggacgaggcga

SEQ ID NO: 48062 - DNA, 189 bp, Triticum aestivum
  Clone ID: PAT_TA_48062
gtcgcacagaagtgtgggcggagaccttctactacatggctcaaaaaacgtatgtttggggcattcttctaaaccaagcattgtgacccctggtgcttgatgcaaagacagggccacccctgaagaaataaccaacttcacccttaagcttcttcaaaaaaagatcccccctttcgtccccggcattat

SEQ ID NO: 48063 - DNA, 431 bp, Triticum aestivum
  Clone ID: PAT_TA_48063
acttcatcttttcagcattctatacaacaaaaggttcactgcatttcacttcccagtatcagaagaggaagtacctgactatcgaacaatagttcacaaccccatggatatggctgctgtcttgcagcgggtggactctggacagtacttctctcaggcagcgtttttgaaggatattaatcttatagtcactaatgcaaaggtttgagtttttcttttggggcatttagttttccactcatgttacatatgttctgatcgtacttcatagcaagtaccttggaatctgataataatctttatgatgatggcaactgatttttttccatgttacatatgttttggtcatactttcctggcaagcacgttacaattcaaaaccgatctttctgattatggtaactgagaaaatgacctaacctctgtaacaa

SEQ ID NO: 48064 - DNA, 106 bp, Triticum aestivum
  Clone ID: PAT_TA_48064
cctacgcgtccggatgcattggccagggttctgatggacccaaatcatccaacagagatacttagcatgtaccagcagtgggccattgatctggggaggttgcttc

SEQ ID NO: 48065 - DNA, 186 bp, Triticum aestivum
  Clone ID: PAT_TA_48065
aggtcggacgcgtgggcacgtagcaggcgatttacttacatagtacatatatggagggacttatggatgcactaacagaaactatagtacgtgttgtatttaaagttgtggtcaaatactataaattgacttactacacctaacatgaagtcagtactgttctgaagcttaagtattctagtgggt

SEQ ID NO: 48066 - DNA, 298 bp, Triticum aestivum
  Clone ID: PAT_TA_48066
cccacgcgtccgcctcacgcgtccggtctaaacaaacctaatggaaggcctcaaaaggataccagagaccagcctgccgacccccgcgtacgtcccaggcgactcgggggatccgttctcgccgggcggggccggaccgctttacctcccccttaccgacgacgtgaagacaggtcgggctcatctcggggatcaggcagttggagacgctcttttacctgccatcgatcaggacggatgcctttctgaagcaggtgtactacctgattcgctgcaagtgggggccttgctatgagtt

SEQ ID NO: 48067 - DNA, 314 bp, Triticum aestivum
  Clone ID: PAT_TA_48067
agaccgcttacaagaaggatggagcaacttgcacagtaggctacggatctggaccaatcgctggatgcttcagctgaggacaagggggtaactacgacgcagcttagtggtgagaaaagaaagaatgttgactcagtaggacatacgcatgtgaatgcaagggctactcttattgttgtgaaggtggatggactactgtggcctgggattgatcggagactttcctggtgtgtgtccctacgagtcggcagagcatgcaagagcagaatctgctacgagaaggacatcatctacttctggctgaaccgggatcc

SEQ ID NO: 48068 - DNA, 256 bp, Triticum aestivum
  Clone ID: PAT_TA_48068
cccacgcgtccgaccaccacccgccccctccgccgcaatccccagaccaatcaccggtccaccgccggccgtcacgctgctcccactccccatcttccacgtcttcggcttcatgatggtcctgcgctccgtatccatgggggagacggccgtgctcatggagcggttcgacttcggcgccgcgctgcgggccatagagcggtaccgcgccacgctgctgcccgcggcgccgcccgtcctggtggccatgatcaag

SEQ ID NO: 48069 - DNA, 312 bp, Triticum aestivum
  Clone ID: PAT_TA_48069
cccacgcgtccgggttgattgatcctcttccgcctccgtacctcgtgtcggtcctcgcgagttcgccgtggaacaccccatgggctccggcgaggacacccccggaggaaccggtggaggagtcggcgggatagtccggggtgcgctgctgaaggcgctcgtcggcttcggcggcgttattctcatccggcggctgcgccgctccaccacccggtgggaccacgcccgcaccgtcggcgacgccctcttcggtgaaaagttctcgagggagcaggcaaggcaggatcctggaaactatttcaaccttagaat

SEQ ID NO: 48070 - DNA, 383 bp, Triticum aestivum
  Clone ID: PAT_TA_48070
ccctcctattcaccaaagctcaaccctgtacacgcgcgaacattttcccccaaatcccactccagcggtgagagcgccgccaaaatagcaccaaagctggggcaccccccctggtacctaggggggagaccggggcactgttcaagccatcgtcgttgcaggccccggctcccgcggctgtcgctgccgcagccggcgccgctgcatctgcagcagacctgggctcccgcggctgccgctgtagaggggccgccgccgccgcctttgctgcatctgcagcagacctgggctcccgcggctgcccctgtagagggtccgccgccgccgctgcagagggttcgccgccgtggagcttgaccgacctgctgccctcgacaacaact

SEQ ID NO: 48071 - DNA, 229 bp, Triticum aestivum
  Clone ID: PAT_TA_48071
ggggctgtgctctgacaggtgctttattttgactgtgtccatgctcacgaggcgcgtataagattgatccaacgcgctgataggaacaagagcgctatggatctgaatgtgtgatcgaggtcatggaggaaggctagactgcatcagacgaggccaggcccagcgttcagattatgtgctcctgatgatgagcgcaagcacatcaactactctctgaaagagaaagata

SEQ ID NO: 48072 - DNA, 309 bp, Triticum aestivum
  Clone ID: PAT_TA_48072
acgccctcctattaaccaaagcgcaaccctgtacacgcgcgaacattttcccccaaatcccactccagcggtgagagcgccgccaaaatagcaccaaagctgcggcggcgcacctcatccatagccgcgtcacccgtgccctcttcaagccatcgccgttgcaggcccgggctcccgcggctgtcgctgccgcagccgccgccgctgcatctgcagcagacctgggctcccgcggctgccgctgtagaggggccgccgccgccgcctttgctgcatctgcagcagacctgggctcccgcggcttgccct

SEQ ID NO: 48073 - DNA, 353 bp, Triticum aestivum
  Clone ID: PAT_TA_48073
ggcgggcccgccagctctcaccttcctcctgctggtcctcctcctcccggcacaccaggctatcgccacagcagccggcgacgcgcacggcgggccggcggccggaggcgcggcaggccggcgccatgccccggggctggaggagtacggcggcgggcgcatcgtggacatcacgcacgtgccgtccgacgcggcggcggggcccctggtgcggctcaaggagtcgatggagaacgggtcggactacaacttgtcggagctccggatgccctgccacatgggcacccacgtcgacgcgccggggcacatgatccaggcccacttcgccgccggtctcgacgtcgacacgctcg

SEQ ID NO: 48074 - DNA, 389 bp, Triticum aestivum
  Clone ID: PAT_TA_48074
gagccattcgtctgccccagccgcgcacgatggccacttcgacgcttccctcgcacccatcgtcgactccagctcgccagaagaggccggcgagtcaaaaatgtagctagctagctagctagcatctgcgccgagctgatcgagcacgcaagcgagaagccacgtacgtgcacagggtaaggggaggacaggcgccatgctacgcctgctcccggtcaccctattcacccagtgccggagcggggggccgtcctcgaaccggtgattcgtcgacgggggctcgcctgtccagagagccgggccagggctactcgcgaacaacggagttcgcggtagaatccggaggcgagcgcgtacgggggcagacagacagacggacaccccgtcat

SEQ ID NO: 48075 - DNA, 325 bp, Triticum aestivum
  Clone ID: PAT_TA_48075
cagagggagatccagtcggagagcgagcaatccgggttccggagggagcggcagatcgatttgtcgccgattctgatttcgattcccccgatccggatctactcctagtatactagtagtagcttatttaaggaggagatcccgttgtctcttctaccccgccggcgatcgataggagaggaggggaggtcgagatggagatgtcgactagcttccccgtgccttgtcttgacatggtgcacggcgtaagcgccgaacaccaacaacccacggcgacgacgctgttcagtctcgccggcgcgaggccccttaccggaggtcgcct

SEQ ID NO: 48076 - DNA, 386 bp, Triticum aestivum
  Clone ID: PAT_TA_48076
gggagggacttatgtcaccacaaacagagactaaagcaagtgttgggttcaaagctggtgttaaagagtataaattgacttactatactcctgaatatgaaaccaaggatactgatatcttggcagcattccgagtaactcctcaacctggagttccacctgaagaagcaggggctgcggtagctgctgaatcttctactggtacatggacaactgtgtggaccgatgggcttaccagccttgatcgttacaaaggacgatgctaccacatcgagcccgttccaggagaagaaactcaatttattgcgtatgtagcttatcccttagacctttttgaagaaagttcggttactaacatgtttacctcgattgtgggtaatgtattt

SEQ ID NO: 48077 - DNA, 445 bp, Triticum aestivum
  Clone ID: PAT_TA_48077
tattgtgagaattcttaattcaagagttatagggagggactcatgtcaccacacacagaaactctagcaggggtgggggatatagcggtggtggtagagtatataaagactctcaatacaccccagagtgtgactctaacgacactgatcttttcgccactttccgagtgtactcatacactggtttccctcccgaaaacacaggctcctgagtcgctggcgaatcttctacttgtacatgcacaactttttgcactgatggacttaccagtcttgatcgttacaaaggactatgctatcacatctagcctgttgctggggaagacagtcaatgcatctgttatgtatcttatccattatacctatttgaagaaggttccgttactaacatgtttactttcattgaaggtaacgattttgtttcaaagccctacctgctctacgt

SEQ ID NO: 48078 - DNA, 340 bp, Triticum aestivum
  Clone ID: PAT_TA_48078
tctcgccctccgtcgccgtagcaaagtggcgattagcgtctagctagccttctcttctcttggcctctctcccccgccctcttcttccccggtccagagagggagctgagctgagccgagctgaccgcccttttctgcttgtcccgttgcagctttctttcctgtaggtgggcatacatacacaccagtagtgctggggtggctctcaatcaaattttggaacagagagagatatagccggccggccatgcagacagccaagacaaggaatggctccgtggagcaccctgcccgtgggtctcctctcggggcaaacaaagacgggccggccgacgaggct

SEQ ID NO: 48079 - DNA, 451 bp, Triticum aestivum
  Clone ID: PAT_TA_48079
aagagaaccacttctggcatcaaggcagaaacatttgctggccaacacgacaagagcaatgctttagattctgaaatccagcaaatacattgtgctgccactaataatcaagtagaagcgtgtgcttttctcatccaggcatcacacactacacccatagagccagatcatgcagagaaaattggaatgttagaatctgatattgaagacgccaggatggcaaccatcattagagaagagatagagatgattgtactaagagagttcgttaacgaaatagaaatacggttgcatggtaatgagatggagtataacatgaagcaagacatttgttcagtcattcagaatgaagctgtagcagaagcggtgttaaacctcaactctgcattgttgaagttcaatgaggaaaggagctgctctgaagcggtatcgactctacagaggcaagaga

SEQ ID NO: 48080 - DNA, 265 bp, Triticum aestivum
  unsure (1)..(265): unsure at all n locations
  Clone ID: PAT_TA_48080
ctctctttatcccctctcgacttattttataaaaccaggccaggaaaacctctcgcctcacaaacaagtcccccaactctccaagtccaaccccacgaccatggcgaccaagcagagcctnctcgccgccgcagccgtctgtctactactacttctncccctcccggcaggctacgccgtcaccgatgtcgagtactgcaataagggcaaaaactacccggtgaaagtgagcggcgtggagatcgtgcctgatccggtcgagcgc

SEQ ID NO: 48081 - DNA, 274 bp, Triticum aestivum
  Clone ID: PAT_TA_48081
cccacgcgtccgcacagacagccatttcttgccacttgcatcacatagcagccagcagaacccacctcacctattttccacgcgggacagtgaaacaaattggcggcgcgcggaaaggaaacggagccacacgcctgacctgaggtttgcagagggaggtttccagaggcagagggggataaggcaggcaggcaggcaggggatgagtacaaccaaggtgaagaggcgtgtgggcaagtatgagctagggcggaccatcggcgagggcaccttc

SEQ ID NO: 48082 - DNA, 266 bp, Triticum aestivum
  unsure (1)..(266): unsure at all n locations
  Clone ID: PAT_TA_48082
cctggtccataccctggagctgaagcaggctaactaccttgccgccatgcgtcagggactgcagtaagtactacatgctctgcccttatcctgtgctccagcgacactgtctatctgtttacttctgtggttatagatagctaaatctatattgtgactgttatgctgcagcttaggttatgatctgttgtattcaatntactngctgcaatgtgtntgctttctgggcatgttcgtgctcatgctgcaaaatgtagatctcacgt

SEQ ID NO: 48083 - DNA, 178 bp, Triticum aestivum
  Clone ID: PAT_TA_48083
cagactcgaagcaaacccccatcttaaacccacagcgcacggccggaccgaggggaactttcgagaagcttctgtaagattggttcgctgcctcgcgtccgatccatggcggccgaggggggcggaggaggaggcggctgctgatccggggaggggttcgaggagcggatgaagcgcc

SEQ ID NO: 48084 - DNA, 253 bp, Triticum aestivum
  Clone ID: PAT_TA_48084
ggagctgcaaagccttatgctagaaaggaagccagtagtctatacatatttgagacacatagaaggggacctggttcttagaggttcacgtgacaatgcgacagaagacaaccatttggggtggcattgttgcgcttgccacacttgttatggcatgcgagggtcgcattgtccggaaggacttagtgttgaaccttgcaggtgcacgctcgcggaccgccacaggtgtcaatttaatgtgcaacatcagcat

SEQ ID NO: 48085 - DNA, 287 bp, Triticum aestivum
  Clone ID: PAT_TA_48085
gggaccgtgggctccgtcatggcagtaaacaacgagattggcgttgtccaccgttgaggagattggcgatctgcggagagggcgtgcccttcaacagaccgggcagcttcgggaagatccaatgagtaaccagatggggatgactatgtactgccggccaagatttatggacccaaggtgtggtgcgcttactgcgccgcgcctgattcgtgtggagccacagatgagtggggtggccaggaacggcataccagtgcacaggccaccccattgtgtggattgggctg

SEQ ID NO: 48086 - DNA, 374 bp, Triticum aestivum
  unsure (1)..(374): unsure at all n locations
  Clone ID: PAT_TA_48086
accagccatttcttgccattcgcatcacatagcagccagcagccacctcacctattttccacgcgggacagtgaaacaaattggcggcgcgcggaaaggaaacggagccacacgacgcctgaccagaggtttccagagggagagggggataaggcaggcaggcaggcaggcaggggatgagtacaaccaaggtgaagaggcgtgtgggcaagtatgagctaggccggaccatcggcgagggcaccttcgccaaggtcaggttcgccaggaacaccgagaccggtgaccccgttgccatcaagatnctggacaaggagaagcttctcaagcacaagatggtcgagcagatcaagcgggaaatcgcaacgatgaag

SEQ ID NO: 48087 - DNA, 329 bp, Triticum aestivum
  Clone ID: PAT_TA_48087
cccacgcgtccgctttctttgagaacccatacagcagacatttttcttagctctccaatggcggcgaccaccacgtccctctcctcctcgacccttgctggcaaggcggtgaagaatgtaccatcgccagctctcttcggcgaggcccgtgtgaccatgcgcaagactgcagcgaaggctaagcaggtttcctctggcagcccatggtatggtgctgaccgggtgctctacctcggcccactctctggtgagcccccgagctacctgaccggtgagtttcctggtgactatgggtgggacactgctgggctttcagctgaccccgagac

SEQ ID NO: 48088 - DNA, 339 bp, Triticum aestivum
  Clone ID: PAT_TA_48088
aaaatccggtggggagtcaacgtgcgtccgcccctggtcctggtctgcaaaaccgcggaggagcgagacacgagggcaccatccgcatcaccgacgccgccggtcggtccctgccctgccgcccccggcgtcgctccgccgctcgcccccatctcccagccgactcgcgcgcgccggccgaaaagggtatcccatcatggatgcagcaaaggatgcaaacccgtcatgtaaactccacacaagactgagactctggcagtttgcagaccgttatatatttgaaccaattgatggtcttgctgacttatatttgtcagttagccgggccagtggatcaat

SEQ ID NO: 48089 - DNA, 216 bp, Triticum aestivum
  Clone ID: PAT_TA_48089
cataatttgggtcggatactcgagatagtggcgaattcacgcgtatgcactaggtgctcacatcgacggcgaggtggaccgtatgtcagtgctggccggtggtgtatgctgtgtctatgtgtgtcgagagtgctgtttgtgtccttggctggatggaggctggctaggaggtgtccggtgagagcgctcatatatagtacagacctgcagatctgt

SEQ ID NO: 48090 - DNA, 473 bp, Triticum aestivum
  Clone ID: PAT_TA_48090
aattgtacgggtggtctggttccttcgtgacctcacttcagagctcgaggctggcggcggcggcgaccccatggagttcctgatgcagcctatacgccgatccactttcctagaggtggtgggagcgagtttggtgcccccaccagtaccggcggagccgattgtggtggctatggtggtggagcatcaggtggtggtggaacaggtggtggcggcgcaggaggctccgatgggcagcgtggacgcacagatcttggcgaccaagggagcgtcggctgatatgagggacagcttgccaccgacctcggagcgcttcgatggagtagggtaaagctggtgttcagaacagaaggtcttgccattgcgaatgtctggctctgataaagacttttacaagcagaggacaatgtttgatactcctctgtaaagaaatatattatttctttaccaaaggagtacattaagcatagaga

SEQ ID NO: 48091 - DNA, 361 bp, Triticum aestivum
  Clone ID: PAT_TA_48091
gctggggtgacgcgggaaatcgtggcaaaaatcaaggagaagtggaggacggatgaggtggtcagggtcaaggtcaacggcacacctgcgctcaacatgcgcctcttccacgagatactagagagaaaaacagggggattggtaatatggaggtcaggaacttctgtttctctgtacaggggagtagcctatgacgtacctgagaccactaagggaacaaataggacttggcaggatgttggtatgaagtcctcaataagagggcctcctatcccttcctcgctacctaacgagaaagttaatagcatgcaagatagcaacggaggcttggtatctaatactgagaaagaggaaacaattg

SEQ ID NO: 48092 - DNA, 416 bp, Triticum aestivum
  Clone ID: PAT_TA_48092
cccacgcgtccgcgccttcctccgcgcggttctgctcgggtgacgatgcggtgcagctacgacgaggaccgccgaccaggcgccttcaaatcctcagccccatgaagcaagcccgaggaggaggacaagttcctggggtcctcatcgccattgcaggggagagcaacttccttctcaacgggcatctatagttctgaacaacaacaacaacaacaaaataccaatcttgtttgctgcatatgcaattacagttgaggatggagttgtcgacttgtgttataaattggctcataaattggcaggactttggttgctctgctctagggccagcatatttgcaccatgattgctcaccggggatcgccctccaccaggacatcaaagccagcaacatccctactggacagatgcttgga

SEQ ID NO: 48093 - DNA, 250 bp, Triticum aestivum
  Clone ID: PAT_TA_48093
gaggagaggggggaaaataatccaaggctccggggcggcggcgcccgatccacacacggcacatctcggggcgcgcggcgcacatccactcccctccgttctccacgagtctgctcccccaccgctaataatagccgctgctacccggcgggcggggcggacaccctctgccgccgccatgggagcgctcgaggaggcgcacctcgccgtctgcgggtgcggcgacgaggaggaggagggggaggaggat

SEQ ID NO: 48094 - DNA, 253 bp, Triticum aestivum
  Clone ID: PAT_TA_48094
gggatatactacttcatctagtgccggcggctggagcggcgcggcagcaccgctcccaacccaacctgattgctgccgccgcgagccccctgttcctctgccaggtacctcattgtgattgatgatgtatggacaatagcagcgtgggatgctatccgatccgtgctgccagacaacaatctcgacagcagaatcatggtgaccactcggatagaggccggggccatagcatgcagtgatgctagtggaattt

SEQ ID NO: 48095 - DNA, 476 bp, Triticum aestivum
  unsure (1)..(476): unsure at all n locations
  Clone ID: PAT_TA_48095
gttcctcatggaagaatccaccgatctgcacttccttgaaagcggcagtgctgaggaccagtacaccaggaggacgcgcttctctgagctcaaagaggatgtgaggaaggccttcagcaaagacaaggccgttgcagccatagcctcatcgacgtcctcgtcttcgccgaggggtgatggaaaggttagtagacatggtcacaagaaggcgaggctgtcgcggtgatatgtatgctcgatgtcgccaagtcggtaggttaacgacggatccgtcgagcgcaggcgcgtgatggcttcngagaggtggggtggggggagctagcaaggttttgttgacagtttgtagtgcagtgaaaccatgtatgtagatgtatgtaaccaagcaagcatatcggntctagtttgttggtgcttggtgcatttcttgtagtttaactgggtttgacatgtgacaggcttcaatagatgattttaat

SEQ ID NO: 48096 - DNA, 305 bp, Triticum aestivum
  unsure (1)..(305): unsure at all n locations
  Clone ID: PAT_TA_48096
ggcgtggtgaaggggttccagcagggcctgtacatgtgcaacggcggcgcctnatatggcgcccagtcacttcatgatgatttataacacctccatctgctgcgccgccgttaataattttttgttaattaattcttttctattttttaattctaatacttaattataatttatcaaattttacaatttatttttagatttttattcatttattcttattttctttattacttatttttaattatttattttaattaattcctttatatagaattataattataatttataatttattttaattt

SEQ ID NO: 48097 - DNA, 449 bp, Triticum aestivum
  Clone ID: PAT_TA_48097
gcgaccatcgcggcgtacacaggactgccgccggaggcgttcatcacggtggctgcggtgatcgccgggctttacatggccctctccggctcattcgcgcggccagccccgtcgccgccgagaaggagggaggcggaggacgagaggacgctcgaggcgctgccgccaccggtgcagcttggtgaggtgacggagaaggagctggggctctatgacgggtccgaccccaagaagccgctcctcatcgccatcaatgggcaaatttatgatgtcacgcagagcaggatattctatggacctggtggcccatatgcattgtttgcgggcagggatgtaagtagggcattggcaaagatgtcatttgagctgagtgatttaaccggggacgtttcaggcttaggcccctttgaggtggaagccttgcaagaatgggagcagaaattcatggg

SEQ ID NO: 48098 - DNA, 315 bp, Triticum aestivum
  Clone ID: PAT_TA_48098
tcgtccacgcgtacgggcccataccaaccgtccgatccccggccgatggcggcggagcccgcggcggacggccaggatcccccgctggcggacgccgccgccgcctccggcgacgacgacgccgcggcggcgaacgcgctcctgagcgcggcctcggagcagctgacgctggtgtaccagggggaggtctacgtcttcgaccccgtcccgccccaaaaggttcaagctgctctgttggtgcttggagggtgtgaggtgcctcctggtttagtaagcatggctgggcctactgcatatggtgaaaagagtacaact

SEQ ID NO: 48099 - DNA, 396 bp, Triticum aestivum
  Clone ID: PAT_TA_48099
caacaactttgcccgtggtcactacaccattggcatggagattgttgacctatgccttgaccgtatcaggaagcttgcagacaactgcactggtctccagggattccttgtcttcaacgctgttggaggtggaactggctctggccttggttctctcctccttgagcgtctctctgttgactatggaaagaagtccaagcttgggttcacagtgtacccatctcctcaggtctccacctctgttgttgagccatacaacagtgtcctgtccacccactctctccttgagcacactgatgtggctgtccttcttgacaatgaggccatctatgacatctgccgccgttcccttgacattgagcgcccaacatacaccaacctcaacaagctcgtttc

SEQ ID NO: 48100 - DNA, 226 bp, Triticum aestivum
  Clone ID: PAT_TA_48100
cccacgcgtccgcgtcatgccatcttcctaccttagccgtcaccactcaccttgtcaaccatggaggggagtttgatccttgggcagtcatgcacagcaacgtcacaaacgctagaatatgtaccgagcagccatgtatgttccaactacgtaggatgcatggacggaatacaacaccatgagcttacattgctttgatgctttgtcatcatgatcactcgatgga

SEQ ID NO: 48101 - DNA, 320 bp, Triticum aestivum
  Clone ID: PAT_TA_48101
ctgggatcctcaactgttccagttcgtatttagcaggatcacatgttgaccaatgactcaaattaattttctcactgatccagttaactcaagaacttgtgacccagttctaggacaactgtggactaagggatggaggttgatttatcagcggttacaggcatgcatgctttatggtggcaagcattatatatcattgaagactttccatttgttcaagttcctgatatgctaatcggtaacctttagatttgtttggagagttctgtccatccaagcaccatgcatgaaacgcttacaaaaagaagaaagagacctgg

SEQ ID NO: 48102 - DNA, 221 bp, Triticum aestivum
  Clone ID: PAT_TA_48102
acgggttagaagactctgctgtgaaaacagcggaaagactgactttgatcttgtcaaggatacagatgtataaaccattactgtccgcatgggcatggctcatacgaaagctaatgagtgtctatctaaattagcacataacgatgcagagctggtgacccttcaaggcctgagttaaactgctgcgcagtacatgcagatcatgggagcagatgcaaact

SEQ ID NO: 48103 - DNA, 313 bp, Triticum aestivum
  Clone ID: PAT_TA_48103
ctgacgcatgggtgcccgtacatttttgtgttgttgcgtggaacactgaacggcaagctacgaatgcaagctatatgttaagttttgataatatgtgagttgcacgctcacactagtagtcatggccaacgcaacactgcggatgtccggatcacccactgaggtggtgcgcgtccatacatcaagcccgaagcggtgcgaaactggcgacgacgacagctggacacaataacacacgaggagaaggagactgtcttcaacgctgtcatggatgctcaacaccatatcaataagaccaccgtacgtttccaga

SEQ ID NO: 48104 - DNA, 447 bp, Triticum aestivum
  Clone ID: PAT_TA_48104
agctatcaacgatggctcccactgtgatgtcgtcggcagccaccgccgtcgctcccttccaggggctcaagtccaccgctggcctcccagtcagccgccgctccagcagtgcggctggcctcggcagcgtcagcaacggcggaagaatccggtgcatgcaggtgtggcctattgaaggcatcaaaaaattcgagaccttgtcttacctgccaccgctctccacggaagccctcctgaaacaggtcgactacctgattcgctccaaatgggtgccgtgtctcgagtttagcaaggttggcttcatcttccgtgagcacaatgcctctccaaggtactacgacggtcgatactggacaatgtggaagctacccatgtttgggtgcaccgacgccacccaggtgataaacgaggtggaggaggtcaagaaggagtaccctgacgcctatg

SEQ ID NO: 48105 - DNA, 182 bp, Triticum aestivum
  Clone ID: PAT_TA_48105
ccacgcgtccgaaacatgaagatactatgtttcaagtcctcagattcaacatcttttggtgggggaggatgatcattgatctcttacgcatccgacgattcaacacatgcgttttcttatgctgctgtacacacaggcgaacacttcgagctatgcagttattgactattcgatgcatcatg

SEQ ID NO: 48106 - DNA, 415 bp, Triticum aestivum
  Clone ID: PAT_TA_48106
ctagctatcgcctccccacctagcaattcacgtactccaccatggccccagccgtgatggcgtcttccgccaccaccgtcgcgcccttccaggggcttaagtcgaccgccggccttcccatcagccgccgctccggcagcgccggcctcagcagcgtcagcaatggcggaaggatcagatgcatgcaggtgtggccgattgagggcatcaagaagttcgagaccctgtcttacttgccacccctctccacggaggccctccttaagcaggtcgactacctgatccgctccaagtgggtgccctgcctcgagtttagcaaggttggcttcgtcttccgtgagcacaacagcttccccgggtactacgacggtcgatactggacaatgtggaagctgcctatgttcgggtgcactga

SEQ ID NO: 48107 - DNA, 233 bp, Triticum aestivum
  Clone ID: PAT_TA_48107
cccacgcgtccgcccacgcgtccgcagctgtaccaaactccggaccaccatgagtttgtgagggagcagataattagccaggtaatcaacagtggtaatctttctttcgtgatccttagtttcattctttgttttcacactttcatctttcgtctgataaataatcgtttccagcttaaaagtaaccgtgaagcctattatggatacgtccccatggcatatgatgagtttct

SEQ ID NO: 48108 - DNA, 429 bp, Triticum aestivum
  Clone ID: PAT_TA_48108
gcagaagtttcacttggcctccccccctcgagtcctccggcgagtctctgcggcggcggcggcgatggcttccttctccgaggctccccccggcaaccccgacgcgggcgccaagatcttcaagaccaagtgcgcccagtgccacaccgtcgacgccggcgccggccacaagcaaggtccaaacttgcatggtctgtttgggaggcagtcgggtaccaccgctggttactcctactctgcggcaaacaagaacaaggctgtggagtgggaggagaacactctgtatgactacttgcttaatcctaagaagtacattcctggaaccaagatggtcttccctgggctgaagaagccgcaggaccgtgctgatctcaatgcgtacctgaagaaagccacctcctcttgaacgggcatgatgatgctatgatc

SEQ ID NO: 48109 - DNA, 426 bp, Triticum aestivum
  Clone ID: PAT_TA_48109
gaccgacgcggtcaggtcgcgagagacagaccgcccgcgcccaaccacatctcgctcgctctctctgctctcacgctcgctcgctcccctccctcttgctcctctcctctccggccgccgccggccgccatggtgtcctggagcgacagcgagagcactgagggctccgccgcgcagtacatctcctccgatgactcccctgtcaagatcccagctacaattgatgagccgtcgttcgagggtcttgttgacgacttgaatgtgatttgtgagcatgggaatccaaggaggaaatatgttgcatttgaggggataagcattgggagggggttcattgcctgtgccactgaaagtgttgcaaattggggattagtgcagggggtagatgagcattggctagagcatctgcagaatgcttatcataag

SEQ ID NO: 48110 - DNA, 450 bp, Triticum aestivum
  Clone ID: PAT_TA_48110
gtcgaccgccgcaagcgcaccccgctcatgctcgccgccacccacggccacatcgactgcgccctcgccctcctccgcgccggcgccaatattctgatgttcgactcggtgaacgcgcggacgtgcctgcaccacgcggcctactacggccacgccgactgcctgcgggccatcctcgccgcggcgcgcaccacgccggtggccgactcgtggggcttcgtgcgcttcgtcaacgtccgggacgagcacggcgccacgccgctgcacgtggccgccaggcagggccggccggagtgcgtgcacctgctgctcgagagcggcgccatcgtctccgcccccaccggctcctacggcttcccggggagcacggcgctgcatcttgcggcgcgcggcggcagcctggagtgcgttcgggagctggtggcgtgggcgccgaccgcgtgcacccgg

SEQ ID NO: 48111 - DNA, 366 bp, Triticum aestivum
  Clone ID: PAT_TA_48111
cctacctgtgttgctctccctctccctccctctccccctctctctctctcttgcgcgctggcttgcttcccttctccgtgtgagcgaggccaccagcggaggagggctgtgctgaagaaggctgcgccagcgagagcttggtgactggtaaatgtgttgaattgcaggtgactgaacatcagtctggatatctggattaatgtaatataggtatattagataatacgaaatcggaagtccactctactgccgcagtatcagcaggagacactggaatggctgaagtcaacttgttgcatggtgaatctgacacatcagctaccggtttactgccagtgtcattcttgtcatgcagtcctagatcta

SEQ ID NO: 48112 - DNA, 458 bp, Triticum aestivum
  Clone ID: PAT_TA_48112
cccacgcgtccgcccacgcgtccggatggggttagcgaaggccgattttgccaggtctttatcaaatggatgcagagtagctgaatggaagcggcaaatctcactttcacttagaagagttgagccggggctgcggatggtcagtgcataaattatatttggcaagtatgtttatttggcaagtttgatatactgttctgccttgagaccactcactgtccataagctttcagaaggtctgtgcataaaatatattctcactctccatgaaacacactctgactaacttagtattttcattagcagatccttgcatcacaacatgccagacattcagacaaagctatttatctatggtctactctataatctactactgtcaccttataccacagaataatcatatgaatcagttatcctcgactactgttatgacttgcttttggtatatcatgcta

SEQ ID NO: 48113 - DNA, 471 bp, Triticum aestivum
  Clone ID: PAT_TA_48113
actgcccaaggaaattgctagactgaagaatcttaagatcttccacgtctacaggaacaacttctatgattctcaccactcaatacaattgacatatcagagaattattttaccggtgaatttccgaagttcctgtgccaaagcgacaaactgcagttcttactggctttgagcaacaacttctcaggtgaattccccacctcctactcttcttgcaagactctagagaggtttagagtaagccaaaatcagttcagtgggagcattcctcatggcatatggggattgcctaatgctgtcatcattgatgttgctgacaatggatttattggaggaatatcttctgatataggcatttcagccaccctaacccagctgcttgttcagaacaacaacttctctagtgaacttccaatggagctgggaaatctccctcagctgaagaagctggttgcttccaacaacagattc

SEQ ID NO: 48114 - DNA, 462 bp, Triticum aestivum
  unsure (1)..(462): unsure at all n locations
  Clone ID: PAT_TA_48114
gctcgcaacccatggcaattgagttacggagaactcagtgaggggtggtcactggctcaaggtggtgagtcggagacgccggcggatctgcttcctaggacagatacggactcganccccttcagcgccttgttctagaggagtaggcaaaatttacttgtgtgccgtctgtttgttagttcatcacatggtggcgccactggaccaggcggcaccgcatgccacattggaacaagatcagcgagacgccgccacagccacagagaatagcggcagggatcacggagctgccgacatagcagatgctgatccaggcgaagcaataggcgctcctggatccgcaccttctgtcacgtcaaggatttcggtgcataaggtgtgctcactcgtgggcaagtttaacaaattcaagaagggattggtcgaggagataggctttggtgggatgctggggattcagat

SEQ ID NO: 48115 - DNA, 386 bp, Triticum aestivum
  unsure (1)..(386): unsure at all n locations
  Clone ID: PAT_TA_48115
cccacgcgtccggaattgggtttggattcataccacaacttgggtcccccggcggtttcctccttcctctcctctcggacaaaaccaaacgaacctcttccttcttcttcttcttcttccttcttcttcttcctccggcggatctcatcttcagatcacatccaagcagcgcaagcaggagacgagacgcgctccctcgctcgctccaccgtccacaaccaaaccaggcaaagggcagcgatggcgttcgacaaggtggaggagctgcggccgggcacctacggccacaacctncagctccgggtgctcagctccaagcccgtcgtcctccacaggccgcagggcggcagggctggcggcaacatgcgcatcgncgagtgcatcgt

SEQ ID NO: 48116 - DNA, 404 bp, Triticum aestivum
  Clone ID: PAT_TA_48116
agctagaccagacttcgcgcgcgcgttagggaccatggcgagcggcagcggcagcggcgaggggaaggcgggcagggcgggcgcggtgtaccagcagtacggcaccggctacgacgagcgccagtggtggccgtggctcgtgcccaccgtgctcggcgcctgcgtctcggtcttcgccgtcgagatgtacctcaacgactgcccccgccacgggagcccccttcgcggcgacgcgcgctgcgtcgccggcttcctccgccagttctccttccagccgctgcgcgagaacccgctcctcggcccctcttcggccactttggagaagatgggagctcttgactggggccaaagttgttcatcaacaccaatgggggcgcctattcagctgtatctggcttcatgct

SEQ ID NO: 48117 - DNA, 364 bp, Triticum aestivum
  Clone ID: PAT_TA_48117
gcccagcccactaaggactgcaagaccttaagaccccagcagcgaaatatcgtcaagcctgttcccaaaccctccccgaccgccgccccccgttcgcctccgccgccgcctagccaccacgcgccaggagagccccgcgccgccggccatggcggaggaggaggggacgcagcagctgccgttcgtgcgggagacggtcctcaagaagaggaaggacaacgaggagtgggccaccaagaaccgggagcgcaaggcggccaagaggcagcgccgccgccacgacgccaagggcgccatcaagcgccccgaggacttcgtcaaggagttccgcaacaaggagctcgactttctgcgggtgcgcatg

SEQ ID NO: 48118 - DNA, 448 bp, Triticum aestivum
  Clone ID: PAT_TA_48118
gaagaatcatttcaagccatgtctccggctaaagttgatactaccaagaaggctgatcctaaggccaaggccttgaaggcggcaaaggctgtgaagtctggtcaagccttcaagaagaaggacaaaaagattaggaccaaggtcaccttccacaggccaaagactcttaccaagcctagaactggtaagtacccaaaaatcagcgctactccaaggaacaagttggatcactaccaaatccttaagtacccactcaccactgaatctgcgatgaagaagattgaagacaacaacactcttgttttcattgttgacattcgtgctgacaagaagaagattaaggatgctgttaagaagatgtatgacatccagaccaagaaagtgaacacactcatcaggcctgatggaaccaagaaggcttacgtgaggcttacaccaaactatgatg

SEQ ID NO: 48119 - DNA, 412 bp, Triticum aestivum
  unsure (1)..(412): unsure at all n locations
  Clone ID: PAT_TA_48119
ggcattcatgggtgatcaccagtacagccgcgcatgcaccgttgctagcacggtcgaccaagcagcaccgagatggctgctgccttgtcctccaccggcggtgccccggcttctacgccgaccaacttgctcgggaagaagctcaagaagcaggcgacctgggccgtgaactaccatggcacgagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtnctcagctcctacgagtacgtcagccagggactcaagaagtacgact

SEQ ID NO: 48120 - DNA, 470 bp, Triticum aestivum
  Clone ID: PAT_TA_48120
ccccttttcccccttcccccgctccaccctcccaccgcgccggcgatgatgtcgatcacctccaccgccgccgggaccccgctctgcccgccgcgcgtctccgggggcggacggcggagcagcaggtgcgccgtccgagcccaagcggacgaaggagctgcagattcggcggagcacaagtcggtggagatcatgcgcaagttctcggagcagtacgcccgccgctccagcaccttcttctgctccgacaagtccgtcaccgccgtcgtcatcaaggggcttgctgaccacaaggatcaactcggagctcctctctgcccctgcaggcattacgacgacaaggccgccgaggccgcgcaagggttctggaactgcccgtgcgtccccatgcgagagaagaaggagtgccactgcatgcttttccttacgcccgacaacgattttgccggagaggaccaagctatcaactt

SEQ ID NO: 48121 - DNA, 308 bp, Triticum aestivum
  unsure (1)..(308): unsure at all n locations
  Clone ID: PAT_TA_48121
gggggaggggcatcatctncttcacctctcaaccaagccaaggccaggggcccagtgaagcagcggccatggagggcatggaggaggacgtgcngctgggcgcgaaccgctactcggagcaccagcccatcggcccggcggcgcagggcggcggcgcgggcgagaaggactacatggagccgcccccggcccccttctttgaggccggggtgctcacctcctggtccttcgtccgggcggggtacgccggggtcctggccaccttccccttcctttacggtgtggttctcgcgcagattggcgggggg

SEQ ID NO: 48122 - DNA, 234 bp, Triticum aestivum
  Clone ID: PAT_TA_48122
cacacgcgatgagagagtcactgcggaggatgctttacaggtgctcatgtgcactatatacctactatcgagcggccggttctgctgtactagcctactcagtcttagcaacagaagaaggatcagggccgtgcatgtataggctacaaacttccttacgcatgcatagaccctgatttacctgccatcgctcaacacagatgcacttcactagccggtggactacatcatccg

SEQ ID NO: 48123 - DNA, 187 bp, Triticum aestivum
  unsure (1)..(187): unsure at all n locations
  Clone ID: PAT_TA_48123
ggcccagacctacgcctacgatgagagaagtaaagagtaagaggtgatatgaannttgtccttgaagaaaatggccattggagtgtaggggagaaacgaccttgtcctgctcgaggaggacgaggatgaggaccacccnagctcgacgacgattcatcaacaggtaacactcgtctcgttcccaagg

SEQ ID NO: 48124 - DNA, 164 bp, Triticum aestivum
  unsure (1)..(164): unsure at all n locations
  Clone ID: PAT_TA_48124
cctacgcattcggattatgatgctttggagcgatgnatgcttatgacaacacacaaaatctcagggcctactatctacacagggcgcactttatttatgcgcaactgtccaaaacagggacattatttcgcgtacctcaaaacccttcaaaaactcctggcaga

SEQ ID NO: 48125 - DNA, 115 bp, Triticum aestivum
  unsure (1)..(115): unsure at all n locations
  Clone ID: PAT_TA_48125
cccgtgggaggaggtttatagtagcnaccaggtcaaaccatctctctccccctcagggggtggtattgcgaggcgctgccttctaattatccattccagaggaaatcaccccacc

SEQ ID NO: 48126 - DNA, 386 bp, Triticum aestivum
  Clone ID: PAT_TA_48126
cccacgcgtccgtaagcatgcagaatcaatttctccacatcagattcagatggattgatagttcgacactcccaactattcttgtttccttcctgacccaatggccgccatcgacttacgcttccatctccatccagccgccttctcctctgtccacccgtccaattcaagcgccaaaccgcaccgccattgcccacctcagagggtccatgctgcaggaagaaggtgcctcctcagggcgaagtcttcaaacgggcacccgcagatcggggcctccttcagcgatggggtgctagatgctaagccgtctggagctggaggcccggcgccggagcagggagagcacaccgtcagcatcacggtcgtcggagccttcggggatctcg

SEQ ID NO: 48127 - DNA, 367 bp, Triticum aestivum
  Clone ID: PAT_TA_48127
ggaatggaaagggtgatgagatgatcgcggtatccatgctattgccaggacatgcaatgggttggacaggacgcgctagacttcggatgggcgaagcgggttgacggcggcgtgccgatggttggggacatcgcctccaagtccgtgagctaccacatgaggtgtaggaatggaaagggtcatgacatgatcgcggtatccatgctattgccaggacatgcaatggacaagttcgagaaggagattgctgtttgggttaacaacgagaactagtccagctccattcgttgtaaaataaaaccccgggtgcacatgtgctttaccgtgttgttttcatggtttgggtgtgggcgtgtaatcatttaca

SEQ ID NO: 48128 - DNA, 366 bp, Triticum aestivum
  Clone ID: PAT_TA_48128
gtgaattgcttaacggaagagtacaagatgctggagctcgcaatgtggtattttattttttgttgtttatatttcctttttttgcatgcaacttctctatgatagatatggatataagttttagataagtcattttgtaatcttcatcatatctattcttttgtggaatggctattgatgcacaagaacctagttccatatagttctagttgttgttgctagatgtctttcttttgtttctttttaatgtaaattatcttgattttttctttttgtttgggtttcttggtgtgttggagaaagcgcaagaggtctttctgattttcctgtagccactacattcactagatactctggcaagttgtt

SEQ ID NO: 48129 - DNA, 428 bp, Triticum aestivum
  Clone ID: PAT_TA_48129
cccacgcgtccgggtgggagggggcatatggacaatgtcgaccgccgcggctaactggtgctacgcaaccgtagtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtccccttctact

SEQ ID NO: 48130 - DNA, 238 bp, Triticum aestivum
  Clone ID: PAT_TA_48130
atcttcgaagtggtggtagggttagggcacgaaatgcgtgccgaagaacatgcttcacaacaaagtgggcttcatccagaacgcgtcgataaacaagacatgcacaataaacctcaaggtaattacgaaaataaagaacaattcccattaattagcgtcaccgatagaaagaaaagtgaaccgttttacgccttcaatccacgaagacggctttgggtaaatgagtgcatctttcctc

SEQ ID NO: 48131 - DNA, 349 bp, Triticum aestivum
  Clone ID: PAT_TA_48131
cacacacgtatgagaggatggctatggagcttaagttggacgtcaagctcaggcacacaggcaggcaaggaagcagaagaggaagggacatggcatctgctactctacttaagtccttcttcatgcccaagatggtcgaatggaacgccgcacgccacgtcgcccgccagagggtgtccatgagcgtgcgcaccgtcgcctacgacgatgagctcgacaagaccctcaaaaccatcgcgaaaaccatgcgcggcatgctgcccatgaaccagtccaacgacaactgcaacaagcgcctcgactagatcggcctctagatcacactggcgaacacgcaggcgtaccggac

SEQ ID NO: 48132 - DNA, 335 bp, Triticum aestivum
  Clone ID: PAT_TA_48132
cccacgcgtgcggtcgcaggagcagagcttctccctgcagcaggcaagtaccatggaccgccgcatcgctccgcactcgtccttcaagatccccgcaggctccatgaccgtcttcaccatgctcgccatgctcgtcaccctcttcgtctacgaccgcgcgctcgtcccgctggcccgccgccgcacgggcctggaccgtggcatctccttcctccaccgcatgggcgtcgggttcaccatctccgtggcggcctctctcgtcgcgggcttcgtcgagcgccaccgcaaggaggccgctgcggccgggggaaccaccgacgctgggacggccccac

SEQ ID NO: 48133 - DNA, 237 bp, Triticum aestivum
  Clone ID: PAT_TA_48133
ccgctgctctggtggagaggagagacggcacacgcgcacgcgtttgacattttccgcccaccaccgccggagggagggagctccagccatggccgccaagtgctacccgacggtcagcgacgagtacctcgcggccgtcgccaaggccaggcgcaagctccgcggcctcatcgccgagaagaactgcgcgcccctcatgctccgcctcgcgtggcactcgggcgggaccttcgacgt

SEQ ID NO: 48134 - DNA, 402 bp, Triticum aestivum
  Clone ID: PAT_TA_48134
gctcagtcgctagctgacactgagcggcgacgtagcagcagctcggctccggcggggcagaagcaagcagagatggggtcgatcgccgccggcgccgacgaggatgcgtgcatgtacgctctccagctcgtctcgtcgtcgatcctcccgatgacgctgaagaacgccatcgagctggggctcctcgagaccctgatggccgccggcggcaagttcttgactcccgctgaggtggcagccaagctcccgtccgcggcgaatccggaagcgccggacatggtggaccgtatgctccgtctgttggcctcgtacaacgtggtgtcgggcaggacggaggagggcaaggacgggccgcttttccggcggtacggggccccgccccggtgcaagtaccttaccccc

SEQ ID NO: 48135 - DNA, 291 bp, Triticum aestivum
  Clone ID: PAT_TA_48135
ggaggcgctgagggaggagagagtagcagcggtgtcgctagcagcggcagctgccgcctgcgtgacctttgataccagcgccgcggtggtgatcagtctcgacatcgtgttgcccgccaagcccggggaccggaccttctgccgggagcgcctcatgctgcaggcgctcccgagagctgctaacgaacgcgatgaggagcccaagacgtatcgatatccaggctgggctctctacatgaccacggccgaggccggcgacttctactggatggtcgtgtcggtgccatacgc

SEQ ID NO: 48136 - DNA, 459 bp, Triticum aestivum
  Clone ID: PAT_TA_48136
atccattccatccatgtagttgggtgaggcgattcgagcgccgcagtttcttctcgagctcggtctgcctgtggttctgttcaaagaagtggtgaggggttcgtcgctgctagccaggcaatcatgggggagacggtaaccaatgtatcggagtaccaggccatcgcgaagcagaagcttcccaagatggcctacgactactatgcatccggggcggaagacgagtggaccctcaaggagaacagggaggcattctccaggatcctgtttcgccctcgcatactgatcgacgtgtcgaccatcgacatgaccacatctgtcctgggaatgaagatatccatgcccatcatgatttcccccaccgcctttcagaagatggctcacccggaaggagagtacgcaacagcacgggcggcgtcagcagcaagaactgtgatgacgctggcatcaggggctaca

SEQ ID NO: 48137 - DNA, 256 bp, Triticum aestivum
  Clone ID: PAT_TA_48137
gtcttctcccacacgctcatcttctctcctctcccccttcccctgcgtgagagcgtcgcgtccaaaccctcctcccccggcgcccgccatggcgaggccgcagcaggaggcgatcgacaccttcatcagcatcaccggcgccgacgaggccgtcgccatccgcaagctcgaggaacatgctggtgacctcaatcaggcaggcaatgcccacttcactgaaggggatagcacagtgaacccaatcaatcaaagtatt

SEQ ID NO: 48138 - DNA, 377 bp, Triticum aestivum
  Clone ID: PAT_TA_48138
gcgcgcccacgagctgctgggcggcggggtggcctgcaccggccgcttccggcgacctccgacgccgcgcagcacgccccccgagctcctcacggtccgcgcctccctcccctccgaccagattctccgctccagtcctctaccgcccgcttgcaaccccacccccgtggctagggttccgggcagggcttcgccggctcgtctccggcggccccagttatttggctcatcgtcgtatcgcaagtttctgacatcgctgtacaccgttgacgtcgccggaaatccgtctgcacgtactccactgtccgccggaactttgtccgacctgagaccaatgctatatggttccactctaccctggctaggcccacgagagc

SEQ ID NO: 48139 - DNA, 240 bp, Triticum aestivum
  Clone ID: PAT_TA_48139
taccggccggatagagagatgatgagatggagggcgacccccgctgcggatgcgagtagcacggctgcgatcggcggcggacggatcggcggcgcctcaaggcggcgggggccaccatgtctgccatagtgtgcggcaagaggtcctacatcttcagcgacgagctcatcccctactattcgacttaccatacccaccaccacactttcaagcggtccctctgctccccgacccgcgcct

SEQ ID NO: 48140 - DNA, 154 bp, Triticum aestivum
  Clone ID: PAT_TA_48140
ggcgtccatttcttccttttgggaggcgctggcaagtttctttgaaccaagcgccctcaccaccaatggttgttgggcaccaaaaactattttattaaagggtggttttccatgaccgaattgggtcattggagccatgttccagggatttgga

SEQ ID NO: 48141 - DNA, 339 bp, Triticum aestivum
  Clone ID: PAT_TA_48141
acgcctgcaagcatttgatagttgagaggggtgagtttgcattcaatggttttagaatgatggaccaaatggctgcagcatccttccctgataacaaatgctgggaaagattgggagttggttctacccaagcatcatcagttcaaaataatgacccaactggagacattggctggttgctttggatgggaccctaatcatataatgatcccttgggtcagcagtcgagaatttcattctgccagtgtcctgcttgtactagagatgttggcagcaaaatgaaatttgaagaactccagcctgaaactaatgtcctgagtgtgtgtctgctcatcctgc

SEQ ID NO: 48142 - DNA, 249 bp, Triticum aestivum
  unsure (1)..(249): unsure at all n locations
  Clone ID: PAT_TA_48142
ggtttagtgtgtgaggtagagtagngtgtcccgtacctcgngtaccactctggatacggactccagatcctcaacatcttccccgacaacggctccatggttgtttctgacatcctcaagctcggggacttcaacagttcgagccgccaaggttgccatgtccccatggccaactccgccaccaaaattgagcctccattctgaataagccccctataccaaaaccttatcttctacatctgtgccaag

SEQ ID NO: 48143 - DNA, 211 bp, Triticum aestivum
  Clone ID: PAT_TA_48143
cccacgcgtccggtgacctagctgcccgcagctgcagtcgtcaccgtcgtctacccctcttcttttcttttcttggattcttctaccttagtcggcgtcggcggcggcggcggcggtgttgacctagacgttaccggctgagaccggtggggtttgggttaggagacgggaggaagagcacattcttccctgatagcgccccgacctggca

SEQ ID NO: 48144 - DNA, 386 bp, Triticum aestivum
  unsure (1)..(386): unsure at all n locations
  Clone ID: PAT_TA_48144
cccacgcgtccgagaaaataagccaaaagtttggggaattgcagtctgcccaagcgcgacagctagggttcctagccgccgccggcccgccgccactactgccggccctccgccgcggcgcgcccacccggctgaggccccgccgccccgcctncggtacaggagcccagcaacgcctcccgccgtcgagcaggcgctcccaccagcagcgcctccctcactggagcagccgctcccgtccagttcataggcaggggagatgctgaaatttaggcaaatgtcaagaagctcaaatggaaggcaaaaaattcgtaaacgggtggtaaaaaaagaggtgtccagcatngtaagtgatcggcgtaaagctgtagtggagaacatcactc

SEQ ID NO: 48145 - DNA, 439 bp, Triticum aestivum
  unsure (1)..(439): unsure at all n locations
  Clone ID: PAT_TA_48145
cccacgcgtccgccaactcatagtggggctccattcttgcaaagttgacagcttctccttctcttggccaccgcgcgatggagcccatcaccccgtccacctaacccgccattgtcgtctccttgccactttcctctgcctccggcctccagctcatcggcatcttcctctgtctctggattgatccacggagcttccatgattctttggtgatggtccgcgagctcctggccgtgctggtgcgcgcggcgctgcagtgggcgctggcgtcgctgctcctcgccaacggcgccgncttctgcctcatcgccgccgcggcctcctcgcttccgctcggcccgcctggcctcntgcgctcgcgtncaccgctgtcttgccctctcttgggacccgttgcagcagagagacacccttcgcgctgtctggacctagtgcgcat

SEQ ID NO: 48146 - DNA, 269 bp, Triticum aestivum
  Clone ID: PAT_TA_48146
gacaagacacgtacggtcttatggatggggccatcttaacattagcgacaggaagacaagaaacgaattagtcagggatccggacagaaaattatactatcagaagaattaaattcggttttatggatgggtccaagtacaaatcaggactgagatgatggagaaccatctggttatggaaccggtcaaacaagtctattaagagaagaatcaatttaggtgtccacaactcaaggatgacagtgcccgctagacacgcatgcaagaag

SEQ ID NO: 48147 - DNA, 437 bp, Triticum aestivum
  Clone ID: PAT_TA_48147
ctctgccccgccatctccccgttattctccacccccaaacccgccgaaaccccaaatcgcgcgacctctccaagaaatccatgggtggcggcagcggcgacctcagccccaccggcatccccgcctccccttcttcgtcctcatcggactcccttcctcgagtctctgacggcgactccgaagggggctgcatctgcgacgaccccgaggtggaggcccttctctacggcagccaatttcagcaccggtcgctgcgggaggcgaaagacctcatcaggaggtataagcctgggtactggattgaaggagttggcaacacaaaaggtggggattatttgttgcctgagaccaccacgttgttattggtgggtcccagaggtgctgggaaaagtacacttgtcaaccgaattacacgggtctttgacaaagatgacgat

SEQ ID NO: 48148 - DNA, 209 bp, Triticum aestivum
  Clone ID: PAT_TA_48148
caccgagcagctccggtgtctcgacaaggcggcaatcgtggagtatgatgacgaggggcggcgcggtgcgtggcggctggccacgttgacgcaggtggaggagacaaagctggtggtgtcgatggtgcccatctgggtggcacgctcccgttcggcatacgacggtcaggtgccaccttcttcgtaagagggcagggatggaccgcgat

SEQ ID NO: 48149 - DNA, 418 bp, Triticum aestivum
  Clone ID: PAT_TA_48149
cccacgcgtccgtgacatgcatgatcttattccctgcttatccagtcttgtttgtttgactgagatatgatcagtcaaatgcaactcacaatgagaaatatatgaatctggttcattatgccatgagagagattgctttatatttctggctttatgatgtgcttgtcgagtgataactctgtaatagcttctcaattaatgaaaggggcccttttgccgctgtttcgaaaataaaatattatgaatctttgtttggatcgttgttgtaatgcgctcttgctctttccctcttgatggaaatacatgtcaatcctttcgccttcgtgagataaaaattactctgacatatagatttgacaaacttccctgtgcactattacattccatgatccatatggcaccaagaagtagctctaat

SEQ ID NO: 48150 - DNA, 107 bp, Triticum aestivum
  Clone ID: PAT_TA_48150
cattcatgttagcggcacccccaatcttgctcatatcattgttctctatacttcttgctggggtacacatagagctatagagggctattgagagcgctcttaccaca

SEQ ID NO: 48151 - DNA, 441 bp, Triticum aestivum
  unsure (1)..(441): unsure at all n locations
  Clone ID: PAT_TA_48151
ctcgtctccgcggttcccaagatcgcattcctgattttgcaatcgcgtgtttgttggtcctagttggagttgaatttgcatcgagggttgacttgactggtggtatacccggcgccggagatgggcaagggcggcggctgcgtccccagcaagaagcgccagccgccggccaccaccgtcgccgccgcgccctcgtcgtcgtcagccaccgcggtcccgcgggacgcgcccgaggaggccctgtgcgcacccaccggggagtcgaggcagacgctgcggctgtacatcgtgttctactcgatgtacgggcacgtggaggagctggcgcgtcacgcggcancgggagcgggtgcggtggaagngggggtgaggctctctntgggtgcccgagactctcttgncgaggtgctggaaagatgcaggcgccatccaaggaccccg

SEQ ID NO: 48152 - DNA, 428 bp, Triticum aestivum
  Clone ID: PAT_TA_48152
cattcctgggagcggcagccccaatcttgctcatatccttcctctctatactccttcctacgctacccactgagctatagagggctattgagagcgcccgtaccacacccttcagggctgctgcacaggggggagttgctcacccagtattcactggtcactatgggtcgcctatgtgagctcgtcgccatggtgcgcacgccgtcgttctcgactgctgcgcccgtacctcctggcgatgccctctttcttgattcggacaccgcgagcggggggtgctgcaagcagcggaagacggcgctacaagcggggccggcaccaccaaccaccgatgtgattcgcggcagagatgctgctaccccggcgcgcggagctacaaccgtaggccggtggagttgcaccagcaaaacaatgctggactgcgatag

SEQ ID NO: 48153 - DNA, 201 bp, Triticum aestivum
  Clone ID: PAT_TA_48153
cggacacgttggatagctgcccatggagtatcgattactacagatcccatccatgccagaggtgaagctcactaatctctcactaaacggattttttccacttggcaacatccattgttcacaaatcaagtctatggataaaactcgagagaaacatcgccagaacgcatagaaaagaaaagccgtataactagcaaatga

SEQ ID NO: 48154 - DNA, 411 bp, Triticum aestivum
  Clone ID: PAT_TA_48154
gacgcctccgaggaggagcctcccggcggcccatcgccgacaggctcggctggcgccagctcgtgacctccatgcgggcgcgtggacggcgatggggctcgtgggcggcatcctcggcttcggcctcggcctcgccgccgcctgcctcgtctacctccgcttcctcgcgcctcgccgccgtccccaggatcctgtcattagacctctacgagatttagatcatgagacattacagacgatggtacaggacattccgttatgggtgaaatatccagactatgaacggattgattggatgaacaagtttatttgtgatatgtggcctttccttgataaggcaatatgcaaaataataagaggtgtagcaaagccaatatgtgatcagtatgttggaaaatatggcattgaatc

SEQ ID NO: 48155 - DNA, 233 bp, Triticum aestivum
  Clone ID: PAT_TA_48155
agctgagcaccaggtcaggcgagcatgcaccggtgctagcacggtcgaccaagcagcacctagatggctgttgacttctgctagaccgacagggccaaggcttgtacgccgaccaacttcctcaggaagaaggtcaagaagctggtgacctacgacgcgaactaccatggcaagagctacatggtcaacaggttcacagacatggctgccgagatcatcggcccgatgaggga

SEQ ID NO: 48156 - DNA, 460 bp, Triticum aestivum
  Clone ID: PAT_TA_48156
caagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctttggctcactgtggagaggaaacactgctaacgtcatccgttacttcccaactcaggtatccatatgttgttgtttttgttgtgcttattttcattagctttcatgctcacatgatggtaatggtgtatgttgaatgcctattctcagtctttgaacttcacatgaaatgtggcatttaacaatctggctgtaatgttatttgtgatgatgctcttgatggtagtctaataaacatctatcatctgttggcttctggtttggaatgcctagt

SEQ ID NO: 48157 - DNA, 235 bp, Triticum aestivum
  Clone ID: PAT_TA_48157
cactctcagaaagggggagcgagcacgcgatatacctacacaaggctgccacagccccaacctggaacgcctcagccgccacattcgaaggtgattctcagagacttaagcacacccacggccacaaagaaacacacccatgcaacagcactagcctatgcagcatgagcatcgcatgcaggatcagggacaagcaaaactcgaccatctagatcctgaagaagtaggagaccct

SEQ ID NO: 48158 - DNA, 371 bp, Triticum aestivum
  unsure (1)..(371): unsure at all n locations
  Clone ID: PAT_TA_48158
ctccggccgtcccattctctctgccctctgccgagctgatcggcttctctccgtccaaacccagcagcatcagcagcaactctcccctctctactgagcctcttctccaccctctcccctgtcaacgacggcgccctcccctcgtcctccttccccgccacttgagttctggaaatcgggagctctggaggcagtctccggcatggcaacggcggacgctccncggcgtcagttctcgatagttcgaccgcgctgagtcgtgaccccaccgctttctttgttcgggagcctgtgattgctcggttggtgaggtgttactaaacaaagtacagtgcgatgagggtgacgtctgagtactcgtacgcagcaag

SEQ ID NO: 48159 - DNA, 331 bp, Triticum aestivum
  Clone ID: PAT_TA_48159
gctttgctactaaagtttgcgcctagctagctagctcaaaccatgtccaaggaggaggtgatcgccggcggcgacacggccgacgtggccgcggagaaggcgccctactgggacccgccgccggccccgctgctggacacgagcgagctgacccggtggtcgctgtaccgcgcggtcatcgccgagttcgtggccacgctcatctttctctacgtcagcctcgccaccgtcatcggctacaagagccagtccgccgtccagccgggcaccggcgtcggctacctcggcgtcgcctgtgccttcggcgccaccattttcgtcctcgtctact

SEQ ID NO: 48160 - DNA, 357 bp, Triticum aestivum
  unsure (1)..(357): unsure at all n locations
  Clone ID: PAT_TA_48160
ctttcaatctcgttttactctaacacgttatcagccgcgttgctctccttcgagcgaatgggcgccaaaaaaaaccgctcgtcgccggcgcagcctatggtttcgtccctttccgttcgcaacctcgtcgtccgcgaaggggtcctaagggcgtcccggcccacgagtggcagaggagacattgggccccgacgcactcttctggagacggcaccgggcccgcctgcgccatggctagcagcgccaggccgtggncgccctcgcgcgcgcccgccctgcgctagggctcgcccgccccccggccgccgtggccgcgccagccgtggccgggaccgtccgtcgatcccgcgcaagctg

SEQ ID NO: 48161 - DNA, 436 bp, Triticum aestivum
  Clone ID: PAT_TA_48161
gcggcggcagcagcgatggcgatccggcgacaatcatcagcagcagcttctctactcctgcccccggtggctgctcttctgtttctatgggtgtttggcggggggcatgtgatggcacataatgagattcgcaacatgacggcactccagaaacatgtctcctttttcgaccgtaacaaggatggcatcattactccttcggaaacatttgaagggtctgtcgcaattggttttaatgttacatatgccagagaatttgccaccttggtgcatactgctaatggtcctataacaagccccgctgatgcaccattgcctcacttatcaatatacatagagaatatgcagagaggaatgcatgggagtgataccggtgcatttgatgttaaaaggaaggtttgttccacaaaagtttgaggaaatattcataaagcat

SEQ ID NO: 48162 - DNA, 429 bp, Triticum aestivum
  Clone ID: PAT_TA_48162
gaaacaagatgcctgcacgtaaggtgatgggggtgctgctctttcttgctctcctgtggagcagccacctggtgatggtagccgaggctgccgaggatatccttccgtcagacgagctgagccttgaggttcttgcactgctcgaggacatcatgaagtccaacctgtgcccggcagcatgcgtgacctgcttgtgcaggtcgggaagagctgccctctcatcttgatgatgtttgctccatgcgtccttggtgaataagaccaaattacgtctcatctaaatgagttctaggtactccctacaaatatcaagattaaacctaacaacattgaccggagcggctccagcggcgagaggtttccgcggctgcacctgcggcgaagtgcggctccggctgcacctgttggccacgctggcacctgaactat

SEQ ID NO: 48163 - DNA, 170 bp, Triticum aestivum
  Clone ID: PAT_TA_48163
accctactcttaatcagaacgacccaagcacgtgcagacctcaaattccttaccgagtacgatatcatatactgagtctctgatccatgatgcttatgaggcggcggcgaggataccttggtcgagcagcctacgacagtttgtgtcctcggctcggacgagcgcacgcg

SEQ ID NO: 48164 - DNA, 386 bp, Triticum aestivum
  Clone ID: PAT_TA_48164
aggaaatgcactacaatacaatccccacagaaatccccatataaaaaccctagtccgtacgatcccggggagatggccaacccgagggtgttcttcgacatgaccgtcgacaggacgccggccgggcgcatcgtgatggagctgtacatggacgcggtcgccgacacggtggagaacttccgggcgctctgcaccgcgcagaagggcgtcgagaagagcgtgaagccaatgcactacacggtcagctagatggaccgcgtgatccaccacttgatgcgccactgcaggtacttcaccaagggcttcagcaccggcggcgagtccatctacggggagatgttcggcgacaagtagttcgtccacaagcacaccaaagaccgggatcc

SEQ ID NO: 48165 - DNA, 342 bp, Triticum aestivum
  Clone ID: PAT_TA_48165
cccaccagttacaccaacgcgtgcgcccactctgtaccttggacgagccgggaacaccctcggacgagcgcgcgcgactgcttcccctatttgttcctccccttcgaggaaggaggtgaaggagggtcaaggctgccggacgacatccgccaacgcttgcgatgatggcgagaactagaagggcgggtatacaagtctcgcttcgcgttagctcagatgccaggcgcaacacatcgagtggcacaagatgcagacccgcacgaatgaggtggtggctgcataagacaacatcccgcggcctacacaagaaggagacaccatgaaggcgacaggtcgacaagc

SEQ ID NO: 48166 - DNA, 426 bp, Triticum aestivum
  Clone ID: PAT_TA_48166
gctgattacgtctgcgatgcaagggtatgaggaattacacatattttataccaggacaagggtatgaggaattacacatattttataccaggacaagggtatgaggaattacacatattttatactaggacagggattgacaccatgtccaagcttctaacatatcggatcgagccgaccagatggctttttgcccaaaacactaatcacattttccaagcggattgtcagattaaagtcgggctcagggcattcttggacaagttactaagctcgctcgagtaagtcgcgatccaaagtggtggcaatgttgaacgaaatctaaggatccagagcagaaggaagagaagagaggagagcggaaaccaatagatgatgaaaggaagaggggcggccattgatattcaagaggcgggaaaagggaaa

SEQ ID NO: 48167 - DNA, 475 bp, Triticum aestivum
  unsure (1)..(475): unsure at all n locations
  Clone ID: PAT_TA_48167
gagcgcgcgagcgagtcgacgggcgaacatggccgcctcttcctcgctccccgcggccgtcccggcgctgctgctggcgctcctcctcgcggcgttcgcgccggagctggcggcagcggcctcctccaggcgccccacccaccagccccctcctttccccgcgggactcgctcccctgcatcagcggcgggctgcgagctcgagcggcaggtacgccgcctccgccgcggcggcgacggacaacggcacggcgaagccgttcacggcgcactacttccagcaggagctggaccacttnaccttcacgcccaaacgcctccgncttttctnccacaagtacctnctcaacgacaccttctggcggcggaagcccgccgccggcccgctgttcgtgtacaccggcaacgagggcgacatcgagtggttcaccaccaacacgggcttcatgttcgacatcgcgcccgagttcggcgcc

SEQ ID NO: 48168 - DNA, 394 bp, Triticum aestivum
  Clone ID: PAT_TA_48168
gttctccccttccctctgactctgggcggcggccgccgcttgcgcgtccccaaccctaatccttccaacacatgagcagcggcggcagggtgtcctggcccagcggcggcagggtaccccaatcgcgcttcaacgcctgaatccacttagcgcacggatccagcggcgacagggtgtcctggccgcgagcgccggggcaaggcggtccggcggcggcgttgtggcagcttcgctgtattccagtccgtcaaggattacggtcctactccgatcccaagttcccaacagcccaacaccgtcgctcatatatacatcctggcgaatccaacccctgtatagacgaaagccggtgctaaaaaattcttcctggtagaaattaaaacccaagaacatg

SEQ ID NO: 48169 - DNA, 383 bp, Triticum aestivum
  Clone ID: PAT_TA_48169
cccacgcgtccgcaaaatggctgtgcgagggaggcgattggagttttcaaccggatgctcaagcctcatgtctgtgttctgcccaatgagaaaactttctcatctgtcatctccgcttgctcccagctagggaacttgaggtttgggctgtgggttaagagcttcatggggtctctgggaattgaactggatgatcacttgcgcaccgccctcgtggatttgtacaccaagagtgggcggattgatagcgcttttgatttgttcaaaggcctgaggacaagagacgtggtatcttacagtgcaatgattgtgggctgcgggatgaatggcaagttaaacgaagctataggtttattcaaggagatgtctgacgcaaatattcg

SEQ ID NO: 48170 - DNA, 328 bp, Triticum aestivum
  Clone ID: PAT_TA_48170
agcaccataccattccaggtccaccacgcggtctacagcgcgaacgcatcgggagatccaaagatgccacagctccatgcctactcgttacgatccattcatttcaccttatcgtgatctttcggcgcgtgtggatacaaccatcaggcatcaaccatggatgacggaggaggagtggagctcaacctgtgcgctcgagtggcgtcgaggctgccagacggcagtgtgggaccgcgttggcctcgttggtgacatgcgttggcgcgcgcggggaggcgatggcgaggtatacggacggggctctggaggaataccactaccgggcgct

SEQ ID NO: 48171 - DNA, 336 bp, Triticum aestivum
  Clone ID: PAT_TA_48171
ctcccgtcctctcctctcctcttcccccgaggcagcagcgtccctcctctccgcccggatcgcgatggccgccgccgccgtcgccgccgactccaagatcgacaacctccgcgacgccgtcgccaagctcggcgagatcagcgagaacgagaaggccgggttcatcagcctcgtctcgcgttacctcagcggcgaggcggagcagatcgagtggagcaagatccagacccccaccgatgaggtggggtgccctacgacaccctcgcgcccccttccgaagatctcgacgccatgaaggccctgctcgacaagctcgtggtgctcaagctcaacgga

SEQ ID NO: 48172 - DNA, 275 bp, Triticum aestivum
  Clone ID: PAT_TA_48172
acccacgcttacgctcacggagctgttccatcatacacagcgcacgcaagttcgcatcttggagatccgatgcgatgattcatgcagctgcacaacatactgactgttctactgcaacatgtacaactgtgagctctgtttgtcttaccagtcgagcgcgttgcaaaagacggtgttgatagatagagcctgttgctcgggacgactgacaatgcatctgtgatgtagataattcattacacatataagaagaggattccgatactaacatgttt

SEQ ID NO: 48173 - DNA, 193 bp, Triticum aestivum
  Clone ID: PAT_TA_48173
ccggaatcccggattcccgccacgacccacgcgtcccgcgcgttggagctccccgcggaactcgcagacatgctgttcgcgcgcaccgccggcgccgtgttcccaggcgactacatgtggaagcgcggaggtgcatcgcgggcacagggagacggtagcacgagctgcctggaggtgctgaggatggccgagt

SEQ ID NO: 48174 - DNA, 375 bp, Triticum aestivum
  Clone ID: PAT_TA_48174
gttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcaacctggggttccgcccgaagaagcaggggctgcagtagcttgcgaatcttctactggtacatggcaactgtttggactgatggacttaccagtcttgatcgtacaaaggacgatgctacacatcgagcctgtgtgggaagacagcatgatctgtatgtactatcatagaccattgagaggtccgtctacatgttact

SEQ ID NO: 48175 - DNA, 267 bp, Triticum aestivum
  Clone ID: PAT_TA_48175
cgaacgctggggttatcgctgcttctgggttactacttgggggacgctcgctgcgtggctccatcacatgcttattgacaagagtagagagcaccgctccgagtgcctctcaatcagctgtcgaatgacagtccgtctgtctgaccgatcatctgaccgaaaagcagtcagtggaggagccaactcggggaccgacagctcgactgacagcttggaaagggagacgagcaggtacaccagcatctccagttaccatgtaggacgtga

SEQ ID NO: 48176 - DNA, 442 bp, Triticum aestivum
  Clone ID: PAT_TA_48176
gatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaat

SEQ ID NO: 48177 - DNA, 235 bp, Triticum aestivum
  Clone ID: PAT_TA_48177
tcgcagagacgagggtagcagctgatctgctcgcttccagaaacattggcgagagctactattgtgaaatcacgtgtcattccgaagaaggccaaatggggaaccactcgctaggtcgccgtgccaaagcatacgaccgtgtgcatggttgaacgggccaaaccatacgctgatgagcttgggatatccgtgacaaccatgagatcgacgggcacgggtatacgagacatggatg

SEQ ID NO: 48178 - DNA, 158 bp, Triticum aestivum
  Clone ID: PAT_TA_48178
tcggtgaacagtttgaagtcttctttcttgcctttagctacaagtgttattgcttatatggtggcgctacaggagaggttgatgcagataaaggctgacagggagctgatccaatatatgtgcagggacttggattggactggtcaaacacagatggc

SEQ ID NO: 48179 - DNA, 192 bp, Triticum aestivum
  Clone ID: PAT_TA_48179
acgatgcaaaattgcagagattcactatgtgcacaaaaagcagtctggtgggtcacgacagattgcagatattattgtgcagtttgaacctatagaagctggaagtcggtatcaattcaatactgaaataacgggaggggcagggtcgaaagaatacttgccaagcgtgatcaaggtgattgaacaaagctt

SEQ ID NO: 48180 - DNA, 195 bp, Triticum aestivum
  Clone ID: PAT_TA_48180
tcggctatgcgttcaaactgaacgggcatatacggtggatctgtgctgatatcaaccgtgcacgcaatggtgagctgtaccgcttcatttgtgtcaacaatggagcattggtgcaatctgaagtctatgaagcatttggtctgactgtgatagatgccatgacatgtggtgttgcaacaattgcgacatgccacg

SEQ ID NO: 48181 - DNA, 277 bp, Triticum aestivum
  Clone ID: PAT_TA_48181
tcgcaaagacaagggtagcacctgatctgctcgcttccagaaacaatggcaagagctactattgtcaaatcacgtgtcattgccaagaacgccaaatggggcaccacgcgctaggtcgccgtcccaaagcctacgaccgtgtgcatggttgaacgggccagaccatacgctgatgagcttggggaatccgtgaaaacgatgagatcgacgggcacgggtgtacgagacatggatgagttggacgccacctctggcaagatactcgcctggattggcc

SEQ ID NO: 48182 - DNA, 256 bp, Triticum aestivum
  Clone ID: PAT_TA_48182
ctccaggcgagcagtcgatggtcaccgtcgcgatcgttctgcgcctcgtccatgggcgaagccacgttctctatacggctgctttcctcgagaacagcacttctctacacggcagcgtgtctgcgtgcgagcactggtgtatcggtcaccgcgtccgggccgcgcaactggcgcatgtagcccgacgacaaggaggcgcccagtacggcggaagcccaggcacaggaggggggcaaggatgccgtggttccgcagc

SEQ ID NO: 48183 - DNA, 155 bp, Triticum aestivum
  Clone ID: PAT_TA_48183
tttgatcgatccccgtgcacactgtctccgtcgctggctgctggctccatggccgaagtaacagccgcagctgtctgtctagggggcggaagcactacctctacactttcgtgcagggcgccagaacaatcccactgtagcttcccgtgcggctc

SEQ ID NO: 48184 - DNA, 312 bp, Triticum aestivum
  Clone ID: PAT_TA_48184
aattcgacgctctccccactcataacgacggtagcagataatctgcttggggtgattatcaatggcacgaactactgttcgcaaatcatgtttcattcccaagaaattctaatggggcttcactcgctaggccaccgtcccaaagccggctaccatgtgcatggttaaacctgcaaaaccatactataatgagggtgtggaaaccacgaaaaccattaaatcgacggccacgggtatcatagacctggattaattggatgtcaactgaggcaagagaaccgcctcgattgcccttgccaacattcgaagtta

SEQ ID NO: 48185 - DNA, 373 bp, Triticum aestivum
  Clone ID: PAT_TA_48185
actatgcatgcgcatgaaggcaaacaccttctccactgtgcacgggcaaggacgccaattccgacactacagtattcgaggcaccgacccacttacgcttctacaaaagctgcacgatagagcgcattaaccgacctgccatacttcccagcaccgtcgactaggccaccggactgacctctaaggacgtctttatctacgcagagaccaggatctctgtacacatctacctttccaagcttaatgacacctccacaaagttctcagtgcttgtgtactttcacggaggttccataattatcggaacggccgactcctggacgtaccacaactacgtgaacgccctcgactacgggggcggcgtgctcacggt

SEQ ID NO: 48186 - DNA, 385 bp, Triticum aestivum
  Clone ID: PAT_TA_48186
acgctccaggggttatcaactgctggtgacgaccacactcaagtggatctgacagtactgtatggtgagcgtgagatggtaacagactacaaacttcttggagaggatgatcttgggtgcatgccaccatcgccaagaagactgccacagattgagggcacttttgatattgctgccaatggaataaggaccgtctcttcacaagacaagggcaccgcagaggatctgaatatcaccatgcgatcgtgcggcgggctttttgagtccaatatcgagaagaccatgcgcgcgggtgcgttgctctcatagaaggccacagagcgcacggcctttattgacatcagaaacacctgagacactaccatttacagcatcccgaagaggt

SEQ ID NO: 48187 - DNA, 147 bp, Triticum aestivum
  Clone ID: PAT_TA_48187
gcggccacgcttgcggccacgcatacaggcagcggcagcagccatcagatcgtcagacagaggcgagaaacgcggcaccaagatgaacaatcgcagtagctgaacacggcaccatgatgatgggccgcttgtcctccaccctgtttc

SEQ ID NO: 48188 - DNA, 183 bp, Triticum aestivum
  Clone ID: PAT_TA_48188
gccactgcgtgcggacagacagacagggggcgactgctctgcctgcaaaggagtcgattgtcttccactgctgcgacatcggcgccggcgatggggcgcaacccctgcgacatatgtatactcatggggggcgccgccttagcctttatgtacattcaaatgccgatgttatgcacccaggac

SEQ ID NO: 48189 - DNA, 249 bp, Triticum aestivum
  Clone ID: PAT_TA_48189
catttgatagaccaaggacatagctgcacctggacgaacgtcaattgattgactggctgtcttattggaaaacatctggccgcaaagtgtttatataagaatcaatggggtggagcctaagatctctgcagggaaaaatattgtgagactctcagacacctgcagatacttcaagattgccattggttggctagggtgaaaaatcggctgtctcgtcagtatgcataataacatactagttcacactga

SEQ ID NO: 48190 - DNA, 188 bp, Triticum aestivum
  Clone ID: PAT_TA_48190
gcaccacgccgagggcgtcgcacggacccggcagccggccctgacaaagacttgaccgggtcttgtgaccgactcggtttcttcggctgcatcgcgtttgtggcgatacctttgcgtccgccgtgttgcgtacggggccccagttccggctatcgcctgctggttaccgctctcccctgcgatcgatc

SEQ ID NO: 48191 - DNA, 203 bp, Triticum aestivum
  Clone ID: PAT_TA_48191
agtccaactccacatgacagaagcgcctcgactcgatcggcctgcactacacatatgcgaacctggacgcgttacccacactgctggtgtcattctctggcctgagacactacatctgcggagccatcctgtgtaaagagacgctctactagtgcaccgtcaacggctagaacatcgtatacatgctgacagagcacggcgtc

SEQ ID NO: 48192 - DNA, 100 bp, Triticum aestivum
  Clone ID: PAT_TA_48192
gcggtcattgatggttgatcagcagaacaagcgggcatgcacacggtggttgcatggtccaccaaccagcaccgagatggctgttggcttatcctccacc

SEQ ID NO: 48193 - DNA, 253 bp, Triticum aestivum
  Clone ID: PAT_TA_48193
cccacgcgtgcgcgcacacatcccactttgacgacatgccaccgacggcgaaaagcgcgtttagccggcaactgaacccttaccttaggatggatatgctttctaaatgggtctgccgaatggaccgatgacaatactcggattatcgcagagttggttgtgaaacaagagaaagctggtaacatgccaggcactcattagacacccagagcatatgatgaggtgggaaacgaattcttgatgagaactggac

SEQ ID NO: 48194 - DNA, 388 bp, Triticum aestivum
  Clone ID: PAT_TA_48194
acgggccacattgtcgtgctttactgcaaagggcacggcgactactctgttcccggcgtatacttgttgcacggactcctgtctgtacggcgaatgatgggagtacgatccaccagctacgtgcgggaccatgggtaaggtgcccaacacgaacagtaaggagaggccgaatgagtataatcacatctactaatagatgggggggtggatatacacgcatattggaatatatgtgggggatgataaagcgaatcatttgaccagaggaagggtccaataggtgggaacaagaacggtgagggcacctcggcatgcgagatatggagctactaggagcaccatgccatgcttggaaagcagggagggacaagcgactacctcagctgag

SEQ ID NO: 48195 - DNA, 203 bp, Triticum aestivum
  Clone ID: PAT_TA_48195
tcgctacgctacattagattagatctgagcttcgtctataagccacgcgacgcgagaccagaactcccgccatggctgcgacagtccagtccgcgaaggcccggcagatcttgtacagtcgtgacatcccaaccgtggcgggtgctgtgtgctgatcagatcgtacctttgccagtgtcgatgtttccagctgagcatcgact

SEQ ID NO: 48196 - DNA, 192 bp, Triticum aestivum
  Clone ID: PAT_TA_48196
gcgatcacgcgttcggacgggggtagtggctatgggtatgcacagttgtcgcgcgcccactcaatgagcgtgactgcctcctgtaacctccactagattgaaagccgatggcccccgtgcggacgacgagcctgtacgctgatggttgctcagacatggacgctctcatattcctttttctgctaaaaatgg

SEQ ID NO: 48197 - DNA, 130 bp, Triticum aestivum
  Clone ID: PAT_TA_48197
gacgttcacgcgtccggtaatacgagaaaagaaggtcctgaaccttgccgataacaagatcatggaaggtactgatcgttgagaagacattgcggatgaaaagcttatatgtgttattttgcatgacggt

SEQ ID NO: 48198 - DNA, 191 bp, Triticum aestivum
  Clone ID: PAT_TA_48198
tcgcaacagcacaacctgcggaaaaattgaccagttagatcaagatctgacgcctgcataattactacgcaaggatgtgacaagacgcctggctgatactttccaatattatgtcgaattagtgaccccagacgtaggccaagacctccgtgttgacttccttgccggtacaacgcaccccgatatgtgac

SEQ ID NO: 48199 - DNA, 308 bp, Triticum aestivum
  Clone ID: PAT_TA_48199
gcgggccattgaattcgtggcgttggcgagcagtggtcgccaggagaggatgggcggcggcagctactgttcgcgcgatgagcttcggccgctccagctccgtaggggccattgggaaacggccattcgcgtacacaaggacacatgtggttaggtccaagggctcgcacaaagtcaccatagtttggctccactgtctgggacactatggagtcatcttgtctaaactgtttgaaactcttccccttcctaatataaaagggatcttggcaactgcacctacaatgcctggggcgatttttggtgga

SEQ ID NO: 48200 - DNA, 194 bp, Triticum aestivum
  Clone ID: PAT_TA_48200
agcatacgcacgattgattccatgattatcccagacaaaaaccacgagtgactacatgaatgggccaacatgcaaccacatgttattccctgggccagcgaacataacgaggacgtgattcgcgccatgagccggcacatcaaaaaatactgctcgacgacgataccaagacttaccaaaacactgctggagga

SEQ ID NO: 48201 - DNA, 110 bp, Triticum aestivum
  Clone ID: PAT_TA_48201
ctgacgtccgcgttgaagatgcaaatgcagaggatctatcaacttgcgtcaactatgaaggaaacatgccggctaaagtcaagaagcttagaaggtcacaggagggtttc

SEQ ID NO: 48202 - DNA, 224 bp, Triticum aestivum
  Clone ID: PAT_TA_48202
gaggaacggcgccaacagagccacacccaatctcgtctccgatcgactcgagagctcgatcaatcctactaccctatctggtaaagacgcaaatcttggtgaagacagttactggcaagaccatcactctggaggttgagagctctgacaccattgacaatgttcaggctaagatccacgacaaggtgggcattagcccggaccagacgggcctgatctttgct

SEQ ID NO: 48203 - DNA, 293 bp, Triticum aestivum
  Clone ID: PAT_TA_48203
tcgatcgctggtgtggttctctactggaaacaactgcaagcgccggatggcttttaagacaacatggatgcactatgagtctgtgcgctcaaacgaaataaccgtgcggatattgactgaccttcataagaatgagcaggtcaatatggaattatggtgagaagctcagatgtctggtgatatgcaacttatgccactggttgactactataccttgatccctctaaagactgttgcaatttgaatgtgagggaacaaaactatgcctgcgaagggcatcatgaaaacagatg

SEQ ID NO: 48204 - DNA, 389 bp, Triticum aestivum
  Clone ID: PAT_TA_48204
tcgatcagaggaaccacaccgacaccccatccacgttatataaagtgaaaggtgtacaagcacacggagaaacacaaagtgcagcaagagctgctagatggagcgctcatcaatggccaggcacaggcttcttgctgtactcctggtggggctggtcgcgggctcctggttgagacacgccgccggcgctggccgaagccttgctgagaagctcagcgagccggagaccaaacggacgacgtactgagagaccatgccgcaacccaagccacagacaatgcctaagcctgtacacatgccaaaatcccaaactcagactctgactatatgtgaaaacatgccaaaatccgagactaagactatgcaccaacaccgacccatgccaaagt

SEQ ID NO: 48205 - DNA, 186 bp, Triticum aestivum
  Clone ID: PAT_TA_48205
cggacgcatggacgcacatgcagtgagcgtactgctgcagcaacgatggcgctggtctcctcatccttgggctgcaccgccgtcggggctctttccagtaatgtgctggccggggcgcggaggtacttcctgggcgctgtcggcaaggcggcggcggcgtcgagcgcgtcatttggcttgcgcgca

SEQ ID NO: 48206 - DNA, 285 bp, Triticum aestivum
  Clone ID: PAT_TA_48206
agacgtacggttagggtttagtaccggtgaatagggaggcgagggcggactgtccacgtacccctcctttccgtgcagactcccctgggccaccgacgaccagtccttgcataacacattatcaaagtacgggaaactgatcgactccaagatcatcactgacagggagacgggccggaccagccgattcggcttcctaaccttcgcatcaaacgacgcgatccgccaggcgatcgaagccatgaacaggcaggacctggacggccgtaacataaacgttaacga

SEQ ID NO: 48207 - DNA, 262 bp, Triticum aestivum
  Clone ID: PAT_TA_48207
cacagctaatctcatcttaccagcggcttcagcagattggcataccctccttgcgagtagtaacaccagcaatggccagtctacccgacctattaaacctcaacctcagtgactggaccgacacgatcatgacatagtacctctggcttggacgatccactgtcgacataacgagccaagcaaggtcggtgaacggaactatcaccgatgcaagccagctgaccatgtggaactacaaagggtacagatcctgtcaggctac

SEQ ID NO: 48208 - DNA, 173 bp, Triticum aestivum
  Clone ID: PAT_TA_48208
tggcggcggccgtggcggcggctttctgattggctgggtaggcgctggcggctgaccctattcaggcggcgatgcgccagggcgttttgaagatacaaaccagagagcatgagttgaccattgagctgacgaagcagaggacatggtctgtccatagggtcaacaaacttgat

SEQ ID NO: 48209 - DNA, 171 bp, Triticum aestivum
  Clone ID: PAT_TA_48209
acgacgaatgcttaccttttcatttctgactaacagaaggagagccgaccattacaggatcgtgatgcaggggcacgagtctgagatctgatccagagcggcggaaactaacatgaactatctccagatgagctactacaactacacagccttgacgcaactctggtggct

SEQ ID NO: 48210 - DNA, 224 bp, Triticum aestivum
  Clone ID: PAT_TA_48210
gaaaaaaacaggtgtcacgcgcgcatgcgtgcacgcgatgccccggcgtctccttcgccggaccgatggccaacccgcgcctgctttttacgaggatcctctggggcgccgccgccgcattctacacgtgactgccggcgcccgactccgtcattcggaaggacatgggtcttgctgcacccattatatgcaggcaaactgttcaaggtcggcattcgatatca

SEQ ID NO: 48211 - DNA, 273 bp, Triticum aestivum
  Clone ID: PAT_TA_48211
agaccgtccacgcattcgcccacacgtactggagaaacgattaggacagacggctatatacactgcatccacctttatgactcacggcggcataccaccttcaacgaacccagcttgcctactaaaggcagccatccatgtcataaactgagggtatgaggacaaaacccaatggcggaaagagatcggacggatctatagatgcactcctgaagatattcttactgggtctaaaatgcacgcaagacgatggatatggatttactgcatgcc

SEQ ID NO: 48212 - DNA, 253 bp, Triticum aestivum
  Clone ID: PAT_TA_48212
acgcggacagcgtgggcagcgagggcgagcagggggcgtaagagatggcgaacggcctcatcaaacgcgaccacacggtggacaccaacgctcattgccctgcaacacaggctgatgaagcggggaaagccgattcctgcgccggatgcgctaaccagctgatttgcgccatcgtgctcaacggcccggatcctgactagacagctatcgctgagcggatggctactgagaaacacaagatactgcttttgtc

SEQ ID NO: 48213 - DNA, 322 bp, Triticum aestivum
  Clone ID: PAT_TA_48213
gcgtccacgcgtccggtatgaacaaacaactgttgacttgtgatagctgcttatcaactggggacacttgacgaggatagcatctcatcaatgctcgttactcatgaatgcacacttgtgatcaataccctgcagacattatatataaaggtgagataatgcggctggagagctttactgaagacgaagagaatgctcttgaggttgtcacctgcttccaattcctaacattctggcacagaccgaggctgtcatcgcttacttagatgttacacatggtttcttaactccagtacctacaagggaggtattgtccagaaat

SEQ ID NO: 48214 - DNA, 303 bp, Triticum aestivum
  Clone ID: PAT_TA_48214
gcgcacgctaactctagatatagcggagcatgacggaggctaaaaccatagagacaggcgactataacggcaccggcggacaaggggaaaaaggccaaaaccgacaccgacttctgctatgaaaacgaacggatcaacagagccatgatgctctccataaagaggctgcaggagatccaggacaagctctagaaggttaatgaaaaaacaagtgataacgtttacgaggttgtgcataaatgcagtgcgatttgcagacctgtctatattttgaggtgtgacatcatctaaacaattccagac

SEQ ID NO: 48215 - DNA, 115 bp, Triticum aestivum
  Clone ID: PAT_TA_48215
cgcttaggtcgccgaatccttagatgggtggcaccgacaccgccgtctctggcttggaggtgttgtctgaacctgttcgtcgccggcgttgcctgtgtctttgacccggtttgtc

SEQ ID NO: 48216 - DNA, 282 bp, Triticum aestivum
  Clone ID: PAT_TA_48216
attgcggagctcaaaatcgcaacttctgtattctactagcaagcaagagtgtacaacaatgccaacagtacattctgctcatgtgcgagccccctttaccatgtattacacccattatactacataggatacatatgtgttcaccttcatcaatataacatatgatacaattgcgcgccgcatgttacaaacaccatagaccggttttggtccaggagaccatgattcaaagctccggatcaggtactgcagctccaggttctattctatgagacctgaact

SEQ ID NO: 48217 - DNA, 327 bp, Triticum aestivum
  Clone ID: PAT_TA_48217
tcgtccacgcgtccgggccaccgtttttcatttctggtagtaagaccagcaggaaaccaggccatgccacggcacacgcacagacagaaaccacgggataacacagcgcacgcgagcaaaccagaccctggcacagagagcgagcaagacattgagaggagcttcggcaggcaggcaggaagacgttgagccggccatgggcgacccgccgcagatcttgtggaaggctaggaggaggacgaacatagccaatgggccgatcttgccagcacaggaacataacgacgaggtcggtgtcaccgaaaaggcatcaacatggaatattcc

SEQ ID NO: 48218 - DNA, 144 bp, Triticum aestivum
  Clone ID: PAT_TA_48218
acgcacatgcgttcctaacgtacggaggttgcagaatggggtcaaatactactatatcgggcggattgatagaacagcgtgcgttcaccaccagtgccattaaaaaaacttgatatgtacactgctagtggctagcaggttggg

SEQ ID NO: 48219 - DNA, 272 bp, Triticum aestivum
  Clone ID: PAT_TA_48219
gtaccggtccctatacggggactgacccaatctttctcgggctcgttcatgatgatctcagctacatgcgccgggcgctgtccatgatgataccatgcgaccaccgcgggccgtgatccgcccatacctgccatgcacagcggccctacttgcgcaacagcttgtgcaacatatgtcccacactgtgcaactactgtttgctcattcaatccgactcgggcatactacagtgcgcaaaccctatcagggtcaaccattagtgatcgaccata

SEQ ID NO: 48220 - DNA, 186 bp, Triticum aestivum
  Clone ID: PAT_TA_48220
tcgaacactcgttcttaccatagcacgtaagacgacaatgtgatcttatcagtgcgccggctctgacgactagacgatcgaatatcgggcgccagtctcgaatccgctgggtcgtacatcgggcgccagacctcaagccggcgtgatctcatgcgtactaccaaaggggcgcttgattcatggtag

SEQ ID NO: 48221 - DNA, 276 bp, Triticum aestivum
  Clone ID: PAT_TA_48221
acaacacacagtcctgcatggatcctaacgtcatgaaggccaatgtcgtggtaagctcctgaagccactacaggacattcggatcaaccagggtcaagcgggtacaaaacgatctcatgataaaagcggcgcccatgatgaaggccctctaaatgaacacggtcgacgatgccatattgcgcctcacacgaaggttgtcccatgcatgattgtcaccagaatggacgtagcctagatcgacatgatcatctagaatgggaacgaccttcagcgcca

SEQ ID NO: 48222 - DNA, 122 bp, Triticum aestivum
  Clone ID: PAT_TA_48222
atacgctcagagagtcaaaaggagatcgctgatgagatatggagcgccacagaatcatggtgcttctttcagctggagaaccaagagattcctcttgccgtcatggacggaatccagagagc

SEQ ID NO: 48223 - DNA, 381 bp, Triticum aestivum
  Clone ID: PAT_TA_48223
tcgaccacgcgtacacccacgcgtacgataaatcggaagagggctcacagttctgtataggatttgcaggcattggctggtatcctccgctatcacgctggacattcgcttctttgatgatcttgatgacgacaagggtgcatatgaagactctgattagcaaccaatcaatcacatgcctgatagtggctccggatcaatctgaataagacttgactattagctccggcgcacctcaaataacctatacattgcatgatgggcgcgggacatatacatattattatgctatagaaggacgagacatacaaccgcaaaatctctatgaaaagacgtcaagcacgtatcctaaatgcgactgatgactctgcgcaccgaacc

SEQ ID NO: 48224 - DNA, 322 bp, Triticum aestivum
  Clone ID: PAT_TA_48224
aaaagatgggctgatttcacgcacgagaaaacttatggaaggcaatcagcttccaaatggatagcttattggaagacattcttcatctaaaatgctgaacttttcggatataacaatcgagaggaatggatggtcgcacatcacctgttccgaaagaattaagaggtaccgttggacatttccgtagcacaggctaatcgtatgttgagaatcattcatcacacaggcttaacatagtattatactccctctgtatgctgctataagaagtttcagacagcctgctctatactgtttagaacagcgtctgaatgtcttaaac

SEQ ID NO: 48225 - DNA, 254 bp, Triticum aestivum
  Clone ID: PAT_TA_48225
gcgcgcagagcatgtcattgctactctgcgaggggtgcaccctgagtagattcaaaactatgatccaccggctgagagactaaatcaagaactaggacctaccgtccttgcttatgcattggcacatctgagaggattcattcacacaccttgttgacgttacctgattagccatgagcagggatcgcagaaattacaacttactcagggatccggcatatgcaagaggcttgatttctcctaaatctgtgact

SEQ ID NO: 48226 - DNA, 174 bp, Triticum aestivum
  unsure (1)..(174): unsure at all n locations
  Clone ID: PAT_TA_48226
gacactatttccgtctcgtgtcgtgccgagagaacctctcatttgcgattggcgtgacggagatcggtacactcgctcgccgtgggctcgatagggatcggaatcaacggtttctgaaggatcgggaggctcatctccagggtagccatncagagcgactatgtacagcttgca

SEQ ID NO: 48227 - DNA, 156 bp, Triticum aestivum
  Clone ID: PAT_TA_48227
taccccattatatttttttgtgaacatgagcacagacacaggtgcttatacacgcgcagacattcatccctatgaacgcaaacacgcacgcctatattatatgagcaccactgaaagactgaggcagcatatcattttgatatttacgaagacacc

SEQ ID NO: 48228 - DNA, 282 bp, Triticum aestivum
  Clone ID: PAT_TA_48228
gcaagtcagaggcacggacgagcggcatgttggtgcagtgaaggtacggcaaggagggcccctccgcgacgtttagggtgtggcacaggccagctttgggcgactgattagggtcctcacacgcaatattgggcggactgatgaggaacataacctatactactggcctggagcctgaaagacagatgctttttttccctcgtaaggcgaagagggacgatcaatttctgtacgcattaggagacatggatggagcaatattgaatatgatggagaaacatg

SEQ ID NO: 48229 - DNA, 348 bp, Triticum aestivum
  Clone ID: PAT_TA_48229
gccacgcgtacggtgaaccacaagtgcagcaggagctgagagaaggaggagcgctcatcaatggccaggcacaggcttcttgctgtgctcatggtggggctagtcgcggtctcctgcttcagacacgcggccgacgctggccgaggcctacctgagaagctgagggagccggagaccaagacgacgacgtactgggtgaccaagccggaacgcaagacagagacaatgcctaagtctgtacgcatgccaaagtcagagactaagactctgactaagtctgaacacatgccaaagtgagagactaagactatgcacaaacctgagcgcatgccaaagtcagagcccaaa

SEQ ID NO: 48230 - DNA, 276 bp, Triticum aestivum
  Clone ID: PAT_TA_48230
aggcacatgcagtgagcgcactgctggaacaacgatggggctgttctcatcattgtgcggcaccgccgtcgcagctctttccatgaatgctgctggccagggcccggagctccttgcttggcgctgccggcaaggcgcgggggtcgagcgcgtcattcggcgtgcgcgcagcagcgctcgagagggccatgtgggtacccgggagcaccacttcggcgtggatcgacgggagccttgatggagacttcagatctgacccctggactctcagatccg

SEQ ID NO: 48231 - DNA, 288 bp, Triticum aestivum
  Clone ID: PAT_TA_48231
gactcagtatagggaaagcgggtgcgccagcacggtaccggaccggaagtcagcgcacgacccacacatccagggacatacagtgagcgcactggtggggcagcgatcgcgctggtctcatcattcttcttaaccggcgaaccagcgctttccatgaatgggcttggaaggaaccggaactgcttacttagctctgcctgcaacgccgcaggatcaaaaagctaatttgttcttctcgcagtatttctccaaagggcaattttggaactcttgaggagaacttcgtct

SEQ ID NO: 48232 - DNA, 260 bp, Triticum aestivum
  Clone ID: PAT_TA_48232
catcaccaagcaattactccagcactggagcgctccccaccatcgtggcctccacagtatgtcaagcccgcagtgctgcacgaacccaccggggctaaattccgccggctgaaagggcaaggtcgcggacagattcagtggaatgaaggcgtacgtctcctgtgccaaatagaccaaggtcgaccgcctcctcatatgcaaagtgtacgggattgaagcgccgcatcttatgaagatagccggtcaaatttcttacattg

SEQ ID NO: 48233 - DNA, 252 bp, Triticum aestivum
  Clone ID: PAT_TA_48233
acgattcacgaaaaccctactgccgacgttcttcattctccaaggtctcaagggtccatatctccctccttcacagctgactaggcggcctttggagcgcacgacatggcggaagaagcacccacaccagttgttggcccagtggaggcacctacccccgttcttggtgagccgatagacttggtgactgctctacaccttggcatgaacaagtcaagtgctcatgatggccttgtgaaagggcttcttaag

SEQ ID NO: 48234 - DNA, 366 bp, Triticum aestivum
  Clone ID: PAT_TA_48234
gcgcggaacaaacggtagcggcggctacagtggcggcagaaacaggaccgagcgaccgttgtacgcgctgaaaatattggtgtgcgcaaacgtgctggggctgctgaacattaccttggggagcccgtcggtgcacccgagctggtcgctgatccaggggctgacggacctggaagcggtgctgggcttgagcacgacgctgaacattaacctagtgggcatcaacatgaccgtggccagagcgctcagtctggttctcaacaactgaagtgagaacgtccgctcctggtatgagtgcatccaactgagctcaggcataccttgcatgctgaatgcgtcatacctgatgcatgcatgcatgcatga

SEQ ID NO: 48235 - DNA, 157 bp, Triticum aestivum
  Clone ID: PAT_TA_48235
acgagcacgcgtacgaccaaccgtctggtggtcgactaggccaccaatgactacaactgcttcatctctctccacgccgacaccatggagaggctgcagatattacgaagggacacctttctattgaaggggaagaagacgcatgacaccatctgca

SEQ ID NO: 48236 - DNA, 122 bp, Triticum aestivum
  Clone ID: PAT_TA_48236
acgggaaacatggtgacagaccctactgcagtccacgagatcattgcttttgcaccagacagcaatgcggtgaatcctgagcttacataccgcaacagcctgctgcgggaagagctgattta

SEQ ID NO: 48237 - DNA, 307 bp, Triticum aestivum
  Clone ID: PAT_TA_48237
gcggcgactatgatgtttctgaaagagcgaacatgccactggcaaattggagctcacgctccaaaaggcacataggaagagttgaacttacaagcctggatgagcatggcgagtatgcaccatctggaacaaaggtggtagaaatcaatgtcctgttgcagaagaaaagtctgaagaagccccatactgtgacagatgcaatgactgtatcataaccagctactgtcgtgacagaagttatagttgtgcccgaagaacctgaaaaatctataaagaagtttgttccaacaacaccaaccatccatac

SEQ ID NO: 48238 - DNA, 291 bp, Triticum aestivum
  Clone ID: PAT_TA_48238
gcggcggcggttgaacagaagtcggcaccggccgatttgcagtttagtgatcaattgcctgtgtgcgcccttgttgcatagcagtccatactggcttgggtgtcagggtgctagaaagcccatactaagggttatgcttcgtgctcaacgacaagctattcgagggtgtactattgcaaccctcgtgacttatctgtcgagcaatcattttgccccaaatggcgtgattagcaagagatttatctctgacgagcctgctagagaacaaatgaatcttattaaacaactaca

SEQ ID NO: 48239 - DNA, 285 bp, Triticum aestivum
  Clone ID: PAT_TA_48239
gcatgtcggcaggggctggcttcttcgccgacatgcagataccaacggtatgatatactaccgaggatggtaccactctgttttaccaatacaacccgaacggcatcggctgggactatgtcattatgtggggccatgccgagtgcctagacctcctgcactggcgccaaataccataggctgtgcttcctgaccagtggtatgacattcaaagtgtcttgtcatgatgcattactgtgcttcctaacaggacgctcatgatgctgtacactggtgccaccaatg

SEQ ID NO: 48240 - DNA, 158 bp, Triticum aestivum
  Clone ID: PAT_TA_48240
ctctaagaggatcctgagagctagtgataatgtcgactcctggaaggatgcccaaaagtcatgttacccactgctaccccctgttctaaaggatatagaaccacttgtataggcacctgctctaaaataaataattactgggatgaccaacagccaaa

SEQ ID NO: 48241 - DNA, 326 bp, Triticum aestivum
  Clone ID: PAT_TA_48241
acggccacgcgttcgcccattacgatccgaatgcaccgcttcctggtcggcgaccacgccaccatggcggcgctactagcacggcacgcatcgatggccctgcgagctaggcacacggcgcgtttcggaccgacctggacggcgatgcacggacaacttcggacctacatggacacagaggcccccaagaggttcaacgaggacgaggagaaagagcagcttgcgaaagaactctccaaacattggagtgctctgaaagaaaggagtatcaatacattgctcttgactgaaatggtccgaggaaagatgctgacgcttatgcactt

SEQ ID NO: 48242 - DNA, 297 bp, Triticum aestivum
  Clone ID: PAT_TA_48242
atagggaaagctgtacgcgtgccggtccgcgggtacgggtacggagttgctggatcgcccacgcgtacaggcgagtggcgggttttaggttaccttaggtgcatgaaaacgaaggtcaccgagtaccgtacgaggttggacagggcaggacatggcatgcgatagtacttagcgtacaggaccatgttccggcgggccgtgccggacgtagtctagcatgcgccggcggcggccgccgctgtcatatgcacgtcgttcccagccaaacgaagatgtggtacgcagaacgcgcgcaat

SEQ ID NO: 48243 - DNA, 178 bp, Triticum aestivum
  Clone ID: PAT_TA_48243
ctacggacgcctgagaagatattgctcgggtacactattgactcctgcaaggatccccagaagtcatgtgtgccactggaacgccatgctgtaagggacatggaaccacctgccatggcacctgctgaaacatgaagaagcactggactgaccaaggaccaaaagatgaaaattccga

SEQ ID NO: 48244 - DNA, 345 bp, Triticum aestivum
  Clone ID: PAT_TA_48244
ggctgctaaacggtgcagccctcgtcgctcgcgagggcgccaagcgctcttccggacccaacgtcctaaggtccgcactgctagccgtcaccgacctcaggggcctcaccaggggcaccattcgcagcccgaaggcggagactcttctcgacgattgccaccctgaggggggagactcatctaggacctcgtggtgctgcgagaagtactattggaacgacgacgcgccagcggtgaaaccctcattggagacacagcgccggacgtgagaatccctcaatccagcccaggggcgggagatgaccgtgaaccattaaaccggcggagacgtagatgcggatgaaa

SEQ ID NO: 48245 - DNA, 207 bp, Triticum aestivum
  Clone ID: PAT_TA_48245
ttatcgtgtccgtataaactctaacacagcgggctgatacttaaggctaccgatcgaacaaacagcagcgggagccaaaacaagagaacgagcttgcagtatggatcgccgatagaagacgcgctgagtgggatctgggtctcctatggcgcccgcgctgtgcaggaccatgggtccgtcgggcgtggtggggctggggtcgagccc

SEQ ID NO: 48246 - DNA, 191 bp, Triticum aestivum
  Clone ID: PAT_TA_48246
cgacgctagcaccaccggccacctgctggggcgatagccggtgccacacgcacgtgcgtcggtgactatggcgggtgcttcgggcaagtaccacatcgactttgacgacgtgttcggcggcgcgcctcgtcgctcgactgggagtgaccgtgggcgccgatcctgggtagactagccctacagctgcgcgt

SEQ ID NO: 48247 - DNA, 308 bp, Triticum aestivum
  Clone ID: PAT_TA_48247
acgtaggactatgctttagcttgccacactgtaacggtcggggcatttgttcgcatccacgacggccatggtcaccgataatgtccacaacctgacagccgcgctgaccgaggaggcgccaccaatggagacgcccgtctccgtccaggaggcgacgaagacgggggacgtgcccgcgccgacggtggccatactaaagacgactcgcccccagccggttgaacagaccatagcagatgcgccgatacacgatgtgacggaggatactaaggagactcatccaagaagtcacgaccatccggaagccg

SEQ ID NO: 48248 - DNA, 323 bp, Triticum aestivum
  Clone ID: PAT_TA_48248
gcgcccacgcttgcgaccacacatgcgagcacgcgtccggataattgtcgaaacaaaagaaagcgtccagcgtctttgatcaagaaacaggctcaggcgttcaggatgtacgatggtgaactgggtagaggtgctactgaagtacttcgtaatgcgtctggcaacgaacgctgggctgcggcagcatgccacggccgtggtcgacgacgacggaacggatatcaactgatggatggccaaccacaacaagggatgctacatgattgactgtccggaccacgccttggtgactcttcatggcttgggcggcgactgtatgatga

SEQ ID NO: 48249 - DNA, 221 bp, Triticum aestivum
  Clone ID: PAT_TA_48249
gccacgcgtaagatctcattcacctatcaaccatgccagggacaggagcccactgacgcatcggccatggacggtaatgaggacgacatgccattgggcgcgaaccgctactcggagcaccagcccatagggactacggagcaccgccgcggggcgcactataaggagtacaaggagtcacctcctggcccctttttcgaggccggagagctcacctcctg

SEQ ID NO: 48250 - DNA, 290 bp, Triticum aestivum
  Clone ID: PAT_TA_48250
ctgctccgaggaggtgagggccgagagcacctcggcccgccgacgttgctgcatgcatgagcacattgtgaacgagacgttcgtgcacgagttcaacacctccggccgtctgcacagttaccacggtcaccaaggacgctgctctagtcacttagcagcgcgcgagagcaggctcacggacgacttgaacactcgcaccgtagagttgcacgagcgcatggcgaacttcggagcacaggacgatgactgaacttacacgtatcggagcacactacgatttgtgatatgta

SEQ ID NO: 48251 - DNA, 186 bp, Triticum aestivum
  Clone ID: PAT_TA_48251
gcggatatctcttccgatctagatcctgtgccgcgcagatatggctgaaggtagcaacaacttgatacgggggcaacggtagaatgaacgataaggcttgggggcacaacgagaggtatgcacgcgaaggagaaggcgcacactgtgactgaggcgcacgcacggagatgatgttcctgtgacatt

SEQ ID NO: 48252 - DNA, 372 bp, Triticum aestivum
  Clone ID: PAT_TA_48252
gcgccggcgaccatgccaactagacaaccatggggcaaggggccgactccacgtcggccaggccaatggccagagtgacgtcgcacctatgtccgccgactttgaatatggaggaggtggccatgttgaagggctctaattgccatgcataaggtgctgtaccagggttgaacgtcccatttctatgtgcatgtagagggatcggccagccgctctgcctgattatgatgatgaaccctattgattcggtgctacatttatatgatgctgccaacacacctggtgctacagctggacatttccacattaacaccaatgctgaagtgcgtggattgtgatggatctacaaatgaaaagtgctgttactggaat

SEQ ID NO: 48253 - DNA, 280 bp, Triticum aestivum
  Clone ID: PAT_TA_48253
gctgaaatggattgccatttgcacgtgaggtgcggcttttgattgggccttggtggtgtagatccactaacacatagggagaagcatgatagatcgggcagagatcgcatgtcgcggacattgtagaacaagggaagcgtgggttacctgatggatatgtaatgacggagggtgaggaggtcaagcatgtgctaaggcacagcaatgcctgagctaaaacgggcgcttgtgtcacagtggagcttgctcgacatagagactaatatcgatgtgcagattg

SEQ ID NO: 48254 - DNA, 292 bp, Triticum aestivum
  Clone ID: PAT_TA_48254
acagcatatcttacatagctacatagttaatgatacgcgtaaagttatcttaccggcagttgctaactctatgtatagcgagcctaccatctctagctgacaccacacgttggtgattgatcatatatcatagtgcgggatcgacagatctgtgcaatcaacctcaccggtagtggaccggacgtgatcaagcaacccaagcgaagatgtgggtgacctctaacaccacgagaggaccaactggcgactgaactagtcgaacgagatacactacctgtccacatggcatgac

SEQ ID NO: 48255 - DNA, 321 bp, Triticum aestivum
  Clone ID: PAT_TA_48255
acgggctaccagcttcaaggccatcaacatgggcgagggctctggcgtgccaggcaagtgcggaattagtacactcttaactatcagaatgtacaacaattgctacactcataaatagaccaatatataaccatttctacgtgcatgcatggacacgcttgagtcgagattagatgactatctagacggagtgctcatacgatactgatgagcgtctaaaaatataagataaatgtgcctgcatgtgacatcacactggtgtgtatatgtatgtaccttacacacacactgactgtgcatatactatgtatgcaacatgta

SEQ ID NO: 48256 - DNA, 335 bp, Triticum aestivum
  Clone ID: PAT_TA_48256
actccgtttagcctttaactgttacgtccaaataaaacgctcgcgctaccaaaccctatgtagggctcctttcaatccgcttgaagtcgatctcaattccgtgcgagattggactggatggggatgacgatacctatggccgcgcgattcctgccggaagggagctggctgacgcgctcaggcgaggaggaaagggcagtcgtaaacacactcacgcgggatgtctaatctaatgtaaaagacggagatactcgctatcttatgtgacataactgatggaccaactgacaatcttatgcgggcttactcaactatggggagaatgacactggcat

SEQ ID NO: 48257 - DNA, 352 bp, Triticum aestivum
  Clone ID: PAT_TA_48257
tcgccgcgaaatcttatgactggtccgcatctccttgcggcatggccatctgcacggtctggatctcgctgctgctcgcgctcgccatgctgctgtccgccccggcggccacggcggacgaggctgccggctcccaggaggccgccgcggcccccgaggccgtgctgacaatgaacgctgactacttggacaacgctatggccaatcacgcgtacattgtcagagagtgctacgcgccatggagaggacactgcaacagcttggcacctgcgtatgagaaggcggtctaactgaagagcatgcacgacccaacgatagctctcgcttaagttgctgccaacgatgacaagaa

SEQ ID NO: 48258 - DNA, 332 bp, Triticum aestivum
  Clone ID: PAT_TA_48258
ttattgaaattcacaatttttttggtttggagggccatgaaacctacaattataatggcccggcatgctttttggtatgccacctgcaccgttctaaaacacataattattgtccccgggcccatattttaaaccattggaaatattacaagggtcccaaatgtcaccgatgattggttgaggttaactcattttttagacaaaggaataactggaatggactccggtttaagggaattggctaatttaaaagcaaacttgattaaaaattggagccttccttaacttaaaatcgacaaaaaaaggaaacccccggggatcatgggccttga

SEQ ID NO: 48259 - DNA, 329 bp, Triticum aestivum
  Clone ID: PAT_TA_48259
acgccttcctacacctttgctggctccgcggctcatgatatgcgatcccatcggcgggccggctgctcaagatgcgaccgcgtgcggggcgacgtgcttcacacgcgatgaaggggtgaggagtcagatgactgccatttgatcacgcactggtgtggcgtagcaacgatcttaagaccgaaacgacctgagctcttagatgattcaaagatggtgaggagctgagagcaactgaaatactacagtgggggcttgggcggcataaggacatgactggattgccatcttggcaacattggtccgggggccaaaaggccatggggataatc

SEQ ID NO: 48260 - DNA, 293 bp, Triticum aestivum
  Clone ID: PAT_TA_48260
tccgcaggggggggcatccgtcatgaccaatacggacagaacggggtcctcggtctcgagatactactgtggaaacaaatacattgatatggtcgaaacgctgagccagaaacgtgctttggaggctttcaatttgtacccagagaactggggagcgaatgtgcatactctattgtgttgacctgacatcttacatgtatacactgttgtgctgatgacacatgacataattatggatgtggatcttactgaccgaggacatatttaccatggttactagactgagacaaaaa

SEQ ID NO: 48261 - DNA, 205 bp, Triticum aestivum
  Clone ID: PAT_TA_48261
ccgcgtcgtcctacgccttctcctatcccctctaccggccgctcgaactgccacgattaggcgcaagaatggccgttagaatgcgcgtggttatgagtgtgaatactgatgtggaaactttggtcgagcattgcaatgaatatggcaggggatatgtacatgtcttgcaagatgtcttgaacgtgcaagctatcttgcacgctag

SEQ ID NO: 48262 - DNA, 272 bp, Triticum aestivum
  Clone ID: PAT_TA_48262
acgtccacgcgtccggtatcctacacagggaaccatatactataagcgcaatagaagaatagcgatccttcaatgggaaaatcacaacacgatcctcttttcttgtcgggctacctgccaccaccaacctgttgttcggccggccgaagtgggccgctgcgggtgctgcttctccggcgagaggtgtacctaggcagcgctgtatgactttgtcggactcctgcacgggggctgtgagatcttaggacctatgactgggcgcgctgatggga

SEQ ID NO: 48263 - DNA, 291 bp, Triticum aestivum
  Clone ID: PAT_TA_48263
ggcggcctaactgatgagcatgcacgacccaacgatcgcacttgcttaggttgatgccaacaatgacaagaacaagctgcttgcaggcaattacgaagcccagggctgacctaccatgaataccttgacgaacggggggatgaacatacaggaatacactggcccaagcgaggctgacgtaattgctgagtacttgaagaagctggttgtgcctgtttccaaggagacaaaggcacctgcatatgccacttaccttgaagactgcacgatccacattgtacgtgctttcac

SEQ ID NO: 48264 - DNA, 249 bp, Triticum aestivum
  Clone ID: PAT_TA_48264
acgcacagacatacagagggagagagagagggagagggagagagacatatagtgagcctctagggcatccccaatggaacaaatcatcagctccacggccatgtcgcgcgaaattaggcccgagatcgcctcgctggtgggctcgctctggttcgcgcacagcatcgtgccgacgctcacagtgacgatcacgggcagcacgaaggactcgcacacgtacgtgcacatgaagtgcaaggtctgctccca

SEQ ID NO: 48265 - DNA, 279 bp, Triticum aestivum
  Clone ID: PAT_TA_48265
cggacgcgtgaactttactgatgcatttactcccgcgaagcgagaatctagttaatggactgctgccagagaaacgagtcttaaaccgctccattgctggcagcagcgagggcaagataactctgatcggcaggatgcccaccatgctggcttaactaaaccaacaataccaagaccgggattccctacctgaacttctactacgtcagggacggctgtctttgctccactctaccaatccagacactgaatccctatctatacttcatgacatgggac

SEQ ID NO: 48266 - DNA, 349 bp, Triticum aestivum
  unsure (1)..(349): unsure at all n locations
  Clone ID: PAT_TA_48266
gatcagaagcgatcagaggacagagggaaggagggagggagggaggccatcctgcgatgagagacggagagagcactgttgcctgctttgcttcttgcacccaatattcttcaatctctacctttacctatcaccggagatacttctttatctcatccgatgagaccatgttgcgaatcacatcatgcatctccccaaagctgactacattctcanacgatgatctactggaacaagagtctatgctcaagggaatatggcttcagaggaaggacctggaagtacgctaatatccatggcaagaagctgcaatgtacccacttcatacctgctgagactgctgaaggaa

SEQ ID NO: 48267 - DNA, 273 bp, Triticum aestivum
  Clone ID: PAT_TA_48267
gcacagaaaaccgggagaggatcatggccggggtgaacaccagtgtggtcggtctcaagcccgccgagacggcgcccaagtccgcctcgccaacgaccgcaaagcgcgtgtaggtcgcctgggccaaggaccggcggtcggggcttcttgggctggcggcggtattggacgtcactgccacctgcacctggtcaagcgcagcatgcgtattgaactagtacataaggaagagcaagctaaacaaggagctgaacgacaagaagaaggcagcga

SEQ ID NO: 48268 - DNA, 314 bp, Triticum aestivum
  Clone ID: PAT_TA_48268
cacacaccttatctcacctcacattctgtcgcctcacatatcttgtctcttgtcactccctgtcgccgcacagaagacggcgtccgacggcaccggccttgtcaccgtgtacggcaccagcaacaacggcaccgtgacacagctggagcccaagacatgctcgttctctgtcaaagtgggcccggcccaaatgctccgcgggcgcgtaatgatggacatggtcaacgctgagcaggcacgcatctccaacgaggccggcgcctgctccgtgatgagggtggagcgcgtcccctgcgacatccgggcccaatgcg

SEQ ID NO: 48269 - DNA, 244 bp, Triticum aestivum
  Clone ID: PAT_TA_48269
aagggatcttgccgaacacagcctattggcgaaaaaaagcgctgttttaacacaaacttaacgcgagtttcaacaaagatattaacggcttacaatacacgtggcacttattggggaaatgagctccgaacccctattcggtcatgagactaaatacatgcaaatatgtatactcttatgagacaatgaccctgatgaatgctccacttatatcgaaaaacgcattgtctgagtatgcaacatt

SEQ ID NO: 48270 - DNA, 171 bp, Triticum aestivum
  Clone ID: PAT_TA_48270
cgcacgcgtgggcccacgcgttcgtacaagcgtgagctgccgttacttgacttatcactacaagacttataggcagggacttatgttataactaacatgaactaatgcaaccgttgcctgtacagcggggattaaagaatataaactgcttcactactctctggactgtga

SEQ ID NO: 48271 - DNA, 293 bp, Triticum aestivum
  Clone ID: PAT_TA_48271
agtgcgcattgtcctggatggccccacgcgatcagaatgtacctgcccttcacgtacaacaagatgtgcaacattggatgacctggaactatggcaagatggacgtgctgtggccttggacactaggactcatagtaggggtgcatgaaataggacatatcctacgctgctagggatgctgctgtcaaacttgatgtaccatatggcagcacctagctggcaaatatgatctttaggtcggcatgacctgaataagcgatattgtgcggaatccgggtgacctgctcaaggta

SEQ ID NO: 48272 - DNA, 232 bp, Triticum aestivum
  Clone ID: PAT_TA_48272
gcgtacttaatcacccgtctggcgacaaacaccgggctactgcaatacaccgttgccttcgatgacacgaccactgacataaacctatggctacctgataatgacaacacaccggacaggaagtagaacccgggtaagaagcaccaggccttattactcgtgcactgcttgtgcggcgactgcattatgacgtgtgcgatccatgcgagcgccatctgcaatactggctacg

SEQ ID NO: 48273 - DNA, 318 bp, Triticum aestivum
  Clone ID: PAT_TA_48273
gcgaaacaaccgcacggcgtcctgagtaggccggcattaatctgaacaccgcgttctggctacgccttgaccacactgggtgtcggggaccgggcatgtgttgcctcgtcgcgtcctcggtgacgccgtcagcgtgaaggcctacggcccatcgtgtgtctgttgcggtggccgctctttctcgatggcggaacgccgagcctcatctagctgtatggaggagtgaatgcccgcgggctataacgatgctacggaggagctgtgccgacggcgacttcagggcgcccggagacggcagactatacaggtcttgcatta

SEQ ID NO: 48274 - DNA, 241 bp, Triticum aestivum
  Clone ID: PAT_TA_48274
acgggtagctgctcaaatggcgaccaacaggaccaaggccgacaagaagatcgggtccgaccagaacctatggcagctgctcgaggagtacaccaaggtgctcaccaccagagccgacaatgtctgctccaagcatctacaggagatacggacgggaatacgctgagactccattgcgctcatgggcaagaacacactaatacgccgatggattaacgtgcactcagagaacaccagcaac

SEQ ID NO: 48275 - DNA, 370 bp, Triticum aestivum
  Clone ID: PAT_TA_48275
cgcagtgagagtgagtgagctagtcacaataggaccaattgatcggtgctacctcactcaagagaggaaggatggatccatgaaagttacggccgacgagcagcttccacaccaagacgacgacgacgaactcacggcaggcggtgtggaacgacaacgaggcgctgactatcagctcgtgcggaccaatcttgattgaggactaccacctgttggagaagatcgggcacttggcgcgcgagcgcattccagagggtgtggtggacgccccgagcaccttacggaatggatttttggagggcacccacgacgtgacggggttgacctgggccgaattgcttcgtttgccagggggatgcacgccgggcat

SEQ ID NO: 48276 - DNA, 207 bp, Triticum aestivum
  unsure (1)..(207): unsure at all n locations
  Clone ID: PAT_TA_48276
accacgcatccgcccacgcatccgaatgaattctactatgaagccgcattgctatcctaggtatttctattattcggctgcaatgacatggaaanacgatgcttgtaactcataatttgtctgctttatcctatgctgggattcttaccttgtaccacagtcaacatgataagtgaagtgttaatgttcacacatcgttttgcataa

SEQ ID NO: 48277 - DNA, 251 bp, Triticum aestivum
  Clone ID: PAT_TA_48277
actcattcccgattggcgtcataacgaccggtccactccctcgccatgggcacgattaacatcggaatcaacggtttctgaaggatcgcgaggctcgtctccagggtcgccctgcacagcgactatgtacagctcgcatgcgctaactacccatgtatcaccaccgagtacatgacctacatgtccaagtcctacacctttcacacgcactggcagcactgtgtcatcaaactcaaggaccacaagacgct

SEQ ID NO: 48278 - DNA, 269 bp, Triticum aestivum
  Clone ID: PAT_TA_48278
ggccgccctgccggcatgcctcggccgaccgggtcacccacctgcgccccggctttcgtgatacgattcacccaccgcccccgccgctatgctgtttagatgcttctctaccaacctctcctccaacatctatggtgctgtacaaaaaccatgtcctcaacaaccacactgtgggacgaaatacatgttattactacagacaaactatgccattgcgattgtgatcacagaacgatgaaccagagcaaaggtggtggtgtgcttgatcg

SEQ ID NO: 48279 - DNA, 272 bp, Triticum aestivum
  Clone ID: PAT_TA_48279
acgggacagttctagcttttcttcctcgcagcggagcggctagttcgagctttccttctacgggagcaccgcgctgctgacacgcttccttctactggagcactgcggagcgaagatccatccgggagcctgaggcattgggatgaaagcgtaggcacaaagcatggtgaaatggacgcactactaagggacaagtgggaaacaattggacctgctgcgatgggaagcctatggaacaatctgcacggaggcgctagctcgatgattgaaac

SEQ ID NO: 48280 - DNA, 312 bp, Triticum aestivum
  Clone ID: PAT_TA_48280
accgatgctggagcagaacactatctctgcctggaacaatgtacgtcttcttattctattatggatatgttgatgagagccagtctgtaagagtcaaatagcatgattccgtaccaatcggaagagatcccttggcattataccatgccaactgccaatgatgatctgaaattttacttgccatctttcgagtatgttactttgatataccaggacgtgtcagcatcatagagctcaggaaaccgtgtactgaacaaaacatgtgaaccaggcttttctgtacttttctcagcctgctggtacaaaatatcc

SEQ ID NO: 48281 - DNA, 248 bp, Triticum aestivum
  Clone ID: PAT_TA_48281
actagggataaacaaatacttgtacatagtagatcacctggtttatttaacactagttcataaagaacgggtgtacctgtgcacgcgtatttagtacgtatcgatcaacaatgggaccagatcatacgtgcgtacgttcggagaacgatacacgaatacacgtgtgggcatatacacataacaattgggcgcaacgcgcgggctcaaacacgaacatattgggctgcaggtggcaaatgatgtgcgtg

SEQ ID NO: 48282 - DNA, 315 bp, Triticum aestivum
  Clone ID: PAT_TA_48282
acgatccttatcctcgctagcgctacctgtcgccgtgggcgcggccacgggcatggccaccgccgtggccatggctcccttattctctcccgccgccgcagtcgctgacttgcacataccctccgctctcgcaaatgcacatgcttcgtccacgcgtcggttccggacacgcacacgcgttctgatggggtgtggtccggcggcccactcagggtctgagggggcgccggccgcggtatcatggagggcgtcgtgctgatctggcaacggaaacaaggggggcggcacgctgaccgtgcatcaggccattgagcg

SEQ ID NO: 48283 - DNA, 245 bp, Triticum aestivum
  Clone ID: PAT_TA_48283
acatgaccggcctgtcgcagggcgtgcgtttaccaggcccggccggcaggcgcgccagcaggttcaccgtgagggcgtcgtccggagcgcgttctctcaggtggtgcacgccggcaccgttgcggccatcaaggttggccccacaacgccgatctgcggtggacttcccggaacggacaactcagacgaggctagggacttccacctgcacctgaagaaccggttctacctgcaaacgatgccac

SEQ ID NO: 48284 - DNA, 276 bp, Triticum aestivum
  Clone ID: PAT_TA_48284
aactatacgggctcccattcgtcgaacagcacgttggaagaaggggtggacatggtaaaacacatcaatggtattcttaacggacattttaaaaagcatcggcagaactatgtaaagacctgattgatccagactggacggatgcagaggcgttgcattgctctacataagaaggttgtgaagatattgcgtagtgctacatttggaactataacatcaattgagcaacggcagactggtaataacatcatgaacgcaagggctgggagatgcttt

SEQ ID NO: 48285 - DNA, 359 bp, Triticum aestivum
  Clone ID: PAT_TA_48285
gcaccaacaaagtggactttattctgaaccacaaggaccggaacaatggtcaatatgatgaaacaaaccttaagatcccaaccccggtcccataagaccaggtttctcaggtctataccggtgtgttggagccggataacagcgggccgaaatttggtgtgccgggtggtgaagagccaagccttatttctttccagtgtttattttgcgcctgcacctattacatcaaagactgttgctggacctgtcaacaagaatgcccaggtctggggcaagcgagcttaaatgcctgggccacctgcaaagaaattctgtgactgggatgcagctaccccaacagaaattttggatgagggggc

SEQ ID NO: 48286 - DNA, 308 bp, Triticum aestivum
  Clone ID: PAT_TA_48286
gcgaccacgcgtgcgaaccctgccgtcgagcgttggaacagggacagggacgtatgccgtccacatcttgaccgggcgctagcgctccatcgatgaccggcttgacgccgacctcggcctcgaccggggcggcgcggacggcgacggccgagctcggatcgcgctgtgcatgaggcatcgacaaactgatgataaatggaagcatgatctgtaccgcgatgatgaatcagcttgctgatcaggggatgcactggatttgggattgaagcttcaaagggaaagcttggaacaagggtatggtgggcaaa

SEQ ID NO: 48287 - DNA, 348 bp, Triticum aestivum
  Clone ID: PAT_TA_48287
gctccagctaaacattacatccggtggtgcacgcgatccgatctgagcatatgtccccagctatctgcatttcgatctccgcccatggccgccggccatatggatcgccggcagggccccgggctgcgcctggaagggcgagaggaaagccggggcctcgtcgtccgacggcgaaacgccgaccgaggccctgatgctgcggtgccggaaccccaacctggagccggacgtgtggctgctgcgggcggagctgaaggccacgcgcgtgtgcgcccacgcctcggaggaggccaatgagcggctgttcacccagctcgggcaggccaagggcgaggcccttaaccttgg

SEQ ID NO: 48288 - DNA, 275 bp, Triticum aestivum
  Clone ID: PAT_TA_48288
gcgatctgcggtgaatgtgcgatgagtcaatcaagagctactgcatgatattggcattgaccccttaatagtgctgaactcaactagctaacgccacgcctaatatgtggacaactaacataggagccggtggccgagtacaacgtctatttcatcactagaatatggtgaagacaatgactgatggaggactaaatcatagtgggaaatgtgggaaacttagaccgcgtgcgaagtccgaaatcgtgagtgatcgacctgtttgggaaaaataa

SEQ ID NO: 48289 - DNA, 241 bp, Triticum aestivum
  Clone ID: PAT_TA_48289
tgcacgcgtgcggagagagagcgagagactacattgctgaagtgtgtacactgaccttctactcatacaacaggggcgacgactgatacactgaaatacttcaccggacttcgtatatcatgaacggagcaaacatacttcaactatcatgtaccgtcatcactatctctgcctgaacgactgacctattttcgaataaccgaatccagagccactcccaaactgttcaaccgaaaactcc

SEQ ID NO: 48290 - DNA, 356 bp, Triticum aestivum
  Clone ID: PAT_TA_48290
acggaatatctgcgcgcgcacacacgttggtcggaaggagtgactgcacgcacagaacaccaagcccttaccgagctgagcacgatcagcgcgtgggttgcttatgcggtggtagactcttggacgatgacaagcgagtgcaagggccaccagccacaagacgacagatgggtggcgacgttcgcggcgacgacgttttacatggtcagcgacccggccacagacgccttggtgtgctggggcggcgcttgtaacactttcttcgtccttgatactgccagcttctcagacttggtagtttcgtcctacttcaagaaccgtaacttttgcagattggtgccgcagatcaacaccta

SEQ ID NO: 48291 - DNA, 206 bp, Triticum aestivum
  Clone ID: PAT_TA_48291
acgaatgtattcctatttcgcatgacaggtgtgtactcgaacgaattcatattagtatatacagatggacacgaaccatgacattacgtactactcgcatcagaacaaaccacgatatgaactccgtggcgcatcagcgaagctttaatggggaaccctggagcattctatcattcgatgacgctacaatcctacaccgtcctgtc

SEQ ID NO: 48292 - DNA, 360 bp, Triticum aestivum
  Clone ID: PAT_TA_48292
acgtgtggcgtgtcaaccatcatcttatattaccacctcgctggggtacggatgaggtcatctagcacccgtaggctcccttcgaaggatccatatcgctgctgctgttctgtgtgcgtaagcatacatctgcctgccgtaatggcggaacagaaagagaatattctgatggggaagtacgagatggggaagatgctcgggccatggacatttgccaaggtgtaccatgcccggaacatgaaaacctcacagagtgtcaccatcaacgtgactgacaaagaaaacgttatgaatggcggactcacggatcaaatcaagcgggcaatctctaggatgaagctggtgaagcaccccaacatt

SEQ ID NO: 48293 - DNA, 410 bp, Triticum aestivum
  Clone ID: PAT_TA_48293
acaaggtaactatatatctagcatctggctgaacacatgctacatacatatccgcaagctagctaaaccgctcgagaggatgacgttggtgacgctcttcgacacactggccctgcactcgtggaacccgttacggaccatttgtctggaccacggcgtccaggggctccgacgtatgtatgtccagagacaccacaggcttggcggacacctacatagagagccgctagacggcggcggcatacatgttgagggccaggctgccggcgggcatgaccaaggaggacgtcaaagtggcggcgaacgatgactgcaaggtgctggtcatagccaggcagccgagcctgtggagggcggccaagaaccatgcttgccaacacttcaagtcgcagaggacgacctttttgggc

SEQ ID NO: 48294 - DNA, 342 bp, Triticum aestivum
  Clone ID: PAT_TA_48294
acggccacgcgtgcgaccacgcgtccgaagataaaagggcggatcgggcaaagcccatttgaattagccgatgctgaagatcaacggagccctccacctatcagtgaccggtgatcaactgtgaaggaaaactttgtagtgtaagagaaattgactgcaaagaaaaatttttaagtgagagactgtggaaccattgacgagcatgcgatagtgaaactgtgcgtggaaaaacctggtctcactgtggcacacatgccgcaggatgactatactgtagagaacatatgtgtagaagggtggaaagaagctgttgcaaaagggcgtaccacggcgaattggaaa

SEQ ID NO: 48295 - DNA, 219 bp, Triticum aestivum
  Clone ID: PAT_TA_48295
acggcgccgactgacaagatccaacaggactacgactgcggggccagactgctgaacccgaaggttgacatgacggatacgactggcacctacatagccatgctcatcacctggctgagccgaatggacagtgtttctgttgtcaaggttgtgcagaatcctgaatgtgcaatacctgtgtctcatgcaggcttagagttggtgactacctgatcggca

SEQ ID NO: 48296 - DNA, 252 bp, Triticum aestivum
  Clone ID: PAT_TA_48296
atcataccaagccctatgcgctaatcggatgcgcatcataaccgtcgcaggaggaagagcgcatagctagcttgctgagcggaagagcttgacttgcttgcttgcttggaaggtggaggaggaggagatcatggcgaggggaacggttgagctgaagcgtatcaagaacaagatcaaccggtaagtcacgttttccaagcgccgcaactgtctgatcaagaagggctactaactatccgtgctatgcgacgc

SEQ ID NO: 48297 - DNA, 381 bp, Triticum aestivum
  Clone ID: PAT_TA_48297
gccacgcgtacggctacacgtgcatgcttgggctgagggcgtaatctctcaaaaggcatatattggtctctattgagatattgcacccaataaagattgtgtgctgcaaaatcaaagaaaacaagttgtgcagattgtggaaggtgcaataacccatgacaatggtaatggcatttaatcttatgatgcgcaacattcatcttagaatatacacaacactgctgccaatcagagtgttgcggctgaaaaacatgacaggattacaaattctcatgatcccataagtttcgatgtaatacaagccacatcttggaataattgtggccatccgatagtagctcctttgaaaaacatgaaacggcatattgtaagattccaaaa

SEQ ID NO: 48298 - DNA, 304 bp, Triticum aestivum
  Clone ID: PAT_TA_48298
tcggtgaggactatccaaaactgcagttggcggatgaatggacactcaccaacattgcgtgaggcacattagacaacaccaaagtggtggacgaatttggtgctgtgccgatgtttgtcaacctactgagctgtcctagtgaggatgtccgtgaacacggctgcaagggctctggcgaatgtgcgctggagactctgcaaagtgccgtgaccttgtgcttggaagtggcggtctgatctctttgttgctaacaaatgaaagatcatgcactgctctcgatgctcaggaatgccacatggacact

SEQ ID NO: 48299 - DNA, 243 bp, Triticum aestivum
  Clone ID: PAT_TA_48299
gtcgcacatctctcgcaatggccgcagctgcatagcggtcctcccctgcggcggtcatcacctgccgagcggcggtggcatgggggccggcgcaggcgctggagatggaagacgtggaggtcgccccgccagggccactggagatacgggcgaaggtcagttgcacctccatgtgccgcaccgacgtgacccacaggcagtccaccgcgcagcccgatctgtggcccaaaactttcgggcacg

SEQ ID NO: 48300 - DNA, 184 bp, Triticum aestivum
  Clone ID: PAT_TA_48300
acggactggagacaatatcatcgctgccgcggccacgaggggcaacaccaaaccagggcggcaaccgccatggatacaccaaccagggctgcttaccacaggcccgacgactaggcggccgccttgttccgcgcggcgccgtccctgcgttaccgggacgccgtcgccgacagcctggccgcct

SEQ ID NO: 48301 - DNA, 296 bp, Triticum aestivum
  Clone ID: PAT_TA_48301
gcgcttatgttggacctacacggacgctacggtcgacatagatgcaggatgctggacgtgcctgcggtatagatacgcgcaggtctgaacagcgccgacgggatgggacgcaccgctgctcacgtgggacaggcctgcgcgagccactggttcttgcacgtgaccgggtacggggtgcacctcgcgcttgcccgctccgcgctcgacggaacgagggacttcttccgtctgccggtaaccaccaaggagtccgttcggcgctccccggcgaacgtggaagggtacttctctggaaa

SEQ ID NO: 48302 - DNA, 358 bp, Triticum aestivum
  Clone ID: PAT_TA_48302
actctctctctctcatgcatccggcgaggccgcgaccgaccgtcaaaggtgagcgcacgaggagggccaggccccatgaacggtaccagaaccggaacgagcatgacccgcggaagctaccagtgctggagcaaacatgacgctcgtaaccaatcgctgctggtgaacacagcgtgatggtaccgaatggggtcatgccaatcctgcctgactgcgacgacctcctctatgtccataatacgatagtcccacttctccgccttcatttgcactatgatcgtggcgcttggtcccatacaaatggggttaacctgcgggttctcctcctctacatatgccggcattatccgtgacctta

SEQ ID NO: 48303 - DNA, 336 bp, Triticum aestivum
  Clone ID: PAT_TA_48303
gcgatatcattagctgagctgcataggtgaggcgggcaaataggggggggtacacaatcgaggtggcacacagattgcgaatgctggtcaaccagattttgcagtggcggtgcataaatgctctgacagatgcaacctttatggtgcatagcttgactgatgagaaaaccctacacatggcatggaaggaaagatcaaacttgcgtgacaatgtcaaatacaaaaggtgcaaactataacttcaaaaacaaaaactgaagctgattgctattcttatgggagagatgacttatctagaggagtggtctcatgtagagaaacaccattcaagttctt

SEQ ID NO: 48304 - DNA, 289 bp, Triticum aestivum
  Clone ID: PAT_TA_48304
accacgcgtccggccggagtcgtctgcttttatgaatgctcagtggcgctgactgctatgtgctaaccgacactaagtggtagggaaaaacatacggcacgcgggagatacaggagaggaaattgtaagagcagaccggacgagatggagttgaacctgaccattaagacggttccgacggctgtgtccaactactgacaagaaagaggcggtggctgcggcacgaactgcctcggtgatcgctgatggcctgctcacaaactcccgctctatgctattaaggccgtac

SEQ ID NO: 48305 - DNA, 390 bp, Triticum aestivum
  Clone ID: PAT_TA_48305
gcgtgtgcagtcatgcaccacgaatagccgctaagaatatgcaacatggcccgtacatgaaacactgatatgatgtaacatggaaaggacaagggaaatggaggtcatttgcttgacaaaagcaaaatgctgatcatctggggagcactgacgtatgcagcgctcgcagatactacataaatactattatgctgcactgttgcaggggacctaaagggggcggcagatatatgagaaatggtatcaatacggaaccaaagatatatttggaatactcttcatacgaacacatttatttatgtgggaggtgcgccagacgaaaaagatggtcactgtgctatctccacctaatgcccaagaggtacatgatgtcatagcggcatattggga

SEQ ID NO: 48306 - DNA, 344 bp, Triticum aestivum
  Clone ID: PAT_TA_48306
acgaaatctatcaatgctcttagcaacctcgctaatccggtaaattcgcctggcatggcagagcctgttccagtttcaagaagcgatgatgacatagatgctcgaagtggaagaccctaccctggggatgatgctacataggaggaggatgtatagatgctacgctggaaaatggactctgcaggtatcgatgctgctgtgatgggtcaacctaaccgggagccatgtgttgtcattcaaactgtaagcgaggatgacatcttggaggatgggtatggaacgcggatatatggacagactgctgatgcacgaaaccccgatgcacggagttgctacatatgcac

SEQ ID NO: 48307 - DNA, 306 bp, Triticum aestivum
  unsure (1)..(306): unsure at all n locations
  Clone ID: PAT_TA_48307
tcatctcgtgcgaacacgcttttactgcggctaggtatgttccgtgaacgcacatatcaccgtcacgcggcactgatcttgattgaacatgtccgtgtgacgcgcacttctatcaaacgccgcacggngttgccatgcgcggacctttacgatgagcggcgcgcgctcggctggtctcgccctcgataccgttagcgcgctccggcgctctgcgagtgcggagcgcgattctgttgacgccggaggccactgtgccgactacctgtgctgatccgaagcgctggatatcgcactccgtgtcggact

SEQ ID NO: 48308 - DNA, 305 bp, Triticum aestivum
  Clone ID: PAT_TA_48308
accatggacatgcacacgtggttccacggcactgacaacgtgcccggcggcatggtcccctgccggtccgaggtcggccagaggctccgttcctttcaagacgccatctcgcgcataatctccttgctgtccagcccgaaaatcgtgcaatagttcaacaccgacaagcaatacaacctgcacatgctgcaggagcgtcaccagatcggaccggaccagatcaaggccgtataccattacaccaagttccagtactagtgcaggatgtacttctacgcccccaatttcctgtgcgactaccgggc

SEQ ID NO: 48309 - DNA, 310 bp, Triticum aestivum
  Clone ID: PAT_TA_48309
tcgtccacgcgaccggccacacatgcgttgtgcttgttttggaagacatgttcaacaagactgttgatgctgcatagagtgctgcttcaatgaccgaagggtgcataatagaaggttttgtgcgggtcaaaatggttcatggtagtgttgtaatattaacttgatctggttcacactcgtttgatccatctcatataaatgattgctactacgtaacaacattattatttggcaaaaagcttttatctaagatggtcaatgaactgaaaagactatttgcctatgttggctgacaccatgatagattagc

SEQ ID NO: 48310 - DNA, 342 bp, Triticum aestivum
  Clone ID: PAT_TA_48310
acacacaataaataatgggtctctgtaccgggagagacacatgaaaacacgattcccgccagacgagcggccacatgaaacctatagtctacgaagaggtgaggctcgatcattaccatgggtaacaagatgtcgaacttccagaatgactgcacggaatatcggccaaagctgacgacgtggatccatggaaccgcggtgaatgtggaaggcggagattcatcgatcgtggatgactggactaacatgaatgtcatcctgcgcacgttctcctacacatattgctagcggctgacgcatttgctatcaaagacggactatgcgccagacgctacggtcatt

SEQ ID NO: 48311 - DNA, 382 bp, Triticum aestivum
  Clone ID: PAT_TA_48311
gacgcggtccatttcttacctggccgccggtcacgaatacaggcctccgagaccgatctgatggtaactccgaatggctactgcggctgctccaactgcaaggccgattgtgtactcatactgctgcacctcctgcttctaccgtgtgcgcataacgctgaacctcaaatgtatggattatgagtacaacgcggagaacctactcaagggcgatcagactgatcctgtgtccatgaagcttaatactatgaaattcgtgactgcctcggtcgaccgcgacgcagtaatgacagactcttacacaataccattgtattcggaggacatgtaccgtaagcgccctattttgccacaagaccctaaaaagaaggccctgtatatc

SEQ ID NO: 48312 - DNA, 280 bp, Triticum aestivum
  Clone ID: PAT_TA_48312
acgggcttggttatgttttattttaatgcgaacaaactttgctcaagttttgattccgatcttagacacgtaacggacagagcggggactggaacagtaacacggaactgtaggaacgtaacatataacgggagactgaacatattggaacctacgcgaccgatcaagatctaggatactggggaacaagcgtgcgataacattgttgtctacaggtaaaaacggatcgggttactatgattactggccagcgagggggcccaccattcacttcctccag

SEQ ID NO: 48313 - DNA, 231 bp, Triticum aestivum
  Clone ID: PAT_TA_48313
gcggcctcactcaccactgaccagcacaccgaccggggaaacggcagatatggactgcgacatcagacatggcatggccactgctacaactgcagctgctgctcattgacggtgccggcaccactgccgcggccgcgtgctcaaccacgacgaccgatggctcagcaccaagctcagaacagtttcacgcggagctgttaacgaacctgaccaacgtctcgatcgcatcta

SEQ ID NO: 48314 - DNA, 310 bp, Triticum aestivum
  Clone ID: PAT_TA_48314
acctggtatcgacccatcgcgtacgggaccgtgaggacatatacctgcgctctaccatcacgtgttgtcgctgcatgctaatgccatgtgggttcataggactcgaccatcttactaagagctgaggctggatgacgtggtgatccagatactactgatctatgattactgaccggcaggctctacttctacacgaatacttagcatcgctgacgagacgtaaagcactctcttacagattgcaaatggataccacattgagcactagacacaggggtgacctacatcacatggcgcttgacgaaagcgc

SEQ ID NO: 48315 - DNA, 250 bp, Triticum aestivum
  Clone ID: PAT_TA_48315
gcaaaccttagcggccatggatccgcccaagctgggggagctgcgctgcttcgcggacgcgtgcatagaaggacccggccatgatcgcagatccctccgtggcattcttccgggactacctgacgtcgctgggaagcaccgctcccaacgtgcggcgcctgcaccagatagaccgcgcccacggcgaggtacatggacgagatgaacgacgactacgacgaggaagaagaggacgacgaccggtacatgc

SEQ ID NO: 48316 - DNA, 203 bp, Triticum aestivum
  Clone ID: PAT_TA_48316
gcgtgcacctaccccacggactgggactacgcctggctcatggccgcatgcgacacagtaggggacatgctcctctgcgacatggtgcacatcatcggactggtcgccatgcaggaagctgtacatccttctgagttctgcgatgtcggtaccactacatcacacatgtctgtacagggactgagggctggcatgatgttcta

SEQ ID NO: 48317 - DNA, 203 bp, Triticum aestivum
  unsure (1)..(203): unsure at all n locations
  Clone ID: PAT_TA_48317
gcgccagcagcaagagccgattgggtcaacgaacggacccgggagctgcacacatggcatgcacgataatgggcgcctcatccggcaccgtcgtggccaagaccccattcctcagcgggcaatgccgngccgncagaaccacccaattacgatacataaccgctgggggcaacggcagaatcaccatgggcaacgacttgtgg

SEQ ID NO: 48318 - DNA, 342 bp, Triticum aestivum
  Clone ID: PAT_TA_48318
acgcgcctgcctgatctatgggagcaccaggaggaggagcttgcaggaacaatggcggcccacggtcttatctctgcatggcacctgcttgtgacgcctctgcagtcttccatctccaggtcgtattgctcccggaagttcgccttcaaaatgacggcatggtgcagcccccctgccaagcaaaatgactacacgcagttgacggtcccgtgcaagcagaccctgacctacctggacggcacgctgcccagcgactttggcttcgaccccttatggctgtccgacccggagggcaccggcgggttcatcaagcccaggcggctggcctacggcgagatcttc

SEQ ID NO: 48319 - DNA, 396 bp, Triticum aestivum
  Clone ID: PAT_TA_48319
gtgcgaccccatggatacgcgtctagcgctgctaataccgggaactatggatccgaggcttgcggcctacggacgcgaactgacccggcggcggctggaactgcacgcaaggagcaatggaggatgagcttgatctgatctgcaagagagggagaagatgatagggagagaaaaatggaaggagaggaggaataaagcgagaggaagagaacagggaggtgtggcgtcggccagcccaaggtcaccggccggtgctggcaaagtcgaacgcaaccttgccgctgggggcggctaaaaccgcatacacaggcaccactgcgtgctgcttgaaccggatgcgcccgacgggttccttttcccttgaggtgggccgttcctacgtgatctgcttccttc

SEQ ID NO: 48320 - DNA, 328 bp, Triticum aestivum
  Clone ID: PAT_TA_48320
gcgtaacatgcaccacacaagacatggaagagttgcttccatggcatgcgtgaataccttgcagagctgctgcatgtacaaaggggccaaggctgatgccagaacgggcaaagccaccggatcaaggagctccggctgccggtcgtccacgttcatggacgggagcggcctacggctcgggctcgaccagaacactgacgccatcatatctaccaagtggtccgagaacttctccattctcagctacaacaacctccgcacctaccttcagaccctgcagaagcagcagcaggagccaccttgccacgctgcctatcaacacccgggg

SEQ ID NO: 48321 - DNA, 200 bp, Triticum aestivum
  Clone ID: PAT_TA_48321
ggttgttccctctcctcgctccctccatggcacatgggtgctctctctattcttataggccggagacagatgcatgcgtgctagcccaaaagccggttcttgtaccgcgtggtggcaggagttttctaagcgcatgaccataacagggatctggttaatatgattactgctctgcaacatagaccggggcaacatgagta

SEQ ID NO: 48322 - DNA, 363 bp, Triticum aestivum
  Clone ID: PAT_TA_48322
gatggatccttctgtgtaccaagccaccgggctacatggcagcgtgattgcaagccggggcctactctgatgccccgcaagatcgggggccgggcctgttccgcgcgaccgttggcgcacgtatcacgtgcgttctgcgttgacacttgcgccaggatgacctgatgtgtgccgaccgacattaggtaggtggcttgcaagtgcgccgacgtcgcctagatggccgggttgctagtgcccacgtgtggcctactagtctgcggtgcgagcgcatacagagcacccaatacgctgacgttgaaggagatccatagcaagacctacatggaggtgtagggtaccggctccactaactagtgtccg

SEQ ID NO: 48323 - DNA, 221 bp, Triticum aestivum
  Clone ID: PAT_TA_48323
tcggtctacgcttacatgtccataatcgcactcgtcgtatgcatttctactgtcatcatcgctgaacgacctaaactacttaaccatggttaagccgacgcgatcgctaatggtggaatgactaaaaccatctctgctctcttctgggtaggaatgccttaccatatgtacaatcagctgactaccaatacctggaacggggtggcaccgctgactcacgc

SEQ ID NO: 48324 - DNA, 348 bp, Triticum aestivum
  Clone ID: PAT_TA_48324
gagatcgttatcatataacacaccagactggctctgatactctgtccttttcaacaagacactaacagtcatactctggaagtatcataaattcccgaaacgcgagtgcgagaaggcaccgactgtcatgggtaccgacccgagggcaagacgggagcccctcggaaagggttccagccgcaactgcaaagttaccctacacaggatgattacgcgcatgctctctaggactacccgcctacacttgggacctacgctcctgcaccagggtcatacactactgagcactgctcaagcgcctgcaacgataagtaggcgctccttgacaacatcatgtatgcaacttga

SEQ ID NO: 48325 - DNA, 169 bp, Triticum aestivum
  Clone ID: PAT_TA_48325
ccctcgcggccgcacaggtgccccacgactgggcgattgcttgcgttcagagtgacagatgctatggcactggcgacctggcacctcgggtacctctgccgcccctccgctgcggccgctcgcgagctgttgcgtgcatttcgtttcaacgtatcaagatctctaacga

SEQ ID NO: 48326 - DNA, 367 bp, Triticum aestivum
  Clone ID: PAT_TA_48326
ctctatcgcctagactgctcaccatgacgcaagaggctggagcagatagtcctatggatcgctgcaatttgagaaactgctgatcacaaggatctgactagtctctcagagcaatgaccaccacaagatcactacacactgggcgtaagagtctgtacacgtgcacaacatgggatggtcaaaatgagaactactgtctactgtctacataatatgcacgtaattacatatatactgactgctcatggaacacaatgctaccgacaaacgaagtgatctacagcacatgtattatgacgaaaccaggacaccaacggtcctgccattatcactcatgaaagacatcacaggtgatttgtctgacgat

SEQ ID NO: 48327 - DNA, 353 bp, Triticum aestivum
  Clone ID: PAT_TA_48327
gcggcggaatacacaggtgtgggattagcactgtgtatcatttgaagcacgggtgctcgcatcgccggctgctatagaaagcacatgtactactcgcaccaactgcatgaatgcaacagtgcaaacgccgtatcaactttctgtatgccacattgcgagcaacataaaattatgctcacagttacctaacacgggcactgtgtcatatgggaaggatgctcaagatttggaatgtcaccaatcggggctcggctagagttatcatctagaggggatcaacacacattcggcgcctgcatatatttaagcgtcatggtctgtatgcgcttgtaccgtactcaaataaaccattc

SEQ ID NO: 48328 - DNA, 330 bp, Triticum aestivum
  Clone ID: PAT_TA_48328
agcggtcatttgatggttgatcagcagcacaagcgggcatgcaacggtggttgcatggtcgaccaaccagcacccagatggctgttgccttatcatctaccgcgggaggcccggcttgtaccacgtccaacttcctggggaagaccctgaagaaacatgtgacctcaaccgggaactaccatgggaagagctacaaagccaacaggtgcacagtcctgacaactggaaacatcttcgcgacgaggtacacagacacgtggaaggagtttgccgacgatatgtcctactaccatcactacatcacctgagggcaggccatggtggactcca

SEQ ID NO: 48329 - DNA, 260 bp, Triticum aestivum
  Clone ID: PAT_TA_48329
tcggacaccacagatgctaactcatgcgtgacgatgtcaccgaaccgctgatcgtggatgtcgaacatttctaacaccctgcttggcctgaatcatcaatgtgtttacaagcacaaccctgtgacgaccatggagacgaatgccattgtgacgctgaacatatcttggacttggaacgagagtaggagctggaatactctagactatgctctatgtagtgcatgctgatactcttgatcatccttaaacggatgacaact

SEQ ID NO: 48330 - DNA, 369 bp, Triticum aestivum
  Clone ID: PAT_TA_48330
tggaaaggccaagcacgtgtgatcatagcagcccatggtgcggcgccaaccgtgtgctttacctgaggccgatttccggcgacactacgagctactcgaccggcgagctccccggcgactacgggagggacaccacaacgctctccgccgaccgatacaccttcgccaagaaccgggagctgcacgtgaaccactgtcggcgggacatgctcggcgcgctcggatgcatcttacccaagcttcttgcacgcaatggtgttaagaaatgtgaagccgtgtgggtcaaggccacctgccaaatcttcaccgagggcgggctcaaatacctggggaacctcaggcatgcgcatgcacagagcatgcttgcta

SEQ ID NO: 48331 - DNA, 215 bp, Triticum aestivum
  Clone ID: PAT_TA_48331
aaacacttctccacagggcatggaacatgcggacatgccccatcgacaaggtgggtcgactgacatatcgatcacatacggacggggtgcccatcaccgtgaggctcttcaactgcccctaggcacactcagcgctatctctccaagctcggctgctgatactgactccttcctcacttgacggtccgcctactagagactctcttctacccgga

SEQ ID NO: 48332 - DNA, 285 bp, Triticum aestivum
  Clone ID: PAT_TA_48332
accgggggcgtgggacgtctgaggtctcagatgggacgcggcggcggcgagggctagcctacacccggccagtccaagcggaacgaggaggaaaaagcctgcctgcttaaaagtgaatctgattgcacgcacattcctgcctcaatccgtcactttctgtagcaacattcctgtcttcattcctttcactttccgcctctgctttgcttattattgcttggacctgactacggttcgagcgatggaagtggaagggtacgaagagggccgaccgatcgaccgtta

SEQ ID NO: 48333 - DNA, 352 bp, Triticum aestivum
  Clone ID: PAT_TA_48333
taactcggacggcgataacagggacatatcactctggaccgtactcctgacacaatcaagagtcacacacaggtctagcggatccagagccgaagatgagcggggtgaagaaagtgactgacgttgcgggcaaagcctgctaggctatcgactgggacggactgagcaagatgctcttctccgacgaggcccggacggagttcaccaacttccgacgaacttttgaggacatcaaccaccaattgcataccaatttttcccaggagcgataggctattgagtgggaattctacacaaaggggatcgtgtcgaaagttgtagatatgtacatggaggctcttgatatcattga

SEQ ID NO: 48334 - DNA, 334 bp, Triticum aestivum
  Clone ID: PAT_TA_48334
gcgctaggaacacatctcggtagagggggagagcgagaaaaaaacgcatggggatgtccgcggacacaggcaaaaacgccgacgagcctgcgccagcacccatacggagcacgagaatcggctgggatgctatgtttaccgacgacgactgcccgaacggatcatgccaataccacgcctccatggttgatacctacacaacaagtaactggctccaaagaatatccatatcatgctgacaatgagctctgaaaaaataccagaactcgctcacaataagcactactctgtatgcactaccaagatcgattggatacataccaagtgaactact

SEQ ID NO: 48335 - DNA, 272 bp, Triticum aestivum
  Clone ID: PAT_TA_48335
aggacgcgtgggcgaggtacgatgcagccgccgcagcgcgaccccgcatgaaactctaccgccgtcgccgcagaagcaaccataggtataaacctgtttggcggaagtaggaacatgaggaccaaacgcgtcgcgcccaagtctaacgatgtctacctaagactactaagaaagctctaccggttgctgttgtggaggagctatagctagtcaaacgccatcatcctgaagatgctatgcatgagctagaccaaccgatcgacggtatggat

SEQ ID NO: 48336 - DNA, 371 bp, Triticum aestivum
  unsure (1)..(371): unsure at all n locations
  Clone ID: PAT_TA_48336
caacggtttcgggcgcatcgggcgcaacttcctgtggagctggcacggacgcggggacagctaggcgttggaggtgatcgccatcaacgacaccgcaagtgtgaagtaggcatcccacatgctgacgtacgactccacgctgagcatgttatacgcggacgtgaagcccgtgggcgacaacgccatgtccgtggacggtaaggcgatcaaggtggcgagcgaccgatacgacctccaacctgacgtgacgcgagatgggcatcgacgtggtgatcgacggcacatgcgtcttagttgaacgcgccggcgcactgaacatggtgtccacctccaccagctcgancaaaggcgtaacgctagtgctctccaac

SEQ ID NO: 48337 - DNA, 388 bp, Triticum aestivum
  Clone ID: PAT_TA_48337
acgcacaactctctccaccctcagcaatccatccacgcggaggcaaattttccgtccggtgctgagctccataatgacaaacgcttggtgaggagctgggatccatgatgactgcaagctgaggttagaggagctcaagtgcaaaacgatgcagcggttaatgacctacaagctggagaaccagaaggaggttattgtggaccaaactggagagcgcgaggccacgtatgaggacttgaccaagaccgtgcctgataacgactgccgattgacagtgcaagactcagactttaccatatcggatgatgtgccaaaaagcaagatgttatatatctgatggcctactgacaccgcaaaggtgaagagcaagatgacgtacgcgagcacc

SEQ ID NO: 48338 - DNA, 167 bp, Triticum aestivum
  Clone ID: PAT_TA_48338
ttacgggcgttctgcgacgccgccaccaacgagctgaatgccatccttgacgtttgtgacgagccgcttgtgtccgtgaactgcaggtgctcatacgtgtgctacaccatatacgcgtggttaagcatggtcatggcaaacaacatggtcacggtcatcagggtggt

SEQ ID NO: 48339 - DNA, 340 bp, Triticum aestivum
  Clone ID: PAT_TA_48339
tggatccttctgtgtaccaagccaccgacctacatggcagcatctttgcaagccggggctactctgatgccgggcaagatcggggggcgggcctgctccgcgcggacgttggcgcacgtagcacgggcgttctgcgttgacacttgcgccaggatcacctgatgcgtgcagaccgacatcagggaggtcgctagcaagtgcgcagacgtcgcctagatggccgggttgcgagtgcccacctgtgccctactaggctgccgctgcgagcgcgaacggggcgcgcaatacgctgacgttaaacgagatccaaagcaagacctacatggaggtgtagggtacc

SEQ ID NO: 48340 - DNA, 324 bp, Triticum aestivum
  Clone ID: PAT_TA_48340
accgccatccgagatggcgatcagggcctggtggaggatcgcgtcggcctgggccccggcacacctgtgcttgtggatggcgctaattgccaccaccctggtgctaccccaagggaagaagtcgaacctgtcagaggtgacgcacaaggactacttcgacattgagaactacggcaagccggtaggtctaaaagtcatgagacttttagagaacgctgtacataaaaccgaagagtacttcacagcactctgcacatgaaagacaggcatgggcaacagcagaaagcctttccactacaaagggagtacggtcgacacaattat

SEQ ID NO: 48341 - DNA, 295 bp, Triticum aestivum
  Clone ID: PAT_TA_48341
gcggtgaacacacacgataactacttctgtgtgtgaggtagacacgcccctagacgactacatgattatacgatgagatggcgttggaacactacttgtctttacaatggtagggcttagtattctctctatgtttttcgaagctgctgctacgtcttgtcttcatgttacttgtactaggaacaagggtaagtcctaacacacccggctgtaggtactaggtaacttggaacagatcggggctgtgcatcatcgggaactttgagagatggtcactctgacggacctgtgatat

SEQ ID NO: 48342 - DNA, 259 bp, Triticum aestivum
  Clone ID: PAT_TA_48342
cacacatttgtggctacattcgaagggaggggtcaatccatacgtgcattaaatcaaacctcgatgaaaatcccaataaaattcggagaagtattcgatgaggctataattagaccccgaatcgtatcccgatgcgtttgcggatacatttaacgcgatctccggctcgatctgatgctgcatctgatgcggaatcgggcgcgcagagattcttggtgcgattctggagtgtgatggggtcagatctggggtcaaaggg

SEQ ID NO: 48343 - DNA, 420 bp, Triticum aestivum
  Clone ID: PAT_TA_48343
cgcgagcggccgacctatgatacattatttgtttcattcatttggtactaaagatacaccataattaaatcaatttgctcgcacatcgcgagcggaattaatttacattggacgcagccagaaaaaggacatatagctcgctcgatcatgggtcaaataaacacacaaaggtcctgctgcttcacgtggatccaggacggacaaatgcacatgcatatttagctcgatggacggacagatgggttaacacattaagcttccgggggcaaaggtgggggcaaaggcccacacatggttgttaaccgcccctgtcacgtggccaaagaggttatctacaagcccattttgggtaacaatggccggcacgaagaatcgaaacatggaaaacatggctaagctgccgttcttgagctccttgac

SEQ ID NO: 48344 - DNA, 355 bp, Triticum aestivum
  Clone ID: PAT_TA_48344
accacacgagcgatctgttattgcgagaattcttaattcaagagtcatagggagggacttatgtcaccacaaacagaaactaatgtaggtgtgggatctacagctggtgttaaagatcataaattgacttactacaccccagagtatgaaactaacgatactgatgtgttggcagcattacgagtaagtcctcagcctgtggttacatccgtacaagcacgtgctgcactagctgccctatcttatactggtacatggacaactgcatggactgatggacttaccagtctcgatcgttacaaaggacacatgctatgacatcgagcctgttgctgaggatgacagccaatggatc

SEQ ID NO: 48345 - DNA, 336 bp, Triticum aestivum
  Clone ID: PAT_TA_48345
gttcccgcggcccatggtgggacgggaccgcgtggtgggcttcttcggtgagttcatgggctccgttagccccgacctccgtttggtgatcgacgacatctgcagcgaggatccatccggcggccgcgtcacctgacacactggagtggaatgggacgccggtcacgttcaccaggggctgcagcttctaccgctgatagcccgacccgcagactgcgcagcacattcagatcgagtatggccacgactgcgtggagccatcaaccaaaccacgtgaactgtcgctcgctgtcatcaggggagtcacctgcattgtggagcgcttcactagacttg

SEQ ID NO: 48346 - DNA, 420 bp, Triticum aestivum
  Clone ID: PAT_TA_48346
gcgctctggtattgctgccagagccggagcccacaccaatcgggacccctgtctcctactaccggtacacccatggggtcgtcggaggccgacgacgaccagctgctcaagagctcgctggccgaaggaaactaggccgatcgcaacaacaaagtcctgaggatactaggttgcttcaagataaacccttgtgagcatcttaagatgactatagaatcttctgaggatgaggtgaataagcaatataggaagttgtcactgctgcgacatcctgacaagtgcaagcatacacacgcacaagaagctttgagagacatgacaaaagcacaatagttgctacttgatccacaggaaagagggtacattcttgatcaagtgacttctggaaaagaagaactggtggctacaaggaaaaaagag

SEQ ID NO: 48347 - DNA, 330 bp, Triticum aestivum
  Clone ID: PAT_TA_48347
tcaacgcaatcgtcctgatagtacagctatggccctcactgtgatgggctcatgggcaacctccgtatttcctttagaggggcttaaatccacggtcggccttccaagaagtcgacggttcaacggaactagcctatgcagaggtagccacggtggaacgatcaggtgcatgcaaccgtgacctactgggggcatctaaaaatgtgagaccttgtaatacttggcgacggatcagaacggatgccattctaaaccaggtctactacctaatccggttgaagtgagcgcctagcctcacattcaataaggttgggtccatcttgcgcgagc

SEQ ID NO: 48348 - DNA, 314 bp, Triticum aestivum
  Clone ID: PAT_TA_48348
acattcgacttgaggagtatggcactaatctaacaaagttagccaacgacggaaagctcgatcctgtcgttgggagggaaccacagattgaacccgtcgttcatattttgggcaaacgaaccaagaacaatccctgcttaattggagaaccgcttgtcgcgtaaacagctattgcataccggcttgcttaacgcatgtgtagtggctatctgcctgtaacgatctatgggaagatggtcattaccctcgatatgggacttattgacgctggtacgaactaccgtggagaatttgacgaacggatgaagaaactg

SEQ ID NO: 48349 - DNA, 379 bp, Triticum aestivum
  Clone ID: PAT_TA_48349
gacgggctgccggagctcttcagcctggccgtcacgaaggcctacagggcgcgcttgcctgaccctaccattggggagcgcaacatgatccgctcttcgaacgggtggttcgtaaccgctgacgcccggtgcaagctgcacttccttaaccccgccacctgggagcaggtagcgctgccctccgtcgccaccataaagcaggtaagccccatccttgactgcaaaggcatcattgaaaggcacgatctttgtatgcatggggatgatccgcatatctatggggcggacgagcttcgcagagtcctttatctgaatgccgtgctgtgctgatatcacaacattgtaggatagcactgtcgtgctgattcacaatgcctat

SEQ ID NO: 48350 - DNA, 310 bp, Triticum aestivum
  Clone ID: PAT_TA_48350
cggactcatcttgctatgtagcaactaaggcgtacatgctctacgttacggggagggacgtgtgcatcagggttagaaggtaacgtggacgacctgcccttatgggctaacagttgctcggcatgtactacgattgcatcggcggcccttgggtgcaagtactatgactccaaggagtcaacgacggcgccgattttcgagccagagtagctcaagtgatggtacttttaccactccagtatatcagcgttgatgaacacgttaatgtttatgtacgtaaccattataaagacgatggggtcattcgggg

SEQ ID NO: 48351 - DNA, 284 bp, Triticum aestivum
  Clone ID: PAT_TA_48351
gcgaaaagacccagcaccatcggcgctggcggtcgggcgactgatatgtgctggccccccttcgtctgctgcgacagatcggggatggtcgcacggtctcgggcgctccgactgctgtcggtgctcaccttcatcgaccttggcatggtcctgggtgaccatgcttcacctagcatgcatccggctgcttgatgatcactcccatacggggcattttgataatgatcaagatgcagcatatcttggactcggatacgtgaagcctgaaactatcagctggaaac

SEQ ID NO: 48352 - DNA, 99 bp, Triticum aestivum
  Clone ID: PAT_TA_48352
acgtttggtgagctgagcgcgcgcctgtcgtcggatctatagaccgaggcaaccaaggcaatcgctccgacgaagatccttttcacccagctgaactat

SEQ ID NO: 48353 - DNA, 392 bp, Triticum aestivum
  Clone ID: PAT_TA_48353
acggccacgcgttcacgagatacggtgatggtgcgatgacggcatgtgacgtgctcctgtttcatcatgaagacatgggtatgccatggagcattgcgaaactgggtgtgcagcatggtatgtggggatgcgtaaaacggatcgagcctggcctgccgtcataccaaaccgagagggccgacagccagccaatatcgaaatgcgcaacgatggcacacgccaacacaacatctgtggggaacgagctaaccgcttcagaaaacaacaccggggccggttcgactagaaacaacgcctacgccgagaagccgaaacactgaacaggcaaccgacccatagtatttgtgataagcagcgacggaccgctggcttgcactttcgacaaggggcta

SEQ ID NO: 48354 - DNA, 352 bp, Triticum aestivum
  Clone ID: PAT_TA_48354
acggagctagtggcgaccactcatgtaaggagccatatccagcggaccaaatccaacgattgccgtgggcaccggcggctacacggggatcggcttcgaggtgtgccgacaactggccacccatggagtcgcggtcgttctgacggcccgctacgagccgtggggctcggacgcagtatataagctcagatcgctggggctgacacaagtaatattgcatcacttggatgtcacggacactcccagtattgctacactgaccgttttgctgacaacgcgctttggcaaactagacattatggtgaacaacgccatactcagcggggatgagtacctgcaataactccatgcc

SEQ ID NO: 48355 - DNA, 363 bp, Triticum aestivum
  Clone ID: PAT_TA_48355
tcgttgtacgcgacgtgcggctacgcaacggaactaatgatgggcgtgaacgcgctgttgcaaggtaagatcgatgcgacgaaatgctcgctgttcggatccgtgctttccaacctgcttttaagacttggcacctcgatcttctgtgacgacatcaaacaacctgggcgccgaccagccctactaccggaaacaagccgacgtgagcactggtctgttcaccttgggcgcgctgtgccagtctctgacgatgctgctgcgtaacgcactcagctgctgggagcatgctgtcgccactgacaccacatggctggagctttctaaggcctgctgttttatcatgctactaggctacgtcagcta

SEQ ID NO: 48356 - DNA, 377 bp, Triticum aestivum
  Clone ID: PAT_TA_48356
acggccacgcgtacggaagaacagataaagggtgatggtgtcgcacatgaagatgcaaatattgactgtggtattggcttattagcatgcacagatgagcgctcatgcttgcagctgtacgaatgcatatcgagaagtactcagcaggttatgcgagacgagtgggagaagttcttgcttgggaaagccgagctgtttggcttacatgaaaagaagtagaaacgatctcatcaaccacaagggttagggataccggatggggaatgtcctacagggtctaatgagtacgagattgcgcggccagtgagcattagcatgctagagactaatgccctacttgctgacgtctctggtgtgaatcatttaactaatgaagc

SEQ ID NO: 48357 - DNA, 322 bp, Triticum aestivum
  Clone ID: PAT_TA_48357
tcgcttcccatggggctgccccggttctgtctcctccgctgccatgggcaggtcccaatacctactcgtccggcgatttgcgacttgcctgtgactagcaagccttccgccccacttcacctgctggaggccgagtctgttccccgccatacatcggctcaccgacgcggcaacatgactcaccagcttgcatgatggaggctgccgaatgtcacccttggtcagatctttcgcctgaactactgacacttgttctcaaacacctgcctaccatagctgaccgtgtaagagtaagagcggactgccacccatggcgctctaa

SEQ ID NO: 48358 - DNA, 402 bp, Triticum aestivum
  Clone ID: PAT_TA_48358
aacatatatggctggcggatataacacgggctgcaacccataaggagtgccctatggcaacaggcaaaaagttatatctttagtgctataaacactgacatctttatgcagatgcacacggagaaacactaacattctagagcgaggaacacttgatctcttaattattggtttaaccgatttcaacgatgagcagattcataatgtaaaaaaatcaatcacattactagaaacaaatctagtcctgatgatgcctaaaggcgatcatgattattatgaacttctttctatagagcttgatgatataatataaacgagactgaataaaggtgcagcattagataaaaatggactgcgaatagcttgtgctttataatgttacaaccaaacagcgatgcgtta

SEQ ID NO: 48359 - DNA, 385 bp, Triticum aestivum
  Clone ID: PAT_TA_48359
agctcgcggaatactcgtgacgacccgcgcgtaccatctgggggcgtacgttgtcatgaaatgaatctggcactgaggaagcatggctgccagaaacgaatatgagactgttgaacctgcttggctgatgcggcaattgacatataacacgtggatggctgtggaataataagaccgctagcgggtggctggccgcgtcggcataaccgctctggtgggggcgtgcatgaacagaccggaccaatcattacttgcggtgaacgaaccatataaattggtgatgactctgaacgaacacgacatatcagctgtggatgcagatgaactacaccagaccaaagctgcagtgaccaggatatatccgacgcagcagtcgacgagatag

SEQ ID NO: 48360 - DNA, 423 bp, Triticum aestivum
  Clone ID: PAT_TA_48360
tcgtcgcccatggccttctgtgctgtgctcctgctactcattctgctagactatgcttgcggtggccgtcacacagctgtggaactatagcgagcaatgcgcctagaatggaggccatacaccatgagcaagaggtttagagagcaagggatacatggaccctcatacagatgattgaaaggatggaacgaggacgtctggagcatgaaggacgaaactgaccgtctggtgctggaggatagtaactacaagtacctactgtggatcgacaaacactaccttaaatggatgactctctacggagaaccattattatactgtcttgggcgacaggcccgaatctgcatatcagactatgaattggcaaggcaaatgatgtaaagcatgtgctgacatttcgtaaagaacaatgcacaccctaca

SEQ ID NO: 48361 - DNA, 262 bp, Triticum aestivum
  Clone ID: PAT_TA_48361
gtgttcagccctccacatgacatggctatgtctggagatccgtacagacaatgacccgatgatctcggtgcacgattaccgtaattacctctgcgatggggtggtgctgttcgcctgattgatccggtgctttagcggatcggtggaccaaaatgctgttttggagtctatcatctgcgtatcacgagatgtgactggcagcagaacattcggctacagatgttatacgtaggatcacgacgaagtgggagcttgacttgga

SEQ ID NO: 48362 - DNA, 331 bp, Triticum aestivum
  Clone ID: PAT_TA_48362
gcgaccacaacaacccgaagacgccgacgcgggagccatgggcgacagtcagtgctgcttgtgcctaaccaccttgagctcatcggggaagctggagcagatagaacatgcgctcacagaggtgggatcagggcaaacctcccttgggataaaaactggcaatggagtagatatcgccaccgataagaaactgccttctattttagtggacgaaacatctgtgcagaagactgaggcgtgaactccaaatattggagttgtgtacagagagatgggtacagattttagtgttcttgtcagaaaaagtcggaagcaagcacatgatgcatta

SEQ ID NO: 48363 - DNA, 406 bp, Triticum aestivum
  Clone ID: PAT_TA_48363
tgggatctagagaccgaaaactgcacccatatattgcgatggcgctcaggcttagcgccgtcggatccgtcgccgcaccgctgtgtcacctgcgactgtgccgactcgtcagctgtatggcacgagccactgtgtgcactacttcggcgcttgacagtatgcggagcacggagaacgtgtctggcgagtttttaggcgatcaccggcgcatggactgaacaagctgcacgtggatggctccggaggtgttcaagagggttgacgaccaatcaggagcggcggagtaaccgacttgcgatgtaatcatgaccaatgtactgaaagtgtcgatcttttgcactacatgctctatgcacactgacaagcctacagaggacattatgaaagtgcaaaacacgtttacttt

SEQ ID NO: 48364 - DNA, 354 bp, Triticum aestivum
  Clone ID: PAT_TA_48364
gggctgtctgtctcacacacgatggagtgcgccatggagctatccctgctaaaaccggcaatgcactacctcggcatcgcgggcaagacggcctcgcacgtttctgttttacgcgcgcgccggggcgccgtcctgttccgcgtgagggacgccgctggggcaacaagtgcacccggagggaagtcagggtggcgctagaagcggcgcacgactgcagtaaacgagtcgatgataacgccgagctgctacacgacggacttaaacaagatggaacagatgatgaacgccgagatttacaagcagatgaaccaggacgagttcgacacgctgatgtaagagttcacgacggactac

SEQ ID NO: 48365 - DNA, 345 bp, Triticum aestivum
  Clone ID: PAT_TA_48365
tccaaagctgcaatggcaggattgggcgaggtcatgctcgtccttgactgatgatatgatggatgcactacaaagtaggatatgaataggcttctgccttctttacatggtatgctggaaaatgcattacccaactcatctttgtgggatgacgaaattctaagtactgaacttacgacgcatggacattgaaccgggttctgaagtgacgccacagtactaactgaaccgaatgcatggacagagcttgcacgaagaaatgatggaatcattgacagaacggagcacgatgattgtgtgtgcatatgctcaaactcacattactgctcgtagagatgatggact

SEQ ID NO: 48366 - DNA, 355 bp, Triticum aestivum
  Clone ID: PAT_TA_48366
acgggattcctgatggagagaactcatttgccggaaacgatgcctaacccaaggaactggagtgccaacgagtcaaaacaacatcacttaatgatgattgagcaagtaagcatggaattcactctactatcatcatgtatgattcatttatgtcagatgatcatcaacaactagatatgacaaatgaatcatatgtgctgcctacatcttataatagtgacctcacgtgctgcagcactgcacttaaagaaggactgaactgataaggaacttactctcttggtgccatgacgtgattatatagcacaaatgcatcataaccagactgggatcttaacaccaaatgctactaaaa

SEQ ID NO: 48367 - DNA, 355 bp, Triticum aestivum
  Clone ID: PAT_TA_48367
gtagagaaaccacacacactcgccatttgagctattacagccggccgccttcattaacatatcgacacttgccccgacggacgacatagaagggcgccagttgcgtcaggaggaagaagacggtggggagcggcatgcatgcacagcgcgcggacccgatcgtggtgggccgcgtgatccgctacgtggtggacccgctcgcgcggacggtggcgctgcgtgtcagctacgcgtccacggacatggccaaccgctgcgagctgaggccgtccgccatcacatacccgccgtgcgtacaggtctgatggccgatcatgcacaccttatacacactgatgatgagggatccgaatgc

SEQ ID NO: 48368 - DNA, 382 bp, Triticum aestivum
  Clone ID: PAT_TA_48368
cgcggcaccatgggcttgtgatgcagccaatcggcacgtacgtagatccttgctggttcgggcattccgaactgcatttttgggcgactgactatgatcgagtgaaaggatttgaattcgaccgaatcatatccactcgaattgaggatatacgagagagcttgatgcctgcaaatgacagctatggtggcacatacagcatcggccgatggacaatgaccaggcacatattatagctggcaatgaaccttcaacctacaagagggagagctcaactccgacatgcgagctgggaacaggcaatatgaatctgcaggcgcccgcatggcacacgagattaagtgctgcacgcaacgagcagaacaccgtgccgaaatcaaat

SEQ ID NO: 48369 - DNA, 328 bp, Triticum aestivum
  Clone ID: PAT_TA_48369
acaccgcaatgctcttctttgtgaggcatggagaccatcacggagctagttgttggtggcactggttacctgggcagaaggattgtgaacgcgatgcttacctcaaggccaccagacctgcgtactgatgaggccctagatcggcctaaacatcaacaagctccagatgctgatgtcgttcaaggcgcacggagcgcggttccttgaggcgtcaatcgacgaccaccggggccttgtcgcctgcgcgaagcacactgacgtggccgcgtccgccatgtgcagggttcacttgcggaggacaacctgctgctgcaaatgaagctggtgg

SEQ ID NO: 48370 - DNA, 290 bp, Triticum aestivum
  Clone ID: PAT_TA_48370
acgactgtactaaccgaatttcttgtgccgagcgatgagggatccataaaaatctcactagacgagctcgcttcaccgggtaccactacgaccagcgccactcagtgcagcacgggggtgcacgcagaacgcccatgggtgacgcactgtgacacggtggcacatgcagtgcggctctcacgggcatgcgtggtcaccggcgtggatgatatagattgtcacatgggtgactcctgggtatcactgtgcgaatcatatggtggctctgttttgcatattgagcgattcac

SEQ ID NO: 48371 - DNA, 304 bp, Triticum aestivum
  Clone ID: PAT_TA_48371
gcggtggtgccgttatgttgatgaaaagcgaaagggtctaatggaatcaggtttaagacgaacgcttgggcctgatggcgcaataagtgcttcaaagtattgttgtatgggaagctatgatgcatacagctatgtatggacacagacatatatttagcataccacttctaggaacacattctgatgcttatgtcagatcatatatgagccttgatgagatcccatactggacgctaaggaacaaagatggatcaaaaatctgcacggaatttatgcgtttaatgaatgactggctgtgtaagat

SEQ ID NO: 48372 - DNA, 400 bp, Triticum aestivum
  Clone ID: PAT_TA_48372
actcgatatagtataagctgagcggctctcgcacgtacggtacccggaattgaatgtgccgggcctacgcgtacgtccacgcgtacgaacgtgatggtctcgcgggaggagtgggtgatacattaggacgagaacgtccgtgtgtgagggtatgaactttatgctggtgcttacgctgtaaggaaatggatcgatccgggcgaactagctgcttgtaacatgtggcgtcatcgtactcaatcgcgtgggtaaccatgtgactacagtgctgtctctgggggggtcaacatgttgacacgtgcttatatcgctgaggactcatattcgctaacgcgacatactgatccaggcttgcgtcaagctgacgagtaccatagccgccaggtggcacaaactgatg

SEQ ID NO: 48373 - DNA, 237 bp, Triticum aestivum
  Clone ID: PAT_TA_48373
tgcctcgcaaatgacagctatggagcacatacatcatcggccaatgaacaatcaccaggcacatattttagctgccaatgaaccatcaacctacaagcgggagagctcaactccgacatcccagctggcaacaggcaatatgaatctccaggcacccgcatagcacacgacattaagtactgccgcaacgagcagaacaccctgcccaaatcaaatcagaacccacctgaaagatgt

SEQ ID NO: 48374 - DNA, 342 bp, Triticum aestivum
  Clone ID: PAT_TA_48374
gcgcaccctctcacatccacaccagcggaatatcgggggcgtgcgcgtgggacaatcccgaccctgcccggggcgtgcgcttgccatgcttgcgcgccggcgtccgccacgggtggcgcagcgatggggggcttgttccgcagcggctatcttgcctcacgggtgtccgaccggctgctgctatatacgcgcatgggcgcaaccgttcatactgcaagacattcgtatgagaatgtggagactagttacactatatagcgacatagatggggcagactattcattgcgcatgttcaccgatgatcggcagtatcttgtggcctttagatgaaaccaccaaga

SEQ ID NO: 48375 - DNA, 321 bp, Triticum aestivum
  Clone ID: PAT_TA_48375
aactctgacggagcagaataggagccggcggcccgccgctgacttgcttatatttgacttcgtcggcgacgccgtcgcccggcagatctgatctggtgtgctacccgcttccacggaccacggccgcggcggtgtaattagcagcgaagaacatgggcgacaacctgatagaaaaggtgacggcgctgagcgagcaactgcagatcacctgaactgaaggcgctaagaaaatgacgggctgtatgagctgcatgacgcttacgacgagagagctgttgatggggcatactacaccctacaagatcgtcgatgacgccacct

SEQ ID NO: 48376 - DNA, 269 bp, Triticum aestivum
  Clone ID: PAT_TA_48376
atcttcgacaagttcttcttattgttgcgcggggaccttccagaagcttcttggaacacgaccgacatgccgtgccgtgggcgggtggacgagatactactgcggcgtgcatggtgaaggagaccgcctactacgaaaccttgggggtgagtattaacgcctgcccctgctgcatcaacaaagcctacttcgtgcaggccaggctggtgcacgcagacaagaatatctgcaaccgggatacggagcgctaattgcaggatctaggaaag

SEQ ID NO: 48377 - DNA, 247 bp, Triticum aestivum
  Clone ID: PAT_TA_48377
cggacgcttctcgctgcacgtgatccactgtctgtggacatgctcggcgcgctcggctgcattttcccgaagctgctcgcccgaaacggcgttaagatatgtgaggccaggtggttcaaggccacctcccaaatcttaagcgagggcatgctcaactacctctggaactccagcctggtgcatgcgcacagcatgcttgccatctgggcctgccacgtggcgctgatcggctccgcggagagctacc

SEQ ID NO: 48378 - DNA, 322 bp, Triticum aestivum
  Clone ID: PAT_TA_48378
acgttctttttttgttttgtgaataatggatatatatagcctttattgagagccccacttacataacatcatcatctacagaatcgctagcatgtttgacaataatatgcgatggtgcactaaaagctgggtctgatcacaatggacgcgtgtcagggaatggcgactttaccaacatgactgggatcgatgagtaatgcctattcaagcattgcagaggaagaagtgtttcacagaactgattagagctcaggaaatacagcgttaatgaactcttgaatgcataggcaatgggtgcttggaacttttgaagattcatgga

SEQ ID NO: 48379 - DNA, 427 bp, Triticum aestivum
  Clone ID: PAT_TA_48379
gcgggtggggcctgtcaccctccactcaaaaccagggggagggcggacaagactaccaaaggactccatggccaccatggacatcctctcggccaagttcttccgttcctgtctctacccgcacgacgcttttgttagctgtccatactttacggccggacgataccgtcagcccttttgaatttactggcggctaagaaattcctgggggtcgtactcctgcaccgtcaccacatccgatggggacacaaaccaagacctttgcgccctgctgttcgatgaatccaccaccggcacacgccggcgccggatccaggacgaagcggtcgaactgcggaacatctagcattctgaccggggagcggctggagaacatgtccaattcttacaagtgaatgacagtcctgaaggacgtatcctgggaagt

SEQ ID NO: 48380 - DNA, 441 bp, Triticum aestivum
  Clone ID: PAT_TA_48380
tcacctacgtacgctgccactatggcccaaccacttactgagctagctagcagccatggccgccctgtcatgtgtagcggcgtccggcccttccttcggcggcaagggtgccacccccatgcgcagaaggaggatggcggcgcgcgcctccctgggcaaaaaggcaggcagcgccgcggtcgccgtgacggccagcacgatgctgttgggcggaacggcgatggcgcaggacgtgctcctgggcaccaacggcggaaggctggtgtgaccaccaaacgaatgaacagtgaagtgcggcgagaccatgagctgcaagaacaacaccgggtgccggcacaacgtgacgttcgacgaggactccatgccgagcggcgtggacgtctacaagatatcttatgaggaatacttaaacgccccaggcgagaccttttcaactacgct

SEQ ID NO: 48381 - DNA, 358 bp, Triticum aestivum
  Clone ID: PAT_TA_48381
gcgagacgtgcaagtgaagctattcataaaccacggtagttgccagcacgaaactagccatgataccatatcctctttgggcctgtgcactctttaacgcactaacgccaagtaggtcgtaattacatgacacaggtgcaaattactagtacatcacttgaccatagtcctaccaactactactgcctaacaaatgcgacatcaagcaaccacacattgcatcatgactgagacagaatctcatatttaaatgctaaatgatatggagggcatctgctataaatatgctcacaccatacgaccaccgtaggcagagaaattgacaggaaatttgtaaaccagatgactgtgcactcaa

SEQ ID NO: 48382 - DNA, 276 bp, Triticum aestivum
  Clone ID: PAT_TA_48382
actagagatctgagcaagagagtcgagccctcggaatacataacgacaaaacggaagccaaagcgcacaacacaaacacacaaaacggatgccgatgccggacgagagagggacacacacagatccggatcgatgatcgatcgcgcacgcgcgcgggcgcggattgatctgggtcgtgcggtccgcgacggcggagagttggtagcggcgaggggtcgacgactgatgagaggtgctgcccggattcgggcctgaatagatcggggcgtgatgcgc

SEQ ID NO: 48383 - DNA, 306 bp, Triticum aestivum
  unsure (1)..(306): unsure at all n locations
  Clone ID: PAT_TA_48383
tggtgatcgaacatcatctacccgacgggtcgtctactgtcgacaccgttgctaggcgaccctggggccaagtccgattcctcctacacgcacgcncgatgttccggcagtgtccgaggatggacagtcacaggactacccggacccgggagaagagaccgtcaccggagacggaggacgtgacggaggaggggcttcagggtgtccgcggtggcgacggttcctaccacgctgtaggggagcgccgncaaacattactacaccgttcttggagtgatgccggacgcagcacgaaagcagatcatg

SEQ ID NO: 48384 - DNA, 419 bp, Triticum aestivum
  unsure (1)..(419): unsure at all n locations
  Clone ID: PAT_TA_48384
gtacctcatcggatttcccttctctacccacgcgttcctttatcttctacgccttcgttttcctcgtgcctcctcttcctcctacggaggtggtgggggctggggccgaggagggggcgagatccaataggtttggccgtttacgttaaactacacgccctctttttcacttctttaacacacactanaagacgataccctcatcccttttgaatttactgcccgctaacaaattcctgcccctcgtactcctccacctttaccacatcctatgggaacacaaaacaacaccttttccccctactctccgatgaatcaaccacccccacacccggcccttgatccagcacgaaccggtccaacatcagaacatctaacattctttcaagggtgcgactgtacaacatttccaattctta

SEQ ID NO: 48385 - DNA, 288 bp, Triticum aestivum
  Clone ID: PAT_TA_48385
acgtcctctccgcctgttcaatccatggagggtcaagtcctctcggccgggtcaggcatggagacgtcgatccgcgtaaccatggatgtgggcgcacacggaatgccgctcatcacaatatgaaacacgggattaaaggcactgaacccgatgatgatgcacgggctgacggagaagtactcggacgcagctgatctggacgacaaaaatgccatcgcgctcacctgaactgctgggaaattgtgtatgagattggatatgaatgacttatcaaaagttgatgagact

SEQ ID NO: 48386 - DNA, 356 bp, Triticum aestivum
  Clone ID: PAT_TA_48386
ggagcacccgctggttctggccatgggcactgggatcgaccgggtgggctcgagcctgctgagcgccgactgctgcggcggcatctacggcggcgccgagggcacctacctggcggcctcatgcagtagaggagggtaccgctccaggatcgagatccactacaagaggctaataactaaggacacctgctacagcatgtgactgaggaactacgcacagctgctgaaccatacgaaaggggaacggtggagggcggaggagtactactcctgctcgatcctgacgcaccgctacgacggcaagctgatgtcgaagtacaccacgctggcatggtatgtgcacggccacgaagagc

SEQ ID NO: 48387 - DNA, 318 bp, Triticum aestivum
  Clone ID: PAT_TA_48387
tgtgccaagccactgaccatacatgggagcgtgtttgcaagccgcggctactctgatgccgggcaagatcgggtggcgggcctgctccgcgcggacgttgtcgcacgtatcacgtgcgttctgcgttgacacttgcgccaggatcacctgatgtgtgcagaccgacatcagataggtggcttgcaagtgcgcagatgtcgcctagatggctgggtgtcgagtgcccacgtgtggcctaatagtctgacgcttcgagcgcgaacagagcaccaaatacgttgacgttaaacgagatccagagcaagacctacatggagg

SEQ ID NO: 48388 - DNA, 229 bp, Triticum aestivum
  Clone ID: PAT_TA_48388
taaatgactctggatcatacatttggcatctgcgcactgaatcttaatacagacactgcttctttcgagctatgagaaattattacagacagacacagaccaagcaagatatgtataacagaggagaatcggatgcagagagttatatataacagccgcacatcacctcaagtgcagaggaggaatcaaccatacatggcgtgatctccagctacgatctcaaggatct

SEQ ID NO: 48389 - DNA, 270 bp, Triticum aestivum
  Clone ID: PAT_TA_48389
cgtacgccaccccactccgtgcggggcaccgcaccggagccgccttacttccttccttctcacccctgttccactgccgtactcttatacgcccgacccgcgctacagagccgaaccataacacgcacgcgcgcaccacgggcctgcccgatctgcgagaagtcacgcacccgcgtgtcgccgggcctacgggatgccaaagccgccggcgccacacggtgcaggctcttctccaccacctcgtcctacacggaggtggatcacacctac

SEQ ID NO: 48390 - DNA, 414 bp, Triticum aestivum
  Clone ID: PAT_TA_48390
tcgggaaaacaacaagtacaacacctactgttggtgctggcactgacgagtaggagacctagtatcgaagccggattggaagatgacgcgagccgtgcaggaacaatgtcaacaattttgcccaacctgtgcgacacctatgtcaccacctggagctggaaggggcgaatgatgcatgtggtgtacgctatggaggctgcgaaacacgcgtcgaactgcgtgtcgctctgatgtgccacaaactccgttcttgacaccagcaacaggtccgccaactagctctcctcgcaccagtgcaaggtcttgcgcgtagcctaccacgccggggtctatctcgcttgcttcatcgccagcggatgaatcatatcttgatttatgtctagctagtgcatgaaccacggcttgatctacgac

SEQ ID NO: 48391 - DNA, 320 bp, Triticum aestivum
  Clone ID: PAT_TA_48391
acacccacgcgttcgtggcctattgctcatcttacgatgagacttataacgtgctactgcccttactcttcctgcagacaatacgcggaaatctctgaatgctacactattacccgtatttaaccacttccgatatggaactggacctagcaagcacgaaactcacaggcgggcgaagacctcacggggggatgccaagcatgcaagctggaagcacatggatagatcactgccatggagggagcccccaaatctctgcagagctgtttaacagggaggccattatgcacggatccgcaactcactatggcatgaattac

SEQ ID NO: 48392 - DNA, 120 bp, Triticum aestivum
  Clone ID: PAT_TA_48392
gaaaccctatacgtatcattattactaaccggtagataaccgaaaaaaatctgcagaattccccccaaaaatcgggacaaaattcttatggaccctatcctccggtcgattccgctgatg

SEQ ID NO: 48393 - DNA, 141 bp, Triticum aestivum
  Clone ID: PAT_TA_48393
ataggtaagctgcacgcgctgcacgtaccggttcgaatttcgaggcgcgcgtgcgcggacgcgtgttagtagatgcagatgcctgtgttgcattcgcagctcggaacggaagatgccagcgccatgtcggggctgtgcaac

SEQ ID NO: 48394 - DNA, 331 bp, Triticum aestivum
  Clone ID: PAT_TA_48394
acgaatgaatatacttggtcacttatatctatataaagctgcgctcgtgtttcccctaacaaaaaagtggcgctcgtgctcgatttccatgaacggacgatgctggtggcaccaatacttaccttctgacatgatcttctgcacattgatgggcatggagggaccaatgctgtgttggcctataacgcatgcatcgcttcctgctgcccttgtcatcaactcattgatcaaatgtgggcagatcggcactgcattctggggtgctgtgtctaaatacacgaacattactagactagtggctccaatctctcaagcatcttcaaagaacttt

SEQ ID NO: 48395 - DNA, 269 bp, Triticum aestivum
  Clone ID: PAT_TA_48395
gcgccaacgcgtacgcgcatgcgtacgccgacgcgtacgagcaagaacacgcctccctacatcgacccctaactcttcgaaggaaacgggagagatctgtcactgcttgttccatggacaacgcgatcgatcggcatcgcgtgctactcaggcatctgcttcgctgcgcatggagccagacagagctatccacgtcggcgtgctcggccggagacagcaccgcctaccagcggatctcctgcttacgggacaatgtagggatcggcgat

SEQ ID NO: 48396 - DNA, 308 bp, Triticum aestivum
  Clone ID: PAT_TA_48396
cccacgcgttcgatcttgaccttggctcgggcacccgttatttttcatcgcccgtctcgatccggagcgagcgagcagcgcgcgggtcggcactccccggcggagcggagaatgggcacgggaggcataggaggtgccgtcgcggctgcggacctgacgaacagcgactccacccgagggttggtacgggtcgtgaagcgcatcagaatgaacgacggcaccggtgttggcaccgggctgaatggccgactgggcatgggcatactcggaactgtcttgaagcaagtgaaggaacttaatgtccaagg

SEQ ID NO: 48397 - DNA, 354 bp, Triticum aestivum
  Clone ID: PAT_TA_48397
caccggagcggagcccgcgcgccctcgcctatcgtttcctagcgaggtccgtcccctgcggataaagaaaaacgaagcgcaacccctcacagccacgccttggtccgtctctccccctcccacgcccctgctcctcctccggccatactggctggccggaggcacgccgcgcggctgaccttgggtgcacgcttggacactccgctcggcgaatgaggttgaggagcatatagcggcaccacaatgctagaaaacggcatacaactgacgccggcatccacttccaacagcacgggcaagacaggaaacaatgggaaagagctcaacggatccgcctccacggaggaggagaag

SEQ ID NO: 48398 - DNA, 184 bp, Triticum aestivum
  Clone ID: PAT_TA_48398
ctggcattgctgtgcggccaccactgtcattctgccaccgacggaggagagagctagtgagatcagcatggtgcgtgtggtggtcgccgcggcggcgctggccgccgtgctggtgtctgtgctggcgccggcggcgacggcgcaaatggacagctgcagcggcgacctgccgttcgcgctcgtc

SEQ ID NO: 48399 - DNA, 408 bp, Triticum aestivum
  Clone ID: PAT_TA_48399
cttaagattccttttgaaaaatccaaaacccatcctgccgcattgaccacgtcgaagtatgggcaatccagctgggagtcattcaaggcagtgatgtcgagagaacaactattgatgaagcgcaactccttcatctacatcttcaaggtcagccagttgatcatccttgggctcatggccatgactgtattcctcagaacagagatgccccatggacagatttccgacggtgctaaattctttggagctctgacattcagtttaatcaccattttgtttaatgggtttgctgagctacaactaaccattaaaatccttcctacgttctacaaacaaagggatttcttgttcttccccccatggacctttggactggaaaacatcatcttaaaagttcctgtttcattt

SEQ ID NO: 48400 - DNA, 417 bp, Triticum aestivum
  Clone ID: PAT_TA_48400
cccacgcgtccgtgaaaagatcacagaaggatataatcctgcaacatggatgctggaagttagctcccctttagctgaggctcgcctgaacgtaaattttgctgaaatttatgctaattctgatctttataggaaaaaccaagaacttattaaggaattaagcattcccccacctggctatgaagatctctcatttcctacaaagtattctcagaatttctacaatcaatgtgttgcaaacttctggaagcaatacaaatcttactggaagaatccacctcacaacgccatgcgctttcttatgacgatgatctatggccttgtatttggcacagtgttttggcagaaggggacaaaaatagactcaccacaagatttgtacaatctacttggagccacttatgctggtgtcttctt

SEQ ID NO: 48401 - DNA, 218 bp, Triticum aestivum
  Clone ID: PAT_TA_48401
cccacgcgtccgagcacacataagcgcggccaccacagcgctcacccacgagcgcaggcggcagcaggcagggagggagcgaaggccaaggcactcacacacagcagtgcaatggccgccgaggcactcccgcgggccgccgcgccggcgcgccggccgtccgtggccgtcgcttccgcctcgcgccttcttcttgggcaccgtccctttcttgcgcc

SEQ ID NO: 48402 - DNA, 484 bp, Triticum aestivum
  Clone ID: PAT_TA_48402
cgacgtgtcggccgcggtagggaggcggccgttcaccgccttaagccaggaggaggccgacctcgccctggcgcgcgtcctccaggagcaggagcgggcgtacatgatgctgagcgcgcacggcggggacgacagcgagtacgatgcctcggacgctgggagctacgagtactacgacgaggaagaggaagggatcgaaggcgacgaggggagcgactacgaggaggaggggaatgaggatgaagaggtgggcgacgcggaggggcccgaattggaccccgcgcggtacgaggatgacgaggcgtatgcgcgggccctgcaggatgccgaggagcgcgaggtcgcccagcggctcatggcgctcgctgggatcactgatttaagggaagagatggagcatgatgttgaagatggcgaatatgaggaagatggggatagcgcacaggaagcatgggaagatgttgatccagaagaatactcgtat

SEQ ID NO: 48403 - DNA, 399 bp, Triticum aestivum
  Clone ID: PAT_TA_48403
caatgctgttagaacggtcattgaagcaatgtacacagcaccgatgtttgtcggtatcaacagctgtgcacccgttcaaccaattgcttcaatcggtagaacagctttctaccgagagagggctgctgggatgtactctgcactggcatatgccattgctgacgatgtcatggagataccctatgtctgcgtccaaacctagtattacaccctgatcgtatactccatgatgagcttccagtggacaggtgtcaagctcttgtgtgtcttcttccgacactactttatcttgctctacttcacctactacaggatgatgactgcatcaatctgaaccaaccatgatgctgcacgcaattgtcgcggaactatgtattacctatgcaacctttcatctgg

SEQ ID NO: 48404 - DNA, 473 bp, Triticum aestivum
  unsure (1)..(473): unsure at all n locations
  Clone ID: PAT_TA_48404
aagagcttgagagactcttggcatcacacccacacgccccctccaacgcagccagagagaaagagaatggcgagccaaggtgttgcctccatgttcgctctggcattgctcctcggagccttcgcctccatcccacaaagtgattccccttccttctctctctctctctctctctctctctntctctctctctctctctctctctctccaaatgattgggtacagttttttttcatgcaagtcgtgcagggagtttgtttagaagatggtaatacgtacgttaatcttagctttcattaagagaagaattagctagctagctaggtaaggtagctagccatggtgcacgcatggtcacataaatctctcccaccaacgtcacacagtatagcttcctcttttttgagatgcacaatacactggttaggtgcatgtcgctttcgttctgcgtattattcttcccgcgccatcag

SEQ ID NO: 48405 - DNA, 399 bp, Triticum aestivum
  Clone ID: PAT_TA_48405
aaagaaaagaaaaagaaatgcccctgcatttgaccaatttgtccgctctctatctccgattcatccgggctttttcctcggtgctgtcatctgatttgccggattagtctgcgcagacgtgaatccaactccttcaggctgtcgcaaggaggcggagtgccgcgctggtgattactagtaggcatcacatctccggcctcatttgccctgttcatcaccagcttcttggaagtctacattttggtcagaccctgtgaagaaaaaatcctctcacaactactaccatgggtgcctgcgtgtcttcaagcagaaggcggagaccgcagagattgcgctgcacatatcgccgcggaaaggttttgagaaacacgcctaccatacgtgccagtgatgtgggga

SEQ ID NO: 48406 - DNA, 454 bp, Triticum aestivum
  Clone ID: PAT_TA_48406
tctatcgatcggggtaggcagcagcagcgatcttgtccggtccgatcttgcttgcgcgaattccgacctctttattaatttctcctttgtgcctgcctctcaacctggtctctcgtcatcaatcaatcgagccatgcatcaatccatctctacttggtagtacaactagctcgctcgtggcgatcgatctccttggcaagcaacaacccaaaagttggtgagaattctattcctctgtaccagatagagagagaaacccagcacccagcatcagcaacaagcgcaggcaatggtagctagcttgtaacaaggacaagcttcctctctaacctctttttctctttgttctcttcgcaagccggtttgttccctcgcccgccctttttagccagccaccagccccgatctccctcgatcttctttccttttttaccctgtcactcattccctccca

SEQ ID NO: 48407 - DNA, 404 bp, Triticum aestivum
  Clone ID: PAT_TA_48407
gtgatagtcaaaagtgccaagcaaatctgtaggttttttcataatcacaacaacctacatgatagcatgaggaagaacgttggtggtgagctgattaaaccgaatgccacccggtttggaaccgtgtttatgctgcttgagagttatttggagaagaaagatcattttaggaaattgatggtgtacgacgactggaagaacagttttttgaagaatgatgcggaccatgtgtttgctgaagagttgctatccagtaacatgtgggggacagccttagaatgggttcttggtttgcttgagccaatctatgtagcccttatgatatgcctggtcaccaatagaattgctcttttttcttgtttgcaagaaagactaatggatgacttgcccattccataagattg

SEQ ID NO: 48408 - DNA, 474 bp, Triticum aestivum
  Clone ID: PAT_TA_48408
gacccacgcgtccgcccacgcgtccgaaacagtcaacagctgccctataacagagacagacacacaccgcggccacagctagcctcaccaatagcttcactatccatggctgcttcaccgacgctccgtcacgtggccatgctccccttcatggcatagggccacgccatgccgctcatccacctcgcgtgcctccttcttggccgccgccttgcctcggccgtcacctttttcaccaccccgcgcatcgcgcccttcatccgcgcgggccttgctggtgccggcggcggcgccgcggtcgtcgagcttacattccccttcgagcaggacgccccgcatagcacggacgagctcccatcgtcgaccagtcttgtcgatcttgtcaccgtgggggcggggctccagccggcgttcgcggacgcgcttgccaagatcgagcccaggccggtcctgcttgtccacgactgctttctt

SEQ ID NO: 48409 - DNA, 313 bp, Triticum aestivum
  Clone ID: PAT_TA_48409
cagtatttgtaagaaaatggcttccaagactttgcttcttttgggtctctttgcatttcttttcatcgtctcagaaatggctgccgcgggcacggtgaagtcagagagtgaggaaactgtgaaacctgaacaacatggtggtggattcggtgacaatggaggaggaagataccaaggaggaggcggccatggtggccacggagggggaggataccaaggaggaggaggacgataccaaggaggcggtgggcgacaaggaagaaggggaaggtactgccggcacaaaccctaacccccttttctaccattccgg

SEQ ID NO: 48410 - DNA, 452 bp, Triticum aestivum
  Clone ID: PAT_TA_48410
cgggggcacagcgtgtggggctgagatagtgagcaacatcagcagctgggcgtccaccatttctgcagcagccactgctgctcgcactggcgatggcgcggcgaatcagcagctgaacacaagggtgaacccacacctgaagcatgctgcaagctgttctgagagcagcggcagcagcagggccgtggtcgcgagggctgtgcccaggcctgtgaccgagaccgtgccggacctgcaggaggacccgattgacgagtggcgcaccaacggggtcatcaacgaagaccttgcgtatggagtgtatgatggccaccacgcctatgatcaaggccaagaaaagagggccttctgggaggacgtttctgaggaggtccaagaagcggaccactcaaaggggctccaagcgctcatctaatgggcattcccttcggcaatcatcctcggaatggatt

SEQ ID NO: 48411 - DNA, 313 bp, Triticum aestivum
  Clone ID: PAT_TA_48411
cccacgcgtccgcacccaccgtacacgctgcaggcacactccttctcgaagctcccatcccaaatggacgacctcctcggcctcggcttcccgggggccggcggctacggcgccacggccggatccggcgacgaggaggacgaggaggccatgaggagcctctacgccgcccccgcccccgcggaggaggaggaggtcgacgaggggtacgccgtcgcggcgatgaaggcgggggaggagaggggggtcgggaaggaggggctccggaagaggctggtcagggagggggagggtaaccagcttcccggcgcct

SEQ ID NO: 48412 - DNA, 470 bp, Triticum aestivum
  unsure (1)..(470): unsure at all n locations
  Clone ID: PAT_TA_48412
aaaccagtccaactcatgtctgatgatttggtagagctgtcgtaaccatggaactggcttcatttattgataagattatgttcattgatcccaagactatgctcatgggacaaggattaaggaaggtcgccatgggatgatttacaaggaattgccagtgttacgtgagaaggcccaaggctggaatcaacagtagcaagttattgtttcccgtgaagccttttgtttttattaattacattagatcatgacttctttctggatcaataattattggatggtaattatatctaccagtttagcttggaaacatctaaagtttcatagcagtgaaggggagagcaagcgactaaccaacactaatgcgtaaaatgtaaagagaaaagcatgatggggaaggattaactntcattcaagaggtggccattgagttgggcagatgaagttgtggaacaacttaaggtcagggc

SEQ ID NO: 48413 - DNA, 423 bp, Triticum aestivum
  Clone ID: PAT_TA_48413
ctctgagttaagtgagcataatgataaggctgatcatgtcaacagtccagctgctgatgaacatgatttgtcgacgaggatgcttaatagctaccaagcgcaacttagtgctcttcagaaagataagtctgatagacttcacaaagttctgaaatatgtaaatgaagtgcattctttgtgtggagtccttggaattgatttcgcaaagaccgtaaatggaattcatcccagtctacatcagaatggtgttgagcagtccagaaacatcagcaatggcacactggaaggccttgatagcacaatatcaaatcttaaagcagagagaaaatctagaatcgataagatgagagacacaatggagtcattatgtcaccttctggaagtaatggactcttccgaagtggagaagagacaattcaacaa

SEQ ID NO: 48414 - DNA, 329 bp, Triticum aestivum
  Clone ID: PAT_TA_48414
gcagccgcagcggcagccagatccgtccgccaggccgcctcgcgaggttccatccgccgatccccctcgaccctctcgccgccggccggtggctcgtctgatcggaacgtgcgtgcgctcgcgtcgcagaagcggttagggacggaggagagaagcgcggagtcgatctgagagggaggggcgaacccctttgcgctcctgtgggtttcgatctgttcatcgggtgtagatccggaagggcttggttcgatctgcaacttacgactgggcgccatggagactctggtcatctcacagcatcgcagccaccaccaccaccaccactctgg

SEQ ID NO: 48415 - DNA, 353 bp, Triticum aestivum
  Clone ID: PAT_TA_48415
ctccacagctcttctccttgtctccacaacacagcttggctctccgccggtttctgctaagtggagaggcccgtcagctcgatcggctccaggatcatggacgacggcgcaagaccggcgcccaaccacaagaggcacctcccactgcaggaggcgggcggcgagctcgtggagctgctgtggcaggacggggccatcgtagcgcaggcgcaggcccagacgccgcaccggcggtgcccccagagcggcgcggccagcggcgtcaccgcggaggatgcgtccgcgtggttgatcccggacggtggctgcggcggcagggacctgtactcgctccttttgcacggcgtcgccga

SEQ ID NO: 48416 - DNA, 237 bp, Triticum aestivum
  Clone ID: PAT_TA_48416
tccacgcgtccgaccacgcgtccgtccacgcgttcgtctaagcatctcagcggcgactacaaatgagggggccctttccgatggtcggcaccgtctccgtcacctgggcttggcccacctcgcgttgctccggacgcccgtgcggtatcttgcgctcgccccgaggagggcttttctggagggttggcgtggggcgatggcgagccgtgtgaaggaggacttgaagattcgagcgtg

SEQ ID NO: 48417 - DNA, 367 bp, Triticum aestivum
  Clone ID: PAT_TA_48417
tgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggtcgttgctcacttgaagggtggtgccaagaaggtggtcatctatgccctaagcaaagatgcctctatgtttgtggctgaggtctacgaggacaatgctcacatttattcgttaacattg

SEQ ID NO: 48418 - DNA, 479 bp, Triticum aestivum
  Clone ID: PAT_TA_48418
tctctcgcggtgttttgatgaagggcaaacccgagctgttactcaacatctatgtggatctcaggggtacttggctccagaattctatagagggcacatcgcattcgcgtcagatatatatagtcttggtgttataatcatggagatactgacaggagcaaagggatattttgaagaggagaacttttttacagccaaaacgctcctccaccaacagaacaaaccaggcaggtaaatggcacctaagctaccaaacagcagctagaaaggaacctatgctgcaagctggagacaaataaggagaaaccaggcaaggtagaaaaacagaggaagataacactcagactaaggttctgaagaataacaatcaacaattgtgttgtactaagcacaacaggtggagtttagttgtgcatggcaataaatcaatatgcagaatcaaagttcacccttcatcaatttataggtgaaaagtcttc

SEQ ID NO: 48419 - DNA, 486 bp, Triticum aestivum
  Clone ID: PAT_TA_48419
ggggaagaaggaggaggaggagtggtggaagaagagcgagttcagcgaggcggggagcagcagcaggaccagcagcagcggcagcagcaacagcagcgccagcaggaacaacgagattggaaatggaattggcggcaacaacccaaaagctccggccaggagtaggagcagaaagagaatcgggtgctatggtttcttcgtggcaaacaagagcaaaaatggggtcatcaaggaataaaactatgcaattgccaagaccacgcgatcagctcatatgaacaccggcatggcgatcctaacgacaatcactgcacagctgctcatgcatgcacaaaaatggagctcatggaagcaaagactcgacgtgcatgcctaaaaactggtggaagatcatgatgtgaccacttgccgtgcacaggtggatacatcttgcccatggagattgcagaggacagatgagatccaacaattgtagcaactgagtct

SEQ ID NO: 48420 - DNA, 406 bp, Triticum aestivum
  Clone ID: PAT_TA_48420
gtggcggcgcgcgggcctggaggctcagcgacgaggcggctaacggcgcaggtggaggaggggtggcgacctcgagatcggcagcgtgcgggaggtcaacgtcaagaccggtctgccggccacaactagcaccgagaggctcgagcagctggatgacgacgagcatatcctcagtgtcaagtttgttggaggcgatcaccggctcaggaactactcatccatcataacagtccacccacagagtattgatgggcggccagggacacttgtgatcgagtccttcgtggttgatgtgcccgacggcaacacaaaggatgagacttgctacttcgttgaggccgtgatcaagtgcaacctcacatctctcgctgaggtatcggagcggctagcagttcaatcacctaca

SEQ ID NO: 48421 - DNA, 477 bp, Triticum aestivum
  Clone ID: PAT_TA_48421
cggacgcgtgggctaaccggcggggtttcagggagaacccaccgggccgcccggtactcactggtttgctgtccgtgttcatgggagtcaagtcccggctgtttaaggcggacggtgcaagttcgttgtctgccattctatatggtgcacacgacggtcacatggtacaagcaattgacgttgtggcggcacgccaagatcgtgatgggggtccgcgccgaggaggccaggtgtgcggcccgcgttgcggagggtcctccttcgacctcggataaaatgaggaggcgaaagcctcgtgctcggagaaggcagttctgtcaattgaccccgcaaccctcgggttggaaatggcagacgccagttggtaggggcaacatcatcccccgcctcgcgacggatgatgcacgggagcaatgccgcctcaccatggaagcggagcacctcatggcggatgaacaactcatgactaagcaagcg

SEQ ID NO: 48422 - DNA, 469 bp, Triticum aestivum
  Clone ID: PAT_TA_48422
gctaccctgttcctgaggagattgtcaagcagagacaaatttttcgtgaggtatcatcacgcctctccgatctagaagccaccttggatgctggaacccagcacagaaacaaagcactcgagtcagtagggtcccaattatggagatggatactcatggtaaaaaaagagaaagctgtttatgatacactaaacatgctgaactttgatgtgacaaagaaatgccttgttggagaaggatggtgtccaatatttgctaaatctcagatcgaggatgttttgcagcgtgcaactcttcacagcaactcacaagttggaataatatttcatgagatggacactattgactcgccacctacatacttccgaactgataaatttacgaatgctttccaggagatcgttgatgcatatggtgttggtcgatatgaagaaattaatccagctgtatattctgttatcacgttccc

SEQ ID NO: 48423 - DNA, 438 bp, Triticum aestivum
  Clone ID: PAT_TA_48423
ttcaaagggagggatttccagttcctgccgtttggaaccgggcggaggatttgccccgggatgggcttcgggctggccactgttgaggtcatgctcgccaaccttgtctattgcttcgactgggagctccccgacgggatgcaggaggaggatgttgacatggctgacatgtttggggtgacgatgcgacggaaggagaaactcgttcttgtcccaaggataccacaggatgcaaacatatagtgcatgtgcatactactcccttcgtcccaaaataagtgcaagacacttattttgggacggagggagtatcagttagtaagaggcaatgaaaatttagaccaactcaaatatgagcattgcctagttatgcttccctcctacagaatgtttatttaggagaagataagacacatgttgcattggacttctcaaaag

SEQ ID NO: 48424 - DNA, 457 bp, Triticum aestivum
  Clone ID: PAT_TA_48424
aagcaaaagaccaccagaaagaacccggaggagctgaagctgcgcggagcgtcgtcgtcgtcggcgccgctgctgcagccgctgccggccaagggggacgggcagaggcggggcgcgcgggtggcgcgggagtggtgggacgagtcgaagcggctgtggcggatcgtggggccggccatcttccagcgggtggcgctgtacgggatcaacgtcgtctcgcaggccttcatcggccacatcggcgacctcgagctcgccgccttctccatcgcctccaccgtcatcgccgggttcaacttcggattcctgctgggcatggcgagcgcgctggagacgctgtgcgggcaggcgttcggggcgaggaagcaccacatgctgggcatctacctgcagcgctcctggatcgtgctcttcctcttcgcgctggcgctcacgcccaactacgttttcaccgagc

SEQ ID NO: 48425 - DNA, 476 bp, Triticum aestivum
  Clone ID: PAT_TA_48425
ctgtgctccactccactccgccccccatcccacccccgcccacgccgccgccatggtcgcgctcgcctccctctcttctctgtgcctctgcggctccgctcgccgccgttctgcctccgcacccacctccatatcatgctgtgtgctcgcaactccctccggcagagggtctcatgaatctagaataccccgtagaaggttccggagaaccgagggtgctactaagagcatggaagattcagtcaagcgaaagatggagcagttctacgaaggggtggatggtccgcccctccgggtcctcccaatcggcggccttggggaaatcgctacgacgagtttggtgtgcaaaagattattcccgacacaactttcatcaagaaatggagccacaaaattgaagcagttattattacacatggccatgaagatcacatcggttattcctgcactggattcgaccacacctatttttgcgt

SEQ ID NO: 48426 - DNA, 355 bp, Triticum aestivum
  Clone ID: PAT_TA_48426
gttttacttgatctcaacgtacatcaggcagcgttggtcgataaaggaactgaccgaatgcagaaatggcggggtggtctgcaggtaccgaagtgctgctcagagctaccaccgagaagggaagccaactgccgtagtcttgccagggtgagaaacggtcgtaggaccagatgcatgctgtcaagttccatttagtgcatgacaacaaggcaaagcatgggttaattagcagcgctgacgaccaaagggctgctctagcaagtctactagctaatacgatcaaagcgactgactagaatcaagttcagcaaggggaagctgacattgcgggagcacaactgattttgtgggtact

SEQ ID NO: 48427 - DNA, 478 bp, Triticum aestivum
  Clone ID: PAT_TA_48427
cgtcgttcagcacgtcggacaaggttcttcagctgtcggactaggtggaggcactcttcctgaagcacttcgcgctcctcgacctcgacctcgagctggcacaggggcgagatggcgcagatgacggcggttgtgctcctcgacctcgagctccgcccccgtccgcccacgctccttgacctcgagctctgcccccgcccgccccgggccgccggtacttcccctgccccccctctcgccgtgttgtttgatgtgatctgtgccataccgctgtatgaaccggctgttgcttatcccatcgctgttgcgttgccgtcgagttagcgtctcatgccacttctgcagctgtttgctgcctcacgattttgcaagagcagcccactttcctgcagtgagtgaaacaaagccatgtaccttaccaaagctaggcggttatgtttgtgtctagctttctcagtatatatacttgctaatattt

SEQ ID NO: 48428 - DNA, 441 bp, Triticum aestivum
  Clone ID: PAT_TA_48428
cccacgcgtccggcggttcaagggggacgaggagaagctgcgggagttcatcaagaggcacgtggcgcggctgctcaaggcggacaagctctccgtgctcggcgagctggagcgccaggaggaggtcgacctttctgtcaagatgttcaggatcatacaaaaggaggactggtataagccagatgtttacatgtacaaggacttgataattgctctagccaagtgtaagaagatggatgaaagcaatggatatctgggggaacatgaaagaggagaacctggttcccgacttacaaacctatgctgaagtcattagagggttcttgagatatgggtcttcatcagatgcaatgaacatttatgaggacatgaaaagatcacctgatccaccagaggaggtgcctttcagggtattattgaagggtcttttaccggattcac

SEQ ID NO: 48429 - DNA, 480 bp, Triticum aestivum
  Clone ID: PAT_TA_48429
ggactatgcaaactgcagtgggggtctttggtggtgggaactatactgatggagcaagtgcatcaccattaatggtagagggtgctggaaacagtggacgtcagccgatttcaagtttgaactgcccaccgtttctcgcagttgaggcttgcagggagcacctgggtgttcatccctgtgacaagaggagcagcataacaaaataccgtactctctttcctgccattgatttttctttgatcgaaaatgatgaagatgttctctgggaacccgatgtcagagaaacaaatgagtctgttgctctcaggggcatgaagttctttgactggttatggacaagagaagagaaagagattgctattgtcagccatagtggtttcttgtatcacaccctaaacatgtacggtaaagagtgtcatccaaccatagcagaggaactgggcaagcattttgccaactgtgagctccggtcgatggtct

SEQ ID NO: 48430 - DNA, 401 bp, Triticum aestivum
  Clone ID: PAT_TA_48430
cccacgcgtccgagcttgcgagggtgctccaggatgcagaccgatactcagttctcttcggccgcgatgaagaggaccagcgactggatccgttcacaagaattcccgagcgatattaccattcaagttggggggagcagcttcaacttgcacaagctcccactggcatctaaatgcggctacataaggaagctggtgtcgggggccaacgggtccagggtgacccacctcgagatcacgggcatgcccggcgacgccaaggcgttcgacctcgtcatcaagttctgctacggcgtcaacttcgagatcaccgccgacaacgtcgccatgctgcgctgcgccgccgagcacctggagatgaccgaggagtgcaagcccgggaacctcgtcggccggaccga

SEQ ID NO: 48431 - DNA, 471 bp, Triticum aestivum
  Clone ID: PAT_TA_48431
ggctcgctgtctccaccactcctctcccctcgccgtcgaccggccgaccgaccgagatggcgccggccgcgcgtctccgcctcctcgcctcatgccgcctcttctcggcgctttccgggacggtgccgcggtgccggcgaggtctccgaggtctgagcacgctctcctcgacgctggggtcgggcgccggcgaggacgagatcgagcgcatccgccgcgagttcgaggacgccaagcgcaactacctcagcatccccgccgccatcaaggacatgcccaagatggacccgcaaggcatttatgtgaacaagaacgtcaaactggacgacctgcaagtctatggcttcgactatgattacacgctgtcgcactactccgaccaccttcagtgcttgatctatgatctcgccaagaagcacttggtcaatgagctgaagtatccagagagttgcttgcagtatgactacgaca

SEQ ID NO: 48432 - DNA, 381 bp, Triticum aestivum
  Clone ID: PAT_TA_48432
cggacgcgtgggttgtcgacttagctcaatttggttgtgcagttaatccatgctgtggagcagagccatagtaagggagtttgccatgagattccacgaacatggtgctgagtcccaagtttcctcagatgcacctctgaaaccatctatggacatattctctctcgggtgcgttcttgctgaactttttctggagggtcagccactttttgagctttcacaactgcttgcttatcggcgtggccagtatgatccaacgcataccctagaaaagatacaagatgctggtatccaagatatggtacttcacatgattcaagtggaccccaaagaaaggctatcatgtaaaagctatctgcaaaaatatgcaactggtgtttt

SEQ ID NO: 48433 - DNA, 445 bp, Triticum aestivum
  Clone ID: PAT_TA_48433
gtgaaagagtaaaccaatgcttggagatgtttttgaggtgtgcagtccatgatactccaacaaagtggcatgcttggttgcctttggctgaattctggtataataccaattttcattcagctctggagtgctcccctttcaaggctctgtatggctatgaacctacatatggtgtgtttcccactttgcttcaatcagacaatatagatgtggaacagtggctcagggaccatcaaacacacactgcggtgttgaaagcacacttactcaaggctcaggctaagatgaagcactatgctgacaagaacaggacacctagggtcttctctgtgggtgaggcagtctacttgaaattacaaccttatgcacaacactctgtggtgaatagaccctgtgcaaaactggcctacaagtactatggaccatttgaaatattggagcaaat

SEQ ID NO: 48434 - DNA, 488 bp, Triticum aestivum
  Clone ID: PAT_TA_48434
ctaacacgtccggttcgatctgtccggactttcacgagcgtaggatctagcacgcgcttgaaacagtggcgccgatcgcgctacaccgacctgtgctggtgatgcctgcagaagggagccatagccaacagctcacaatgactgacagggagaggcggtccagcccgtgcgcgttgcattagctcatacgcaagtgagacgcaagatgcagccccactcagagggcgtggctcatgtgacaagctctggatgtacaacaaagaacaaggcatggacacttccatctgcttttgataacaaagggaactatgtaataagcttgagccaatcggtgcgatggatgcccgtaaaggctgaaaaattaggtgttgaagtgtatccaggagttgctggcagtgagatcctttatgatgaaaatcaaatagtcgcaggcgttgcaaccaatgattgttggttttgctaaagatgggaggaaaacgggaaacttt

SEQ ID NO: 48435 - DNA, 426 bp, Triticum aestivum
  Clone ID: PAT_TA_48435
cccacgcgtccgcccacgcgtccggagccatcggcacccagctcaacttcaggatccaagctccaccgaccaccgccacctttcggctgccactgcccgccgcactgcgcgtggggaggcggttgccgccgcggcgtgcggccgtgctagctcgtgccgatggtgaggggggcgaggtcgaggaggccgccggcgggggaggaggacgcggagaaggagtacgaggtggacgtggagcccgaccggtggaagtcgtcgtcgcggaacagccggctggagctcatgggccgtctccccccgctccgccgcctcagccgcatcccgggagccgacgccgacgccgagggcgggttcctccgcggcctcgtcatccaccccgacaacaagttgtaccgggcatggactaggttcaataggggttgggca

SEQ ID NO: 48436 - DNA, 405 bp, Triticum aestivum
  Clone ID: PAT_TA_48436
aggcggcgagcctgcataatttggtgtttccttacgacgatttggataagatgatacgcaaggacagggaaccgcccacgaaggctgtgttctgggcattatttggagctatatatctgtgctttggaatgcctgaagtctatcgtgttctctttgaggcgttcgggatggaccctgaagaagagagctgtcagccaaaactgcggcgtcaactagaagacgttgattatgtttcagtggagtttgaaaagagacaactcgcatggcaagatgttgctgcctaccggccaccagcggatgctctttttgctcatcctaggcttttccgggcatgtgtgccaccaggcatgcatcgtttcaaagggaacatttgggattttgataatagacccaaagtcatgaaca

SEQ ID NO: 48437 - DNA, 341 bp, Triticum aestivum
  Clone ID: PAT_TA_48437
acgacctctacctcgtcttcctcgtcgcctactgccgcttgctccacctcctctacgtcgacgacctgctcgccgccgtccgtagggagtgttgccagatttacatccccggccgcgcctcctatgacgacctcttcaccgagaccttccggcagctgcaccttgaggccgacgggcgcgcctaggccatgcacaagtacaagcagcatccctataatcccttctccggcgccagcgccggccgtggtcctgccggcaagaagctcgggcccaacgctcgcgcttcgagcggtgctgctggtaagaagaattctggctctgggaaggatgactcctatggc

SEQ ID NO: 48438 - DNA, 467 bp, Triticum aestivum
  unsure (1)..(467): unsure at all n locations
  Clone ID: PAT_TA_48438
cagcaccatacgtgacccagcgccgtttgcacggccatggattcaccgcttctggtggccgcgctgtcgtcgctgctcctcctcctagccctgtacctgctcggcggcaagaggcggcgccggagctacccgcccgtggccggtgccatgctccagcagctgcttcactggggccggctgccggagtacatgacggagctctcccgcaggtacggcaccttccgcatgctcaccctgacctgcaactgggtctacaccgtcgacccggccaacgtggagcacatcctccggaccaacttcgccaactacggcaaggggccgatgacccacggcgtgctgggggacctcctcggcgacgggatattcaacgtcgacggcgccaagtggcggcaccagcggaaggtcgccagctntgagttcaccacccgggcgctccgcgagtacagcagtggcgtgttccgcgacat

SEQ ID NO: 48439 - DNA, 396 bp, Triticum aestivum
  Clone ID: PAT_TA_48439
gtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatctagcctgttgctggggaagacagccaatgtatctgttatgtagcttatccattaaacctatttggagagggttccggttctaacatgtttacttcca

SEQ ID NO: 48440 - DNA, 216 bp, Triticum aestivum
  unsure (1)..(216): unsure at all n locations
  Clone ID: PAT_TA_48440
ccgatcgccaccgccgccgccgcgcgcgacctgctcgacggaattccccgcggcggtgcatgtcactggcgtgcgggctgccgctgctggagtgcgtctactgcctggggtgcgcgcggtgggcgtggaagcggttcgttcactcggtccaccacgacagcgccacctggggccacgccggcgtcggcgacttngagcccgtcccccggatgtgcc

SEQ ID NO: 48441 - DNA, 264 bp, Triticum aestivum
  unsure (1)..(264): unsure at all n locations
  Clone ID: PAT_TA_48441
actagttctagatggcgttcggcgggggcgggttcgcggtgagctacccggccgccgcggagctcgccaaggccatcgacggctgcctggaccgctactcgcagttctacggcagcgatcagcgcgtgcaggcctgcctcagcgagctcggcgttccgctcacccgcgagcccggcttacaccaggtggacatcacaagcgacgcgtacggcatgcttncagcccaccacatggtgcacataatatcgctcaaccacctggacc

SEQ ID NO: 48442 - DNA, 428 bp, Triticum aestivum
  Clone ID: PAT_TA_48442
cttctcgtccactccaaaccctagcctcctcctcctctcgccgccgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtaatcccatctattcttatgctaacctttacgagcaagccgtggtcgctgatgtatactaggtgttatgtttgtttctaataagcatcgtctcgtactggtagatgtatgttcgtctggaacagtatatagtcaagtttcacgatttggtatcacctagaggtttttagaatgctttgtaagcatggccctt

SEQ ID NO: 48443 - DNA, 129 bp, Triticum aestivum
  Clone ID: PAT_TA_48443
cccactcgtcagtcctgatcttatcccagtggttgactcaccgcaaaaggcagcaagggggatatggagagcagcaagggcaaccgcgtcctcaagcgggataaggagactgcttagccatcctcttac

SEQ ID NO: 48444 - DNA, 171 bp, Triticum aestivum
  unsure (1)..(171): unsure at all n locations
  Clone ID: PAT_TA_48444
gtccgcccatgcatctctcgccgccacccgcatccccaccagcgcgcgtctgcacagcagggccggctccagtcagagggtcgacttcgcctacttnatacaactgaggccgttatcctgctcctacagcacctcctgccagggaggccttcttctcctatgtcctcggct

SEQ ID NO: 48445 - DNA, 226 bp, Triticum aestivum
  Clone ID: PAT_TA_48445
ggagcgccacgcgcacagctcgtcttctgaagcaaacaacagacacaagcggggacgaatccgtcccgcggcggttcgtcgatcgatccgatggggcggcggtccagcgcgtcgccggtggggtcgggggagccgctgctgccggaggtgcggaagtgcgtcagcggcggcgcgacgatgcatcggtcgcctgtcgcggtcggacgattagctgtattggtctcgg

SEQ ID NO: 48446 - DNA, 179 bp, Triticum aestivum
  unsure (1)..(179): unsure at all n locations
  Clone ID: PAT_TA_48446
acgattggcacaaggagagagaaagtaacagagagaggtagagagagtagagggggggagagggtgggagaggagaccctgaccaatcccatccacaagttagagatcattgagaagggcatgcnaaaatccccaccgggcgagaggagaggagacgagaccagctccggccttcatca

SEQ ID NO: 48447 - DNA, 467 bp, Triticum aestivum
  Clone ID: PAT_TA_48447
ctatccgacccggttttcttcaattcatcttcaccactatctctagagcttcactctcgagacactttcgtcgcgtcacagcacaaagactacaaaagcttaacactcagtcgactcgagcgcgactcatcccgagtcgccggaatcgtcgcgaagatccgtttcgccgtcgaaggagtcgatagatccgatctcaaacccgtttacaacgaagatacacgataccaaaccgaggatctaacgacacctgtcgtctccggagcctctcaaggaagcggcgagtatttctcaagaatcggtgtcggaactccggcgaaagagatgtacttggttctcgacaccggaagcgacgtaaattggatccagtgtgaaccttgcgccgactgttaccaacagtccgacccggtttttaacccgacttcgtcttccacatacaaatctctcacttgctctgctccacagtgctc

SEQ ID NO: 48448 - DNA, 407 bp, Triticum aestivum
  Clone ID: PAT_TA_48448
ccctctctctccccctcctcctcccgggtcgctcgcgcgggcggctccggaggccaaaaccctagccccgcgagccctttcccacgagcttccctggccgccgccgccgccgacgccggcagtggtggcggcgcccggccgcctaaggcggcgggcggggtcagcgcgccccgacgggctcccttcgcgcggaggtgaggcgtcaagcgggcggcgcaggggttccttccggtgtggtggcgtatggcgggggtagttgcagcggagtggcggagctcggcaagaagttgcagttgaggctcatggtgctcgggcttgggatcctggaggcgcccgcgtggacctgatggcggcggcgcggctggagcaagatggtcgcggcgctgcggcttaaccaggatgggctg

SEQ ID NO: 48449 - DNA, 415 bp, Triticum aestivum
  Clone ID: PAT_TA_48449
caaacatacagatacatctaccccggccctccaagcccacgatcccgtggttctcccgcagtcccgcatcgttggagctccaccccgctcccgcctagctcagctcagctccggtcaggtgaggtggaaggatgccgtcggtttcgagggccgtgtgcttgcagaggccgaccacgagcggcggcgggaggagcagggaggcggcccgatcggtggcgtcgccgagagcccgtcacgcgaaatcgaagacgatgatccacccggcgcggggccggcattgctcgcctcccaacgcagtcgcggcgcctatgcccgccacaaagaagagggtgttccacttcggcaagggcaagagcgagggcaacaaggccatggaagacctgctgggctggaagggcgccaacttggccgagat

SEQ ID NO: 48450 - DNA, 406 bp, Triticum aestivum
  Clone ID: PAT_TA_48450
aggaaatattacgacatgaacatggtgtgatgacccgtgtgcaacctcaacaagtgtgaaggtgctgctaagttagaggattgattagaaagtaatttgttttcactgtgtgcaatggaaaatgtttactcattaaaatagataagaaattaattttagtttgggtggattgattagttataaaatgttgatggtcctttgcttggatctctaggttgagtcgttgcttttctacttcaaactgatggatttatcttcagccaaaaaaaagcaggcttggttagcttcaagaagaaaatatttcaaaaccgtgtacctattgaaatggcatggaagacagagatggtagcagcctgcatcctcaaattggagttgcctcttggggagtatcaggttgctgaaatga

SEQ ID NO: 48451 - DNA, 451 bp, Triticum aestivum
  Clone ID: PAT_TA_48451
cgtcccatggcactcctcgcgctccgcctcggccacagcagcctcctccccgccccgccgctccgccgccagcgccagcgcctcgtcgtctcctgcagcgccgtgagcggcgggggcgcggcggtggtgtggttcaagcatgacctccgcctcgacgaccacccgggcctcgtcgccgcctgcgccgagccccgccgccccgtcgtgccgctctacgtcttcgacagccgcatcctcgccggttactcagacacgaggctgcaacttctactttttgctttgaaagaccttaagttggcgttgaagtctcaacggtctgatctgctcataggcttgggaaatgctgaagatgctgttctgaaactcgcaaacgaggtacaagcgggtgtcatttatacagaagaggaagttgaacacagtgtgcgcagtgttttagccaatgttgaatctt

SEQ ID NO: 48452 - DNA, 304 bp, Triticum aestivum
  Clone ID: PAT_TA_48452
gcgatcgcggcgtcggcgcagggcccggcggtggcgcccgcggcgccgacgacgcccacgaccccggcggcgcccgctcctgccgccggcacgacgaacatcacgggggtgctggccaaggccgggcagttcaacaccttcatccggctgctcaagtcgacgggcgtggcggtgcatatcgacaaccagctcaacaacagcttcggcagcggcatgacggtgttcgcgcccaccgacaacgcctttacctcgctgtgctccggcacgctcaactagctgtccgacagccagaagaacgcgctca

SEQ ID NO: 48453 - DNA, 432 bp, Triticum aestivum
  Clone ID: PAT_TA_48453
ctactactacccgcccgtgcagcagccgcagccgccgccgcagacgctccgccgccgtccgcgccccgccgcccgctgggtcaagcagtggatcccgcaggatctcgcctcccccggctccaagtgcgccctcttcaagtgggtcagagaggacgtgtacaagaatctgaaggagaacggcggcgtggggcaggagccggaggcgcagccgcgcaaggttgagccggccacggagatcctctttctctgcagctacgacaactgcggcaagacctttgtcgacgtggctgtcttgaggaagcatgctcacgtgcacggtgagaggcagtacgtttgccaggagcccggcttggggaagaaatttggagatagctcaaagttgaagaggcaccaccttactcacacaggacaaaagggttttggttgtccaca

SEQ ID NO: 48454 - DNA, 338 bp, Triticum aestivum
  unsure (1)..(338): unsure at all n locations
  Clone ID: PAT_TA_48454
gccgctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacatttgagccaatccctctgcttggggtggtggtgattattcaggtgttgatgaccaggccgngaaggtggttgacattgttgacacctttcgtcttcaggagcaacctgcttttgacaaggagcagtt

SEQ ID NO: 48455 - DNA, 384 bp, Triticum aestivum
  Clone ID: PAT_TA_48455
cacagagagtgagaggggcagaggaaacaatcaacccaactccaccaccggtcagaggagagaggagcatcctccgccgcgctgtcgatacgttagcccgtcctcatacgctggatccaccgacaggatcggtcgcgttcttcggcagaagtaacacgctattatcccgagagtggcacagatttgaacaccagtcgcctcttgtattctcgcattactagcaaggatatcgagcgcgcaactctatgcatgcccgcactgcatgcgacatgctagctgcttgagctagttcttctccgcagactgccgatttacggagactgacttgtcatctatttacaaaattgcacatgaaggacacaccttgtttagctactaccctgc

SEQ ID NO: 48456 - DNA, 434 bp, Triticum aestivum
  Clone ID: PAT_TA_48456
gcatttgaaaggtgataggaaagactttgatttcgtgaaaaccagccttgctgctaagggcttcaatgtcgtctatgatattaatgggcgcgaggccactgaagtatcccccatactagaagcgttgccgaatctggaacagtttatctattgctcatcggcaggagtctaccttaaatcagacctgctcccacactttgagaccgacgccgtggacccgaaaagccggcacaagggaaagctggagacggagagcctgctggagacgagcggcgtgaactggacgtccatcaggccggtctacatctacggccctctcaactacaaccccgtggaggagtggttcttccaccggctcaaggctggtcgcccgatccccatccctaacgccgggaaccagatcacccagctcggccacgtcaaggatttggcga

SEQ ID NO: 48457 - DNA, 170 bp, Triticum aestivum
  Clone ID: PAT_TA_48457
cagcgttgatgatgatgacagtgatgaggatgacagccaagatgactctgttgatgatggaccatggattccaatgaaggatgattctaatgtagtgaggccggggatgattcctttgatgttagggaggatagctctgattaggaggaagaagaaccaccaaagaagca

SEQ ID NO: 48458 - DNA, 374 bp, Triticum aestivum
  Clone ID: PAT_TA_48458
attgctgcaacaagaggactctgtaaccctattattttgtgatataggatattaatgatgagccaccaaaccctgatcagccaatctcgaaacccagtatggcacccaagcccaagccgtgggagaagcaaggccaacaaagttccggcctggacctgaaagctcacacaagcaaccccagcgaatcgtcgtcaggagttcaaaccgatggcaccagccaggccacgggatcaaacaacagctccggtcacgggaacttgatgctgacggcagagccggctacaggctctgaagcccccgtggatggcgttgccacctcgccaaagcagtaactctggaaatgcatagacgaacggcggtgggatcaggacatg

SEQ ID NO: 48459 - DNA, 465 bp, Triticum aestivum
  Clone ID: PAT_TA_48459
atacaaacacgttgatgacggtttgggcgggtctacagaaaccataattgagcaccactcgtacggatgaaataaaattagcccccccccccccccccgcgtcggccctcctctggcgactcgggggcgcccctgtcacgccgtcgctcccctccctccctcacacccagtctcgccgccacctgaggaggccgccggcaaaggccgcgcgcgctccggggaaggtggcggcgaggctcttctcctgctccgcgtgtcctccgtttcgtcagaggaggggccacgagatgcgtcagattggatcgggagggcggcctcggaggcgggcggaggtggcgcttgtcgtcgtcgtcccggtgtccctgccagccagtcccggccccctgtgtgcagcagctcgtcgctgcttgctcgggcgctgactggtcagggggcgggggcggatctggggctccctttccagat

SEQ ID NO: 48460 - DNA, 231 bp, Triticum aestivum
  Clone ID: PAT_TA_48460
cacacgccttcttccgtgcccaaacccaccaccaattaaccgcgacccaacccaccgggcattctaccaccggggcctccccctctatatccagcgcgcccgtcgcgaccagtccgatgacggcaggcggtgcgtaccggctccgtcgtgcggagctgtgccaacggcacttttcacggtggctcgtaccgttggtacttctcacatgggatgctcctgttaacaaggcct

SEQ ID NO: 48461 - DNA, 423 bp, Triticum aestivum
  Clone ID: PAT_TA_48461
cccacgcgtccgcaatgttccagacttctctccccttcttgagctaatcaacatggtatcagagccacccgtctccggcgaggcagcggcggccgtggaacggcgttgagtgggttcggaggcggcggaagttggtggtggtgctggtggtcaacggcgctgtgaaggagggcgacctgggcccgtgaggcgactcagtgcagtggcggaactgagcagagtgctgcagcggtgaaggaggtgctgggaggaacaaggcggcgaggagcagtggtctgatttaccacgggtgagttggctgtttgtgtggttgcgtgttgaggttgcccaagctggtggtgtgattagggaggagaaaggagccgacggctagctagtgcggcgtgcagaggcttgaatctgagaagtagaaatgcagcgtgt

SEQ ID NO: 48462 - DNA, 164 bp, Triticum aestivum
  Clone ID: PAT_TA_48462
cccacgcgttcgcccacgcgttcgcggtgaagggacgttcgtcaaggtcaagttcgccaggaacggtttggccggcgagaatgtcgccattaagatccttttcaagggcaagggccttaagcacaagatgattgcgcaaattaagggcgggaatctccaccatg

SEQ ID NO: 48463 - DNA, 245 bp, Triticum aestivum
  Clone ID: PAT_TA_48463
catcgcatggccggggcaagcgcgcagcctgcgtgggcgcatgcgctcgctgcggctgtcctgctggccgcgtaccatggcggttccatctctactcaacttgtccccctagatactgttcctctgccctgccttcttactgtcttcgatctgtgccggtttcgtttgtcaaatacgactagatacctacaatgagtgatctctaaaggttcttatattaagaaacaaaaatgattcttctacat

SEQ ID NO: 48464 - DNA, 432 bp, Triticum aestivum
  Clone ID: PAT_TA_48464
gtactatatagaccatgaacttagtattgatgattttcttcacgggtcaaacccagatggcctcaataaccagccggaacatcagcagttcaatttgccactagatctgcaacattctaatagttcatatgctgatgcaaataactctgtgcaaagtactggagatgtttttttccacatgtcagacttgctcacaacagtcagcccatcaccttctcaatatttggggccaaaatgtgcgctctgggattgtggtcgacctgtgcgaggatcagaagagtgtcaagactactgcaacccatatcatgctggcttagctttgaatgatgatggtcttctggggacaatgggaacaagacctgtgatgcggccaaggggtaatgatttgaaagatgggcccctgtttgatgctctttgtgcaaaagtccaagg

SEQ ID NO: 48465 - DNA, 344 bp, Triticum aestivum
  Clone ID: PAT_TA_48465
gtcgagtcagccgatggtgaggcgaaggagcaaagtaagcgacccgtcacgatgggatgaggctacagggaagagggtcatgtcccgtgctggcccaaatgcaaccgccccatggcgggcctatacaagcacggcctggatccggtctaagcccgaggacctcgtaccaaggaatgcggactacattgggactcggcatctggggcgactacggacgaggaggggaaagcgaggcagcagcagctagcatctggggcggcggcggctggactacatgagcctgtcgaggtgcttcatgataaggaagcagctgacagtgcaagctgagtgatccacggcgagga

SEQ ID NO: 48466 - DNA, 406 bp, Triticum aestivum
  Clone ID: PAT_TA_48466
cacgaatttctgccacccttgccgtctcgccggcgtcaccaccgcagctagatacgagaatagatgagagagaagaactcggcgggaggcctcgagatctgtctccggagaggggaattctgggggtcagaatcggagcaagcgtccgcgctcgcgatcgcgcttaccatacaattttccccacgaacctttagtgaatccgctaatggatgcactgggggacacaaagtctagcagaaagagttccctgatgtacgaagctcccctcgactacagcattgaatacattctacctgacgtaggccccaataagtgctctgctgcatactctaactgctccaagaacccatcctggtatccattctggcatcccctttccgatgcttatgatgtttatgcagattta

SEQ ID NO: 48467 - DNA, 451 bp, Triticum aestivum
  Clone ID: PAT_TA_48467
gcttaacgtagtgcaagccatggcagctgtcctgatggtgctagtaaccacgagagcgctatggtatgtgctttggaggccgtatgccatggccagttggttccgacggcagggcatcagaggtccgacttacaatctcctggttgggtccctgccggagtgccagaagatgattgtcgccgtgagagccaaggatctggacaccatcttccacgactgcatcactaccgggcaacccttcttgcagaaatgggcctacatgtatgggaaaacattcctatactgactggtgccgacaccagcactgtgctctacggacatggagctggtgaagaaagtgttaaccgacaggacggacatgttccaaaaagactactcaaatgctaacctggaagcggttctggggaatggggtttatttgcaacggacacgatggaagcggggcgcaaat

SEQ ID NO: 48468 - DNA, 464 bp, Triticum aestivum
  Clone ID: PAT_TA_48468
cccacgcgtccgagagaagctgaagcttctaagtactccagaggagcgtgctcgtaggctaaaggaagaacctgaaatacatgctgaccccgccatggatccgaattatgaatctccagaagaaccagaggaggatgctgagagaagtagcttcagtaggccgagaggttctttctctaggaaagatatcaatccagtgtctcctggtaaaggagagggtaggaacgctgcacgagattcaagaactaactgggagtcaaaccgaaacacatggtcaagtacacaattggaatcgcctcatggacggagatctacattttcttctcatggtgaaagtgctggttacacaggtaaatcagagagtccaaacgtcagtacacaaaaagttaatgtggaagccacggcagctaatactccacatgggccatctgttatctcatctcaaactctaacggctaatttaa

SEQ ID NO: 48469 - DNA, 366 bp, Triticum aestivum
  Clone ID: PAT_TA_48469
ggggcaccggcatctggcctgttggccgctgtggcttgccggcgtggggggcgaccgccggattggactcgctggaacatccgctcctcggctcctgcctccgctgccgactacatcagacaacgtcgacgccgcgcggtgcctcagtgagccgcttcgcccctccaaagatttctttcaagctccgccactgatggggtgggcatgggcagccctccggtccggagttccaaggtggcggcgtgcccaaaatccatcgacctcgtccagctgggtcagctcgatcggcctcatcattcggtcgtcgcagccctattcggccgctcccagtcccagccacggtgggggagaggaatgggatcggga

SEQ ID NO: 48470 - DNA, 295 bp, Triticum aestivum
  unsure (1)..(295): unsure at all n locations
  Clone ID: PAT_TA_48470
agcagataggtagcttctgcttgggctcctnaacaggctactgattctccctctcattcatccgtcccggagctatcttgaccaaagcgattttccacattcctccaccgagcaaggagaatacaggagccattctgatactcctgccgatatgtcaccacagctgttccttagatagctccgcacacatcaaatgatgttgagtgcattcgactccaccatgctgatggtcctggcaaaactaggtgtatataaaccagatatgatttgatatacttggttaattcaacatgaa

SEQ ID NO: 48471 - DNA, 441 bp, Triticum aestivum
  Clone ID: PAT_TA_48471
agcagccaaggaagcagcaccaaccccccggaggtcacaacctgtcaggaaacctccacagggaagcagcaatccagcagggccctgtagcgaaaccgacaacgggacgggagaggcggcggctcccggtgccgggcgtgacctgctggcgcgcctcaaggacagggtgaacgcgtcgaggaagcggtcgctggccagggagatgagcagcccatcgtcatcgtccggtggattcagtgccagttcttctggtggtggcgccacccggtcatcagcggtttcgaggccgacgcgtcgtgccgcttccaggataaggaaggcagatgaaggcgaaagcgcaagaagtagtcgcagggtgcctaggagggacaccggtggtggcggggtgccagggggaattcggatgacccggtgatggttgggcagcgggcagcaagggag

SEQ ID NO: 48472 - DNA, 451 bp, Triticum aestivum
  Clone ID: PAT_TA_48472
tctgcccgccgtttcagtgccattctgttacggagcaacgaactgtcagtcctccgagcaacgagatcagcacctagctaggcaagaaccatgaaggcggggacaacaccgccggccagcagggcggccggcctgcggacgctggtggtgcacgtgctggcggtggcggccacggcgctggtgctgttctggtgcatcggattccgcggcggccttgccttccgctccagcgacaagcagcgcatcttcaacgtccacccgccgctcatgctcatcggcctcgtcgtcatcgccggggaggccatcctcgcctaccgcaccttcccggcctccgtcagccgggacgccaggaagaaggcgcacctggcgctgcacgccgcggggcctgccgtcggcttcgtcggcgtcttaccggtcttcaagttccacgccgaggccgccatccccaacc

SEQ ID NO: 48473 - DNA, 387 bp, Triticum aestivum
  Clone ID: PAT_TA_48473
tccttgcaccggtgcaaggaaatctggggcctcgacgtggacgagttcaaccccatgaggtttgagaaaggcatctcgagggctgctaagaacatgcacacgttgtgggccttctcatacgggccacgcgggtgccctgggaggagttatgccatggtccaggtgcagactgtgatggctatggtcctgagaaggttctccttctccctctcttctcggtatgttcacatgcccatgtactacatcacactggtgcctaggtatgggcttcccctgatagtgcagaacctggtggatgatgaaacaaatgacatgtaatatctattcatgtcatctttaagaaataatttctatgttctgccaagaaataaaaagacaagatggata

SEQ ID NO: 48474 - DNA, 377 bp, Triticum aestivum
  Clone ID: PAT_TA_48474
cgtatttgtttagaaaagatgaaaattgaagtggtgagagcactatccaaggccgtttctgggccattgtaccttcgtgcggactgatcgagcccaacatataagcccggcccacccgacgagtcctctgtcctctccatctccgtctacaacacttctccgttcgtctccttttccgcgagacgattcgaggcagcccgcacgccaccttctcgccgtgtccccccggaaaaaaaaaagaacctcctcgccggcgggaccgcttcgcgcccctcgcttccccaccttcgctcgccggccgttcccccggccgtccatggcggcggcggccgtcggcatcagcaggaccagcgcggcgggggcgggaagcaacaaca

SEQ ID NO: 48475 - DNA, 459 bp, Triticum aestivum
  Clone ID: PAT_TA_48475
cccacgcgtccgacacaagtcaagaagcttacagccatgggccatggcgacggcggaggcggggttctccagttgacaggaatttcttctaccagatcttgccggtggcgattgcgtactggcaggagaaaccaaccaaactctagtctgcacgaccactgactcgagcattggcgatgtgggtgatgcaacgctgacagtacagctagatttaaacaacacttgcgagggggtgaccttgtccacgcccaattcagagcagtcaactggctaacatgcttttcaagcgcccggcttgaccaagaaggtaccggtggacatgcacctaccaaacgcccacatgtgctgatcagggtcctcgagaaaatcttgagaaggtatgcagagaaaaagactgacacagtcatagcttcaggcgttggaaacaactttgattcactcggagaagcatctgactat

SEQ ID NO: 48476 - DNA, 209 bp, Triticum aestivum
  Clone ID: PAT_TA_48476
ggcaatactgtcttgcacgaggagtaagaacacatacacatctagcacattgcacacgctgcgcatatacaactcatacatagtggacgcacatcaacataactccaagtcgaactataatctgttcacaaaatacgatcgtccgaggtcatatcgcacatattggagtctggaaaatctccaatttgttgatggatacctgagtgact

SEQ ID NO: 48477 - DNA, 133 bp, Triticum aestivum
  Clone ID: PAT_TA_48477
cagacatgctccgtgcgggtacaagcttctactcatacgcgcgtgtcccttgatatcaggacgagctcgcgcgatggaccagagcgccatgacctcgagggctctatctacacgcccggatgagagatggggc

SEQ ID NO: 48478 - DNA, 320 bp, Triticum aestivum
  unsure (1)..(320): unsure at all n locations
  Clone ID: PAT_TA_48478
ccccgcttgctaagatcaaggggtacccggtgtgggggaacccgaacacggtggagcccttcctcgacgagaaggcggcgccgccccctgcctgcccaagcatcgttaacgccaagcaactcggtctgccatcttccaagctntangcagaggcagacgcagagatggatgaatcactgctactactactactactgggaaggagctatatatgtatgaatgccctcatcctcatggagtagcagtactgaatgaatgaatgagtatatatatcaagcaagagattntttatcagttatgcatttattatatgtttccct

SEQ ID NO: 48479 - DNA, 318 bp, Triticum aestivum
  Clone ID: PAT_TA_48479
cttcgctgcgcaacccaaccactccgcctcctccgagggcgagcagcttccaggagctagggtttcccgtaccgatcgatggcgctgaccgtcgtcgtggtgctgccctcgccgccgccgccgccgccccagccggagcagatcgtcgtcgcggtgctgccctcgccgccaccgtcgtccccgccggcgcgggtcgtcgtcgtggcgccggcgctcgtgtgcctccccttcgtcctccgcgtcgtggcgtttgccctcatctacctgggcttcgcgctggcgtggatcgtgtctgcggccacggctgcagaggtcgtc

SEQ ID NO: 48480 - DNA, 254 bp, Triticum aestivum
  Clone ID: PAT_TA_48480
caaccattttcaggctcgagcacgacgcaatcgaaaaacacttattctgcactctcctctgctcgataacctgcgacctccacgccatgctctccgtcaccatgagcacacgtcctgtggtctcacgccgaccgcaccttccagggcgagctgatgaactaagcccatgctcctcacctgctacagaaactcgtggagccaggccataggcacgaggagaggcagtagctcttacgctcgcgcccgatcgtgct

SEQ ID NO: 48481 - DNA, 409 bp, Triticum aestivum
  unsure (1)..(409): unsure at all n locations
  Clone ID: PAT_TA_48481
agcaaacggcagcccggcccaaattcctggcagcagcagcagcagcagcagccggcgccgggagaggagcgagcaagaatggcggcggcggccgtggcagcgcgggcgtacgaggcggcggcgcggtccgcgctggcggcgctggagcgcaacctcctgcccgacgcggtcacccggcggctcacgcgcttcctgctcgcgcagcgcctccgcctcggctacctcccctccgcgccgctccagctgcaggacctcctcctcttcgcccactcgcttgaaggcatgcccattgccattgaaatggacacagctaaaacccaacactacgagttgccgaccacattcttcaagctagtgctcgggaaaaaccctaaatacagctcatgttacttncctgatgattcgagca

SEQ ID NO: 48482 - DNA, 280 bp, Triticum aestivum
  Clone ID: PAT_TA_48482
gacgcgtgggcaatcatctccagccggcctcctcctcaacccacccaccccgacccgtctgtggccgccagtagccaccggtcaccatgggagaagcggtggcggcggcggaggacaccctgaagaggggggcggtggtggtgccggcgccgcatccgagcaagggggtggcgtcctgggcggtggacctgctggagcgcctcgccgtccgcctcggccacgacaaggccaagccgctccactggctctccggcaacttcgcccccgtccgcgacgagac

SEQ ID NO: 48483 - DNA, 360 bp, Triticum aestivum
  Clone ID: PAT_TA_48483
cccacgcgtccgcggttaagtatggggctgataccatcacgagcatgggcaattcactttgtaggatgtactgcaagtctggagacttggagtctggcctgagggcctttaaggggacccctgagaagaatgtcatcacctggacgacgatgatatcgtcctgcgccgaagacgagaactacctggagcttgggctgagcttgtttctcgatatgctcgagggaggggtgacgccgaatgagttcacattgaccagcgtcatgagcttgtgtggcgcgaggctggatatgagcctgggcaagcaggtccaggctttctgctacaaggttgggtgtgaagcgaatctttcagtgaagaact

SEQ ID NO: 48484 - DNA, 384 bp, Triticum aestivum
  unsure (1)..(384): unsure at all n locations
  Clone ID: PAT_TA_48484
cgctgaaggccatcgaagtatttaggcaaatgcccaagaaaggctgctatcctgattcagtcacttacagtacactaatagacgggcttgccaaaactggcaacatggagcaatcccttgagttgttgaatgaaatgggcaacaaaggattcaactcagaggtaaaatatgagctgttagccgagtttctggatgaagatgataaagttgaagaggcaatccaggtggttcataaactgcaagatacaggcatatcaccccatgctgttctctacaatacaatactcttagggctttgcagaaatgggaaaacagattatgctatngatatttttgcttgatatgggtcctgatggtgcatgcctgatgattcgacttacacta

SEQ ID NO: 48485 - DNA, 301 bp, Triticum aestivum
  Clone ID: PAT_TA_48485
tggccgtctgagatgccacccactcacctccggccggggtgttggatttaaagctggtgttaaagattataaattgacttactacaccccagaatatgaaactaatgatactgatatcttgtcagcattggaggccgccgttcgatccttctactacaacacggatgtctacgcctatggccaggatccggcaccccatccaccgccaccgtgcccagtcgctgttgatggcgcgtactcctaggacgatgactacttgtgcgtcggcttacaaggatcaggtcgactaggactacgtggg

SEQ ID NO: 48486 - DNA, 413 bp, Triticum aestivum
  Clone ID: PAT_TA_48486
cccacgcgtccgcccacgcgtccgggcgagctcactcccctgcaccagcagaagcaccgcaacggcaactgcaacatcaatttctacggcggtggtagatgccgtcgtaagcgccaccatgtcaaaaagccaaggattgaaactatgtgcagtgaaccgagcttttccgagaggaccaagacaagaggtaacacactgcctagagtagtaatatgcaccagcatttggatcataacaacctatagttgtgatcagcccttattatctgtattcatcagaaaaatgtatgtatatatcatgcctgatttttgcctttctgctttttggatcagttgttggcaatataaaactgtagatcaaggaagtgaataatctatgcatggaaaataaacaaaagagggtcatatagtctg

SEQ ID NO: 48487 - DNA, 340 bp, Triticum aestivum
  Clone ID: PAT_TA_48487
ctctcgcgctcgattcacacccacacctctcaggaactcctcctgctgcttcctcctcaatcccccaatccgccggccgagcaatttccccatgctccaggcctcccggatgacccccgccccgacccgccgctccctctgctgctgcttcgcctgctcgctcaatccccccggagccgccgtcgcccgctagtcctcgccgggggagcagaagatccggtcttggcccccgcctccgtcgccgtcgtcgtcgtcgtcccgcgtggggctgatcgttctgtggagctcgaggggcagtgcttttgaccgagaatttgagcccaacggatgaacatgtgcg

SEQ ID NO: 48488 - DNA, 323 bp, Triticum aestivum
  Clone ID: PAT_TA_48488
cccacgcgtccgtactccctcctcctccttcccgcttcgcctccgagatctctccccgctccggcgaccggagtttcggagaaggcttccagatgcgcgctcccccgatgctcgtgccgaagcgcatcaattacgtggccccgatgctcgcctccgccctcatcctgctcctcctcctctccggctacttcgagctcccctctataacctcctccctctccacccagttctcccccaccgtccccgcagccggcgccactgggagccgccgcatcggtacagcgctcgactccgtcggctcccgcgagcggtcggcttttacg

SEQ ID NO: 48489 - DNA, 413 bp, Triticum aestivum
  Clone ID: PAT_TA_48489
cccacgcgtccggtactggtgcatggacagctggtcggactgatggacttaccagccttggtcgttacaaaggacgatgctatcacattgagcctgacgctggggaagacagccaatggatctgttatgtagctcatccattagacctattcgaagagggctccgttactaacatgtttacttacattgtaggtaacgtattcggtctcaaagccctacgtgctctacgtctggaggatctacgaattccccctacttattcaaaaacttttcatggcccgcctgatggtatacatgttgaaagagataagtggaacacgtatgggcgatcttcattgagatgtactatgaaaccataattgggattatccgcaaaaaattatggtagagcgtgtcatgagtgtctacgtggt

SEQ ID NO: 48490 - DNA, 348 bp, Triticum aestivum
  Clone ID: PAT_TA_48490
cccacgcgtacgtgtgagaattcttaagtcacgagttatagggagggacttatgtcaccacgaacagaaactgcagcaggtgttggatctaaagctggtgtgcaagattataaattgactgactacaccccagagtgtgaaacttatgatactgatatggtggcagcattccgagtaagtactcatgctggagtcacgcccgaagaatcatgggctgcattagctgccgaatcttctactggtacatggacaactgttgggactgatgtgactaccagtctggatcgttacaaaggacgatgctatcacatctatcactgttgctgaggaagacagacattggatctg

SEQ ID NO: 48491 - DNA, 273 bp, Triticum aestivum
  Clone ID: PAT_TA_48491
gacggaggctcgcaaggctgaaactgcagtctcggcaaggccgcctctctttagctagcgtagcagacttctgttcagactgttcttgcgtgcagtgcacttcttggctagctagctactcggccatggcggatcaccagaggcagaggatccacccggtggacctggaggcgggccagccgaggccgtcggcgccgctggtgccgccgggcagctcgttccggtccgacaagggcgacccggccgctgccccggacaggaggccgtcacacc

SEQ ID NO: 48492 - DNA, 259 bp, Triticum aestivum
  Clone ID: PAT_TA_48492
gtggatatggtgctggagcggcatccggtggcgcaggaggcggttggacagcagttgcgggttgccgagcgggcggcaaatacagaggacgcgcagatcttgatggtgagtgaagcagcggccgacaggagggatgtgtcaccaccaagctcggaggagagacagctcgcctccgacttctgagctcaccacggggaagatgaatccccaggctcctggttggaataagagttgggatggagatagcatcctatgcact

SEQ ID NO: 48493 - DNA, 333 bp, Triticum aestivum
  Clone ID: PAT_TA_48493
acgagcccaacctgttgaccaagctggcctacatgctgggctagtaccctgcgacacactgttccgcgcggttctggacctgcgagagcagcaactataatgggaaaccctatgtcgcggctcataacatgctgctgtcacatgcagtcgccgatgacaactacaagaagaactaccagacgacgcacggcggatcgatcgggattgcgatcgcgatgaaatgggctgagccactgacagataccacagaggatatcctagcagctcgacgtgcctcgcgtcttgaggtagattgggaggtggagccgatattgtagggtgattatcccagag

SEQ ID NO: 48494 - DNA, 118 bp, Triticum aestivum
  Clone ID: PAT_TA_48494
ccacacgtacgcgagaattggacgatacattccatctccatcctgataggcatggcgacagacaccgagggcatatccgcgctgttatgcacaggcagcgacgacggcgaatacgaca

SEQ ID NO: 48495 - DNA, 376 bp, Triticum aestivum
  Clone ID: PAT_TA_48495
ctctccgtggtccatgattacaagaagatgatcatgaatgagccaggggctctggagaagctggcttgtatgctgaaaaaagggacgccaagggggaggaaagatgcagtgatggcacttttcaacctctcaactcatgcagaaagctcagctcggatgcttgagtcaagtgcagttgtagctttaatcgagtcactgaggaacgacaccgtgtcggaggaagctgctggtgctctggctctgctcatgaagcagccttctgttgtgcatcttgttgggagctctgaaactgtgatcagtagcctcgttggattaatgagacggggaactccaaagggcaaggagaatgcagtgtccgctctctacgagatatgtc

SEQ ID NO: 48496 - DNA, 284 bp, Triticum aestivum
  Clone ID: PAT_TA_48496
cggaaagctcatccatccataccaatacgtgcacacaaggacagcaacagcactagcgaacgagtttattagtcacgcaggcacagtaaaaagtaccaaaatggacaggcactgttctatgcgttggacattaccccgcctctatgcgatgtacagaaggtcccgacagtggaatagtgcccacttttattactgcatatacaaagatccaacagcgggaaactcaagagcgagcgaagtactgtctgtctactcggacaaatcatgcaagcactttctcatac

SEQ ID NO: 48497 - DNA, 404 bp, Triticum aestivum
  Clone ID: PAT_TA_48497
cggacgcgtgggtccggagatccctccgtccgcggcgccggcgacccgagagggagggagaccggagcacggcggcaatcgggcggagctggagagatagggaggcgggagcttggagaaggcggagcgaaccactcttcttctcgtcggagaggaggcgcccgctgcgtgcgggtctgctgaacggatcactgcattgcaatcagccatggtcatggacaccactgacccaggctactggctcaactggaggttcctgctctgcgcgacctgggtctactcctgcatggccctggcatgctacttgatctggaagtacgaggggcccagttcgccggccggcaatgacgagggggtcgacagagaggaagcgcggcccaagatcggacccggagttgtgtatc

SEQ ID NO: 48498 - DNA, 310 bp, Triticum aestivum
  Clone ID: PAT_TA_48498
aaaaaaaaaaacaaagggaccccattttttttttattttccgggaccacaaaggctcaaacagttcaacccctttaaatttaaccaaaaaacccaatctttgggcaaccccccgggtcccctccccccctgttttccttgacaaggcccaaccccttttaagcccccagtttgggcaaagggccccccccctccaaacccaatggaatgcccctttggttcccgtttgcaaatgccaactttttaaccccccccccctggggcttcctgcttaaaaaacccatgggggccatggccggtttttgggaaaa

SEQ ID NO: 48499 - DNA, 416 bp, Triticum aestivum
  Clone ID: PAT_TA_48499
cactgaggaagctcatcgtccagtagactgtgccactgtttcaaagtggatcctcaagaacagcgcagagtctgagaatatgaattgagtcttatgattattattatgagatggggtgtgttgcggatattgtaagctttagctagataacgtggattgttattttttatggtagttggacaatcgtccttgatctcctggtgggacgcactgcatcctgctgtggtgatcatgctagccaaccaggatactggctaactcaaagccttgccctaagtgcaagcggcctattgagaaaaaccagggatgcatgcatatcacatgcacacctccatgtaaatttgagttttgcctgctgtgtcttggttcatggtcggagcatggagagaggactggtggattttatgcttgtaacc

SEQ ID NO: 48500 - DNA, 209 bp, Triticum aestivum
  Clone ID: PAT_TA_48500
tacattcatcctgaccttgatcctgacatactttatgtgagtcgcttatggagatacagtggctgatacagagaggtgcagccagaggccctaactttgtcatgctgtaaaatatgctgtaacagtgagtagatcagccagttgctgaagctgccaccagagaaatcgacaagatttgtgagagcatttgtcagagcatataataattt

SEQ ID NO: 48501 - DNA, 410 bp, Triticum aestivum
  Clone ID: PAT_TA_48501
cggacgcgtgggcgcacgctcaagccgctcgccgccaccacgctcctccacctccaggcgacgccgagcacgcggtctccctccccaaaatcgttccggagcccgcggtcctcctccacctacagctcggctccccttccagatcgcgccgccacctcccttcccatcccctcctggatctctccctcggcgagccaccggcctgcaaatcgtccacatcccagttcccagtgcgtgcatggacaggttgaggagcgtggtgctgtgcaggtgcaagagcctgtcgcgggcggggagcaggcggtcgtcatcgtcctccagctcctacagcaacctccgctccatgtccgccagggacgacgccgccggccaacacaacgtggagatgaccgagggggcgtcggcagtgg

SEQ ID NO: 48502 - DNA, 345 bp, Triticum aestivum
  Clone ID: PAT_TA_48502
cccacgcgtacggatgctggccctctgctgaaaccaatgctcgtacgaggggtgctaccttgcatcggtgctacatccctcgatgagttccgcaaatatattgagatagatccagcactggaacgccggtttgaacatgtgcctgctgatcaacctacagtggaagatccagtgtgattactccggagattacatgagagatacgaattgcaccatggggtccgcatattagacagtgctgttgttgctgccgatcttttgtcagatcgtcacatcaggggtcgattttcgcctgacaaagcaattgattcggtcgacgaatcagctgccgagatgacattggag

SEQ ID NO: 48503 - DNA, 474 bp, Triticum aestivum
  Clone ID: PAT_TA_48503
agaaaaggtaaaccacagctaaaccctagccgccggcgagatcggccgacgcacccagtccagcgtcctcctcttcctcacccactcagacggagcgttaaggcggcatggcttcaccattcgggggcgcctcaacgtgtggcctcaagggcgccactccttccggattcgcgaccaggaagcagctctccctcgtttcgcccccgttggtctcgctgccccagagggccaggccagggagaaagtgcagtttccgagtgaacgctgcaaaggagctgtatttcaacaaggatgggtcggctatcaagaagctgcaaactggagtcaataagcttgccgatctggttggagttactcttggcccaaaagggcggaatgtcgtcctcgagagcaagtatgggtcgcctagaattggcaatgatggtgttacggtggcaaaaagaggtgaagctgaagaccctgttgaaaatattg

SEQ ID NO: 48504 - DNA, 457 bp, Triticum aestivum
  Clone ID: PAT_TA_48504
cggacgcgtgggcgctccgacgaacggaaccaacaaatccccaagccaatctcgtctccgatcgactccagctccccttcctccggtcctccccgccgccccaagatgcagatctttgtcaagaccctcactggcaagaccatcacccttgaggtcgagtcgtctgataccatcgacaatgtcaaggctaagatccaggacaaggagggcatccccccggaccagcagcgcctcatctttgctggcaagcagctggaggacggcaggacccttgctgactacaacatccagaaggagtccaccctccaccttgtcctccgtcttcgtggaggcatgcagatctttgtgaagaccctcactggcaagaccattacgcttgaggtggagtcatccgacaccatcgacaatgtgaaggcaaagatccaggacaaggagggcattccccctgaccagcagc

SEQ ID NO: 48505 - DNA, 198 bp, Triticum aestivum
  Clone ID: PAT_TA_48505
cggacgcttgggtcgtcccgcacgtcccggccagttctccaagcagtgtctgcggagggggaggtgatcaagacaagcagaacgtctaacatactggcctatgagcatcttatcaccgattggtacatgcttcctgctgacggattgaacttcagactgaagacccctgtaacctgccccttcaccgatcttctgtcc

SEQ ID NO: 48506 - DNA, 398 bp, Triticum aestivum
  unsure (1)..(398): unsure at all n locations
  Clone ID: PAT_TA_48506
cacccacagccgccgccctctccctccctcagatctcgatccgccgccgcccccaaacccacccccccgtcgacgaccctcaccgtagacgtggtgctgtggcgccgaggccgggccgacctgagcgccctactcttagcgaccgtcgtcgcctcctggatcctattccacggcgcctccggatacacggccgtgtcactggccgccgacgtgctcctcctcctcctggtcgtgctgtacacgtggtccagggccgcgcgcctnctcggccacctcgcgccttcgtggccctcatcgtcatcacctcgctccagatccaccaccaccacctcaaggtggatctcggcaggtccgactacgccgaggccatgggcaggcagcagcaagcggagggggac

SEQ ID NO: 48507 - DNA, 332 bp, Triticum aestivum
  Clone ID: PAT_TA_48507
acggcctcgtcgccgcggccaacgtcgtcgcggtggcgctcgagtaccgcctcgcgccggagcacccgctccccgcggcctacgacgactcctgggaggggctcaagtgggtggcgtcccacgccacggcgggcgcggccggcaccgagccgtggctggtcgaccacggcgacttctcccgcgtgttcctggcgggcggcagcgccgggggcaccatcgcgcacgtcatggccgtgcgcgccggcgagcagggcgccctccccggggtcggcatcaaggggatcatcgtggtgcacccgtacttcaacggggccggcggagatcggcaagga

SEQ ID NO: 48508 - DNA, 312 bp, Triticum aestivum
  Clone ID: PAT_TA_48508
cgctctcgtgcgaattcttaatagaagagttatagggagggacttatggcgccacttacagaacctcaagcaggtgctggatctagagctggagttaaagatgatgaataggcttactacacgccagactacgaaactaaggatgctgctatcgtggctgctttccgagcaagttctcaagctggggctccgcccgaagaagcaggcgctgcagcagctgccgcatcttctaccggttcatggactgctgcatggactgatggactgaccagtcgtgatccctacattggacgatgctatcgcctatagcct

SEQ ID NO: 48509 - DNA, 230 bp, Triticum aestivum
  Clone ID: PAT_TA_48509
cccacgcatgcagatcacactccacctgctgacgtgcacgctgattatggggcaccacgtggtggtcagcaccgccgacaacaccggagcttgcgctaccgtcccgagcatcgccaggggagactgtgcctctctccgacattgacgaccacagagaactgcggtacctgcatgctgccggcgagctcttgcgagccgtcgatcgccatgggtggtctgccaaggcagct

SEQ ID NO: 48510 - DNA, 481 bp, Triticum aestivum
  Clone ID: PAT_TA_48510
cccctgtttcctcttctccttctcccccgacgacttctcttctcccctgacgattgagtgcgatcctcaggtgaatcaggcgcatcgacgaaccctaatccgacgtctggcgcatcgactacttctcctatgttcttcttcctccgtcgcgtgatggattcgtctgcacacgaaggaggtggggttagccaagttgaagaaccagaaggggacgaaccaactgaatatcgtccacgaggtctctggaatgactcagtagcggcgatccccaagtgaaggcagaggttacagaggtaaggaacaagtatgttgatcatcggaacaaaatgccaatcaacaaaatagaaggaggggatgcttggtgatgagacagaagatggatttatcaggagcttcgcattttatttcctaccatctattttgtgccctgcatcatactgctttggtaacatgaagttcttggactctctaagagatgttc

SEQ ID NO: 48511 - DNA, 332 bp, Triticum aestivum
  unsure (1)..(332): unsure at all n locations
  Clone ID: PAT_TA_48511
tcgcccacgccttcnntgaagaccgaaaccagtgaacttaacccaagccgatgctgaccccaccattaaggcgggggccatcgcgaaccccggccggcccgaagcccttcaagttccccaagtggaagaccttccggcgcccggggatggccaagtgctcctcgcggtggccgcccccggcgtcaaccgctccctcacggttcaacggcatggtcggtacccgtcgtcggcgggcgccttcctctaaccgggcctttaatgcttcggcaccattcttgcgcttggggccaacctgcccccgcgcttggccgtcggccaccaggtttgcgcgc

SEQ ID NO: 48512 - DNA, 429 bp, Triticum aestivum
  Clone ID: PAT_TA_48512
gcatcaccttctggtcaaaaatttggtcagcgagtttgggttcatatccaggtggaagatccatcttttgtcagtgacaacaagactgctgctgttaacttgaatcagcctcaggaaagcaacatcacaaacacaagtagtctgcctcaggaaagcaacatcacaaacacaagtagtctgcctcaggaaagcaacatgacaaacacaagtaatttgattgatgtcaacatggagcctgctaaccaagtcctagatgaacatgtgaacggcactagaatggaactgctggagcctttgatataccatgaagctgctgagcccaagaaatccccctcagcattttcagcagctcctccataccccatggtcgatgttccgtcatccagtgaaaatgcagctgctttcgtgccaagtgttaatgtacttgca

SEQ ID NO: 48513 - DNA, 343 bp, Triticum aestivum
  Clone ID: PAT_TA_48513
ggaatatccatatggccaccgccggcgctgtcgttgaccggctcctacgccggctggcctccgacgctcgccggtcggagctaccctcgggcgtagacgagcacgtggcgcatctgtggcgaactctggcggggttgcaagatgtgctggttagtgtggagagatattttagggtgcgtacggaggtgcaggattggatggcgaagataaatcagattgtctatgacactgaacatctcttggacgagtttgaagaccaaaatggcatcggatctgagaggaccggctgtattacaaaggcaacatcattgtgttcttcatgtccatttttcttgtacgatac

SEQ ID NO: 48514 - DNA, 285 bp, Triticum aestivum
  Clone ID: PAT_TA_48514
ccccagcgtgcgtcacctcgccttgcagcacgattccatgctacaggctaagctggaacacagctactcactgtcaacgactgaagcctcaagatgtgcaccgagaagaataccatcctgtctgttcaggacatactcgcactcatgctttctcttttgcttggcctgacaggtcacttaacatatgactgaagcagtatgctgctccgtgtcatcaacctttctggaggtacagcatagacactcatggtcgataacttctacttcatcaatctcattactgac

SEQ ID NO: 48515 - DNA, 424 bp, Triticum aestivum
  Clone ID: PAT_TA_48515
gcagaagcggcgggaagtacgatacgatacgaacgcgtctctcctcctctgcttcctctgctctgcctccccggctagctagggtttcctcatcgaccgtctgcagatccatccgaggtttttgtgatggctcccgctattgaggcagtggagaaggtcaaggtggcaagcacacccgttaagcctcctgttcttaatgaaagaatactgtcatccatgacccgcagacctggttcagcgcattcatggcatgatcttgagataggccctgatgcaccaactatcttcaactgtgtcattgagatacctaggggcagcaaggttaaatatgaacttgacaagaaaactggactgataatggtggaccgtgtgctttattcatcagtggtgtaccctcacaactatggattcattccccgcacgc

SEQ ID NO: 48516 - DNA, 264 bp, Triticum aestivum
  Clone ID: PAT_TA_48516
ggggggaaaataatccaaggctccggggcggcggcgcccgatccacacacggcacatctcggggcgcgcggcgcacatccactcccctccgctctccacgagtctgctcccccaccgataataatatccgctgctacccggcgggcggggcggacaccctctgccgccgacatgggagcgctcgaggaggcgcacctcgccctctgcgggtgcggcgactaggaggcagagggggaggaggatctcctggcggcgctcgtcgtg

SEQ ID NO: 48517 - DNA, 396 bp, Triticum aestivum
  Clone ID: PAT_TA_48517
cggacgcgtgggtttgtttgctataatatatacctggagtcttgctgggatagtgccatccagaagtgccacgccagcttctatttctgtacaggatgtgcatttttaacactattactatccattcagtaccgctggaatggaggctagtggaaccagcaacatgaagtttgcaatgaatggttgtattcttattggaactttggatggtgcgaatgtggagatcagagaagaggttggagaggagaactttttcctctttggtgcacatgcacctgaaatcgctggtttgaggcaagagagggctgaaggaaagtttgtgcctgacccgagatttgaagaggtaaggaatacgtcgagtgcgtctttggatagcactatgatgattgatgggtc

SEQ ID NO: 48518 - DNA, 461 bp, Triticum aestivum
  Clone ID: PAT_TA_48518
tgatcatttccatgaacacccgccaaaaaacctccgcccaactttgccaagttgcccagaggcttgggggctattgtcggagtaattggccacgggtatcccgaagacggcaagacaatatttcaagacatcggggctagcaaagcccctcagtccaactgcccggctgctcctgccggctcccagtccgactgctctgcctggccggctgccggctgtcgactgcaccaactagccggctgccggcttcagcccgactcgacaccgacaagacaccgacgagacggtcgtacccgagcactattgacgtgtcaccccaggcatcatgtatagtgtcacttgtcccctggcactatttatgaagtgacccaggggacaagcatgacaccccaccatgccttgcccatgccaccacttagcttacttcctaagctagccatgcctatatatatgggcacaca

SEQ ID NO: 48519 - DNA, 456 bp, Triticum aestivum
  Clone ID: PAT_TA_48519
cccacgcgtccggccccgccgacgacctgttctacaagggccagctgctgccgctgcacctgtcgccgcgcatctccatggtgcgcacgctgctgctcgcgtcggcctccacctcctccgcctccgcctccgactccacctccacctccaactcctcccgcgactccaacggcagcacctcctcctccttctccaccgactgcgcggcgctcctgctcccggactccgccccctcatcctcccgccccagctccgccgccgacgacgaccgccaccccaacctgctccagggaaccgcctcctacgccgggctcccgccggccaagcgcaccggcaagcagtacctctcgtccttcgccactcgcttctcctccgtcttcctccaccgcggcgccgcgccggccgccaagaagccgtccaacaagtcgctcgccaaggaggtgatcaagaagtacg

SEQ ID NO: 48520 - DNA, 221 bp, Triticum aestivum
  Clone ID: PAT_TA_48520
cctcatggtgatgctagatctcactgttcacatgatcattatctacacctatggtggctggggagcacacggaggtggagctttttcttactaggaccctactaaggttgacctgagtggcccctacattgcctggcatgctgtcaagagcatcattgctagctgtcttgcacgccgttgcattgtttagatattctacgccattggtgagcctgagccct

SEQ ID NO: 48521 - DNA, 383 bp, Triticum aestivum
  Clone ID: PAT_TA_48521
cccacgcgtccgcccacgcgtccggcgcgcgtcaccggcaccgccggtcgccccgtcctcgactggatctggaccctccctgccgggatccatgtgcccagccacctgcgccgtcccatgcgccatcgcacgccggaggacctgcgccttgccttcctcgccatcgagcacaaaggcgctcgatccagacgacgccaccgttgaccgctcctctgcctcgccgccttcgccgtccccatgtgtctcctggacatggagagagagcacgggagggaaggaggaaggaagagggaggcgtggccatggttggttctccggcggcgctggatcggtgcatgggcgcagagctcctgctcgggggcgcgagatctagggagggactc

SEQ ID NO: 48522 - DNA, 278 bp, Triticum aestivum
  Clone ID: PAT_TA_48522
gttctctgcagacaatatctcaagctctggccacagccagggaacactttgcaagatctcttctgaaatgagaagccgccgtttcttctttcacccctgtgtgttcgaggttgggctactatgctaggcctggcagcggtcacttaaccaaaagcgcaactgtggcagacagatgtgtctggattattcttaaatgctatgtaataccattttcttgttaaatgcatgctgtgtatcttacattttctggaggtatagagaaataatttttgaagttg

SEQ ID NO: 48523 - DNA, 362 bp, Triticum aestivum
  Clone ID: PAT_TA_48523
cacacgcgtgcagaaggagtgaacattgtggttcatctactggttcatcgagcacttgaccgcgcgcgtgggcgcttcgccgcgcgctgcgcccaccgaggtgcgcacccagatggtgcactgcaacgaccagaataacgacgaggctgcacctgacactagcgtggtcaccaggctgtgcgtcgtgctgtgcgtcctcgccggtgccgtcaacgtctccgtcaacgtttccgcctacggtgacgcatacagcgaatcagggaacgcgatcagcaacgcgaacatcaacacgtacttcgtggaatacatcaaacaggtgatcaaactgatgatccacgccaagaaggaccgcaagaaggatc

SEQ ID NO: 48524 - DNA, 359 bp, Triticum aestivum
  Clone ID: PAT_TA_48524
cgcgctgtcgccgcgggcgctgatggcgacgaaccggtacgtgtgcgagatctgcggcaaggggttccagcgggaccagaacctgcagctgcaccggcgcggccacaacctcccctggaagctcaagcagcggaaccccaacgaggtggtgcgcaagaaggtgtacgtgtgcccggagcccgggtgcgtccaccacgaccgctcccgcgcgctcggcgacctcaccggcatcaagaagcacttcagccgcaagcacggcgagaagaagtggaagtgcgacaagtgcgccaagcgctacgccgtgcagtccgactggaaagcccactccaaggtctgcggcacccgcgagtaccgatgcg

SEQ ID NO: 48525 - DNA, 391 bp, Triticum aestivum
  Clone ID: PAT_TA_48525
cccacgcgtccgcggacgcgtgggtgctgctgcaccaagcatgacaccgtgtccgaatcgaatcagtgcgttcgagaaggctgtaagatgttttgcagagaagccagcttcaaatgttcttggcactacatttgactccttgggcaaggcttgtgacttctacaatctgtattcatgggaaaaaggttttggcattcgctatgggaagagacggctaaatgtggagtgggtaaaatgcatgcaggaaatagtttgtggctgctcgggtaaagctgcggtagacttctacaggcagaagacaatggaagatcaacagggaccaggcggatgatgatgtgaggaagacaatgaagtttttgcagacattggagccaaggatccgcattttaca

SEQ ID NO: 48526 - DNA, 436 bp, Triticum aestivum
  Clone ID: PAT_TA_48526
attaaagaagttgagcgagtcacaagagagtctaacttttacgatgctgagaagacaaagaactttctgatggaagcaaaactacctgatgcccgtccactcataaatgtctgtgatcgctttggttttgttccagatcttactcactatctgtacacaaacaatatgctccggtacattgaaggctatgtacagaaggtgaaccctggaaatgctccgttggtagtgggccagttacttgatgacgagtgcccggaagatttcattaagggtttgattttgtctgttcgatctcttcttcctgtcgagccactggttgatgaatgcgagaagaggaaccgtctacgtttactgacacaattcctggagcacttagtgagtgagggtagccaagatgtgcatgtccacaatgctcttgggaaaattatcattgaca

SEQ ID NO: 48527 - DNA, 389 bp, Triticum aestivum
  Clone ID: PAT_TA_48527
ctcgcctctctctcgcgcttccgagctttggcctccctcccctcctccccgcaatctccccaccagcgtagcgcagcgcgcgcctccgccgctccgacccgcagccatgagggagtgcatctcgatccacatcggccaggccggcatccaggtcgggaacgcgtgctgggagctctactgcctcgagcatggcattcagcctgatggacagatgcctggtgacaagaccgttgggggaggtgatgatgctttcaacaccttcttcagtgagactggtgctgggaagcatgttccccgtgctgtctttgttgatcttgagcccactgtgattgatgaggtgaggactggcacctatcgccagctcttccaccctgagcagcttatcagtg

SEQ ID NO: 48528 - DNA, 330 bp, Triticum aestivum
  Clone ID: PAT_TA_48528
cccacgcgttcgcccacgcgttcgcaaagtaccaacatgatgattgtttgctatccagacctgatgcatatcaagaaaggcctctaggccgtgcttggaatcggtgtaattcaatacggaggtgtttaacttactcgtgtatcttaccggccgctgagccatttctggacggaagcgaaccggcgggcagagacgtgtattctttacaagtgtatttaaaaggaagaacggtgatccaaacaagcccctactcagttcgtgctgcgcatgcagatgcaggcttttttatggaaatttattatgcagaggccggggtaaaccccctttttg

SEQ ID NO: 48529 - DNA, 411 bp, Triticum aestivum
  Clone ID: PAT_TA_48529
ctcatgcgtctgcaccttctcctaaacattctagctactattcctgctttttgtctgcgcgcgcgcgtggacgcacgcatcgaagattgcttggttgacgctgcggtcgaagatccggtattcgaaccttgattccgccctcaagatgcatctgtgtagacgaagatgacaatgtagtatactatttgcctaacagatggcacacaacctgtcaactaagcttactatgctttcaactatatgtcaatgcagatacggtcgcagagcacggagggtatcgccttattcgatgagcgataagaccagaggtcagacgtggagaactacgaggatgacaggagagagctgaccatagggctgtcacttaacaagaaagcgctgaatgcatcacgcaaggtcacacattcgctc

SEQ ID NO: 48530 - DNA, 462 bp, Triticum aestivum
  Clone ID: PAT_TA_48530
gtggcacctcgccaccacttgcagatggaggaggcctcggcctgcagctagaggagttcttgacctgcatctgcagatgaatggcacatccgggagagataggagatggcagcgcacctcccactcaccatggacggcgtcccctcctctgctcgaacttcttctccaacctcagcctcgccaacctgatattcctcggtgaagcccggcaagtggtgtgctctttctgttactgttcttcctcacaaaagcatgtgtccgcaaccgttggccaactctgaccactccaacttcctgctcctctcttataattcatcttttctcctatccaagtatgcgtgtgcgcagctgaagttcaacaattgggcagagagccggagccggcgcgtcaacgtcataaaggacaatgggcccgctctgatgctgcgcacaggcttgaagcagtgtcatcaaaccccgtca

SEQ ID NO: 48531 - DNA, 432 bp, Triticum aestivum
  Clone ID: PAT_TA_48531
caacacacttgcgaggtgctcattggtcaaggaccttgaaatgttgccatatggagattgtactcaaattggggagagaggagtaaaccttagtggtggtcagaagcagcgcgtccagcttgctcgtgcactataccaaaatgcagacatctatcttcttgatgatcctttcagtgctgttgatgcccatacagccacaagtctattcaatgaatatgtcatgagcgctctatcggacaagactgttctcttggtgacgcaccaagtggatttcctacccgtatttgactccattttgttaatgtcagatggagaggttattcggtctgcaccttatcaagatctattggcagattgtgaagaatttaaagaccttgtaaatgcccataaagatacaattggtgtttccgatgttagtaacaatataaccac

SEQ ID NO: 48532 - DNA, 371 bp, Triticum aestivum
  Clone ID: PAT_TA_48532
cccacgcgtccgcccacgcgtccgcccacgcgtccgaagaggagagggcttcctccgccgtgttcacattcctccaccggcaccgggctgcttgctgtataggtacagcggccagaggaggtggcggagcaggccaacatccctcttcaactccaacccaacgcctggaccaccccttgcagcgaatattggcgagggccaccttcgagatgtacaggcggtccaccatcagcatgtgcctcaccgagatggtctccagtgggaccctcagcccactgagacgctcgccatccaagtgcttttccagctagacaaggtgctctgtctatatgacggaggcattggaaaaccaagtgtagagcaaggttact

SEQ ID NO: 48533 - DNA, 291 bp, Triticum aestivum
  Clone ID: PAT_TA_48533
gctcgagaccgcgagcgcgaccaagatccaccgcttcgcttccgatcttctccgccggcgactggagagacggcccggcccctctccctccggtgctccgccaccacgctccgtctctccaatgaccgcgacgtctgttgtccttacgctgctccttccccggatctcccctccgcctcgaatttcctgtcccctccggcgacggcgacggcgacggttccgcggtcaaattccacttacttcgacctaaggccgggtgcaaaatttactcacaggttatacatctcatac

SEQ ID NO: 48534 - DNA, 305 bp, Triticum aestivum
  Clone ID: PAT_TA_48534
tcgcccacgcgttcgaccactcgtccgcccacctttcccctctgcggccggtcacgaaggagtctagtgacgacgaaaaaagaaggcatggcaaacccctagtacccgtggtgcgtgagcggactccactgaggcaccgaccaccaggccctgcaaaacgcattctccaagttcggtgacgtaatcgactgcaagatcatcactgacagggaaacgggccattcccgcgggttcggattcgacaccttcacttaggacgaggcgatgcgccaggcgatcgaggccatgaacggtcagcacctgta

SEQ ID NO: 48535 - DNA, 268 bp, Triticum aestivum
  Clone ID: PAT_TA_48535
cggactcagagaattcttaattcatgagttatagggagggacttatgtcaccacaaacggaaactaaagcatgtgttggatttaaagctggtgttaaagattataaattgacttactacaccccatagtatgaaactacggatactgatatcttggcttcattccgagttagttctcaacctggagttccgcccgaataagcaggggctgcagcagctgccgaatatatactggtacatggacatctgtttgtactgatggacttacc

SEQ ID NO: 48536 - DNA, 401 bp, Triticum aestivum
  Clone ID: PAT_TA_48536
cggacgcgtgggtggcggtgcaggctcaaaggcgtggtgctcggtggcatcggcgatggggttcctcggttccgggcaacgcagcgggcctacatcgactgcgaccgcttcgtcatctgcgccggccatggcggcactgctccatctcgcgggctacggcggtactgttccatctagcgggctatggcggcgtcacgtatttgcagttgcctgtttcggagatccaagttctgcgtcagatttctgtcgtcaaagatccggtgttcccggctttattgatttaggagaaagcaagcgggaaaacagtggtgatcaagcgatcatggttacaagaggcggatcaaagactaaaaataaagcacgccgtcgactatctcactacatctcccccaaaggggggc

SEQ ID NO: 48537 - DNA, 166 bp, Triticum aestivum
  Clone ID: PAT_TA_48537
cacacgcggactgattgatggactgttcgttgcctcatctatcaacttatgcggccactcatgccgcttcttttgacacatggtatatcgcatgaaatatgacatctaaagtgtccacaactgggtcccagctgaggacactgctgatacgactgctgatgccatg

SEQ ID NO: 48538 - DNA, 460 bp, Triticum aestivum
  Clone ID: PAT_TA_48538
cccacgcgtccgcccacgcgtccgaccggaaggagcggagccgccgagccgtgaagagccaccaccccatcccatcgccccgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatcatgtcatcttctccaatgtttgccaatgcaccccctgagaagaaaggtgtcaagaactttgcgattgatttcctcatgggaggagtgtcagctgcagtttccaagactgctgcagctcccattgagcgtgttaagctgcttatccagaaccaggatgagatgatcaaggctggca

SEQ ID NO: 48539 - DNA, 423 bp, Triticum aestivum
  Clone ID: PAT_TA_48539
cggacgcgtgggttacaacaacaaatcttaaacgttttactttgtgctgcactactcaacctcaatggccgcctcaacaatggctctctcctcccctgccttcgccggtaaggccgtcaagctttcccccgcggcatctgaagtccttggaagcggccgtgtgacaatgaggaagactgttgccaagccaaagggcccatcaggcagcccatggtacggatctgaccgtgtcaagtacttgggtccattctctggcgaatcaccgagctaccttaccggagagttccccggagactacggatgggacaccgccggactttcagctgaccccgagacattcgcaaggaaccgtgaactagaagttatccacagcaggtgggccatgctcggagccctaggctgcgtcttccctgagcttttggc

SEQ ID NO: 48540 - DNA, 264 bp, Triticum aestivum
  Clone ID: PAT_TA_48540
acttggcctcatcaccagggtagtggcagggagctcgttcgatcaagttgtgcacaccggcacccacatgaacataaaggttatcccatacccggccttctacaagggactgcgtgagtgcctccagccgttcgaacattatctatactcgctagacaaagtcataatatagtatagaacggtgtacattaatacacctgatctgactgacgataggactgtgtgtgccaaacatgcacagacacatctgacgaacatactaac

SEQ ID NO: 48541 - DNA, 380 bp, Triticum aestivum
  Clone ID: PAT_TA_48541
atctatctttctctacagatcgcggttaggagatcagcgagcgcgcccagatttctccctttccggatcagtctcatccgagaagataataagccgagcgggagggggagaggccatgatgctggagggcaaatcctgcctcgtctcgcgctccctgcccagctactgcgacccggactccgactgggcgttcctcctcagcggcagcaagcgccccgcgccggaagacttcggcgcggaagacatggaggaggtagacgcccggcgcggcagcgggaagcgcaacaagtcgtcttccccgcagccgcacacgccggacatcaccgagagccacggctccagccgccatgcctccctaagcagcagcggcggtggggagc

SEQ ID NO: 48542 - DNA, 333 bp, Triticum aestivum
  Clone ID: PAT_TA_48542
accgcgtgacggtgtagagctgcccatttcccgagtcacgaggcccaggggtcgtaggtgcgaccactctttctccccgtccacgcctagctccgccccttccttcctccctgccttctgtggcggaaaagttcgacagcgatggcggaggaggcgggaaggaggaggcccgccgcggtggttgtgctgggcgacatcggccgcagcccgcgcatgcagtaccactccctttgcctcgccaaccagggcggcatggaagtggacattgttgcaaacggaggaagtgatccccatttatcactgagagagaatccatcgattcacatccacgag

SEQ ID NO: 48543 - DNA, 344 bp, Triticum aestivum
  Clone ID: PAT_TA_48543
gcagaagcttctaagtcgaggcctcatggttctacttccagattgtctgataatggggtctctatactctcgccaggtactcgtgatgaagctggacagcctgtacagggttatgaaggttctgataaaggtgctgcagcagaaccagccaatgagtgctccttacctatttcaccaactaaagatggaaaccatggtgctgttgattctgcggatcctgcaccgaatgacagtggcaatcttgtccaagaatgccatgctgcatgtgatgttcatcctgatgaggtaccacaggggaatgcagatgaggttccacatgggaaccctgtgcctctcacaagtgc

SEQ ID NO: 48544 - DNA, 286 bp, Triticum aestivum
  Clone ID: PAT_TA_48544
gacagagctggcatgcgcagacagacagagcttgagagagcgcgcgcgagatggcagcctccatgatcacctcgccgattgtggcgccgacaagcgtcctctccctctcccgccggggttcctccttcgccctcatctgcagcggtggcaagaagatcattggtcgacaagccccttggacttggaggcggcttgacagtcgacatttactcctacggctggaaggtgggcaagaaggtcgtttaccagtttgttgacaagtacggtgccaacttctacggcttca

SEQ ID NO: 48545 - DNA, 234 bp, Triticum aestivum
  Clone ID: PAT_TA_48545
accacgcgttcgaagatcagctgagagatcattaaattaccacacagatgaccctaccactgctactattgcaacatatattgcagaccatactactgagcctgctgatctgactgctgatggacaatcacttgcatatgaatatactggcgcagctactgctcatgttgtagcttctgctggaagcctaacagagaggcttgcagaataccagagagataacgggaagataaa

SEQ ID NO: 48546 - DNA, 223 bp, Triticum aestivum
  Clone ID: PAT_TA_48546
tacaatctgaatcttttaccatggttaactgtgagccaggttttactggcatttgtgattaatatatttgctatttattgtatttaatatctgtagaagttagctgcactcataggatgtgggcggtacatcgatcctatttccattttcatacaggcacctactactcgcccaacggctagcgcctgctccgcggggcccagcaggtgcgcctcaacacgcc

SEQ ID NO: 48547 - DNA, 414 bp, Triticum aestivum
  Clone ID: PAT_TA_48547
ctcggcggccagatgtgcctcctcctcctctcccgcctccgcctcccgctcgacgtcgtctcctgcgcgctgctcctccccaacgcagccgcggcgctcgccgtcgccgcgatctcgccggcctccgtccccatcgcgctccaccaggccgcgctcctcgccatcgccgtgctcaccgccttctggttcacgctgctccccgagtggaccacctgggcgctgctcgtcgccatggccgtctacgacctcggcgccgtcctcatccccggtggccccctgagggttcttctcgagctggccattgagaggaacgaggagataccggcgctggtctacggggcaagggccggtggatcccaggcacggccagaattggcggctttggaaggagagggcgcggcaaccccgccggga

SEQ ID NO: 48548 - DNA, 431 bp, Triticum aestivum
  Clone ID: PAT_TA_48548
ggctaaatacagtcagcaacgtggctgcttctgcaagtggaaaactatcagtgccatctggtgctataactgctattttttacaattccatttacaaaggttctctgccggctccgtcgaaggctaatgctttggagcatttattggtgtattcaccgtctggtcatgttattcaacatgaacttctgccttcttcgggttctgaatcctctgataacagcccaacagttgggcctggcagccatttgcagctccaagatgatgagttgcatgtcaccgctgagccagttcaatgggtgggatgtttgtcgtcggacaaactggcctgaaagagaccaggacattgcaaatgttgtattccacaaccaactaaacaggatgatgacaccggacacttctgactgtgaggatagtgaccattctgatttcac

SEQ ID NO: 48549 - DNA, 354 bp, Triticum aestivum
  Clone ID: PAT_TA_48549
cccacgcgtccgagttgcctcttgatcaaggagccgatggtgaatggaggagccgccgccgagtgccgctgccctacgtcaggtggtgcttaaagcgaaggccaacactcggtctccgtgctccgttcaagattccggcgtcggttgcgtgctggttgggggtcgctccggtccatcgccaaggctaggtgtttgtggaattgcctgcctcctttgcaactgcaacggcagcgccagcagagtaaggaaggctaaggctaggcagagcaaggaaaggaaaggatggccatgccgcggggcctggcggcgtacatggtggacatggtgtgggcggtgctcgcccgggtgggtgtc

SEQ ID NO: 48550 - DNA, 443 bp, Triticum aestivum
  Clone ID: PAT_TA_48550
cgcctctcctgcgcgcgcggcgagggtacggccggccatggcgtaccagtaccaccaccaggaccacgcgctggggatggacccggcggcggcggcggggaaccccggcggcggcttcgcgccaggcctaggcgcgggcgggtgggagagggagaaggcggccatcgaggcgcacccgctgtacgagcggctgctggaggcgcacgtcgcctgcctccgcgtcgccacccccgtcgaccagctcctccgcatcgacccgcaagtcgccgggcgcgcactgaaacacgtgctatcctacataaaactatacagaatgtacttcaaagaggagagcgattggatctcttggttgaaaaaagctcagacctgagtgctgcttcacagatgtttgcgcgttcacgccatggaagcttggatggcttgtttggagctttaacaaactt

SEQ ID NO: 48551 - DNA, 448 bp, Triticum aestivum
  Clone ID: PAT_TA_48551
catggtctagcttctacgacgccgtctcgcaggacttcaagtccgagagcctgaattgcttcagtgtcatcaaggcggtctgggacgtgctcgataacaggggatcaaccgaggcagggctcttggaggtcagcaaaaccttcagggcctgcaagaccgtgcgcttccctagttcgctgtccaactggctatggacggcattcacatacacagccatggtggactatccaactccagccaatttcatgatgaatctgcctgcttaccctgtcaaggagatgtgcaagatcattgattcttttcccgccggagcagacgtcgtcgaaaaagcttttgcagcagcgagcctgtactacaattacacaggcgaccagaagtgcttcgagatggaaggtggggatgacccccatggcctcagcggctggggctggcaggcctgcacagagat

SEQ ID NO: 48552 - DNA, 165 bp, Triticum aestivum
  Clone ID: PAT_TA_48552
ggctggtgatcccaacattcacttcgtcgaagctggggcccttaagcccccggaagtgaccttcgacctggccatgcagcaacagcacaaggctgacctggcggttgaaggggacaaccactggctgatgacgatgacgatctgatcgagtatgaagagaggatc

SEQ ID NO: 48553 - DNA, 435 bp, Triticum aestivum
  Clone ID: PAT_TA_48553
cccacgcgtccgccagttcatcatttttaaaaccaggataacaaaataatgctgtaaatcttatgtttataactccacaactgcggtaggtcatattttgtggtattcgtattcaccaacattttttcatcccatgtttagagatccctccctttttcgctgcgtaattatgccatgaggaatcttagccgttgcaaggatgaggcccagagggctgcttgccaaaccatgatacaacagatcacaagcaaagctattagcaatggaaccctccttactaagaattgggacactgaaccgctgattcctttgccagagaaccttttgaccatgaccgaaacaagtgcaaacaattcaagttccttgccaacatcttctacccctaaaagacgactgaaaagtaggtgggagcctgttccggaagaaaaggtactg

SEQ ID NO: 48554 - DNA, 455 bp, Triticum aestivum
  Clone ID: PAT_TA_48554
cggacgcgtgggcgccgccctgatctagcattggcgacctcatcgatggcgtcgccgtcgtccgaaaaggggggcgagctgccgccctcggagcacatcgccggcgagctgccccgcgacgcgctctacgacatcctgctgcgtctcccggcgaaggatgtatgccgcctccgcgccgtcagcccctcgtggcgctctctcaccctggacccgatcttcgtcaaggcccacgcggcccgccacccgggcccgctcctcgccaccaccttcgccgacggcgagtcccgcggcgtcagcatcggggatctgctctccggcgacgttatcaagcggatacgcacctccggccccgacctgagagtgccccgcacgcgcctcgaccgtgtctgcctcgtcggaaggcgacaccctttgggcgggcctggcacccctgttgacccggccacgggtgctgt

SEQ ID NO: 48555 - DNA, 445 bp, Triticum aestivum
  Clone ID: PAT_TA_48555
ctacaaattgtattaaaaattatgcaacagtagaggactatacatccatggggtgaacctaaagtttgttctggcgcatttataggatgaacatgcattctttatcttatttgccatgcttttccatcggcttgctgatatactgtagcatgggaattgctttgtagtgatgtgtctttccatatcagttctcttagcttcacataataaacaaccatctagcagtctttgtctggttacaacaaaatttctcatcatcatatttttgtatgtttgggcttctattcttcttgagtaatttataaccattcttaaatagtatacatgaattcttttactatgtttcagttactcctactttcttaacgtctgtaactgcccacctgagaatctatgtgcgctgctgcatgtagtgtgatagcctactctcagcttttcaattttt

SEQ ID NO: 48556 - DNA, 439 bp, Triticum aestivum
  Clone ID: PAT_TA_48556
cccacgcgtccgcccacgcgtccgcggacgcgtgggggcctttttttcttctgattttgcaccagaaagctccttttttttcattccggttttggttcggccttctctacatgcaccttcttctacctctgcccaagccctcatggccgctgccatagacatgtacaagtacaacaccagcacgcaccagatcggctccgccgcctctgcctcggatcaggagctcatgaaagcactcgaaccttttatcacgattgcttcctcctcttcctctcactacccctaccactactactcctctccctccatgacccaagattcgtacatggccaccccatcgtcgtcgtcctacgcctcctcgttcgcagcctctcctctgcccaaccaccgccccgcctcgccgtctttctcccagcttccgccgctctactccttgcag

SEQ ID NO: 48557 - DNA, 134 bp, Triticum aestivum
  Clone ID: PAT_TA_48557
cggacgcgtgggcggacgcgtgttcaaagaggaaagtgcatactgagtgcgcctacatgccttgccaaacccactgcggcagccgtggacggggaggccgtacccgctgcccaagctgtcgtcacgagacctgc

SEQ ID NO: 48558 - DNA, 332 bp, Triticum aestivum
  Clone ID: PAT_TA_48558
aatgcgccaaattaaactcgttcatttcctccgatccttgtggggaccaggcgaccgatggatgttgccgcagagagacaggcggctccggcgggcgtgcatggtgtgtcctcctccaggctgatcgccggctttattttaggcgcgctcactggcctcttcgttctcgctggagcattatccggagcagtcaccgtcgcgctggctggcggagccttcgatagcggcgttcttcggggagctagatctggagccatcacctgtgctgtcctcttcatagtggttctccaggcatctcgcgccttctgttgctcggaccggctcggagcatc

SEQ ID NO: 48559 - DNA, 485 bp, Triticum aestivum
  Clone ID: PAT_TA_48559
acaattaccatcacagtctcgcattcaccgttgctagcacggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgtgaagaggaacacggacaagtggaagggtcttgcgtacgatatctccgacgaccagcaggacatcaccagagggaagggcatcgtggactcgctcttccaggcgcccacgggcgacggcacccacgaggccgtcctcagcttctacgaggacgtcagccagggactcaagaagtacgacttcgacaacaccatgggaggcttctacatcgctcctgctttcatggactagctcgttgtccatctcttcaagaaacttatgaccc

SEQ ID NO: 48560 - DNA, 450 bp, Triticum aestivum
  Clone ID: PAT_TA_48560
cgaaaaaaagagttatcccttaggccgccacaggaggcaaaagcaagtggaagccatggcgacggcggaggtgggaggcgatggcttcgagtttctgtcagatcccgttgacagatatcccttcatttcaaaatagatgacccaaagtggaacggagggagtaacttccttatctcccactcgtggtgcgtactgctggccgttgtgattcgacgcgcaaccttagtactcgactcccttcttttggcataggtccctccgccggatcttggcggcggcgagtctatacttgacgctgaacccccccaaactctgatctgcacatccgcccagtccagcactggtgatgtgggtgatgctgccctgcagtacaattagatttgaacagcagttgtgagggacttagcttgtcagcgcccaactcagagcagtcaactggcaaaggacgat

SEQ ID NO: 48561 - DNA, 449 bp, Triticum aestivum
  Clone ID: PAT_TA_48561
ggagagggtttttggagaggagactcttgccattcctccccgcatccgcttcaatcaatcggtgttgattaatcggcgtcggatccgtcgatctaggagatccaggccaccaagagatggggtcttgtatggagtgcagttcagacgagtcgtcagagctaagtgacactgatatcgatgactatgctgacaaggcgtacacggacctcaagtctggcaagcttgtggcgaggttcggcgcagacaggtttagatgtccgttctgccccgggaagaagaagcaggactaccgctacaatgagctgcttcagcacgcaattggtgtgggcgcatccaaccgtgctgccaaagtgaaggcaaaccatcaggcactggccagtcacctcaagactgaccatgccgatgcagcaggctcgttgccgcctcgacaggccgaggcgctgatcaac

SEQ ID NO: 48562 - DNA, 426 bp, Triticum aestivum
  Clone ID: PAT_TA_48562
cggacgcgtgggccgcgcaccggactgcctgaggggggaggggagtgttgcaccgcgagtctcgcgccggcaggcggcgcgctcctcgagcggctggaggcggcgtggctgctcgatgcagaacgaaggcggcgtccggggcttggaggggacggattcgtgtgcggcaggggctggggaggcagatccggaggcgttcggcgagacggggttcgctggtgacgaggaggaaggccggagcgccgcttccggggaggatccatagcatccgcggctcctggacagaaaggagacacagaggtgagggagagaagaagagaaaaaggaggggcggtgcggcgacctatgccggagctcaccggtgccggacaacggcggacgggcgccactgctgctgcctgcctggttatgaactcctacaatttc

SEQ ID NO: 48563 - DNA, 431 bp, Triticum aestivum
  Clone ID: PAT_TA_48563
cccgagcgaggtcccaatccgctcctcccctctcctgaggatacgcaaccgccgccttcgccgaattcgccgttgtcgatctgacgatccgggcagcacagccgccgctaccgccgtcgatctgcctatccaggcagacgcggccgtcatggatcacgagaacgccggcgccgccggcgcctcgaatacgtcgccccgctcggcatggatggccgccccaagacatggataagctctcgtgatccccaccccacccctctcatcccctgaatccatatcctccttcccgtcttgatcccgcccatgatctgatcaggaagctgcccacgatctgatcccctggtttcttatccggttatcctcctctcttctctcgcacgggcgttctagcaacccccatctttggtgtggcaacgttgctgacatcgtcg

SEQ ID NO: 48564 - DNA, 285 bp, Triticum aestivum
  Clone ID: PAT_TA_48564
gccaaaggtaatcaatagctcacagatatcgcaagctcacaaccctagcccttatgcgtgagcgagcgaaaagtgatggacaccacgctgctgttcttcgacatgaccaccgaaggggcccccgacgaatcccattgctaatgagctacacaaggaccgcgagggtggaactgtacaaaacttacgcagtctctgaagagaagacacgggtgttgctgagagcgacaaacctttccactacaatggcggcgctttaggacatgatatcccgcacttactgtgccg

SEQ ID NO: 48565 - DNA, 484 bp, Triticum aestivum
  Clone ID: PAT_TA_48565
caatgatccaatctcgaatgtcgtctgcctctacgcccacggccgtggcggtggcgcggccggcggggaggtacgccgtgtacgtcgcggccgtgccgctgagggctcctcagggtccggcccaggccctgatgtcttcggcctactcgttgggtctgtgggaccttcagcacttcatggtgctcctccggcccgaccctgcccgaaccccaacccgagcccaggagcaggagcaggagccgtcgttggtgttcgatttccagcctcgccacccggaggatgctctcgccgccttctccgtgctctcgcggagcaaaataccgggggtggttcggaggagaaggctgcggaggatccctgacaggaggagctggttcgtcggcctaagcgacggggacggcgacgccgccgacgccgccgagaggttcagcgagcgctggccgaccgaccctgtcgtcgggaaccacgactgccgagactacac

SEQ ID NO: 48566 - DNA, 370 bp, Triticum aestivum
  Clone ID: PAT_TA_48566
aaggccggagggatcctgcagcgctccggcagctccagtagctccagttcgtctgaggatgatggcatgggcgggaggaagaagaagggcatcaaggataagatcaaagagaagcttccgggtggccacggcgaccagcagcagaccgccggcacctacggacagcaaggtcatacgggaacggccggcaccggcggcacttacggccaaccgggacacaccggaatggctggcaccgacagcaccggtgagaagaagggcatcatggacaagatcaaggagaagctgcccggacagcactgagcccggcccgcagcagctactcgagagttgaggtgccgatctggccacctttgcagaataataagat

SEQ ID NO: 48567 - DNA, 406 bp, Triticum aestivum
  Clone ID: PAT_TA_48567
cccacgcgtccggacggagaagaggggtcagggggacacacacggtcgccatcgccgtgatcgccggcgccccctcccccacacacccgccccagccggcgtcccgacctctggccagcgataagcaaatcccgcccgcctccacgtcgtacacaaaagccccgttctttaccaaccccagccccgcctggctcattaccttcaacctttcctaattacgattctctgacatagtccctatggcttgcccagacagccaatggatctcatatgtagctcatgcatcatacctatttgaagagggttccgttactaacatgtgtacttgcattgtgggttacgcttttggtttcaaagcactacgtgctgttcttttggaggatctaccaattccccctactttttt

SEQ ID NO: 48568 - DNA, 278 bp, Triticum aestivum
  Clone ID: PAT_TA_48568
ggccaggcagttccgcggataccggctatactccgccctaaaagcgccgccgccgtcgtcacgtgcagctccaccacggcctgcgacagcgctgcggccagaccaacaaaacgtgcgtgtgctccccaagcttctgcaaggtccgagcaaagcatccgcatcgtgttctctgtgccacagccacctccccccacgttctcgggaatctcgcgcccccggccgcgatggacgtggagcttcccgtccgcgccttcttcttccaagccaaggcgagggag

SEQ ID NO: 48569 - DNA, 281 bp, Triticum aestivum
  unsure (1)..(281): unsure at all n locations
  Clone ID: PAT_TA_48569
ccactcttattcntactcttggacggacgcgtgnnacaaagatcaatattagcacggatagagaaggatgaccggaatagatgatacacttgtaatacagggtcgagccgcggactaatactgcgaccaaatttctcaatgaagaagctcaacaatgacgtgacctccggccgtgaactaccatgtgaagagctccaaggatcaacagcatcaaagccatatcagaggttgactttcacgatgtgaggaacacacatgggtggaagggtcttgattactat

SEQ ID NO: 48570 - DNA, 146 bp, Triticum aestivum
  unsure (1)..(146): unsure at all n locations
  Clone ID: PAT_TA_48570
ggatgtaatgatgtcaaacttggactgtacgggttaaacatcctcgcaacacggagaccactatgaattggcacttcgagggantaaactagcattgtacagagtgcctgaacaacctggacaagatcaccgctaccaccacacat

SEQ ID NO: 48571 - DNA, 463 bp, Triticum aestivum
  unsure (1)..(463): unsure at all n locations
  Clone ID: PAT_TA_48571
gagggcttgaggcgtagtgttccacacagctaccaactccgctcgagatcgaatcgagctcactgatgccgccgatggccgtggacaagcagcggctgcttcctctcttcgttctcgctttagtgacgccggcctgcttggcgagtggcggagaggagccggcgaggttccagatcccacgagacgggagcgttgtggagctggacgagggcaacttcgaggcggcggtggccgccntcnatttcctcttcgtggacttccacgccccgtggtgcggccactgcaaacgcctttccccgcagttggatgaagctgctccggttcttgctgggctgagcacgccaattgtagtcgcgaaagtaaatgcagagaaatacaaaaagcttaggtccaaatatggagtagatggcttccccactcttatgctttttgaccatggagtccccacagagtacactggttc

SEQ ID NO: 48572 - DNA, 481 bp, Triticum aestivum
  unsure (1)..(481): unsure at all n locations
  Clone ID: PAT_TA_48572
ggctgcctcagagtccgctgaactcagagcgcgcgcgcgatctccagagcccgctggtttcgccctcggctacttgctcggggcggcgttagagggacggcggtgctgcctggcggggtggtgcgggagggagtgagcagctgcgggcagcggcgatctgggcatggggaacgcgagcgccagggcggtggagaacggccacgcggcggcgccgatggagcaggtggccgtgggccccgtcggcgggagctccgccgaggccgcggcgccgccggacgccgtgatgcgggagctccctcctgcggtcccctacgtcttcncnccgcaggttccagtagctccgctgcagataccgaatgaattttcacctgtttttaaccattcatggatgaatggttcggatgaatccaccaacaataaccccccggagattgaaattccaactttaattacatggagtcaaggaggaaacgaggtgttt

SEQ ID NO: 48573 - DNA, 485 bp, Triticum aestivum
  unsure (1)..(485): unsure at all n locations
  Clone ID: PAT_TA_48573
ctcctccgtcgtgccgcgcgtactcccgtgcgggcactccctctgcggctcctgcatctcctccctcccgccggcctccgcgtcggccgcggcctcgtccctccgctgcccgctctgctcccagtgcgtccccttctcccgggccctcggcccctcctccctccccaagaacctcgccctcctctcactcctcccctccctccccaacccttccccgccccgcaccgccggtnccntctccgctgctcgacccctccctctcccgctccacgccgcccactcgcgcgtgctcgcccgcttgcgacacgccatcctaggcgagtccgnctgcccgctacactcctcgccgtccggccaccctcccgccggcctcgcgctcgggtcgatcgcctgcgacctgggagccccctggttctgctcgcggagtcaccccgtaaggcctctcccgatcgacgctcccgccggcggtgcgccgacgcaggagg

SEQ ID NO: 48574 - DNA, 303 bp, Triticum aestivum
  Clone ID: PAT_TA_48574
gccagacgttcggaaggatcctaactagctcactaaatttgctgctgagcttactacgtgttctatagtacgaatggaggcaccaaatcattcaagccctgatagtgacggtgaagagaacgggtatgcagacagatttggagctcctgtttcaagcagggcttagtgaaaggctaactcttataaggacactacaaaggccactacctaaccaagtaaccttcctgagagacctgctgcgagagtggcattgttcaaggttattcttgatgtaacacattgccttaccaatgaccgcaccaa

SEQ ID NO: 48575 - DNA, 482 bp, Triticum aestivum
  Clone ID: PAT_TA_48575
actttggggatcttgtgttattgacggtaaatgtgatctgtcagaggattcaactacaatcgattcccaggataccaaagccttcagtctttttggctctggtgtttccactgatttgcagactagctatgcagcaagaatcatggcgatatctgttctcccctttatcgttgttcagataccgcaaattctgaagctcaaatctggtcatcgcttaactctactgcttgggcttatagttgcagtgctacttctgcttacttattgcctataccagatctttcagccatggatccagaggagaaaattagaatattcaaaactgaagcatgtaatgtctgggcttctgaaacatgctcaaatgcatacttttggtcaccttatcgatgatgatggcacaccaaatgtttctgtcatagagaagttatttcacaaaattgatctggacaatgatggaaggatagggcgtggtgaactacaag

SEQ ID NO: 48576 - DNA, 214 bp, Triticum aestivum
  unsure (1)..(214): unsure at all n locations
  Clone ID: PAT_TA_48576
ccccgtttctcaaccttcaagtgagattagactcgcagcttctcacactagcaataatcctcctgacgcggatcgtggtgtgaacaccagatttgtgctttgcaatgattatacccttaaagagagacaatctcctcttgttgggctgtcncattggcggaggaagaggaggagctggcgccgaggcccaagcctattaagttcggcgagatca

SEQ ID NO: 48577 - DNA, 490 bp, Triticum aestivum
  Clone ID: PAT_TA_48577
cccacgcgtccgcccacgcgttcgcccacgcgtccggtaggttgcaagaatgagaaggctcctccgtgcttaacaggaagagacagggtcacagccgcaccgcacgacggcaggccatggtgagccgcaccgcaccaggtgggctagggcgagctccagggcgagcgagcgcacccgtcgcccacgccggcggtgtcctggccacgagcaacaggaacacagggtccatgaccatggctggatctcctccttctccgtccacatgcgtgcagcaagaactagcagccgacgggtccagcgggaacacgggaagtgaagatatactgaactatacatatctgacagatgaggcagggttgaacaccgtcgacggtgcgtggatgagccgtggctcgacgttgtcgccggcgtcctgatccgtggatcaggtacagtggttcccgctagcgccggcagtgcacacagttaatgcagtggttgggcgactcgg

SEQ ID NO: 48578 - DNA, 281 bp, Triticum aestivum
  unsure (1)..(281): unsure at all n locations
  Clone ID: PAT_TA_48578
accggatcgccgccgatgaccatgggggcggagcgcgaggccggcgaggaggaggagtcgcggcgcccacttctcccatcctctccgtcgccagcggcggagcaccagcagcagtaccagcacctggggcggagcagctcgtcggcgctgcgcgggggcggaggagggtggggcntcngnggctcggaggtcagcgcggctgaggtcaggtccgccgtcttcttctccttctggtngtgnaacgagtatgccttggtgcccatttcccaccacgacgccgt

SEQ ID NO: 48579 - DNA, 490 bp, Triticum aestivum
  unsure (1)..(490): unsure at all n locations
  Clone ID: PAT_TA_48579
cccacgcgtccgctgccgactaaaaaagattattgagagttttggagaaaaggtacaaccaactttatgccaacgcacgtgcgatgcttgcaagcacccaaatcaagtgtcctcgcgtttggaggaccttcggcgtgtgcccaactgtcgctttaacactgtgcagcaagtctttgtttcttttccacagttttgcttatgagatatgaattgtacatattctgtgcttttgnattaacttgcgccatattggtctagtaaaacttctcattcgtgtgacagctcatcagttgacccaaaacactttgacacgtaattttggaaccgtgaagatgacgtaagcatatcagacgaagatatatcagattctgatgatgaggaagaggcagtgagcaatatcgccatttcaaagcttccatcaaaaggagggtttgaagcaagacttgatgccttggagcgtgctgaaaatgcttacaatcaagccaatggt

SEQ ID NO: 48580 - DNA, 428 bp, Triticum aestivum
  Clone ID: PAT_TA_48580
cccacgcgtccgcggacgcgtgggatttttgccaccctcgtgttgcggtttggttccagatccagtgacactgctcgccacgagacaagagctccctgcacctgcctcccggcccagctcaccggcgaagaatatcttaagcatacaatcacaactcacaagctgcgtccgtccagttgcagtcgccacccaccaccactagagccatcaccacatcaaagaggcagaggacaaaaaagaatccgcacttgcttggctttccagctagtaattcaggttgccgtccggttactggctcggctcccagatgatacagatcggcctctcacggcgtcggcggatcggctagcagcaatggcgcgcgcgttcggcgtcggcgctgcggtgctcgtcgtcgtgtcggccttcttcgcgccggcactagtgac

SEQ ID NO: 48581 - DNA, 395 bp, Triticum aestivum
  Clone ID: PAT_TA_48581
ggaggaagaaacgaagcaagcccagctggctgcccatttgtcccagcccgcagcacaagcagatgcacgcccgcatcccgcagccccgcattgctcccgtcccctttggtatccattccgcaccaaaacctagatgcacgccgcaccagccgcctccggccggacgccgcgcccttcctcagtaggccgccaactctagccgcccttcctgctagtggctgcgcgcctgcgccctgctgcttccacgccggcgccggccacggcgaccagtcttaagcggccagcgcccagcggcagcagcttcgccgacggccggcggtgtgcaggcgtgcaccctgcgctggggtctggagacgtgcagcatagcaagctagcagctgggagctgagcagcag

SEQ ID NO: 48582 - DNA, 282 bp, Triticum aestivum
  Clone ID: PAT_TA_48582
cgcgaggcgaccggtgggcaaccctaaatcccgtcggtctccgccccctctcccctccccctccctcgccgccgcccgtgggcgcggctgggcaaagcccagccgtcgccggcggcggcggggcctcatcgtcctcctgctcgggcggtgctggcgcgggccggcgcctcgggtcggagcgtggagctgtgccgggcgacacggcggtgcagcgggcagaggccgatcttatttgcttatgctcctcctcgacaggcggacaggtgttggtgcgtgctcagc

SEQ ID NO: 48583 - DNA, 473 bp, Triticum aestivum
  unsure (1)..(473): unsure at all n locations
  Clone ID: PAT_TA_48583
gaagggtgcacaggttcgcggatttcccagcgatttggtgcgtgccgatcttccaagccattctgaccgaggaggggaccgggcgttcgagcagctgttcttgctccggccaccagcgagaccggatctcgccgtcgctgataaggaaaggcggatgccagtcgcctgggaggtcacgggtgctggcagagagctttggcgttgcgtagaatggcctctcgttccttgtcgcttangttgatgaagagcgacagatttcccatccaatgagtgttgagagatctcatggaggatggagtaccggttgatggatttactggacaaaattgttctactgggtcaagctgttggtgctagggcatcaatgccaaggtggcataggacagaaaataattgttgaccaaggcaagctaatggagaatgactggatcctgaggcacagtacaaatggtggactactgctatggtctatt

SEQ ID NO: 48584 - DNA, 483 bp, Triticum aestivum
  Clone ID: PAT_TA_48584
gcagaaacaaatggtttaaatggaatggttaccggcttccacagaggtatgttgaggttggcaatggagccatctgtgttagggcaggctataatggagggtggtccagacagaaagatcaaacttgatcatatccccggacttgatgagctatacattgaagggtacctgcaagccatgctggatgtcatgtataaacaagagtaccttcgtgtgagggtgattgatgacctggttttcctaaaaaatctaccaccgaacagcgctctcataaatgaaattgtggaaaacgtgaagggctttctcgtgagcaaggcattgttgaaaggagacgcctctacggttcggtcttggcgccgcctgcgaaattagcctgagtggaagattgcgccgacggtgctcaccctgtgcgagcacctgtttgtgagcttcgcggtgcgcctgctgcaccaggaggccaccaaggccgtagcggaggtcacg

SEQ ID NO: 48585 - DNA, 482 bp, Triticum aestivum
  unsure (1)..(482): unsure at all n locations
  Clone ID: PAT_TA_48585
cccgagcgcaacccaaacccctaccgcctctgcgacccgccggcccccctctccggcgctagtgctccggcgagctctctggctgcctcgggataggtgaacggaaggcgccgaacaagtactacccgccggacttctacccggcgaagatcccgcggcagaagcagcccaataaccagcagatccagacatacttgggaatacagatatttaggttttaattcagctgtactaggngctcaactgagattacctttaaaacagacccccagaattcagactatacggtggaatctggggctagtcgaaattctgagccttggcgtaaagacattgaggttgtggacaaagagaagagaaaacgaaaagtggaggagatgggcgatgcaatgagattactggagaacagagcaaacgactcaaagcaggacatggacgtaattgctgctttagaagagatgcggtccatgaagtcgagacat

SEQ ID NO: 48586 - DNA, 500 bp, Triticum aestivum
  unsure (1)..(500): unsure at all n locations
  Clone ID: PAT_TA_48586
cggtggtctggtggctactcaaagtgagctagagcttgccgagatcccacccacccaatgcgcgcgcgcccctcgngagctaccagagccgaccgacacacccagcagagcagcaaccagcgaactgacggacgccatggccaagctcctcgccgtcctggccctcgtggccgccgccgcgccgttcctcggcgtcgctggccaggagggtgagggcgggtcggagctgctgccgttcgcngnggacccggcgccggaggggtgcgacgtcgggcagggcgagtgggtgtacgacgaggcggcggcgccggcgtacgaggaggcggngtgcccctncatcccggccgagctgacctgccaggcgcacggccgccccgacaaggcgtaccagcactggcggtggcagccccgcggctgctcgctccccagcttcaacgcgacggtgatgctggagatgctgcgcgggatgcggatgctgttcgtgggcgacgcgctgaacc

SEQ ID NO: 48587 - DNA, 476 bp, Triticum aestivum
  unsure (1)..(476): unsure at all n locations
  Clone ID: PAT_TA_48587
cggacgcgtgggcgccaacgcgcggcagcagattcgaccgtctccccaccctctgcctgtgtatttttcctccgtcctccttggcgctgagcagggaggcgcgcggggagctgcgggcgggcggcggcgatggagaagccgcgggcgatgctggccctcgcggcggcgctcgcgctgctcctctcctgctccggcgtcgtcgtcaggggccaggacaccgagaggatcnaagggagtgctggtgatgtgctggaggatgatcccgttgggaggctcaaggtggtgacgtctacgagctccccaccaagtacaacaagaagatggcgtccacgcccgcgggcctctacggccgcctgaacaggacgagcacgcgcgcgttcctcgcctacgtcgccgccggggccgtctgcgccgccgtgctcgcctgcttcgtcgtcttctccgccgaccccgccgccgcgcccaatggcgcgccc

SEQ ID NO: 48588 - DNA, 289 bp, Triticum aestivum
  unsure (1)..(289): unsure at all n locations
  Clone ID: PAT_TA_48588
acgcctacgcttactgggacggtgactcgtgtgcaagacctcctcgancaacacatccatcttcaaccccacattggacgtgacattactgaccacgttactgatcagcacggttgtcatggatggaatcatagctagagtgtgctcacttgagcgctcactttatcttttccgttgatgttgaatcctgcttcaaattctgcaaccagaactagatgcttttgtagcccactaataacatgccanattacacccggaaccaccacagatacgacctgagcaatgacat

SEQ ID NO: 48589 - DNA, 481 bp, Triticum aestivum
  unsure (1)..(481): unsure at all n locations
  Clone ID: PAT_TA_48589
agagaatgtaacttncacagataagattgattaggnccttgtgcgcgaaactaagcagagaccaagcagatggagatgttaagaagacaatggattattttgctgagttgaagcagagtgaccctgagttcacttatacagttcgngtagacaatgagagtagagttagaacattgatatggacaactgggaagagcaaattacagtaccactactttggtgatgttgttacatttgatactacctacaggacaaatctatacaacatgtcattcggactatttgttggggttaacaaccattgccagagtgttatatacgcnggtgtacttatgcgtgatgagaaagtagagagctttaactgggtttttagagtttgtcaagttgatgggagggaagaaaccaattaccattctaactggtaagtaagttgtcaattgggtaatattttttttttgtaatgaaaactggttggatctga

SEQ ID NO: 48590 - DNA, 469 bp, Triticum aestivum
  Clone ID: PAT_TA_48590
tcgtggctagagcgccaacatacttgccccacatgtagagctcccattgtccccccggacaatggacgtactgtatcagcgcaacagcatggagctcaaccgggtgttcagcttgctgcaggcatcggcgctccaggttcagaaggagcaacaagtgagaacatgaacaggcgtcaagcaaaacttgaggctgctgcttcagctgcttccatatatgggagatcttttgcttatcctccaacaaacaccttgaatagcaaattgtaatgtaagcacagtgcagcatagtttagcaaaagcaaaccgagcctaagagaatgtgcctttttccaagctggggtgtgttttcttgaagcaggatattatttggcctcagtagctctgctgggacttggtggttagccacttttcttcgatcttaagtattcaggacctctgcgtgctacatcaggtacttcacaatcaggag

SEQ ID NO: 48591 - DNA, 395 bp, Triticum aestivum
  Clone ID: PAT_TA_48591
accaagtcctatccaagctcaatcgtggccgattgctctaaaaggtagtgatattgtagctgtggcgaagacaggttctggaaaaaccctgggttatctacttccagggtttatacttgttaagaacctacggcacaattcaagggatgggccaactgtgttagttctgtctccaaccagggaattggcaacacagattcaagatgaagcaatcaagtttggtagatcatcgagaatttcatctacttgtctatatggcggtgctccaaaaggccctcagctaagagatttagagcgtggtgctgacattgttgtcgcaactcctggtagactgaatgatatactagaaatgggaaaagttagtctccgtcaggtagcttatctcgttcttgatg

SEQ ID NO: 48592 - DNA, 426 bp, Triticum aestivum
  Clone ID: PAT_TA_48592
cccacgcgtacgcaagagagcacacatggcctatctatagtaataccaaaaccaatccatccatccgtccgtgcacgcgtcggagcgagcggcctagcgcaacccatggcgggatcctccgccttgtacacgtactggagggcgtacgcgcgcgcctttctcctggacgaccagccggacgaccaggcgcagcggggcctgctcccggacgcggcctgtacgcggcgcagggcgacgccgatggccagcctggcggcaccgcagacggccacggacgaggcggtgctcgaggtggtgctgctgcaggacgagctggaggaggacctgcatgggcgccaggcgcgacgggaggcctactccggccggcgccaccagtggctggaccagcaggtggagcacgaggtcgactccgagctcggctggggc

SEQ ID NO: 48593 - DNA, 404 bp, Triticum aestivum
  Clone ID: PAT_TA_48593
cccacgcgttcgcccacgcgtgcgcggacgcgtgggctgtccatggcctccttctccctcctgcccccggccaccttcgacaacaagtaccatgcgctgctccacccgcacggcgccaggcaccggctgaccaggtgcggtgccgagcccaccgacagcggcgcggtggacgagctcctcaccggcgcgctgaatctgaacctggaaaggcccgacccggtggtggcgaccgtggtcagcgacactggcaccgatggctggagtgaccttttcaccgagctcaagaggtcggtgcaggcggactcgtccgacccggccgccagcgattcgtcatgcattggcgcggctgtcccggacgggctactgagctcggctctggccggcgaatcggtcaatgccaacgc

SEQ ID NO: 48594 - DNA, 430 bp, Triticum aestivum
  Clone ID: PAT_TA_48594
ctagattctgcgttgcaggtgtttgagcggctgcaaggcgggagggatgtcgcgtcgtggaattcagtgatatcaggctgtatgcagaacggcatgttcttgaaagctctgaacttgtttcgagggatgcagagggctgggttaagtatgaattcttacacaactgttggggtgctacagatctgtacagagttagcccagctgaatcttggcagggagctacatgcagcaattttgaagtgtggcagtcaggttaatatccagcgcaatgctttgcttgttatgtacacaaaatgtggccatgtgtacagcgctcatagagtattccgtgagattaatgagaaagactacatttcatggaactcgatgctgtcctgttatgtccaaaatggtttatatgccgaggccatcaaatttattggtgaaatgc

SEQ ID NO: 48595 - DNA, 478 bp, Triticum aestivum
  Clone ID: PAT_TA_48595
cccacgcgtccgtccgaggcagatgggcgcaactccgtaggcaggactagatataatactgatcggtggtgacaggtgacagggacatggcgtagcttcgctgttgcctttaaattagcttcggtcgaaggggggctagacaagaaccagactccagggcgtcgcctttcttgctaagcttagctaccttgaggaaatggccgcggcgacggcaatggccatgctggcggcgctggcgatcctcgcgccgacggcgagggggctcgaccgcgccgagttcccgcctggcttcctctttggcgccgccacgtcttcttaccagatcgagggcgcgtacctggaggacggcaagggcctcagcaactgggatgtcttcacccacacgcagtctagggaaatcaacgatggacggaacggtgacgtggcggatgaccactaccaccgttacatgggagacgttgagatcatgcatgatctg

SEQ ID NO: 48596 - DNA, 391 bp, Triticum aestivum
  unsure (1)..(391): unsure at all n locations
  Clone ID: PAT_TA_48596
ntccgccacgcgtccggtcttgctccagtatgtgccctctgctggcttcctgtagagcatgcatcacgtgaagttcacggacaaacatggcttcggtgaacgtgttcgggcacccgatgttgacaaacgtcgtacgggtgctgctcttcctggaggaggtcgacgccgagtacgagctcgtgcccatggactttgtcgacagggagcacaagatgccgctacacgtgcaggtaaacaccgttgcgaagatgcctgggttccaagatggcgatctcgtcctgtccgagtcgcgcgccatcgtcaagtacatccttcggacgtacggggggacagcctgtctggacctcctcggaaaaaacagcggtatccaagaattagcaatggcggacgt

SEQ ID NO: 48597 - DNA, 391 bp, Triticum aestivum
  unsure (1)..(391): unsure at all n locations
  Clone ID: PAT_TA_48597
agacacgcgttcgtactcggacttatgctaccaaccaagcagctccatacaccaagaaatccacagaaaccgagatctctctctatctacgccccgacggatcccgggttgttgttgtagctgcgcaatggcgaccgacacgatcctggataccatcaagcctcggctgagcccgctgctggaggaccttccggtgactaatgggggcgcaacgaacggccgcaaggtcgacctgtccggcatgcgccggcgcgtgtcattgaccttgtcactgagcctccagccgntgtcctcgtcgtcgtccgcggcgttccggcacgcgcggtcgatggcgccgatcaaagcgctcgcggcggcggacgcggtgcagtagtggcgggagtgggggctc

SEQ ID NO: 48598 - DNA, 267 bp, Triticum aestivum
  Clone ID: PAT_TA_48598
ggaagctgacaactgcgactgtcggcctggatttcaagtatgctaatctattcgggggggtacccgatccggtgtggtcacccccttgatatctaaaatcacggcagacgtccctgaccgcacgatgctgacggtctcagcgttaatgtcaccaaaagtagctgatgctggggttgcgccatacaacgcagccctatgagtccatcaggtcgttgagaatgctgctgacttcatgaggcccgacacccatgctatgtatgacatgtg

SEQ ID NO: 48599 - DNA, 396 bp, Triticum aestivum
  unsure (1)..(396): unsure at all n locations
  Clone ID: PAT_TA_48599
ccacagccagtgattccactgcgagaggggattctcatgaggtgaaatccgccgtctgggtcgtggccggcagcaagacaagagtagcgccgcccgtctctgacgtgcttcgtcaactggagccgtcgcggctaccgccacctgtctccggcgcgcttcgccgcccggagcggtggggttgaaaggcggtaagacgggagtcgtcgccgctggctagcgccgctcacctcggtcacgccgcgctgcctggggccgtggtcttggctggggacaagatgggatccgtcgcggctatgtctgctcacctcaggcgcgccgcgccgcgctcggncgtgtccttggccggcggcaaaacaggagccgtcgcggctagtgctgcctgcctccggcgtgctc

SEQ ID NO: 48600 - DNA, 239 bp, Triticum aestivum
  Clone ID: PAT_TA_48600
tgcaatagtataggaactgtgattgtgtcggttcttggcgtgcaaattaggtgtttagctcgctgttcgatacatggtaaggtatccaatcatcttgggggagaattatggtctgtttcatcattatagtgttttatgtcgtagatctgacaaggatggtccatttcctgcattggttggacgactcaatgagtatagattgatgttctttcttactagtgccacttctggtcgacatg

SEQ ID NO: 48601 - DNA, 329 bp, Triticum aestivum
  unsure (1)..(329): unsure at all n locations
  Clone ID: PAT_TA_48601
cggctggcaaccgctcagtccgtcccgccccgaccccgcacccgcccccgcccccgcaggtcgcagccaccgccgcggcgccatggcctccgtcacctcctgctcttccaccgttttcacctnctcctcctccataccctaccgaacaaggacgcctcgtccatctctccgcccgccgccgcgtctcgccggccttccgggccgaccggtgctgaggtgcccagctaaacgcgacccgggcgagcagccgctgcttggagctcctgtggtttctgacgagagagaggcgctggagccggcaggccgggacagtggcgggcttgcgccct

SEQ ID NO: 48602 - DNA, 196 bp, Triticum aestivum
  Clone ID: PAT_TA_48602
cagaccatttaggctgcaacctgcaagccggccggccgagggaggggcgatgggttccgacgcggcggcggtgagcaccgtgcgggaggctgcgcgcatgacgtgggaggagtccaagcgcgtctggggcatcggcatgcccatcgccatcggcgggctcagcatttacgccgtcggcttcgtcaccaccatcttc

SEQ ID NO: 48603 - DNA, 409 bp, Triticum aestivum
  Clone ID: PAT_TA_48603
caagaaaagggctgtcctttttggcggtgtagtagatatggaagttgaagctgatgtccttatgagcatgttcatgaacgagctgtatggattccagttggataatcaccgttggtatcctttagagctcaggaaagacaagcctgctaaaaataagacaaaggatatcaaaagaaaggaaacagcaaatgattcagaaagtaatattggtaatgaggatgatgataccatggactgctctgaagaagctactgatgttcaatctgaagttggtggagtttctaatcacttgaccaagagtctaaccttaaataaagttggctcaagccaaaactctgatgtcatgtctgattcaacagaacatgaagcaaccccagaggcaattaagcccattggtcgtatcaatgca

SEQ ID NO: 48604 - DNA, 398 bp, Triticum aestivum
  Clone ID: PAT_TA_48604
gtggacgcacacaatctggaatttgacgatgaggagtagcgcggagcgatcgttctggagcacggctttattactgcccactctgattggaatcacctggagccggacctcgtagacgactaccaagtggtcctgttcgacaccatgggcgccgggcctgtccaacccagactacttcgatttttaccggtacgccacgctggagggatatgcgctcgatctgcttgccatcctggaggatctcgggatcgcctcctgcatctacttcatacactctgtctccgtcgaaatcggagtgctctcctacatctgccgtcccgacctattctacaagcttgtacttctgtccgcttatgccatgacctcaatgatgtggattactatgggggatattgagc

SEQ ID NO: 48605 - DNA, 340 bp, Triticum aestivum
  Clone ID: PAT_TA_48605
atcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaagttcacaggcatggcagcggaaaacatcgacgagaagaggaacacagacaagtggaagggtcttgcctacgatatctgcgacgaccagcatgacctcaacagagggaagggcatcgtgggctcctcttacaagcgcccacgggcgac

SEQ ID NO: 48606 - DNA, 395 bp, Triticum aestivum
  Clone ID: PAT_TA_48606
ccatggacgactggtcggagtttgatcccatctcttgtcgaatccaagccaaaattcctttctttttttcttccttccttccgtccgaatcaaagtggcctccccagctgtgccgggaaggcccatggcgatccaccgccgacgtgagcccctgctgcccgcgctcggcggcgccgacctgctggtgctcctcctcggcggacccggggcgggggacgaacccttcagcgactaccgctgccacgacgcctgccccgggtgcaacaacaagtgccccgcatggcaatgggatagaactgggcgagaggaacccgatgcacccccgttgggcgcatgtacgcaaagcacggatccccctttgcaagaacgttacacggggcttacccgacacccat

SEQ ID NO: 48607 - DNA, 410 bp, Triticum aestivum
  Clone ID: PAT_TA_48607
ctccgccctccaagcgtgctcactcgccttgccagtaggttgcaccccatcctgcccctagttgaagagggagaccgatggcgagcagcggaggaggaggaggagggggtggggactcatgggaaggtgagtgattcatgccatcgacattgtcaaggttaatatccagtttggagatggatctgatacttctgtcaccaagaatattcttgataatgagggagctggttgcttttacaatggattatctgctggcttgttaatgcatgcatcttacacatccgcttctacttgtatccttcagggttctcacaaattatagatgtttatcaaacgaaggaataccactgcccttattccatattgctgctattgatctcactgctggatcgattggagcttgttttttt

SEQ ID NO: 48608 - DNA, 451 bp, Triticum aestivum
  Clone ID: PAT_TA_48608
aagaggagagagccatcatccatgggaggaggcgtcatgcgcaccgtcgcgtaggtctgcctctccggttgcgccgcgtttgctttagtcctctttcgtatcttaataacgttttttttttctttttttgttttgtttgtcttctattctttttcatcttactactcccattttatgttttctatattgttctgaaattttcttttcatttcttattattttattatttgtattctttctgattttttttttttataatgttctttgctgttttatttttgtgtattaatattactttgttcgatatgctcatttcgttctttttgtttctttttttaattttttttatattgtttttttttttttttagtttttttatttattgtttttcttttattttgtttatttttactgtatttctgtatttcttttcatttttttatgatgtttt

SEQ ID NO: 48609 - DNA, 361 bp, Triticum aestivum
  Clone ID: PAT_TA_48609
tctctcctccatcctcctccggtttctgatcgcgaccatgggaacccgcgggctcgccgtgctgctcctcgcggccgtgctgctgcaggccctcctcccggcgtcggaggcggagggcctggtgcggatcgcgctgaagaagcacgccatcgaccggaacagccgcgtcgccaagagcctctccgaccgcgaggaggggcccctcctcggcggcggcgccgccaacaccctgcgctccgaggaggagggcgacatcgtgtccctcaagaactacatgaacgcgcagcacttgggggagatcacgatatgactccctccgaatgaacatatcggtatgtctggaaaccgatcactatttcat

SEQ ID NO: 48610 - DNA, 197 bp, Triticum aestivum
  Clone ID: PAT_TA_48610
gccacgcctccgacacccaatccacttcatcatacacgagaggttaagagacacgcggagaagcgcacggtgcagcacgagctgcaagaaggaccgagcaacagtggcagggcacatgctgagtgacatgctccttgccgggctgctcgcgggcctggtcgtgaactaggggttcacccttggactcgtccttgtcc

SEQ ID NO: 48611 - DNA, 412 bp, Triticum aestivum
  Clone ID: PAT_TA_48611
cccacgcgtacgtctcactctatgctcaaagggggaagaagggatagagtggggagcggagctgagcccacttcagcgggagctctactcatgggcatggcgacctgcaccttctacgcccacccgctatcgctcaagccccaggtcggccccaggccccaccgactacacctagctcgcttaccgcgccttcggtaccaccgacgactgttcgccggcggacgggaggcccccggcgaggcaccggccaagccacaagaggtagctgcgcgcggagcagttcgagaacgaggcggcgagacgcgcccgcctatcacggaggtgctggacgtgctcagggccatccaggatgactgcctgggtcacaaagacagaggaagcaaaggtcaagaaggacttggacgagcccttt

SEQ ID NO: 48612 - DNA, 254 bp, Triticum aestivum
  Clone ID: PAT_TA_48612
ccggcacgttccggatcgaccgactcgacccactcgtccgcccacgcgttcggacatcggccataggtaagcctgccaagcaagcaagccttactcagagcaggcccattctctacctgaagtgcctcccccaacatacttcccaagatgctcaacctgccctaaggtgaattcatctacgccttgaaccatgttatcctcttcagtcctggccggcttgacaatgcttgtgaagcttaacccgagtgctcctt

SEQ ID NO: 48613 - DNA, 223 bp, Triticum aestivum
  Clone ID: PAT_TA_48613
gcagcatttgagggtcttcaaatgcgacacgcccataccactatgaggcagcttgacagtcgacattgacgccaacatcttgatggtcggcacgaagggcgtgtaccagtttggtgacaagaacggcggccaaacgtagacggctacaacccaatctacacgccagatgaatggtatgaatctggagaccagtacgccatctgaacgaccgggctatttattt

SEQ ID NO: 48614 - DNA, 133 bp, Triticum aestivum
  Clone ID: PAT_TA_48614
gagcggtggtccctgttttccctccatctgagtcgaacgtcgtgcgggaagggaggctaatgttggaacccagccccgtatagctgcactgtgctccatccataattcttgtcctgtttgacacaaacacctt

SEQ ID NO: 48615 - DNA, 165 bp, Triticum aestivum
  Clone ID: PAT_TA_48615
gacccacgcgtgcgatttgagcgagcagcaataatcatctagtggagtggagtggagtagtacaattattgatggcctcagactacgatcgccttggtgcgctcaaggcctttgacgacaccaaggccggcgtcataggcctagtcgatgcggtcgtcaccacca

SEQ ID NO: 48616 - DNA, 369 bp, Triticum aestivum
  Clone ID: PAT_TA_48616
cccacgcgtccgcgaccaccgccgtcagacgaggaaggtgtgcccggcgtccatgggctggaaagagcgccgcagcgatggcgcgcgaggcaaccgcagcggcggcgcgcgaagcaatcgcggtgccgttattttgggagataaaacacattttggtgatgctttggaatgggagaacatgacaagaggaggagttaatcataacacatgagctgctattctggaacatgataaaacacattttggtgatgcttcaaaaagggagaacatgacaaacagtggagttaatcataacacaaggccctaagatttgcttgtgggcaggaaggctggtccttatgatcaccatgaacaaatcacaagcgaatt

SEQ ID NO: 48617 - DNA, 411 bp, Triticum aestivum
  unsure (1)..(411): unsure at all n locations
  Clone ID: PAT_TA_48617
cccgtggccatggcgctggtctcgctctcgctctcgcccccgtgcgcgcccgccgcctcctcgtcttccagccacctcctcacgccgccgtcgatcgccggcggcagcggtagcatcaggaggggagggccacgaggcaacgccggcctcgctctgacgctgccggccgggcgtcggggtcgggagtggagggcgccggtgtcgtccttctactccttcctgccgtccttcttgacggggagcaagaagaaggaggaggaggacgccaagaaggcggcgacgctcaaggaggagctgctggcggccatcgcgccgntcgaccgcggtgccgaggccacgcccgaggacaaggaccgggtctaccagatcgcgcagcagctggaggaggtgaacccggccaaggagccgctc

SEQ ID NO: 48618 - DNA, 248 bp, Triticum aestivum
  Clone ID: PAT_TA_48618
agctggtgatgagttcggtattggcatagttggcgggtcttctctagcacatatcgggtctcctgctatgcaatctaccatggtgcgccgacgactagatactgcaattgagtcatctgcatcattgcccagcacccaagaatctgtacaaggcgaagaggctgagttcgtagaagattcagcccccattgccacccctataatttcaaggaaagataccgcaactcaaactagtccagatctaagta

SEQ ID NO: 48619 - DNA, 261 bp, Triticum aestivum
  Clone ID: PAT_TA_48619
ggcgcttgtgactgtgctattgcctcgagcgacagccgggctagcaaagctgcccgagccggcaacgccagtgagctggagtctgcgtcatctgagtcggcggcatgtcgaagtggccggcagcgacgactaagaggctgaagcgcgctctctggccgccggaggaggacgagatgctcaggaacgacgttgcccatcacggatacggctgctggagctctgccaccaagactgcaggccttgagaggtgtcggaagacgc

SEQ ID NO: 48620 - DNA, 375 bp, Triticum aestivum
  Clone ID: PAT_TA_48620
cccacgcgtacgccaaatcaatcaaaccgcgccctcgaagcacgcgcagcagcagcagaagcaatggcggccctcgccgacctctacggctccccgaccctccccatccactccacctccgactactcctcctgaccgtcatgctgatgccgtttccgaccagccgtcgactgcgcgtcgcgccacccgcctggctcaagcagagtgacgcgcagactctacaagtgtgggtggagcactagatatcgccacagcgaaggcatagacttatggggcaggggtgcggccggattttaggccttaacgacgcacatggagaaggtgctcaccatcagaaaaagagagaggcagttcacaaatatagaggacattgga

SEQ ID NO: 48621 - DNA, 402 bp, Triticum aestivum
  Clone ID: PAT_TA_48621
ctactatttcgatttctcgtggtgctttggctgattgttgttccttccttttgctggaattttccgtggtttgcgcagctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtaccgtgttgagtccaccggggtattaatgacaaggtcaaggc

SEQ ID NO: 48622 - DNA, 460 bp, Triticum aestivum
  Clone ID: PAT_TA_48622
caacctgctgctctcggcccaggttgcggtccgtggggacggacccgaactccatcatgtaccgcaggctcacccccgtctgcttcatgctgccccaccgccccagttcctgcaaaaggagctccccatccgcatcgcccgccgcgcgctcgagctcgagtccctccccttcggcctctccgccaagcccgccatcctcaaggtgagggactggtacttggactcgttccgcgacatccggtattttccggaagtgaggaatcgggacgacgagcttgctttcacgcagatgattaagatgatcaaagtgcggcacaataacgtggtacctactatggctttgggagtgcaacaactgaaaaacgaacagttcagctcaaggaagcttcccccaggattcgatgagatccacgggttccttgatcgattttacatgtcaaggattgtattcgcatgctca

SEQ ID NO: 48623 - DNA, 219 bp, Triticum aestivum
  Clone ID: PAT_TA_48623
atcctcctagaactcaaggcgtggtcctattttgagcaaggagatgaagacatgtatgtatattgaccgtgctctggctgcaggctcttgatacgaccactccatctatgcccattgcgagagaccatggtttcgagctgcacttggacatcgttgaccgacatttaggtctgtatgaggaagctgctccggtccgactcgtttaataaatggttactg

SEQ ID NO: 48624 - DNA, 343 bp, Triticum aestivum
  Clone ID: PAT_TA_48624
gcggctggacgtgtcggggaacaggttcgtggggcctttcccggcggcgctgctgtcgctgccgtccatggagtacctgagcatcgccgggaacaggttcaccgggcggctctcgggcaacgcctcctgcggcgagaacctccggttcgtggacctctcgtcgaacctcctgacggggagcctccccggctgcctgctagcggcccccgggaagacggtactcttctcggccaactgcctttccaccggcgacgactcccagtcccagcacccgtcgcctttctgccggaaccaggcattggccgtcgggatcgtgcctgagcagggacgcaagaagagtggc

SEQ ID NO: 48625 - DNA, 378 bp, Triticum aestivum
  Clone ID: PAT_TA_48625
cccacgcgtccgggagatccaggtcccggcgctcgtgctccgcgtgggcgtcgacgaggcgctcggctccggtgactcggtggccgccgccgtggcacggggcgtggggatcgtcgtgctcgaggccggggaggagggcggcgggcgcgcgtacgaggctgcacgcgcgctcaaggccgcggtaggggaccgcgcgtacctgctgatcgcggagcgagtcgacgtcgcctccgcggtcggggcgagcggcgtcgtgctagccgacgatggtattcctgctattgttgcaaggagtatgatgatgaaatcaaactctgactccatatatctcccgcttgtcgctagaactatacggtcctcggactcttgaggaagcgc

SEQ ID NO: 48626 - DNA, 433 bp, Triticum aestivum
  Clone ID: PAT_TA_48626
ccttccttcctccctcgctcgcacgcccaaaaagcctaaccacccggcccctgcccccgaccaaacccgcgcgcggccgccgcgcctcgcgtctcgctcgccgccgacgcggtccggtggtggtgggggcctcgccgcgatggattgggcggcggtggcgtacacggcggcggcgctgctgtgcgccgcggcggccaccgtcatcacgctcggccacatctaccgccacctgctccactacgccgagcccatcttccagcgcttcatcgtccgcatcatattcatggtcccggtctatgcagtgatgtcatttatttcccttatcctaccagacaatgcaatatattttacctctatccgagaaatctatgatgcttgggtcatctacaatttcttttcactctgcttggcatgggtgggaggacctggggct

SEQ ID NO: 48627 - DNA, 343 bp, Triticum aestivum
  Clone ID: PAT_TA_48627
cggacgcgtgggcggacgcgtgggttctcgcctccaggtccaggtcccggcccgctttaaatccgcccctggcctcccttccggcctccctccctccctcgctcgccgctgcttagtggagtagtataatcagtacagataattattggcagccagatattttcgtccgctcagttcagttcactacccgcggtggccgcgagaacccggatcgccgatcgacagatggacgcggccatatccgccgcccacgaagcgccgcccgctgtcgtcctcgtctccgccggcgccagccactccgtcgccctcctcgcgggcaatgtgctgtgcacgtggggcaagg

SEQ ID NO: 48628 - DNA, 443 bp, Triticum aestivum
  Clone ID: PAT_TA_48628
gtaacatgaacatattgaactggactgatgatacactaatcagttaattacttaactcgataaagataattcaagtgagacacctagtcacaagtaagcaaaagtccacaatgattttgttgttggacgataaagtgtgtaaatagccacatgatccatgtgagcatttgtatatgtattactacaactttatatgattattataatagcaatgttgatgaatagatggaattgcaaaatgtacatgtgattaagatatgcaaaggcatattgatgtgtgcattttgctccgcgttctcgttcacatttttgcactttagcgttagcattttttatgttttaccatggttgtgttgcacttttgccctgatttattcgagagtataaactatgggcacttggattattggaagaaaaatccctttttggtggcatttattaag

SEQ ID NO: 48629 - DNA, 471 bp, Triticum aestivum
  unsure (1)..(471): unsure at all n locations
  Clone ID: PAT_TA_48629
atagtctgatctatgtatggcttcaagccttgaaggtcacgtagcactaccttcaccacaactcgcaggtcactagcatggccatgaagcaggctaaatatcagttcttattttcttcttctgctaccgtgctacacctaaggaggagtgaactgaagctactttcatcgccatctttcctgtccagcactagttctgctcctatctcttctttacatcaaggtcatctccgattggtcccatctgcaagccctacagaacaagtactattaccagatgattctcattcaacaactcctaatggcaccagcagtaatggaaacagaaacaagggaaggaggagaagcaggagaaagagncaggagacagcaaaagaagaaaaggaacgtgtaccatctgcagaagagtgtccatcagaatggctgaggcctatgaaagtggtgacccccttgggcggaaggagctgggccg

SEQ ID NO: 48630 - DNA, 391 bp, Triticum aestivum
  Clone ID: PAT_TA_48630
ctgatgcttccgtgatacggactaagaaatggagacacatgctgatctgatatagcgagggtagcgcgcacctaaatagctctacttagtgagttatttgcgcgtgacatgcgagacttagcaagctgacttgcattgatggtgaaactgatgggtggtgctactacgttctatgcctagtgctgcggtaagacactgctcgattctgcacgaacgccggccacgattgctcggcgaaatagtaggacccgtggcttgttgcgaactccacggtggatgtatacaggtgggtagcctgcgatctatgagctgcgacacgatattgactagcaggagagctgatgaatgatcaagcgttattgtactaagcatcgaagagtagacgagccat

SEQ ID NO: 48631 - DNA, 344 bp, Triticum aestivum
  Clone ID: PAT_TA_48631
caaagaggaatgtgttaaatatatggaagataaaattatttgcaagcaaactctgcttgtttgccatattttgcgcaccgtcttaaaattatttgtccaatggaaggactctctgcaacatcaattccagtatgttgctttagttgttctgtgtgatgcaaggtaatatttttcttgcaatttttgcatcttttaccttttcacttctgttgagagaaacatgttgtttcttaagaagatattgtttataagacggaacaatactcaccatatatgatattcttccaccaaataaatattttttgagtgcaactaaaatcgttttccttctcattcatgatact

SEQ ID NO: 48632 - DNA, 472 bp, Triticum aestivum
  Clone ID: PAT_TA_48632
atcttggttcaatgcagttctcgggagacactataatgactgggaaaatgagttttataggctgcacaacatggaaagcacaatggactttgatcttggatggagtgacatggtgagctgctatggattacatggaaataggcacattgctagcttatttgcatcacggaagctttgggcatcgccatatttgagaggacattttttggcagggctggctgctttgccgggaatttcaaaaataaaggattttattcagcggttgttgagcgcccaaacatgcctatcctgtttcattgagcaggttgcggtagttgttgactacaaagatcaagctggggaacaacaaatagtgcaacaaaactcggaaaatacaattctgaagacggcagctccagtggaaggacatgctgcagctgttttcaccccatatgcattctataagctacaggatgagcttgtagaggcagct

SEQ ID NO: 48633 - DNA, 456 bp, Triticum aestivum
  Clone ID: PAT_TA_48633
tagatattgagcttgtctccaatatgtgccataacaagggagcattgctatgcattgatagcacctttgcgtcccctatcaatcagaaagcacttactttaggtgctgacatagttgttcattctgcaacgaagtatattgctgggcacaatgatgttattggaggctgtatcagcggcagggatgagctagtctccaaggtccgcatttatcaccatgtagttggtggtgttctaaacccgaatgcttcctatctgatcctccgtggcatgaaaacactgcatctccgtgttcaatgccagaatagtactgctctgcggatggcccagtttttagaggaacatccaaagattgcacgtgtatactatcctggcttgccaagtcacccagaacatcacattgccaagagccaaatgactggctttgggtggtgtgcagctttgaggttgatgggga

SEQ ID NO: 48634 - DNA, 386 bp, Triticum aestivum
  unsure (1)..(386): unsure at all n locations
  Clone ID: PAT_TA_48634
atcaaatccaccaccatttctgcagatttcagctcactcccttccgaattcggctcggtttccaatccacatggagctgcagctcactcccctccgcagcctcccactccactaccgcaccaccaccaaagccacggccacagcaacggctaacaccgtctccgcatgctcggtggaatcccaagcgctcaagccacgcccgcagctcccacggcaggcgcccttccacagccgcaggcgcagcagccccgtccacctnccttncctctgcgccgccatcgagcggctggtcaccgaagggcgtcaccgggaggcttgcgacgcgctcagggacgctcgcgcgggtgcccccttcgtggctctgccagcttccacctatgacgctc

SEQ ID NO: 48635 - DNA, 377 bp, Triticum aestivum
  Clone ID: PAT_TA_48635
caagagtcctcactcgctcattctctccaccgaggccaagggaagggacgaaccgaacggaacggggcgacggcgatggcggcagcgaacggcggcaaggggttcgaggtgccggagctggacatcaagttcaccaagctcttcatcaatggccagttcgtcgacgcggcttccggcaagacgttcgagacgcgggacccacgcaccggcgaggtgatcgccaggatcgccgagggagacaaggccgacatcgacctcgccgtgaaggccgcccgcgaggccttcgacaacggcccatggcccagaatgccccgctgtgcaagggcccggatcatgcacaagttcgcggacctggtcgaccagcacgtcgaggagct

SEQ ID NO: 48636 - DNA, 266 bp, Triticum aestivum
  Clone ID: PAT_TA_48636
tcgcccactctgcttactaagatcacttcatttacttaggccaagggaaggcccgacgtcttcagaacggggctactgtgttagcacagcgaacggcggcaaggggttcgtcccaggattgaccggtctttcagcactttcattgtcttatccggaagtacgggtcgacacggcttcctgcaagacgtttgagacgcgggacccaccccacccttaggtgatcgccaggatcgccgagggagacaaggccgacatctacctcgccg

SEQ ID NO: 48637 - DNA, 337 bp, Triticum aestivum
  Clone ID: PAT_TA_48637
cgacgaccggcaagtgccgttgtggagtcccggcctccgggagcaacagagaagcgtcgacgatctcatcagggcacctccccgacgacgtcctcggcgccgtcgtctcgctcctccccaccaaggacggcgcgcgcacgcaggtcctctcgcgccggtggcgccccctctggcgcttgtccgcggcgccgctcaacctgtcgatcgaccgtcgtttttgcgcgggcggcactcgcttggacgttaccagcgtctccaggatcctgtccgaccaccccggtctcgcccgccggttctctgtccgccaggcctttactactgggccagatcgaccgtt

SEQ ID NO: 48638 - DNA, 278 bp, Triticum aestivum
  Clone ID: PAT_TA_48638
agatctgcgatccgatccgatccgatccggccggcgatcccgcgcggcgcggcggagggcgggatcgatctcagccatggactcttcttcctcgtcgacggcgtcgtctttccaggcgcaggcgcagccggacttcgactacctgttcaagctcctcctcatcggcgactccggcgtggggaagagcatcctgcttctccgattcacatgggactccttttaggacctatcctcgaccatcggcgtttactttattgtgaagattggttaacatttgt

SEQ ID NO: 48639 - DNA, 185 bp, Triticum aestivum
  Clone ID: PAT_TA_48639
atgaactggagactgatcggtatatgtcctcagcggctgtgtgcccgcgtagctaccgcggcataaagagcaaggttatgtcaatctgcgccgtggagactctaccggcgagtgtgttgagaaattgataaagccgatcaagctgttagccagcccttaagctaggaggatgaggatttgcacca

SEQ ID NO: 48640 - DNA, 427 bp, Triticum aestivum
  Clone ID: PAT_TA_48640
cggacacctcggtggccgccgtgggtatggatgcgccccacgacgagctcatggagctgataagggaaacgccgcaaggccaacaacccatggagctcaaggtgatctcccttgttgggttcggtggcatagggaagactctcctcaccaagcatgtgtacaacacaactgagagcgaatacaaagcacgggcttgggtttgtgctgcagagaaaggctcaagagatgttctcaaggagatactttggcaacttggaatgcattccaccattagtagtagtagtggaagtgcatgcaacccctgccgtctcagcaataacatgctttgtgcaagcctaagagagtgccttgggaccaaaaggttttaaattgtatttgatgactttcggagagacttttgggttgatttaaaagaagtttttccttg

SEQ ID NO: 48641 - DNA, 450 bp, Triticum aestivum
  Clone ID: PAT_TA_48641
gtgcgacgccggcggcaaggctgctgctactgttgcttttgctgctcgcgcgccgttgttcgccgcgccgaggctgcttcactcgtcgtcgctccctgccggcgaccgcgccgcggtcatcactgggagccccgcgcgggactccgagacgacggccgcctacgccatgagcccgacctccgtgctggacgcatcagcggccttcggctcgaccgtggacgccggcgggggcaagcgccggccgtggtgcgacgggtgcgcgggcccgcacgggctcgccgacgtgctccactgcgcccacgaggcccagcggaggaagagcgtcctccggagcaccgtcagagcgcaggcgccggctcttgtcaggtcgtgctccctggaccggggcgtggagttcggcgtcaagaacaagagctcatggctgccgctgcgcgccgcccgcgcgggggc

SEQ ID NO: 48642 - DNA, 248 bp, Triticum aestivum
  Clone ID: PAT_TA_48642
agccgagctgagctgagcctctccagtctccaccgtccgtccatggcttctcgagccctcgccgcgtctgtccatccagccgcgcctcggcgggagcgcctcggccctcggacggcctgccgtccgtgtcagcgccaggccgccgcggcggcgccggtccatggtggtgcgggccggcgggccgccgagcaccaacgtgctcatcctcgccttcgtgctcccgctctcgctcttcgtcggcaccctcg

SEQ ID NO: 48643 - DNA, 247 bp, Triticum aestivum
  Clone ID: PAT_TA_48643
ccaatcctccccactctttttcccacacattcatccactcttccaaccacccttccactcactcttacgtaccttctactacatgtcttataacatcgttattttttattgcatcctccttaagccaatcatggtgaccccttcttcttatttcaattacacttccacccctaattaattatccatctacacccttaaacttctacaaataaagatcccttcttccgtctatatcattattatcttt

SEQ ID NO: 48644 - DNA, 460 bp, Triticum aestivum
  Clone ID: PAT_TA_48644
cccacgcgtccgtaagaggagagcgagagcgagagagagagagcgcttcgcctgaggtgatggagcttctggggataccacgatccctaccgattcttggaggtaggacggtagctccacttgcttcatcacttgccgattcatacttccactagtagatgccacttgcccaccacctgcttgtgtaaatgcccagccgtaactaggtccccagtttaccagagttcttgcttacaaaccaccgggagaaagcataacctgaatgggggtcggcctgcacagtgtgcgacgagtcacgatggagcttttatctcacatgcaaatggtgctccaaaggattcaccttcgccagatagtttgcttcgtgatgctcgcatcctctattgtgctttttctgccatgggtcataacaaggaagcactatccagaatctaacaaatgagtgccagcaatagttgat

SEQ ID NO: 48645 - DNA, 457 bp, Triticum aestivum
  Clone ID: PAT_TA_48645
gcgcacccgccgtcgggcatcgagtccgccctcgccgcccgcgccgagcgccgccagcgcgcgcagctcgagggcaccaagtccaccgcgcagcgcgccatcaagggcctccgcttcatcagcggcaacaccaaggccagcaacaacgcctggatcgaggtccagcgcaacttcgaccgcctcgccctcgacggccgcctctcccgcgccgacttcccgcaatgcatagggatgatggagtccaaggagttcgccatggagctcttcgacacgctgtgccggcggcgggagatgcagtcggaccacatcaacagggaggagctgcgcgagatcttgtcgcagatcaccgacaacagctttgactcgcgccttcagatcttcttcgacatggtggacaaggacgccgacggccacatcacggatgcggaggtgaaagagatcatcatgctaagtgcgt

SEQ ID NO: 48646 - DNA, 396 bp, Triticum aestivum
  Clone ID: PAT_TA_48646
ggaggatttgatggagcaccttgatggagctgatgaattgcaaacaacgtctattctgggtagatctggatacctttcccagcaggaaattaagtctgatattctgaaagcaacacagtctctaagaaaagcgaagggggagtccaatggcaatgaggagaacgcagatgcttcaggagctgataagtacccacttgtatctgtccctgatgacatgttgacaccagagcagttaaaggaaaagaagaaacagatactacttaaaactacgacagagggcatgctgcgcgccaagcataggcgtgccgaggaggcatctttgaaggagaagcatgaataaaagaggcccacggataaccctatgttttactttgaccgagctttttgcccgatatt

SEQ ID NO: 48647 - DNA, 187 bp, Triticum aestivum
  Clone ID: PAT_TA_48647
gcggactgaaccatgcataccttgaagaccggtggcgcatttaagtcctactccaggttacgtggatattgcgtcatgatcgacccgcatgtcatgacgacgtggatattgttgtatcaaatccacaagtgccagcagaagattggcatcttagatctcccattggagaccagagcatcaattctta

SEQ ID NO: 48648 - DNA, 202 bp, Triticum aestivum
  Clone ID: PAT_TA_48648
ctacccgaattgcgggctcaacccactcgtaccaccacacgagcggagtacttaagtgcttgggagtactagaagagtgaccgccatgaagactttcgattgcttgagagctagctagccctgaaacttgccatgatggaacagcttgattgccctgttactttgaacgatggaacagccgtcctggaggacgaactgaggc

SEQ ID NO: 48649 - DNA, 260 bp, Triticum aestivum
  Clone ID: PAT_TA_48649
acggccaagcatgcgattccactggccatcacctactgcataccatggccgccacctgccgcttagccgcgccactgggaatagccccgctgtctcgcaagtgaccccgcaccaagagccacggtcactgaataggcaccaccaaggtagctacacgtacacggagcaccccggagagggcaagggaccgctcgacgcatacgccaaaaatgctgacaggtgcgcaggacgcaccatcaaaagttgaggacaagtacgcc

SEQ ID NO: 48650 - DNA, 187 bp, Triticum aestivum
  Clone ID: PAT_TA_48650
acgatcaagctttatgagaaaggctaaccctgagatgatagcggtctatttgaagatctcgcatggagatttcagaggcctgatagtcgtcatctatgggagaaatctctttatgaatcgcctgcaatctagagaggaaattgaggaatctttcactagagttgctgaggctgaatcatatttgact

SEQ ID NO: 48651 - DNA, 235 bp, Triticum aestivum
  Clone ID: PAT_TA_48651
tccgcgacgtacgagattccgcaattcgacacacgcgttctggcactcgtgcgaacaaacgcacactcaaactctagagataggggagtatgacggaggctaaaaccatagagacaggcgactataacggcaccgacgtacaaggggaagacgggcaaaaccaacacccacttctgctaggagaacgagggcatcgacagagccatgactatctccatagggaggctgcagaaga

SEQ ID NO: 48652 - DNA, 140 bp, Triticum aestivum
  Clone ID: PAT_TA_48652
agccacacgtccgagcttatgctctgctcaggcaagtggcatgtctaagagaataccttgcagcgaattcaggcctcacacctgattatccttgaacagtcggggagtccaaagtatttggatacctgatcatgcagagt

SEQ ID NO: 48653 - DNA, 238 bp, Triticum aestivum
  Clone ID: PAT_TA_48653
tggatggggtagatgctagagagctcacctgagctcagcctaaagaataccgggaggaggatatggaacctgtgtagggaaacaatgcgggaggatatgcaaacactgggggatacggtaacaacacaggatacgggaacactggcgtgggatatggaaacaacacaggtgggtgccagcatagcgtaggatacggaaacaacacaggtgggtgccagcatgggggggatacagaaac

SEQ ID NO: 48654 - DNA, 162 bp, Triticum aestivum
  Clone ID: PAT_TA_48654
tcggaatttgcatattttggggtactaatagatgattatactctgatgatcctggagatgaattcacatttaatttcgatgtgttctgtgatgtaaatacaatgaaattaagtgtgttaattgaaatttcaataagatctaaaaggagtcttcatgtcccgt

SEQ ID NO: 48655 - DNA, 301 bp, Triticum aestivum
  Clone ID: PAT_TA_48655
tacgccggtacgctccggcgtacgggtactgaattctcgcaacgactcacgcatcctatgacttcagatcttgcgaagacatgagccggatagtatctgagggtgtgaataaacagtcacactgctggctatgagagcggtcaaggagaggcatactgggtacacactgaacggggcaagactcacgctatgcgggatacacggaacgtacaccgttgacctatgcgatgagactgagaacgtacatcctgatgctttcagcatgaagctacaaagcctgtacgactgagggcaaaccgac

SEQ ID NO: 48656 - DNA, 224 bp, Triticum aestivum
  Clone ID: PAT_TA_48656
gcaggaggattcatggcgtaccagggggatcgggtgactggaatacagcagctacaagttgcttcagctgaatagactatcggaatgacgagttccttgagatggagaatggactggggtcaagcggagctagcgacgggacacgggccgtggttgagcagctgtagagacatgaacaaagcaaggggagcacagctgcggaggtaagggggactatagatagg

SEQ ID NO: 48657 - DNA, 273 bp, Triticum aestivum
  Clone ID: PAT_TA_48657
attctgccacggtccgtgcacacatccgatgaccagtgtgcgcattcgcatgataagagcccagcttctctggcagacgatgcgagaggctggctagacctccgaggaactccctgcgggacgcttgctatcacaacggaaacctacagaccgtccctaattgtgcagtaccaacactatgagaacgcttctcatttttgagaagcggcatgtattgtgtgctcacccactgtgctaggtgggatgtattatgcattctgacataatacttga

SEQ ID NO: 48658 - DNA, 347 bp, Triticum aestivum
  Clone ID: PAT_TA_48658
tcactatagggtaagctgtacgcctgcacgtaccggcacccgtattcacatgtcgaaagaccaataaaggcaccagtaacccaagtcgcgtcaggcacccatgtactttcagagatcttattagcctagatggcacatgctatcgaggctcatagggagggcgcagaggtataccaccgcgcgtcactgggcgcgcgcaaagctgtacgactgctcgccgctaccaacatgccactgggcctgcttgctctggcggacatacatgaggtgggctacaatcgcgctagcggatttgtgtggcttcgcctgaaaaaggcgctcacgcacaccgtgaatcagatcgggcg

SEQ ID NO: 48659 - DNA, 287 bp, Triticum aestivum
  Clone ID: PAT_TA_48659
gcgcccacgcgttcgatcacgcgtacggacacgggtccggttaacgtcgatctttagtacagaaaaggaccgtgtgaactggccgatctactttaagatctgcgcatgacggcacggggaccgctgatgctgcttgtacaacaagtggactgtctcgcccacactattactctggaacatgtaccacagggcaaacatgatcaccccgggcgtagacacgcagggtaacccgattgacaccaggacgattcagggcgacttagaggacttcgacgaggacataatct

SEQ ID NO: 48660 - DNA, 196 bp, Triticum aestivum
  Clone ID: PAT_TA_48660
gcaacgggaaggaggaagccggcgagcaatgctagcatcagcaaggaacgagaaggtgacccatcctactatggggaaggggccgggtgaggtcttgcgcacctgccggcggacctcatgttgactttgtgaggcaccaccttttcctctactctgcaccattagaggcggcacctttggcttaacacccccctac

SEQ ID NO: 48661 - DNA, 265 bp, Triticum aestivum
  Clone ID: PAT_TA_48661
tcgtgcacacatgcggatgtgcattggtaatctatgactgaggagatggtgaagctgagtttagttaatggtgagctagatagtgaagacaaagtgctgactgcctgagctatattgtttgaatcatgacacaattacctaaagatatatttagtctactagacagaggctctcacgactcggataatactcttagagaatgacttgaacgccttgaaaagtatctgccacgaattggctgtagaacttgagagctgcatggcgc

SEQ ID NO: 48662 - DNA, 164 bp, Triticum aestivum
  Clone ID: PAT_TA_48662
atgcgacacacacacagcgatgctccaaaaacaaaaagcgaagcacggagagcgagctaccatcacgaaaatccaaaccttaagcaacggcaacaccaccgagattacgcttctgatgcaagggggatgcgcattgatatcggcgccccgatccaatggcacgc

SEQ ID NO: 48663 - DNA, 299 bp, Triticum aestivum
  Clone ID: PAT_TA_48663
tactcgtgcacgagagaaaagacaaccctagcggcgcgcctgggcggaagcacgagcaacgccgcgaggggatcgacggccacaagcaccgatcgtagcgtccgcgccgccgcgggcaacatgagatcctaccccacgtggcgccagggcccacttcctggtgaccacgagcttgcgcgaggactaccgtcataacgagggcctgccgattccggcactggcaactagccggtgcacgcatgactgtatgaggaccaatttccagctgacagaaagtgaagatggactggaatgggaaa

SEQ ID NO: 48664 - DNA, 227 bp, Triticum aestivum
  Clone ID: PAT_TA_48664
actctagctcaggtcgcgccatatactgtgtcagacaagagtgcttgaagtgccatcttatatgaatgggtcgagactataatgggtattgaagctactagcggtctacgtgtcatgcgctattaacatttagggtagattgttgtcaaaccgcgatatcaagtgtaagacatgttgctctgaacatactcatgagggccattacactatattcacaagccgtacag

SEQ ID NO: 48665 - DNA, 311 bp, Triticum aestivum
  Clone ID: PAT_TA_48665
acactacgtcactgtatcctactcgaaccacagaacactggcgacgagtccggcgctgagaggtgagatcgagcgcgagtagctagccgatgagccggctcttttaccggcggcacctcggtgccgtcgcgggcgtctgacgatcccgcgatgtgttagcttgcaggtggatgcacacgctggcatatgcgacggtgtactgcaaggagatctgtgggtcaagcccgtcaggagtgcaaaatggagtgcaggggaaatggctaaagactgctaactggaattggatagtggatccgttaaatggccaaaaa

SEQ ID NO: 48666 - DNA, 358 bp, Triticum aestivum
  Clone ID: PAT_TA_48666
cacccgaattgcgaggtacgaccgacgcgttcgtccacgcgtcaggagacaagtaagggactagtgttcggtcgaacatgatacatgggcaggaggattgtatggtcgagcctaccccataggcacctgacctttatactgatgcggtcgtagatcggcctaaagatcaatgagctcctactgctgatgccgttcaaagcgaatggagcgctcttcgtcgaggcgtgaatggaggaccaccggagccttgtggcctccgcgaaccatgcggacttggtggtgtcaaccatgtgcaggcgatactagatgctggaaataacgctcgtggacgaccataaagaagctggaaatatccagc

SEQ ID NO: 48667 - DNA, 188 bp, Triticum aestivum
  Clone ID: PAT_TA_48667
aggacacgtgggctgcaaatgcaaggtgcgtcgaagacaagggtagcacctgatctgcttgaatccagaaacaatggcaagaggggctcttctgaaatcacgcttccttcccaagaaggccaaatggggagccactcgcaaggtcggccgcgccaagccggcgaccgtgtgcatggttgaacctgcca

SEQ ID NO: 48668 - DNA, 203 bp, Triticum aestivum
  Clone ID: PAT_TA_48668
tcatgcgtctaaacttacatccaatcaatcgagttggggtgtttaaactaagatacaatcatattccctcacgatgctatatcaatagggcaaactattataccgctatggtatatgaagagggacaagtagtataccggaacggcaaaacaaaagggtgctctagacggtatgaaaaggacaacaatgtttagtgctaaagg

SEQ ID NO: 48669 - DNA, 326 bp, Triticum aestivum
  Clone ID: PAT_TA_48669
tcccatgcatccgaggaaccacgccgacacgcgatccactatatgtgaattgagaggtttaaaagcaatgaaccacaagtgctggaagagctgagacaggaaggagcgcgcatcaatggccaggcacaggcttcttgccgtactcatggccgggctggtcgtgggctctggtttcagacaggccgccggcgctagcccgggcctatgccagaagctgcgccagccggagcccaagccgatgccgcactgggtgaccatgcccgaacccaagccacagaccatgcctaagtgtgtacccatgcccaagtgcgaaactcagactctga

SEQ ID NO: 48670 - DNA, 188 bp, Triticum aestivum
  Clone ID: PAT_TA_48670
agggacagacgactgggccattgcctgctttcagagtgacataggccatggcgctggcgaggtcccaccggtgcctctgccgcccctccgcttcggcccctcgcgagctgttgcgaggatttcgtttcaatgtatcaacatatctaacgaggagggggcgtccatatagacagttagactaaccagtt

SEQ ID NO: 48671 - DNA, 291 bp, Triticum aestivum
  Clone ID: PAT_TA_48671
cttcggacgaggacgcactaagctcatacgagtacgcaagacgggggcttaagacgtacgacttgcacaacaccacgggagggttgtacatcgctcctgctaccatgggcacgcttgcagcacatatatccaagaactttatgaccttggccaacatcaagatcccagtcatttcgtgtatctggagaggcaagggtcaaggaaaatccttacagcgagagctagtattgcccaagatgggcaatagcccaatcatgatagagtgccgcaaagctataaagcggcaacgcc

SEQ ID NO: 48672 - DNA, 279 bp, Triticum aestivum
  Clone ID: PAT_TA_48672
acggcagtgctgaagaacgtcttgtccaacgcgaaagacatggatgtggaaagccaaatccttgcctgaagccttggcttgagaactttaaagagagcgctgaagggtggcctgcatattgataacgctgtcgaggccgaaagccttgccgataaactgctcaaccaggtgctagtggcaaagctaactgctccacaaacttatgttgtgggcaaggtctacttatgggaataaatgtcgctaagaaaagtgatggactatgcgatcaaccttgctagg

SEQ ID NO: 48673 - DNA, 283 bp, Triticum aestivum
  Clone ID: PAT_TA_48673
ctcagcacctgccttctttctcctgagcgggggacagagcagaggccagcgcggccttcgtgctggtgcgtgctagagccgggcctcggggttggtctgtggactgagcgtgatccgttgccgggctggttcgggctccgaccgacacccgacgacagccatgggcgggctagaagagatcaggaacgaggccgtcaatctggagaacatacgcatcgaggacgtgtttgagcagatgaaatgcacgcgccaggggctcacctcctatgagggggcgcagaga

SEQ ID NO: 48674 - DNA, 140 bp, Triticum aestivum
  Clone ID: PAT_TA_48674
atgccgtcctcgtgctcctgtcgatcgagacgcgaccgctcattcttttgcgcggagacccagaaacggtgcaggactttagccatgcggccggcaccaaccgctcaagcgaccatccatcgtacccggggatcacgtgc

SEQ ID NO: 48675 - DNA, 283 bp, Triticum aestivum
  Clone ID: PAT_TA_48675
tcgtcggcgcgacctttggctagagaaggcaaatattcggctgcctgatctataaaaatccatatcacattcgcaagcgcgaactcccttcccggatctggaactagccagctttccttcctatccggatagccaagatcgacatccttgctatgttcggcgagagccaacacgaactcgtggtagatgctgtcgttcaacatacacgactggttcttggaagcgatcgcgcggacgaaccgctctggccttctgagacaagccgataactacaacctctgcc

SEQ ID NO: 48676 - DNA, 286 bp, Triticum aestivum
  Clone ID: PAT_TA_48676
gcggtgcaggctagctctaagaacagatttacggggcctgtgtgggcactctgtgaggccaatcaagggaacactgacaaaacaaggaagacacttaagattgtccatgctgtgaactgtagggaccctgtaattctacagccacttgcactggtggaatacaaatgagcatatccaaaagtggcccgaggattatacaaaaaggcatatcatattgatccaaggcaccaaccagaattggatagctagacgttggatggactgtaaagaaggaaatgagagaact

SEQ ID NO: 48677 - DNA, 274 bp, Triticum aestivum
  Clone ID: PAT_TA_48677
atattcaacccaaccgatggcacctatcatggtcattgtcagcatgacagatgggctctttcaaggggactggctcgcatgcgcgtgctgctggtcctgatgatccatgtgaacgcgccggccgctgatgcggacataccatgcaagcagagcggccctacttgcgcaacagcttgtgatgcatatggcccatactgtggaactactgtttgctaaatcaatccgacttggggctactacagtgcgctaacctaatccgggtcgagtgttagtg

SEQ ID NO: 48678 - DNA, 282 bp, Triticum aestivum
  Clone ID: PAT_TA_48678
gcacacctacatacacgcatacacacacacatacggacatatatgctcacgcacatacatacacgggttgcactttctgctaatgccagtaccttgatacccttgaaagggatccacaccatagaagctatacaccgagcaaaggagaactaccatatgcttcatctgctaaaccatcgaatactggccattcttatagacgatgaaccatcggatgatcaaggcagcattatgcacgattgccgagcggatcagcaaagggcactacgcggctagacgcta

SEQ ID NO: 48679 - DNA, 214 bp, Triticum aestivum
  Clone ID: PAT_TA_48679
tacttaatcacccctttgccaacaaacgcggggctcgtgtaatacaccgatgccgtccataaaacgaccactcacataaaccgaagcatcactgattatgaaggtgcaccgcacaggaagtagagcccgggttagaagcaccaggccttatggcttgtgcactgcatgtgcgcccactgtattatgacgggtgtgatgcatgcgtgccccctct

SEQ ID NO: 48680 - DNA, 230 bp, Triticum aestivum
  Clone ID: PAT_TA_48680
acagagatcggctatcttgaacttagaagagaggcatattttggcgacatgtcattgagaaggacaacccaatcgaacagcttattctatcagctggaaaatatggggatactatttttctggaggcaaataatgtgggcatcgaattttccacattgacaaaataacaggggaacctatattttaacttccacatcataaaagtcaatggtgcatgtgttgtaaaacag

SEQ ID NO: 48681 - DNA, 290 bp, Triticum aestivum
  Clone ID: PAT_TA_48681
ttaagcttgggcacgaattttacatactctagccttgacggcgggatggatcccgcacgatcggcaagccgcacgcggcccctgctccctccaacatataggggggatcggccccgtgaaccatgcaacatctgtatgaaatgggggccgtgatatatgccgggtcgttctccaaagaggtgcgctggatcttccgctccgtgcgcctgaccgttgggctttgctggcgttttgcctcccgggaaatatagaggtatattgccttctcacttccggccaacagaaagaaa

SEQ ID NO: 48682 - DNA, 300 bp, Triticum aestivum
  Clone ID: PAT_TA_48682
gaaaatggcagcaccacctctcatgctggcacgccgcgttgctggtgccttctccgctgccgtcgtggtgcattgctccttctgtagccgttacttgcggcctcgactgctcccttcaaagcggtggagtggggtggtgaagatgggggcggacacgggaggcgcacagagaggccaggtggaagaaaccaggcagacccacgagatagccgctgccagaacgcgacggtagaccctgagcagggagcatatgatcaagaccttaacaccaagggacgctggctatacatgcaaactcac

SEQ ID NO: 48683 - DNA, 302 bp, Triticum aestivum
  Clone ID: PAT_TA_48683
tcgccccaaccaagcgactgctatacaaacttgttatcgcgtttttcttggaggagaaacaaacaggaccgcgctcctttctctacctatttcggactatcatcggaggcctgaggacaactcacttttgaccatgacagggaccttagtcctgccggctgctcttgagacaacttttgcgggccgaacaagccgtcggtactgcaagtcttatggaaccagcaggactccctgaatgcaggcaatgtcattcaaccatcctgtcatgatggcatcatttgtcggtctgagatcggtacata

SEQ ID NO: 48684 - DNA, 255 bp, Triticum aestivum
  Clone ID: PAT_TA_48684
ctaaaattagagctgtactcgagcaccggtgttgcgcgacctagagctgccgacgcgcggtagctctgtgccaccgccgtggcgtcacaccgccgcagcctgtccgccggtgctggcggcgtcgagcctgatagcgacgtcgggtgcctgccgtctacgccccgtgagcggtcttgggcgttcgttcgtgagggattgtggagagctctagagtgacatacggctctgctcgtctgagccaagggtgcgaagaat

SEQ ID NO: 48685 - DNA, 247 bp, Triticum aestivum
  unsure (1)..(247): unsure at all n locations
  Clone ID: PAT_TA_48685
accacccacacgtacggccacgcgtacgggagagacgacacctagccacggccacgggcactaataacaagaagaaggcgcccgccgccagccgctnctnccatgtagcgggcaacaccgacgagacgcaacacgtggattcaggctcagtcagcggggacacgattcacccgccgctgcccactccggttggggacaatgagcacacgccggaatctgcggcgattacgaatgcagaacatgctgc

SEQ ID NO: 48686 - DNA, 230 bp, Triticum aestivum
  Clone ID: PAT_TA_48686
cccacgcagaccacgtactcgtgggggggcgggctggctagaaaccagctactttgcggctaacgggctgcgcaagacaggggggtactggagatgaatgcacacatatatcaagtggctgaagaggatgaaggccagaatctgcagctgctgtgaatagtgcacgagcctgttccggacgactatgattatcgtggtctagttttgcggcaactactacaagtggacga

SEQ ID NO: 48687 - DNA, 361 bp, Triticum aestivum
  Clone ID: PAT_TA_48687
tcggagtcaccttacgctttctcatggggcggggggtgtcttcccctctctattatcaaacaaccgagggaggtgtacacggacttggagggaaccatgcagtggctgacataacgattagcatggaaacatcagctggtcaagatgacacccggtttacagcttgtcgagatcggatctctatcgctatcagaggtatcatcagctgacatggtcatctataacatacctcttatacacgcactcgttttaggatgacctactgcattaacaaggtggcatatcatggtagacctactggaccctacatgtggcacagcgcttacattgattcgagcccgaggcaatagatggacataca

SEQ ID NO: 48688 - DNA, 227 bp, Triticum aestivum
  Clone ID: PAT_TA_48688
gcgggcatattaactactacgtaactagcacagaggaggaagacctagcagtatttactggagacaccttgctcattgctggatgtgcgaggttttttgagggtaccggagagcaaatgtaccagtcactttgtgttacactgggctcgatgctaagaaaatacggatactgaggccatgagtggaggcagagaacggcaaaatgaagcagaaactgcgatgggctc

SEQ ID NO: 48689 - DNA, 223 bp, Triticum aestivum
  Clone ID: PAT_TA_48689
tgtcctggtattacgaggatgaaccacgcatctgcttcctactttcaagaacattcacagaggaagctgcgtaccaggtgcagacgccgttggagtggccggtagctagtcccagaaccatcgtgcggatgggttgcacctcgatccgccacactatgtgctagcgcaggtgcgccaatcgtccagtggagctgctcgcccagctgggaggcacatcccggag

SEQ ID NO: 48690 - DNA, 309 bp, Triticum aestivum
  Clone ID: PAT_TA_48690
actcgcggtggccatggccacggcgggagcgagttctgcccaaggcgggctcccggaagagatcgagatatgggagattctcgtgcggcttgccgcgaaaggcgtactgcgatgtcgggccgtgagtcgcgcctggcgcagcaccaccttcagccgagacttcctagccgctcacaaggctagtaaggcggacctagctaacttgtttcaggaataccacggggggcaaaggttactctcctacgacaaccggagcgcggccaccactcaagtccgaaaggttgctgagactgacgactactcctgact

SEQ ID NO: 48691 - DNA, 322 bp, Triticum aestivum
  Clone ID: PAT_TA_48691
gtgcgaacgaatgaatccacacgtaaggtcatgtgtgatagacaacaggttcgtagaatatttcttctccgatggatcaagaggtagatgtatgcgaagaccctgaccggtaagaacataaatctttgggaagacagttaccggaccgtccataacgttaagggcaggaagcaggacaaggatggccttcctccaggccaacagccacttatcggtggtggtaagcaggtggaggatgggcgtaacctttgctggtacgacattcgaagggggtccaaccttcactgtgtactgcatctggaaggaggcctgcatatatttt

SEQ ID NO: 48692 - DNA, 231 bp, Triticum aestivum
  Clone ID: PAT_TA_48692
gtctttctctccctatttcggactctgatcggaggcctgagacaacttacttgtgaccatgacaggtaccttagtcctgccggctgctcttgagtacaacttttgcaggccgaacaggcacgtcgtcactgcaagtcttatggaaccagcaggactgcctgaatgttggcaatgtcattgaaccatcctgtcaggatggcatcatttggcgctctgagatctgtacataaa

SEQ ID NO: 48693 - DNA, 242 bp, Triticum aestivum
  Clone ID: PAT_TA_48693
tcgcatacgcgtgcgcacgactctccttctcctgtaccagtgcgagggtgcagagaagccaaccgtgcattgcattgatggcggaggagcatgaataaggacatccatcgatacgcgcagtgggctcataaaggatgtccagcattatagattctgtgtgcataaaggcgcactagctattcacacttcttgagagacaagcaggacttgagtgttttaccaagacaagaaaagtgtgtgcc

SEQ ID NO: 48694 - DNA, 250 bp, Triticum aestivum
  Clone ID: PAT_TA_48694
catacacgtgcgcacgactctccttctcctgtacgagtggaagatgcaagagggcatcattatcaatgcatctgatccgcggaggagcatgaattaaggacgtccatcaatcctcccactgggctcataaaggaggtccagcaatattgatcttgtgtgcacaaaggcgcacttgctattcatacctgtacagaacatagttgtgcttgagtgttttacaaggcaaagataagtttgtgccctaaagcaa

SEQ ID NO: 48695 - DNA, 303 bp, Triticum aestivum
  Clone ID: PAT_TA_48695
gcgcccacgcgtactcctacgcgttcggacgcatgcaggttgaccaactcctcagacttggcgtggaggcgaccatctactgtggacaggtattgaaaaaacacccaccgtctctcttgtgtccgactagtagatccgtgcgcgttttgtgcaattcaaagacccaaggctgcacgcatttgttgcctgccgtccggcgattggtgttgtacgttcgatgcgactgtctagagttgtatgctgcacggggcacgcatgtttccaaatctatcaaaatccctgacatgtgacacccagaagctt

SEQ ID NO: 48696 - DNA, 391 bp, Triticum aestivum
  Clone ID: PAT_TA_48696
aagttagacctactcttgcctccacacctttcgaaaatcaatagatgttatcggctcaaacgtatagccgcccatcaaaatagatctgaacgagcaactagccgaccatccacataaggctaaaagactagtttgcaccacacccaacgagagccagctctgtctctaccacctctacaaacaagagaacgctgtgcctgtaaagactgtacaagcaggccaccttttggatatggatgaccaggccaactggcatgcttttaaagacggctgacccagatacaaggaatactccataggccactacatccccaaggaaagacgagtgcatgacgaagctcatcaccaatgcgattcatcttatgccagaagatcgcaatcgattttgtta

SEQ ID NO: 48697 - DNA, 177 bp, Triticum aestivum
  Clone ID: PAT_TA_48697
ttaatacgactatatagggaagctgtacacctgccgtaccactccagaatcgcacgctcgatcaacgcataccataacgagggcatcactcgtgataacactgtaccttaactggcactttgtttagaataggactggaattagggtagaaattagtttagaacaagtgaggagata

SEQ ID NO: 48698 - DNA, 255 bp, Triticum aestivum
  unsure (1)..(255): unsure at all n locations
  Clone ID: PAT_TA_48698
tcgtatttcaccaccagcagtagccatgggcggggcctgctgcaccagcagcgctccctcggaggcgcgcgagctgcggtagcaggaggccctggcgtctgctgcgctttcgctgacgttgctgcgagccgntttctcccgctcagctgatctggctgcgaccctcttcttgaagctcacgtgcattcgctgggcctcctctctagaaactgcggcgcacttgcaggaccttttttcaagcgtggggcccaccat

SEQ ID NO: 48699 - DNA, 346 bp, Triticum aestivum
  Clone ID: PAT_TA_48699
ctacagaatagccgattggaactacaattcagaaacaaagtcaaccagatcgccactgatatgaagcgactacttgacccaaatgggaccaaaatgagtgtgggtactctacgcgagggcgatcataaaggagaataaggactttgtgcgcggcggctttaacggggaagtaggcgaccctgagaacataactgaacacacccgtatacgaccatcaatacataacataaagtacctgcttgagaaggttgataaggacattctagtcagtcatctggaacggtgaaaaggtgatactcgcaagttcagtttgaagcctaaagggtgacacctgtatgagctcctt

SEQ ID NO: 48700 - DNA, 257 bp, Triticum aestivum
  Clone ID: PAT_TA_48700
gcgtcagcgctagacagtgcacaagatgaaggcggcatcaagaataaactgcgcgcagagaagacatggttgccacactcgtctgtgaacaatagtgactacatctgctgccactaccatgctacctgttcctctgaaccaggccgaggtacagatgatgcagagcagcagcgcaaggctagtgagattgctggagatgtggacacgaagctattgatgacgtcgtcctagggcccacagaagttcatggaggcgca

SEQ ID NO: 48701 - DNA, 351 bp, Triticum aestivum
  unsure (1)..(351): unsure at all n locations
  Clone ID: PAT_TA_48701
tcggaaggaccacagcatttgcagcacagcggcctaaaatggcagccgttctcgggcgcgccgtcaccaccgccagcggcgggttcgggcgggatcataaagaaatcagcctgggcggacgtgggccaaatgcggtcatggttccttccgagacccgcgccgcgccgcaggaagggtcgctggagcggtcggcgtggtcctgagagactccggtgtcgtggattgtctccgggctcatggcctttaagacgttctactcactaatgaagctagcctccacataggtcatcatgaggacggcgnaaaagtccaacattctgtcgagtgcgatgacgaacaaggtgctggagt

SEQ ID NO: 48702 - DNA, 292 bp, Triticum aestivum
  Clone ID: PAT_TA_48702
cggacgcttggactgacacgtgggtagctgtcaacgatggctctcactgtgatggcctcaggagccaccgtcgtcgctcacttacaggggcttaagtccaccggtggcctctcagtcagccgccgatccagcagtgcagctggcctatgcagcggcagcaactgcagaggaatacggagcatgcaagcgtggcctatcgaacgcatcaaaacattcgagaccttgtgttacatgccaccgatctgcacggaagcccttctgaaacaggtcgactacctgatacggtccaaat

SEQ ID NO: 48703 - DNA, 204 bp, Triticum aestivum
  Clone ID: PAT_TA_48703
gtgaaacagagcacagcgattgcccacagaccgtggaggtcaacgcactgacactatggtcttcatgtcaccagctacactctaactctattctcttcctctctccagcccgggtataaatatcgtctcttctcttgtctgcgctggttataaaaaccgctggttctcttgccagcgaatctttccgttaaggctggctagcgg

SEQ ID NO: 48704 - DNA, 240 bp, Triticum aestivum
  Clone ID: PAT_TA_48704
gcgaataaaacgagaagatgctctagctaatgcggggatcagaaccttaggacgcactacccatgggcggcatgtcgtcctggcgcatgcttggcttcaggctactgttcggcatggatcacgcgcgggtgtagtccagcatacgggtgccatccgacgacgggtctgtagggaccaggtgggctaccctcatcaggcggttcagcggctactacaactaacgtcgacaggcggaggttt

SEQ ID NO: 48705 - DNA, 265 bp, Triticum aestivum
  Clone ID: PAT_TA_48705
gtgccaaaaggttacaatacgcttgtgggcagccggtcaaaaagtatacaatatgtatacaacacccaggatagggactagagatagagcatacaagatcgaggatagtgactcgaaaaagagcaccgaggctaatgatgatgaggacctaggagggttacacaaacctctagacctaggcgctatcatgatgcaactgagataaatagatgatcaagatcaagactcgcttgaccttcatcaaaaattaatggagagatttgat

SEQ ID NO: 48706 - DNA, 183 bp, Triticum aestivum
  Clone ID: PAT_TA_48706
tcagaatataagggttgacccaagccaccaaaccttgccacgtaaaatgtgcttagaaacgtgagactgtgtactggcgtgcgcactgacaaaggcgagcctgtctacattcctgacgacggccaggggcgacttactttccagacctcatgtggtcgcagccggggtcacttttgcaagggg

SEQ ID NO: 48707 - DNA, 213 bp, Triticum aestivum
  Clone ID: PAT_TA_48707
cctgcacgtaccgctcacgcataggccgatggggacacgcttgcaagcgcacgcaaacgtcgattaggacaaggtgggaggagcgagcacccatctcttgacccgtgtgcggcaccccgagcacgataattgggacctcgctggccgagccggcgccggaaaaaaggagcatcctggcgcgaatggcattgcgccccaaaacagccaccgccc

SEQ ID NO: 48708 - DNA, 282 bp, Triticum aestivum
  Clone ID: PAT_TA_48708
tccacgcgtgcggcgacgaccgcgacgacgacgatgacggcgggtaaagccctccgggcctacacccagcagtggcgccacagtacgccggccctgaatccggccgtgatgcggtcttagtctggtccggagtcaaagaacgaccagtcctgggtctggacccagatcaagggctaggctcgctgatacaccgacgccgagtctgcgatcggctccttgatctatgccactgtgctctcctacccgacaatcgagcgctctctatccttctatctaggcaac

SEQ ID NO: 48709 - DNA, 305 bp, Triticum aestivum
  Clone ID: PAT_TA_48709
gagaagagcagctccaagaggacgggcagaaaacatggcattctgtgcaccacacagcaccacattcgtgcgctgcccatgcaccaccatctcaaactctggcttcacgcagagccgagtcatactctgcacgaccagaggcactatgaggagtaacacgcggcatggcgcacggaccttacaggtctgatgcgcagctgagcaggcaatagagatagctctgggcgcagactcaggatgtgggaaatgcagcttgatgcgccggctcacaagcgtgttttgaggtgctgcagagtcatccaagg

SEQ ID NO: 48710 - DNA, 291 bp, Triticum aestivum
  Clone ID: PAT_TA_48710
atgccgttttcggtctgagcttccgctagcgcaatgaggcctttgacttcaacgtggccctgacggatcaacagaagtatgtcaagagggagcaagataaagagacctgcagccaggaggcaaacgacagctagattgacatgcacccgtcagtgaatacgcggctcacggaaggtgaaaccattatgataaacgtgaataacatgccataatactgaagtggcatgctttactttgctggcttatgtggtggggccactggacaacctaaagcaagcatgcttcttgcac

SEQ ID NO: 48711 - DNA, 173 bp, Triticum aestivum
  Clone ID: PAT_TA_48711
cagcacacttgagcttgaggtcaatggcaggccgtcgagtgtgataggatgaagaagaactaatgacatggcatgtaggtactcttgtgaagtcctgcttcctgtccaagaacgccgaatggggcttgtcgcgccaggtcgcccctacgagggtgagcatggtcagacgcgcc

SEQ ID NO: 48712 - DNA, 363 bp, Triticum aestivum
  Clone ID: PAT_TA_48712
tacaccagttgaaccacactcatgggaccacccatagctagctagctagcagcttaaggaactagcttgcatctaccgatcgatggctcgtctcaacagcaaggctgtggtggccgccgcggtcctggctgcggtggtgctgatgatggccggcagggatgcctccgcggccctgtcgtgcgggcaggtggactccaagctcgcgccatgcgtggcgtacgttactgcgagggcctcctgcatcagcaaggagtgctgctccggcgtgcacgggctgaacggtatgggccgcataagatcctaccgaacgaaatcgagcacgtgcctaaagagcctggctaccagcatcaagtccattaacat

SEQ ID NO: 48713 - DNA, 265 bp, Triticum aestivum
  Clone ID: PAT_TA_48713
tcgctgcttgcgcactcctaccttcgagagtcgggtgctagatgaatagtccgtcccttggccggaaggtggatgacgaataggccgtttggcgggatgaataatgatgcctccgacccctcttggcgagaggggtatggtttcctcggggcccttagtcggaccggcggtggggctctgcgcgccctgtaggggcgcgctgcggagttggcatccacgccttgccggggcagagagaggtcttgcatccacgcaatgttgtggc

SEQ ID NO: 48714 - DNA, 156 bp, Triticum aestivum
  Clone ID: PAT_TA_48714
gcggtatatagtacggaaatactcccctgtcagggagatttacacaaagagaacaggttccactgaattaaaagtgggcatatagatatggagtcatagaattagcctaggggatgtccttcttgaacgcgccgcatggactcacattaattcatt

SEQ ID NO: 48715 - DNA, 298 bp, Triticum aestivum
  Clone ID: PAT_TA_48715
gggtaagctggagagccagacgtaccgctacagtaaacacgagcggaagcaagcgactggtctagaatacacaactccgtgggcaacagtcgctgcttggcttcagcactgccgtggcgagattcagtgctgtgtctgcgccgcggctggtggagatcaagagcaggctgggagccaacgctggtgtccggagggtcgacgtcggctcgcaagcgcacgatgaggaggatatacgtaacgtcgtcggggcgctccacattggagatatcgaacgcgagctcggcgttccgcatgggca

SEQ ID NO: 48716 - DNA, 274 bp, Triticum aestivum
  Clone ID: PAT_TA_48716
ccgaatccctgtactctctgcacgcgcatggtattacaaggacctcaagtttagggagagggtagagtgatcagtggcacaagcttatgccgagggaacagacatttcctgtgttagcgtctatctgactagcggggcgcagccgtcttcatctctatccaaaataggagacggagatggctgcctatgagggcaagataggaggtggtcatagctgccaactccagcaacattgtcattatggggggcaccaggctcatcggacattttcttt

SEQ ID NO: 48717 - DNA, 114 bp, Triticum aestivum
  Clone ID: PAT_TA_48717
tcgaatgggcgtgcaggaaaatatacgcgtgcggttcaatggcggcgaaggaaccaatgcatatgctcttgatccgatgattacgacaggagttatattctgttgataccatga

SEQ ID NO: 48718 - DNA, 223 bp, Triticum aestivum
  Clone ID: PAT_TA_48718
gaagaagccgaagccaagagcagagctaagggtggacagaccctaacgatagagcataagtcgctgagcttacttactgtcgaggtagctagagccatggcgcccaccaagggcaaggggccggccatcgggattgacctcagcaccacctactgatgcgtcggcatgaggcaggacaaccgagtacagattattgcgtacgaccaagggaatcggagcacgc

SEQ ID NO: 48719 - DNA, 277 bp, Triticum aestivum
  Clone ID: PAT_TA_48719
gcgatcgtctgcactcatcaagcacctggctagggttctgcttggtccacacccggagagggaggcgagatccttactcggaacacgcggctgcgacggaagtacctctatccgaagagcctcgcggggaacgagcggcactactacaagaagaagctctgcgtaccgaaggcgctcgcggggggctagcctatcgccaccgagcttacgtacgaggagctcaccctgcagcgcgagagcgacctatacgaccaaaatccggcagtgccacggtgca

SEQ ID NO: 48720 - DNA, 244 bp, Triticum aestivum
  Clone ID: PAT_TA_48720
accgcgatccttactccgtccggccgagggctggaccgcgcagatttgctgaccaggttcctgttccgcgtctcgacgactgcttaccaccatcgagggcgcgtaccttgaagacagacagggcctcaacaactgagatgtgtttagccacacgcacatctcgagaaatcactgatagacggaactgggacatagcggaagaacacaaacattggtacatggaggacgcggagataatacataa

SEQ ID NO: 48721 - DNA, 283 bp, Triticum aestivum
  Clone ID: PAT_TA_48721
aagaattactggaagggccctcgcgtgcggcttgaattattacttacagagacgtaggggggggcttattttaacgctgacggtaactaatgtaagtggtggtactacagctggtggtatggaacttaagttgccttactacacgccagattatgaagctgacgatactgatgtgttgccaccatagaaagtagggcttcagtctgtggctaatcttgtagtggcacatgctgaactggctggactgattgacactgccacattgaccactgcaaaggccgat

SEQ ID NO: 48722 - DNA, 327 bp, Triticum aestivum
  Clone ID: PAT_TA_48722
tcttttcttttttttttttttttttttattttttttttttttttttttgtttttttcgggcgggcaacgggtttttttacaaattttggctcacaaacaggggtgttttttgggggaactttgactccttccaggaactaaccctttttgctctgggccattccctaaattttcactgtttgctttatgccccagatttttggggggttttttttggaggatgcttgataaacaatttccaccactaacattgagcaggttacaaaacaaaagcctgaaattcaggggaatggacattggttctttacagagttaaaattttttttt

SEQ ID NO: 48723 - DNA, 405 bp, Triticum aestivum
  Clone ID: PAT_TA_48723
catccctacacgagagggccccatatttttgttgccgcgcgcatctcgtcccagattggcggcaaggtcgtcggcatcgcgctcctttcctgcaacgtagtcggacgtccgcgcgcgacgagcttttccatggcgaacgagagcttcgcccaaagatttctgcgatgactgcgtccgaaggatgctggaaccgcccagtcccgggcctgcgaccggtgctgcaactggcggcgtcaggcgctagacccggcaaggggttgtgctgggtctgccctttttttgagcacatgcagcaccaatgttaccatcggtgatttgttttgctggaatcggtgactttttttggtgggatccgtaattttgtgtgatttttgctgcatccggcattcgattttgttacgatcg

SEQ ID NO: 48724 - DNA, 415 bp, Triticum aestivum
  Clone ID: PAT_TA_48724
gaagatggaatgaatagtgtgtttgccacaaaaaaaaaaaacataaaaaaaaaaaaaaagagaaaaaaaaaaaaaacaacaaaaaaacaaaaaaaactataaaaaaagctgatagtaacaaaaaaataacttaaaaagaataaatagaaataaaaacaaaaaaaaggggggggcctttttaggggtccaaatttatttccccgcgctttggaattttatgcttttttttagggccccccaaatcctatttccggggcggcgttttaaaccgcggggtgttgggaaacccggggttttcccaccttaattgctttggtcaaaaatcccttttgcccccgtggggaaatatataaaaggccccgcccatttcctttttcacaaaatttgccccctttttttggaaaaggggcccccc

SEQ ID NO: 48725 - DNA, 481 bp, Triticum aestivum
  Clone ID: PAT_TA_48725
cattaccatggcccccgccgtgatggcttcctcggctaccaccgtcgcacccttgcaggggctcaagtccacagccggtctccccgtcggccgccgctccagcggcatgcctcagcagcgtcagcaatggcggaaggatcaggtgcatgcatgtgtggccaattgagggcatcaagaagttcgagaccctgtcttacctgccacccctattcacggaggccctcctgaaacaggtcgactacctgatccgctcaaagtgggtgccctgcctcgagttcagcaaggttggcttcgtcttacgtgagcacaacagctcccccgggtactacgacggtcgatactggacaatgtggaagctgctctatgttcgggtgcactgacgccacacaagtgctgaacgaggtggaggaggtcaagaaggagtaccctgacgcctatgtgcgtgtcatcggcttcgacaacctgcgccaggtgcaatgcg

SEQ ID NO: 48726 - DNA, 441 bp, Triticum aestivum
  Clone ID: PAT_TA_48726
cccacgcgtccgtacagccccccatacgatctcgccgtgaaatctttccgatcgaagcgaagcgaaggctctatcgtcctcctccttaagatgcagatcttcgtgaagacccttactggcaagaccatcacccttgaggttgagtcctctgacaccatctacaatgtcaaggcaaagatacaggacaaggagggcatacccccggaccagcagcgactcatctttgctggcaagcaacttgaggatggccgtaccctcgcggactacaacatacagaaggagtccaccctccacctggttctcaggctccgtggtggaatgcagatatttgtcaagaccctcactggcaagaccatcaccctggaggttgagtcctcagacaccattgacaatgtgaaggccaagatccaggacatggatggtatgccaccggatcagcag

SEQ ID NO: 48727 - DNA, 462 bp, Triticum aestivum
  Clone ID: PAT_TA_48727
atctgagacacacactcacgcaggaaacaagacagaaaggaggctgctgtatgaaggtacccatctcccgattcaacatggtatcgagccaggcgacgacggtggcggcgtagtccctcgccggagaggcggcggtggggcccagcggggtcaggcgagaaaggaggctgcgtgcgtgcgcgaggcggcgggtctgctgtggtgcgtgcggcggcggcgcggctgggctcgaggagctgcgacgcggccgggaaggtgctgcttcctcttgtcctgcttcgcgtccctggggtggctagctgcgaagggggcggccgaggagggctgctgcaggctgtgcaagcggctgcggcaagaagaggaggaggaagaaggcggcggcggatttgggctgtgtgcgagtcatgctgcggcggagagctgctgctgttggtgctgctgaacagaagaggaactgcagct

SEQ ID NO: 48728 - DNA, 340 bp, Triticum aestivum
  Clone ID: PAT_TA_48728
cgaagttcctaatgacgattggttcttattagtttctttaaaggaagaacaacacgtggctgtactaggaagattaccttgacatgggagtttcttgtctctaacgaacacggcagtctttattatttcacttgaaaagatgatgtacacatttacagcgtagaatttacagtcgtatattcatattgcgcttaacttttactttgtaaaaatcaatattgtctggctgattggccgattatttaagaagtaaaaaccttaggtgttgatccacttgatctctagccatatgacttaccattcaagatatgacaggacatgtatgtcatacacccacatg

SEQ ID NO: 48729 - DNA, 321 bp, Triticum aestivum
  Clone ID: PAT_TA_48729
cccacgcgtccgcccgaactccaaaccctagcagtagcgccgccgccgccaggtaagaggcgagatggtgtccggctccggcgtgtgcgccaagcgcgtggtggtggacgcccgccaccacatgctcggcctcctggccttgatcgtcgccaaggagctgctcaacgggcagctcgtggtggtggtctgctagctggagatctacttatactgcgaacctgtgcgtaggatgatagatgaactaaagttttttgtggtgcagttgtggccttgtaacataattggttgttccgtttatggagatccttcaagtttattata

SEQ ID NO: 48730 - DNA, 488 bp, Triticum aestivum
  Clone ID: PAT_TA_48730
cccacgcgtccggtcaaatcctagcgaagacaccacagggagaagcatccttcggctcagcccctctgcgataagaggcgccgggcgagagatgctcccatgggcggccacggcctcctcctccgccgccgccgcccttctccatgcctctccgcgccccgcttcacaccgcgctgcactacctcactaccgtccatctccctctcttccgccgccgctctcaattgccttccgggccccggcacgtgtcctccctcgcggcggcgacgccttctgggaggagccagacgacggctccgggagcgactacgaagataacggaaagcaagcgaccgtacaaagaagctctcctttcccttcccccttaccgctctccaggctcgttgcaaggcggcagcaggagcgtgaagagcaggagctccggagagaaatcgagcttctcttaacgccggaagaagaggctatcttggatcagaatgagacagctg

SEQ ID NO: 48731 - DNA, 487 bp, Triticum aestivum
  unsure (1)..(487): unsure at all n locations
  Clone ID: PAT_TA_48731
cagacccatctaaaggaagtggtgttgaagtatttcaatggttacgagcaacatattgactttgccaggttcgttgttttgaacgcaaaagtggtaaacaaaattgaattccatgtacgtgaggaccactacagcaatgaatttgtggctcgtcaacacacgctgctcgaagccgaaaacagagcttctccggatgctcaattcgaattcaggaaaacttgtggttctattgattatcatgtcagcaagcatatccacgatctgtcggtggccgaccccttcgcagacagggttgatgcctgaagattgccctcttttgtgcttattctctagatggggttgatgcaaaaggagtccacttctgaaatattgtaatgggtaggaatgcaaaaaaattactgctggaagtngtaaagtgggatggagctggtaaccccacccaccagaactcttctggcccttttggcaacttaactgtcctttcagt

SEQ ID NO: 48732 - DNA, 438 bp, Triticum aestivum
  Clone ID: PAT_TA_48732
ccattccccattctccaatccacctcaaccgcccagcttccatggctcggagcaacccggggcttctcctagggctgcttctgctgcggctcaattggtgcttgggcgtggatggcggaggcgcggaggaagggggcggcgtgtttccggtggtggtgagcacctggccgttccgggaggcggtcagggcggcgtgggacgtggtgaaaaccggtggcgcaggggggtcggctgtggatgccgtcgtcgccggctgctccgcctgcgaggagctccgctgcgatggcacagttggtccaggtggaagtccagatgaggatggtgaaactaccttagatgctcttatcatgaatggggttaaagctactttaaccactcaagctacagtatatgctgatgtttatgatacgacatttatggtggatgtaatagagcatt

SEQ ID NO: 48733 - DNA, 443 bp, Triticum aestivum
  Clone ID: PAT_TA_48733
gggagaatagcaccaggaaaacggcggccatggcggcagctgcggctacaacgcgccgcaggagcaccgcgttcctcttcggcaatgagggtacaggactctcacaaaaggagtgtgaggtctgtgacttcttcgtctacatccctcagtatggtggcggaactgcatcactcaatgttaccgttgcagcatcgattgttctccaccacttcggggtctgggcaggctttcctgaaagaagccgagaaggcagtaaatttgtggttgctgagaaaccaaaggggcagtcgagggggctctactgctcagattcaatagaagacgtgattgaagagcgaaaggcacgcagagaaaatgcctgcgatatattcgaggaaaatggaagtagccatccgcaagaatcaaatggtctaggaatgatgtttacagactaatcttatctc

SEQ ID NO: 48734 - DNA, 311 bp, Triticum aestivum
  Clone ID: PAT_TA_48734
gtcatacagaagaacgagccgacggccttgcagaagaccaagcttatgacccgtatcacctacacccttgaccagatggaaggcccactcgaggtctgagcctactgcaccctcatgctccaggagaaagactgaatctactattccgtcgataccgtgcagcttcccggatggagctcagtgccctttctcttaccgtgaagcaggtggtgcacaccctgacgcccgatagcttgagacatcccttacttgtgcccctgttcaactgaccatctttgctcgacccaaagggccgtggtgtctctactggc

SEQ ID NO: 48735 - DNA, 488 bp, Triticum aestivum
  Clone ID: PAT_TA_48735
ccctgtcattgtgagaattcttaattcaagagttatagggagggacttatgtgaccacatacagaaactaacgcaggcgttggattgaaagctggtgttaaagattataaatggacttactacaccccacagcatgaaactaaggatactgatatcttggcagcattccgagtaagtcctcatcctggggttccgtccgaagaagcacgggctgcagtagctgccgaatcttgtactggtacatggacaactgtttgcactgatggactcaccagtcttgaccgttacagaggacgacgctatcacatgctgcctgatgctgcggaagacagccaatggatctgttatgtagcttatccattagacctatttgaagagggttccggtactaacatgttcactcacattgtctgtcacggatttggactcaaagccctacgtactctacgtttggaggatctacgaattcccactacttattcaaaaac

SEQ ID NO: 48736 - DNA, 364 bp, Triticum aestivum
  Clone ID: PAT_TA_48736
gccacacgagccttcacagacaggtttgtagacaggatgggcctcagctggcgcctgatacaacggtggctacaaccgtcccgagcaaggggcccctgaacgacaccctgaaaggctgccccataggctgagcgatgagcgaccggaggacgcacccttgagcgcgcgcttgacacaggcccggataaagccctccataatgcatgccttaagcgaaggctctgcctcagacgctgggtgacattcatatggacgaacctacggaggcacggccatgcgcctagaaatgcgctgtctagaggatgctatataacatacacgctcatgcaaccgtgcatgcgacctattatgtcacctatagtga

SEQ ID NO: 48737 - DNA, 377 bp, Triticum aestivum
  Clone ID: PAT_TA_48737
ccctgttattgtgagaattcttaattcaagagttatagggagggacttatgtcaccacaaacagaaactaaagcaggtgttggatttaaagctggtgttaaagattataaattgacttactacacccaagagtatgaaactaaggatactgatatcttggcagcattccgagtaagtcctcagcctgcggttccgaccgaagaagcaggggctgcagtagctgccgtatcttatactggtacatggacaactgtttggactgatggacttaccagtcttgatcgtcacaaaggacgatgctatcacatcgtgcctgttgctgaggaagacagccaacggatctgttatgtaacttatccattagacctatctgaaga

SEQ ID NO: 48738 - DNA, 379 bp, Triticum aestivum
  Clone ID: PAT_TA_48738
cccacgcgatcgctgctattgtgagaattcttaattcaagagttatagggagggacttatgtcaccacaaacagaatctaaagctggtgctgaatttaaagctgttgttaacgatcataaagcgactgactacaccccatagtatgaaactaacgatactgatgtctaggcagcattccgagtaagtgctaatgctggggttacgacctaagaagcaggggctgcagtagctgccgaatcttatactgctacatggacaactgggacgactgatggacttaccaatcttgatcgctacaacagactatgctatcacatcgagcctgttgctgtggaagacagccaatggatctgttatgtaccttatccattagacata

SEQ ID NO: 48739 - DNA, 493 bp, Triticum aestivum
  Clone ID: PAT_TA_48739
ggttcgtcctcgctcttgataaaccactggagaacaggctgttcaacatattctccggcgtcagcattccgatgccaacgacgacaatggtggacggggatgcacgatatatccgagttgaggcagctgctctatcagggtcgccagttctggacccaccatacaactacaccatcggcgcgattgcaaggatcgagggcagtgagttatctggcattgcactatgggacccgtccaaggagcactggacgggcattgactgggatctcatccgatcgcagagtctggatatacacgatgtggtatactccaatggcagcttttacttcctcaactcttatgagaacatggagagaattggagctcatcccaaccgtgagggagtcccaccccgtctggagatttatgtcgagaaggattgggagatatatgatgaggaacacccggagaacttgacagtccagcggtatttggttaatcttggaggtatgga

SEQ ID NO: 48740 - DNA, 259 bp, Triticum aestivum
  Clone ID: PAT_TA_48740
cccacgcgtccgcccacgcgtgcgtccacgcgtccgaggacgcatgggcaagaagcactgggggcgattgtcgccatctgattcactgatccccactggaggctgccactttactgagaaaaccgactcctcttgggtccataaatgccgcatcatggggatccgattggagtgtaccaattgcgtacacctacatagccaggatgggctctaaaggaactcactgcagctgcaaagaatgctatactgaacgctaact

SEQ ID NO: 48741 - DNA, 419 bp, Triticum aestivum
  Clone ID: PAT_TA_48741
gtgatggtggtgtactacgagaaataaccatgcatgacttactggagactatacacatatgcgagactgatcatctagctattgacgttagctaagattctttaccacctctttatgttggatataaagaccctggtgatcgacttcatgttggcgatgctaggcagctcttgagaaattctccagaaggaaaatacgatgccattaattgtgattcatcagacccaattggaccagctcaggagctcgtggagaagcccttctttcagacaattgcttgggcttcaaagcctggccgcgttcttcataatatagctgaaagtatgatggtgtacacacatgtaattcaagatatgctatctatctgccgggagggattcatggctggcttgccctatgcctgggcgagtgttacgaca

SEQ ID NO: 48742 - DNA, 251 bp, Triticum aestivum
  Clone ID: PAT_TA_48742
actacggcgactgttttcgtgtaagggaattcctgttttaatgcaggcccttgaaatttgagcggttggatgatttagctcgggtcgttagttagatacctttcttgcctatgttggtggattttttggacccaaacgtccgcgagctgcggggggaccttggggttctgccggccgattgggaagacggaataagcttggccatagacggaagggcaacggtattccgtgggccatcatttggagtgggg

SEQ ID NO: 48743 - DNA, 385 bp, Triticum aestivum
  Clone ID: PAT_TA_48743
gccaaaggtatgcaatccgacagaaatacccatctcaaaaccctaatcctcatgcccgatcccggcgagagagatggccaacccgagggtgttcgtatcgacatgaccgtgggcggcgcgccggcggggcgcatcgtgatggagctgcacaaggacgcggtgccgaggacggtggtgaacttccgcgcgctctgcaccgacgagaagggcgtgcgcacgagcggcaagccgctgcactacaagggcagctccttccaccgcgtgatccccgactatatgtgccagggcggcgactataccaggggcaactgcacctgcggagagtccatgtacggcgagaagctcgccgacgagaaggtcgttcacaagcacaccaagcccggga

SEQ ID NO: 48744 - DNA, 403 bp, Triticum aestivum
  Clone ID: PAT_TA_48744
cggagacgtccacctccgacgaggaggcgcggcggcagcacgaggccggatgcgccactgctacgaggtccatgagatcggacgaagcggttggtcagccggtcaagaagcccaaggtcgacgagaggccaccgctgcccccgtcgccggtcacggaggcgaagcggaacagcggcgacaagaagcctaagatcgacgagtggccagcgctgtccccgtcgcccggcacggttggctagggtaacagcggtgacaagaagcccaaggtccacgacaggcaagcgctggtgcctgcgtcgcctgtcacgggggcgaatgggaacagcggtgacaagaagcccaagagtcacgagaggccaccgttggctgcgtcttcgggcacgaaagcgaaggggaacagctg

SEQ ID NO: 48745 - DNA, 470 bp, Triticum aestivum
  Clone ID: PAT_TA_48745
cctactcctactgtacttgtagccagctactcctgctatgttacaagtcatggagacctaccctctggcaaagctcatctcactcgctttcctactagttttgcttccaccgggcatggctcttgtgccgtccctggaagagcaagccggagctctccttgcctggaaggacacgctagagagcagccctgctcagctacaatcctggggaagggaaaacaataattcatggccgtgcagctggcatggcatccagtgcagcaagcatcgagcaaggcaccaagaggtgatcaccgggatctctatacaggggctacagctgagagggaagctggagtccctcaacttcactgcgttgcgtactctcacgagtatccaactctccaacaatcagataaggggctcctttccacccgctttagcatcatctttgccaaacttgagacacctaatgcttcaggagaatgaac

SEQ ID NO: 48746 - DNA, 294 bp, Triticum aestivum
  Clone ID: PAT_TA_48746
atctctcttcgcccacgcggcggagccgccggcgacggcgtggaggagatgatgttggtagctgcccatggaggggccgcgctgacgcgatgagggcccgacggccagccacggatccaaaccagatccatggagcgacgggcggtggcgcgatggcagagctgtgcagagggtggaggcgcaaccatggcgtcgtatgcgaggtcggcgtgtggggtgggggatctgggcgagctccgtcgccatctgccaccgccgccgttcccgccaacccgcacggtaggatcccgatcc

SEQ ID NO: 48747 - DNA, 162 bp, Triticum aestivum
  Clone ID: PAT_TA_48747
cagcagccatgttgcgccgcgcctcccagctcctacgcaccatccccaccgccaccgtgttcccccgccggcttccgcaaccgcaccggcacccgcttccagccccacccgtccatctccttcccgcccccaggcaaccgttgtacttctacgccaccgagt

SEQ ID NO: 48748 - DNA, 461 bp, Triticum aestivum
  Clone ID: PAT_TA_48748
cccacgcgtccgcccacgcgtccgacgaccactcactggttctcttctctagtttttgcattattgaaggcccagagacaatacaagacttcattcagatgcaatcacaagagattcaagacaacatcaagagtcggcgcagcaaaatattccttttgatggaagaggtcagacgactgcgggtgcagcagcgaatcagagctgctgaaagcagatgttccagcagtgaagaaaatgagatgccggagatgccatctaccattccgtttttgccttatacgtagtcaccaaagacaatgaagcaatctacctgacatcattctctttcatatctgggataatcatttttggtggcttaatagccccaatacttgaactgaaattagggcttggtggtacctcttatgaagatttatacggaacatgtatttacctcttcagttaaggtgatttaaagaaac

SEQ ID NO: 48749 - DNA, 344 bp, Triticum aestivum
  Clone ID: PAT_TA_48749
atcatcatcagttcaccgcaagaacgaatccccgccagccactaatcggccagctagacttggtgtgccgggcatggagggcgcgacgacgctggcgacggagctggacgggctgctggccatggcgagggagctggaggcgcgggtggacggcgaccagggtgcgccgggcgccgccagggagctctgcgccgagctggccgcgtccgtccaccgggccgtgcgcctcgccgggagcgaaggcaatgccggcggcagggcgagcgtgaacgggcggctcaggagcggcaggaaggcggcggcgcggcgagggcgcaggtcaaggtggcgtctatgcaagatct

SEQ ID NO: 48750 - DNA, 472 bp, Triticum aestivum
  unsure (1)..(472): unsure at all n locations
  Clone ID: PAT_TA_48750
tgggaatagattaccctactgccgcatggctttccagagattgtggctatacagcatacgcagtgagctcggtggatgatctctacaatccatttgcatcaatgtactttggagcagcttacttgggatggttgtcacgatatgaaggaagggagaggagccatgaattcattgttcaagcttatcttgngggaccagacaaagttaaccttcaggaaactggaccgtattggaagaaatttctggaggctntgatacactatgaagatccgaagaaggaccagacgagctgctgtattttgtaaaatcggatgtcttcatacgattttgtttactgaagaccgcaggctgtaactagcaaagcttcgtttcaccatcttgtaactgaagataactcggattaaaataatccgtgtagcagtaaacgcttcattttgtaattttgctggccctttggttggtcttgtttttt

SEQ ID NO: 48751 - DNA, 223 bp, Triticum aestivum
  Clone ID: PAT_TA_48751
cccgaccgttacatccatccatacatgggaaccatggtggagaagccggcccttggcttgcggagccttgtgagcaatctgcaagtggtggtacaagagcggcaggaccaaagacctcttatggaggccgtcgcagctcaacgggctcatcaagctcctgactgagaacgaggaggagatctttgacgcgctacacgactacatggacacgcactggactgaa

SEQ ID NO: 48752 - DNA, 239 bp, Triticum aestivum
  Clone ID: PAT_TA_48752
cccacgcgtccgatggtcccctctactgcaagaacaagtacgccggtgttggatcggccatcgaatacgctcgctgtgctctcatggtcgaggacatcggggtgattggccacagccgctgcggtggaatcaaggctctgctctcactcaaggatggcgcatacgactcctttcacttcgttgaggactgggtcaggatcgactttccggccaataagaaggtgcacactgagtgcgcc

SEQ ID NO: 48753 - DNA, 227 bp, Triticum aestivum
  Clone ID: PAT_TA_48753
cgcgcgcccttctccctgcgcgccgtcgcgccaccggcgccccgtgtggccctcgcgcccgcggcccttagcctcgccgtcgtcaagcaggtgcggtgagccaggctccgcgcgcaggcgacgtacaaggtgaagctggtgacgcccgaggtcgaggtggagctggaggcccccgacgactgttacattcttgaccaggccgatgaggaggggatcgtcctgcccta

SEQ ID NO: 48754 - DNA, 477 bp, Triticum aestivum
  Clone ID: PAT_TA_48754
cttttctaaaggtgattacaatggaaaagagctacattcccactagcttagcctacagctcctcggcagatcttctgtggactgtcatgggcgcatcaaacatgcctaaccaggccgcctcccagttattaacccgtgtcagaatcatcctccggttccaaaaagaattatcagcctcggctgaccacgaccctgcaatcctggaggacagcgaagtaccacatggcgagaagcttctgctggcgctgcagggaagtcttgacgcctcaaagcaggaggaggtgctggccgcggtgctcgccgcctcagagtctcgatgcacaagatgctggtgaagaagaactactcagaggagaggcgggagcagcggaagaggggcaggaacgataagaagatcaagaagtagccctgcttggcctgcaaacaccaccagatcgctgtaaaagaaagaaatgtaccgacaagttctgagaatag

SEQ ID NO: 48755 - DNA, 174 bp, Triticum aestivum
  Clone ID: PAT_TA_48755
accaaccaaagggggagagctcagacgacaggacaggcgagactcctcaaaaagagaagtgagccgtgagacttgggaggagacataatgcacacaaaccagaaggtggatttaaagctggtgttaaagattataatttgacttactacaccccacagtatgaaactaaggatt

SEQ ID NO: 48756 - DNA, 442 bp, Triticum aestivum
  Clone ID: PAT_TA_48756
cccacgcgtccgagcacgtccatggcctctgatcgcgtcgaggtcgacaccgcccgccctttccggtccgtgaaggaggcggtcgcggtgttcggggagcgcatcctcgtcggcgggagcaactccagatacagcagcagtgcggttgccattgccgacgcgcatgccaatgccacccctaacgccaagcacgaagatagcagtaggagcagtaccaccaccctttctccaaatgcaatggcagaggtagatgcggagctagagccagaggcaacggcagctatcgtgcctatgtactccgcgactcctcgccgtcgttcacgtcgccgcgttcggcgtacggcgacgacggcgagcttggttgccaagacgacgaggccgggctcgcggtcgtgagctccatcaagaagctggaggccgaggtggccgatacgagacggga

SEQ ID NO: 48757 - DNA, 477 bp, Triticum aestivum
  Clone ID: PAT_TA_48757
ctcaaggggcagacagagcagggcggagtggctctcgctccaggggcggttttcgcggcgaggtggccagtgccaaggagagcgagcagcagagcgtcctagagacgtacaatcctgtcagcaggggggtctatgacgtcctcattgttcttggtgcttctctggcgctcagattggtgtcgcgtgctgtgctacatcgttggccagaaaaacaagtctggtccatccggagagcagcataagttattggtctaaactgtttgggattcagcaaagggatagctgcatactggctggtacagacatttggggacacttgcaatcccttatcggtacttcgttttcgtttgacgcagccatattcgaaaatataattgttatgtcctgttgtgtcatggtggtttgtgttaaccagaattcagaattaactcaagttgacaagtgcgagtgcctgcgatattctcaaggtgcagcttt

SEQ ID NO: 48758 - DNA, 217 bp, Triticum aestivum
  Clone ID: PAT_TA_48758
cggggagggaaatcaatccccatgaccccgcccctcctcgccggaccagatccccggcgggccggcgcggagccgtaggcggggaccggcctggcccgttcgatgggtggtgaggcccctgagcctttgttgtttattcgttcgcttagcttgtacggtagtttgtttcaaactcaagagtgttagaccttttacacggttaaagttaaactgtttg

SEQ ID NO: 48759 - DNA, 393 bp, Triticum aestivum
  Clone ID: PAT_TA_48759
gagacacgtcctgaggcattctctctatctctctctctctctatctctaagaatatatccatgaatgcattcatgcgcagattcgggaccagatcccgcaccggagcaccgagcggcagatcgagtctcctcccgtgtctcatgcgaacacgcaagcgaacacgccagcgattgatagtgagaagaacagcgaggagaccaccggcggttgcagcggcggctgttgttggtgccggtcttgtttccggctcactaccgtgctgagatcgtcgaggtgttcgtgcagttgctggagcagctacaggagtgcttcaagagctgtgcatgttctgttgcattcgctgctggagttgtggtggtacttttcctgctacatgcctggctggagcttgg

SEQ ID NO: 48760 - DNA, 345 bp, Triticum aestivum
  Clone ID: PAT_TA_48760
gggacacgtggctcttaacatattattcgactagatacagatagtgaatttgcattgagacacctatttcatgacggatttaaacttaccttgtattctcgcgcctttagtatgcttagtattctcggcaatggcaatgacttgtttatttttttatgtgcaaaaaaataagattgtgtagcatttttaagtgtaagtactataatacggtcgggtatgtggcttttgctacgctacactttttacactcaaaggttaaacggttattggttcgagtataggctatgatgctttatgcattatatgcagagcccgtttttggagaggtttttttttactgtattt

SEQ ID NO: 48761 - DNA, 360 bp, Triticum aestivum
  Clone ID: PAT_TA_48761
agtctcacaagagatcctcatacacccaccgtctggcggccagcaccagtgtcgagagtaggctaggaagatagctgagagagagacctggtggggaggcctcgagatctgtgtcgaaagagaggcaattcttgaaatacgaatcggaccaagcgagcgcgctcggcatcggggataccatacagtactgcccaggaacctttagtgactgcgctaatctagtctaagggaggcacaaagtctcccactacaccttcattgatgtgcacagcacgcctgagctacagcattaaacacgtttgacctgctgcagcgccaatacgttatgtgctgatactccaactgcgcgaagaagccatc

SEQ ID NO: 48762 - DNA, 351 bp, Triticum aestivum
  Clone ID: PAT_TA_48762
gttggcaagcaagcgcaaacagacagagcttgagagagcgcgcgcgagatggcagcctgcatgatcacctagccgattggggcgcctacgagcctgccgaccatctcccgacagggctcctccttcgccgtggtctgcagcggtggcaagaagatcaaggtcgacaagcccttcggactcgcaggctgctcgacagtcgacatcaacaccaacggcacgaaggtcggcaagaatggcgtgtaccagtttgttgacaagtacggagccaacgtcaacggctacagccaaatatacacgccgcatgatggactgaatctggtgaccggtactccagcggaacgaccgggctta

SEQ ID NO: 48763 - DNA, 462 bp, Triticum aestivum
  Clone ID: PAT_TA_48763
ccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcggcctgttgctggggaagacagccaatggatctgttatgtagcttatccattagacctatttgaagagggttccgttactaacatgtttacttccattggaggtaacgtatttggtttcaaagccctacgggctctacgtttggaggatctac

SEQ ID NO: 48764 - DNA, 341 bp, Triticum aestivum
  Clone ID: PAT_TA_48764
agccaagtgacatcgtccatccattaagccagcaccaacttctccgttctcttcgtgcgttagcttttctactctgccttgagtaatggcgaccatggtggctttgaattccttcgccgtcgtcggccggtccgccgcccgctctccagtggcggccccgcgccggaggaccctcgtcgtcagggcccagaccgagcctggcatggactcaaccaaggagacaacgagcgcatcgacctcctcctccccgagcacgagcccgaccccgaccccgatcccggcggcacccaagcccatggccaagaaggctaacccctcggtctgggacgcgctcgccttca

SEQ ID NO: 48765 - DNA, 364 bp, Triticum aestivum
  Clone ID: PAT_TA_48765
cccacgcgtccgcccacgcgtccgctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggg

SEQ ID NO: 48766 - DNA, 267 bp, Triticum aestivum
  Clone ID: PAT_TA_48766
gtgagattgcgagaatcatgagttcaagagtggtacggagggactcacgtaccgacactcaggcacgagtgcgagtgaaagctgtagagctagagtataagatgacttactgcaccactacgcctgaaactatggatcctgagatactgacagcatggcaagtttgcgcgtaagctgtgattccggccgtacaaccaaggactcgagtacctgacgaacttcctactgttacacggacacatggacggactgatggactgaccaact

SEQ ID NO: 48767 - DNA, 433 bp, Triticum aestivum
  Clone ID: PAT_TA_48767
ggcagctagcagctagctagggttcgtctacggaagctgaccgcgagctggctggccggagagaccgggcagctccgcgcgccgcagcgggcctggagctgcctagctagcaaagctcggtgaagttcttgtgaagctagctagcggacgatcgaaagccgatcgacgatgcgcctcgtcgtcggaggtcacttgagatgatgagcggcaacaaccagcagcagcagtcggcggcggaggaggagcaggagctagcgcggaagcacgcggcagcggtggctacgtcgcggcaatggtcgtcgcagacggagtcacggatagtgcgcgtgtcgcgcgtcttcggcggcaaggaccgccacagcaaggtgaagaccgtcaagggtctccgcgaccggcgcgtggcgctgtccgtgcagacggcgatccagctcta

SEQ ID NO: 48768 - DNA, 469 bp, Triticum aestivum
  Clone ID: PAT_TA_48768
accagggaggaacccggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacatgatcaggcccctgtggaggcactacttccagaacacccagggtctcatttttgtcgtggacagcaatgacagagagcgtgttgttgaggcaagagatgagcttcaacggatgctgaatgaggatgagctgcgtgatgctgtgct

SEQ ID NO: 48769 - DNA, 116 bp, Triticum aestivum
  Clone ID: PAT_TA_48769
cccacgcgtccggttccttctacggttagaacattctccaggcagctctgggtgatgcgggcgaggatgcgatgaagactggttccttctactgattgatcattctccatacacac

SEQ ID NO: 48770 - DNA, 414 bp, Triticum aestivum
  Clone ID: PAT_TA_48770
cccgaacaaaccccagctgcatccatggcgaagccgcggcttcttctctgcctgctggtcgccgccgccgcgctcctgctcgtcgcctccgccaagaagtccggcgacgtctcggccctccagatcggcgtcaaggtacgtgccctcagtctcttgcctctggtgccatcagtggataccgcctgcgcgcgttcagaattgtgtgttttcctcctgcgtgtctcgccggggggatcgattcatcctgagggaaatagattagatgctgtgcaatcgtgaatttcgtcggatctgaggcctagcatgcgcagattatgttagtctagatccggtggataacgatcttgatgggtcgaattttcagaaacgaactgtcttgttgggactgatgttcacacaacctcgagggttata

SEQ ID NO: 48771 - DNA, 397 bp, Triticum aestivum
  Clone ID: PAT_TA_48771
cgccctgctccaccttctgctccccctccggctacggcggcgctgatctccggtcgggagataggttcttcccccccttgcgaatcgacgagataaaagttatggattagtcttgctcttgtttagttccgttttctttcgatttgatccggaatttaagtgcctgctgattttgaaggtttcgtcagtttccaccggaattgggatgaattgcatgcagtatcaagttcttgtcccctttcctttgaattatctggaatgttatcccgttaatcttggctgcaacttcgtgcgtttgatttgtgattcgtgtggtgggagtgcagagatctctagcttgcgaatccagggtgcgccgccatggccgagcaccctcgcgtcgatcttcggcacggag

SEQ ID NO: 48772 - DNA, 404 bp, Triticum aestivum
  Clone ID: PAT_TA_48772
cccacgcgtccgcggggagcaggcggggatctccgccgtcatccccggatggttctccgagatcagccccatgtggcccggcgaggcgcactcgctcaaggtggagaaggtcttgttccaaggcaagtcggactaccaagacgtgctggttttccagtcctccacctacgggaaggtgctcgtcctggatggagtgatccaggtgaccgagagggacgagtgcgcttaccaggagatgatcacccaccttcctctctgctcaatcaaagatcccaagaaggtcctggcgttctgcgggaggtctcacggcactcctcggtggagcagatcgacatctgcgagatcgacaagatggtgggcgattgtgtccagcagttcttccctcattttgcccctgggtttcg

SEQ ID NO: 48773 - DNA, 412 bp, Triticum aestivum
  Clone ID: PAT_TA_48773
atcatcttcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccatgtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctttgatctgatggagtcgagcaagggtgcgtgtgcctgtgcctgtgggttacttgctcgct

SEQ ID NO: 48774 - DNA, 488 bp, Triticum aestivum
  Clone ID: PAT_TA_48774
ctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagaagggtccgttactaacatgtttacttccattgtaggtaacgtatttggtttcaaagccctacgtgctctacgtttggaggatctacgaattccccctacttattcaaaaactt

SEQ ID NO: 48775 - DNA, 379 bp, Triticum aestivum
  Clone ID: PAT_TA_48775
ttcgagctcgaccacgcctcaaagaatgccacggtcatatgcacatcacctgcagttatatatactttctaagctttgatggtcattgatggggaaacaaagtgaggctatacaagaagcggctcacacgtttgccactcaaagaatgccaaggccctatacacatcacctgcaattatatatacaattcttcgtagtgttgttacctttcatttacaatatttcttttctcagcgttgatacctttcatttgcagtatttcttggtcagttgtatttacccaaagctttatgacttgccaataaaatctagagatggaaatccctacatcaaagctcgtctaatcaaaggagtcgataacagggcaacaattacgaga

SEQ ID NO: 48776 - DNA, 355 bp, Triticum aestivum
  Clone ID: PAT_TA_48776
gcgcgatgactgacagaactgcggattgtattagctgctgaaccatggcatatggagcgtagctgcatgaccaggcaagtgctacccgacggtcagcgacgagtacctggccgccgtcgccaaggccaagcgcaagctccgaggcttcatcggcgagaagaactgcgcgccccttatgctacgcctagcgtggcactaggccgggaccttcgacgtggccaccaagaccggcgggcccttcggcaccatgaagtgccccgcggagctcgcgcacggcgccaacgccggcctcgacatcgacgtcaggctgctcgagcccatcaaggagcagtttcccatcctcttctacgccgac

SEQ ID NO: 48777 - DNA, 286 bp, Triticum aestivum
  Clone ID: PAT_TA_48777
ttccggacgcactgtgcccatgctggaggacttgtagactcgatctgacgtgccttcagccgtggcttcctctgtgagcacctttcttagcacctttcttgtgaacccggtggcggacaacgggccccttaaagggcggttcttggtttcggtaaagtttggccccaaaaataaagccccggtgaaatccaaaacgcccccgcccacttttttttccctttttgtttccccccgcgtactcttacaggaatctcctcggcgaattcgtcttatactactgcttttt

SEQ ID NO: 48778 - DNA, 365 bp, Triticum aestivum
  Clone ID: PAT_TA_48778
cgcaagcttaacggacgcataggcccacgcggacgccctaggaggcacgctcagacgtgcctgcatccgtggcttcctcggtgagcaccttcctcagcaccttgctggggacccgggtggcggacaacgggcccatgaacgggcgcatcgtgtctcggttgaagttggccccgaagaaggacgccacggagaaggcgaacacgcaccggaccatgtagctgccggtgtcgctcgcccgcgcgcacgtgcacgagtccctcgtcggcaagttcggcttcgactactgcttccaccgcttgcccctggagtagccgcagtactacctgcactacgtggagcactacctggaccagaacctggccgac

SEQ ID NO: 48779 - DNA, 384 bp, Triticum aestivum
  Clone ID: PAT_TA_48779
tacaacaacctcagtggagctattgatggtacacacataaccaacctcagaaatcttgtagtccttcatcttggatggaacaacttcagtggcaagattccagtttctataggacagctcaagaaattggaggagctccatttggcttacaacaacatgtcaggggaactgccatctgctctgagcaactgcacaaatctcataacaattgacctcaagagcaatcacttcagtggaaaacttaccaaggtcaatttctccaacctgcccaatctaagaattttagacctctggttaaacaacttcaccggtgaagttccagaaagcatatactcgtgcagtaatctgattgcactgcggctatctagcaacaacttacacgga

SEQ ID NO: 48780 - DNA, 282 bp, Triticum aestivum
  Clone ID: PAT_TA_48780
ccgtccgattccggtcgccacgcgtccgttataacggacgcctcatgctatcaaatcttttggatcgagagtgaacctcttcgatgcacattctggtctgcggtcaagtagtgtttgtgacttggattcccgattttaagcttcttttcttaaccttcttgaactacccttgtacataacatggcatgcttcttcggaagcaaggccatgtacagggaaatatgttaaccaatcgtgccttgtaagtttgtgacgtactaaaaaaaaaaaaaaaaagggcgg

SEQ ID NO: 48781 - DNA, 391 bp, Triticum aestivum
  unsure (1)..(391): unsure at all n locations
  Clone ID: PAT_TA_48781
cccacgcgtccgcccccccgcccctccccccacgaacccacagcgcgcacccgagatccgcagccgaagcccgtgagaacagcgaagcgcgacaggaaaggcactgaactagtttgcaacaaagaagagagaaaatgtctaccgctgaggcaacccgtgaggagaatgtgtacatggccaagctcgccgagcaggctgagcgttatgaggaaatggtcgaattcatggagaaggtggccaagaccgctgatgtaggtgagctcactgttgaggagcgcaacctgctctctgtggcttacaagaatgtgattggtgcccggagggcttnctggaggatcatctcctccattgagcaaaaagaggagagccgtgggaacgaggcctatgtcgc

SEQ ID NO: 48782 - DNA, 272 bp, Triticum aestivum
  Clone ID: PAT_TA_48782
ctcatccatgattgattagccaacaggcattacgcactacattagcagcaaccacgtgcgtgcatacataggatggtgaactggttacaagtgctaagaaaacacttagttgctagtctggcgacatacgccggcctgaagctgcacaccgttgtcgcctatgacgcgaactctgacataaagatctggctggctgataatgacaatgcaccggacaggaagcacatgcagcggaagaagcaccacgccgtggtgctggtgcacgggttcga

SEQ ID NO: 48783 - DNA, 301 bp, Triticum aestivum
  Clone ID: PAT_TA_48783
ctcatccatgattaatttgccacccgcccttactcactatatttgcagcaaccacgttcgtgcatacatggggtggcgaactggattcacgcgctaataaatcacttagttgctcgtctggcgacctacgccggcctgatgctgaacgctgttgccgcctatgacgcgatctctgttataaacatctggatccctgatattgactatgcaccggacaggtagcacatgcagcggaagatgctcccccccttgttgctggtgcacggtttcgtcgtctacggcgacctgacgtgtttgctcc

SEQ ID NO: 48784 - DNA, 366 bp, Triticum aestivum
  Clone ID: PAT_TA_48784
ggtgtccccagcgccattgctcctcttcctccctcaccaaacaccaatcactcagctgcttcttcttcaccagagagcagagcagagcagatccagagtcaaggcggcgaatgggagagacggggtcggagagagatggcgggggtgggcgttgggacgggggccatgaactccctcctcggcaagctcaccgccttgctgggcgacgagtacaatctgctcaagaaggtacgcaaggagatccagttccttgagcgcgagctcaccggcatgcgagtcttgctggagagactaacgggcatggaggagaaactcgacatcatggccaagggctggagagacagagtgcgcgatcttagctacgac

SEQ ID NO: 48785 - DNA, 312 bp, Triticum aestivum
  Clone ID: PAT_TA_48785
ccacaagcaagcaagaagacgggacaaaaagaaacaaacaataattgagtttttttatataatataaatgttctagtactacttttgattcagtcaagttcagctggagctctggcccaaaaaactaagctctgccgccggaactgaataaggcacagaaagataaatgtttcctgcagaaacgcacctgaatagtttgctccatttgccctacactaataatctgcccaattcagttattcttgtgaaagttatatgtaggataaggtaaaaaaagagggtatgctgttgctcccaattttccagagcctg

SEQ ID NO: 48786 - DNA, 408 bp, Triticum aestivum
  Clone ID: PAT_TA_48786
aagagaatggcggcgagcaacggcctcgagggtgtgctcctggggatgggcaacccccttctcgacatctccgccgtcgtcgacgaggccttcctcgctaagtatgatgtcaagctgaacaatgccattctcgccgaggacaagcacttgcccatgtatgatgagttgtccagcaagggcaatgttgaatatattgctggaggagccacgcagaactctatcagggttgcccaatggatgcttcaaactcctggtgcaacaagttacatgggttgcattggaaaggacaagtatggtgaggagatgaagagtgccgctaaagctgcaggagtcactgctcactactatgaggatgaggctgctcctacaggcacatgtgctgtctgtgttgttgcggtgaaaggcatt

SEQ ID NO: 48787 - DNA, 407 bp, Triticum aestivum
  Clone ID: PAT_TA_48787
cggacgcgtgggtttcattcatgttcctctttaagtttatttatatatgcaataaaagtagttgcaaaccaaactattaaattccacttgtaccatatatgttctttcagagcagtactacattctttgacttgacataggtgcaatttcacctttggctcttcactttttacagagctgcaagatctgctggcaacacttatcaaccaacttctgtaaggtctaactggttttggatagaaatattcgatagagaattcagtaatcaaacctacctacatgctaacaagtgagggtgcaactgaattgatgtacatgaatctggaacaagaggaagaactgaggattcttcaagaagctgcttctatttatgcgcaatggcgtcatagccagtatggcagcacgtg

SEQ ID NO: 48788 - DNA, 369 bp, Triticum aestivum
  Clone ID: PAT_TA_48788
cccacgcgtccgcccacgcgtgcgcggacgcgtgggccgtgggcggcaccaaccacagacacgccaccaaggacctgaccgactccatcgccgtcggcaactacccggagtggaccttctacatccagaccatctacccggaccacgaggagcggttcgacttcgacccgctggacgtgaccaagacgtggcccgaggacgtggtgccgctgcagccggtggggcggatggtgctcaaccgcaacatcgacaacttcttcgcggagaacgagcagctggccttctgccccgggatcatagttcccggggtgtactactcggacgacaagctgctgcagacgaggatcttatcctactcggacacgcagc

SEQ ID NO: 48789 - DNA, 146 bp, Triticum aestivum
  Clone ID: PAT_TA_48789
tgtcacacagccctagcaagtttagcagatccagagccgaagatgagcggggtgaagaaggtgacggacgttgcggccaaggccgggaaggcgatcgactgggacggcctggccaagatgctcgtctccaactaggcccgcaaggt

SEQ ID NO: 48790 - DNA, 206 bp, Triticum aestivum
  Clone ID: PAT_TA_48790
gcgacgcgtacgtccaccgactcgttcctataacgtttgcctactatggcgtccccctccatcttcggcggtatcgcacagggcccagaggaccccatacgtcaggcgacggcctcgtacaacaaggatcccacgctcctcaaagtcaacatctggaggagaccctaccgcaccaaggaatgcaagcccatactgctgcatgtggc

SEQ ID NO: 48791 - DNA, 400 bp, Triticum aestivum
  Clone ID: PAT_TA_48791
cctccgcctccgccgccgtcgccgtcgcgtcccgcctgctcctgcgccgcgcgccgcacctgctgcgccgcctcccccgcgcggcaccgtccgcccgcccctcgtcgtcttcgtcgtcgtttggcgccgccgccgctctccgacgcccgctcgggcaccgcgccaggatggggcacacctccgccgcggcctccgccgtccccgcgctcgggctcaccaaggccaacgccgtcgagctcccccaggttgctttcacgggcaaggacattgaattctccgactggaagggcgacatcctcgccgtcgcggtcacggagaaggatctgtccaaaggctcagactccaaattcgagaatgccgtgctaaaaaagctcgacgcccagcttagcggtctgctctc

SEQ ID NO: 48792 - DNA, 261 bp, Triticum aestivum
  Clone ID: PAT_TA_48792
acgcggacgcatgggttcgtactctttaccagcgaagcactctcacttgttagctagcaggagcagccatggccgctctgtcatctgcaggggcgtccgtaccttccttaggcggcaccgcgatgcgcatgagaagaaggacgatggcggtgcgcgcgtcattgggcaaaacggcatgctgcgcggccgtggccatagccgccagcacgatgctgctgggcggaacggcgatggcccaggacgtgctcctgggcaccaacg

SEQ ID NO: 48793 - DNA, 237 bp, Triticum aestivum
  Clone ID: PAT_TA_48793
gcgaggggaaccaggtccaagccgtagattcgggcacgagcgtgcaaactccactcggcaccaacaggcacgccggtgcaggcagtcacggacacggtaatgcgggcttctcacgacccttacccaactcatgatgtgacattcacatcacctgctctgaatgcaggagcttaaagatagcttgtgtgctctcagcgccggaatgtggtgaagtatgctgcccgggcaacgtctgtc

SEQ ID NO: 48794 - DNA, 333 bp, Triticum aestivum
  Clone ID: PAT_TA_48794
catgcgggtgattggttacctagacctatcgcgacctgagtgcgagcgggcactctgaccaatggcgtccagatgcggcgggcgatctgttccggctgtttgtagatggcctccggagccctgtggctggcgctaactgcggggctcgcgggctctctggccgtggcaaactcctagggcgacgcgctctcggggctgagacgtaggatgcgagactccggaagcgttctacatagctggaactcaactgtgatcgacacatgcacgtgattccacgtgatctgggaccgtgagaaccgtgtgaccctcctagatcttggctacttgaattta

SEQ ID NO: 48795 - DNA, 361 bp, Triticum aestivum
  Clone ID: PAT_TA_48795
tcgacgacccacgcgtgcgaatggccctcattgtggaaagatcgtgtgtggggaaagacacacattttgtggatatacatactgggtcctgatgatgagcttgctgatgacgggctggctccaaatgaagagaatttgtcgctgcaccgagctgaagaaggggtctcttggatcgcccgtgctgttaggggctgatgtcaaagtgcactaggatgcgccttgagtctcatgtctcggcatgggagcatggttagtcatggtaaagctctcgtggacccacttgtgactctattcggaagagtgcctgagaagatgcctgtagctatggggagcatgcgcagcacattggttcctaactttg

SEQ ID NO: 48796 - DNA, 252 bp, Triticum aestivum
  Clone ID: PAT_TA_48796
gcggaagcatctgaagcttgcgtccaagccggatgtcttacagaccgagggccacactttcaggtttgcagcagcaaagctggctacaaacatcgcaagctccataggggatgacaaggttcaccttcacaagtaccatcttctgtcaaagaggtcacgggcgccaatattagtagcttctagtaatgaggaaggcaacgctgaagtgaatatatctgacatccctggtggtgctgctgcattcgaaatctg

SEQ ID NO: 48797 - DNA, 370 bp, Triticum aestivum
  Clone ID: PAT_TA_48797
gcgacgggactgactgaggcgacgaagcatatggagcacgcctgcataaaaggctaaggtaaggagaaagcctctatgcctcccctcctgacctcacccgcctgcatatcctcgtccgctgccgggtgcgagttcacgcagttcggcaccgcctgcttctggggcctggagctggtgttccatcccgtgcccggggtcactatgaccgaagtcagctacacccatggcgcctttcatgaccccacctagaaggacgtctgcaccggcgcgaccggccacaactgggttgcccggatccagtacgaccctgctgggtgcaagaacgacgacctactcgacatcttctgggcgcgccacgacccgaccacgc

SEQ ID NO: 48798 - DNA, 249 bp, Triticum aestivum
  Clone ID: PAT_TA_48798
tcttgcggcgagggagtactcgaatactgatcggatatggcgaccgcggcagctgcaggatcggtggacaagcgcaacgccaggttcttctctatctcggcacacggccacatcaagccgatgcttcagctggcaaagctcctcaaacggagccatggcttccgggtcaccttcgttcacacggagcacaaccgctggagggtgctccggtcgtgcggtcccggcgcgctggacagggtctgcgggttt

SEQ ID NO: 48799 - DNA, 228 bp, Triticum aestivum
  Clone ID: PAT_TA_48799
tcaatcctgaactacctgttgctcatggggcagatgaacaccagcacgatgcgtaaggacagtcgattatgacaacacattgtctgccaacggcatattatgcaaccagcacatcgagcggtgctcgacatacagaacataccactggtagcacgtctcgtctcgacagtgcacacgctgatatagacctatgcacttgcatcctcgaacgtggacatcatactgaac

SEQ ID NO: 48800 - DNA, 268 bp, Triticum aestivum
  Clone ID: PAT_TA_48800
gcaaatcagatcactccaaaccagagactcagagcccaacgctttaactctgagggagatcatgaccatccgaccatgtcttgctgcggaggcaactgtggatgcggatccagatgcacgcgcggaatcagctggggagggagcaagatgtaccctccgatggactaggcggtgaacactacctgggaaacccttattatgggcgcggcgcccttcaagggcacaccatgtgtcgaggccacctgctataacagaggatgcaagtgca

SEQ ID NO: 48801 - DNA, 349 bp, Triticum aestivum
  Clone ID: PAT_TA_48801
gtcgcgacagctcagttctttcgtctggtgtgggagcgagacctaccagtcgcgtacctccggcgcccgagcgatatcgaccgccgaggactcctaaaggccattggcctcgggcacaggcagcctgctaagaggcatcagccgaggcaacaggggggctggaaagacagcctcgaggaaccagtttgcgtacaagacgatcagcatccactggaaggctaccatgggggccgattttctaacctacgaagttcagatccaggacaggatgttaagcctacaaatatgggagactgacggtcccgagaggcaaaaaagtgttggcgacgcattcaaccgcagagcagaa

SEQ ID NO: 48802 - DNA, 323 bp, Triticum aestivum
  Clone ID: PAT_TA_48802
tataaccaactcgtacagtcatgctaccaagctatatacgctacataggacagccatggccctcactcgtgatgggctcaagggccacctccgtctctcctttacacgggcttaagaccaccgtcggcctggcagtgagacgacggttcaacggatctagcctatgcaggggtagcaactggggaaggatcagatgcatgcaagcgtggcctactgaggacatctaaaaacggaagaccttgtcatacttgtcaacgatcatgaccgatgcaattgtgaagcatgtctactacctaatacggtccaagtgattgccttggctc

SEQ ID NO: 48803 - DNA, 301 bp, Triticum aestivum
  Clone ID: PAT_TA_48803
tcgcccagccgtaccgcacccgtatctctcgattctgcccacacgtacgtccacacaagctgctaataatgtgagggaggaccttgcgaagataggcgtgaagattcaccgctgctactggaaggatcggaggggtgatattccactaccacatgaaaggcctgagcgcactgatgcacttatgaaaggctacgccgcactccacctatgcaattatgccacgatttactgcgctggaaccagggaaaagcgtctcgagtttctgtgtacgcatcactgggctggttatacactgtgatgc

SEQ ID NO: 48804 - DNA, 283 bp, Triticum aestivum
  Clone ID: PAT_TA_48804
gcaagctggtgtgcgtcatcttgaaagaaggctacctgaattggatcgtgcacctgatcgtaaaggtgcaaagctagattgtacgcttatactcggcacggaaatagcagccaataactacaactctactggactcgagactcctctatggcggtgcatatgaaatgcatattattcctattgaccaagacatatcaattacatattactattcatcacccatgatcgctgatgatgctatgacagaaaaagtgcttgagccttctaaatctgatgacatgaa

SEQ ID NO: 48805 - DNA, 418 bp, Triticum aestivum
  Clone ID: PAT_TA_48805
gcgggctctagcaggtaccatccctatgggaaatgagtgcgaacccatgtggatggtactaggatgcaataagcgctctcatctgcatgggatcttctaaaacatgggcatccatctggagttacctaatcagaggcatcacaacatacatggtttagctgaattaaaggcgccaccggggacaagggtgatctgtgtcgctaagcctgcccgtagtttggtgtagcggctacagactaaagctgaggagactcctgtaagcacatatatgcagagcgtgaacagaccctgaaaacaaagacctatcgtgtgaggaacaagatatggttgatagaactatatgcgtgctgccaagatgatcgttatatgcaagcgagctcgcttgttgccatctgagcttatatgcagggaagccttt

SEQ ID NO: 48806 - DNA, 218 bp, Triticum aestivum
  Clone ID: PAT_TA_48806
gcgcgctaatgctgcgcatgtgaaggcatatggtgcgcgggcggggttcgcatggcggcacagaacggctgctgaagctgtaccagctcccgcgcataaacgattatcaatactgactacctgtcgccatttaacaattacctatactggttcatgcttggcattttgcactccgagatcataatctatggatcggaatatgctttgagagcccatga

SEQ ID NO: 48807 - DNA, 391 bp, Triticum aestivum
  Clone ID: PAT_TA_48807
gacggggggcaggctcctgagccgactggtacagagatcgtcgtctgcgccagagcagaaaggcaaagatactctgggatgcagacctgctggcctcccgtgcgattccgtggcatgcagtagtttgcaccgtgttctcttattctccgacgccaaattcctacgctgctccggtattcgataccgcaacggggctacattgatagggatgttcatcgaccacggcggcgacagcgacagcgacgacgacgacgacagtggcgactacgactacaaccacggcgacgatggctacagcatcaccttcgagccatcttctggcacacgataccgtctgaggtgcggactcttgatccacaagatccggatcgaggtcctggtgtgggatccc

SEQ ID NO: 48808 - DNA, 349 bp, Triticum aestivum
  Clone ID: PAT_TA_48808
gcggtcacgcgtacggtgcaatgttactaatgacggaggaaatatgagcgctgaattcactctgctgtgggagaaacatgagccttcgacttatcccacacgatgcagactgccataattagctataaccctaaacgagctgactccaggtttaaaggagatacttgctacatcagattcgaggctcacaccggatcaccgtctcctagagtacggggagtgccatggagccagctgtgacaagctacggatggtgacaaggcgacagatggcacggtaaacgcaggctcatggatcggaaccgagctggttagacagggacactgaaaaccgagcgagccactgcacc

SEQ ID NO: 48809 - DNA, 243 bp, Triticum aestivum
  Clone ID: PAT_TA_48809
cgaggccaccgaaccaccgatgccgaagcgaccgctgacgccctcgaccaccgtgaacgaggagtctgatgatgagctgtaatagcgcacgcccgcgacggaatcatatacagtaatcacgcacgcacgtgagggggatggagagagggtggtggtcatgccgccctcgccggcatcgtctccgctgatcaagccggcgcttgggggcttggatccggctgactttttgttgtctccggcgct

SEQ ID NO: 48810 - DNA, 438 bp, Triticum aestivum
  Clone ID: PAT_TA_48810
caaacaattacttctactacctaggcacagcgagcccaaacagaactagcgagcacagccatggcacccaactgaaacgacaccgcgggaaacttctacagagggatgcactgtacaatcacgacgctgataacgagcgacgccctctacagttacattgtatacaccacctggttctcatgagagcacaagtgcatgcgcgacctgtgccttattactgacacgaacccatggtgttacatgcactcatcctgagacgaggcgcacctgctacggatgctgatcacgatggcacgcgctaataagatgatcgaagtgggcgtgttcacgggctactcggtgatgggcaccgcactggcactcacggaggacggctaggaggtggtcatcgacacctgaccgaagtgctactaggtgggtaggccgtttatcgagaag

SEQ ID NO: 48811 - DNA, 322 bp, Triticum aestivum
  Clone ID: PAT_TA_48811
tcgtacacgcgtacagaaatacgtgctatctaagtagcacgccctaagagcctccttgcttgtgataatacaacgggatggtatactcctaggatgacatcctgaaccacgatgggagaagccaatgacaccaaggtgtacgaagaggatctcgaggactacgacgaggaggtggagaacgccgtcgacagaacagtcaccaaccattccacagacgacggctaaaagggttacttgtgaatccacagctgatgggtgagagacatgattgtcaagccagagctgcttcgcgagatacaagacttgtggacagagcatgctt

SEQ ID NO: 48812 - DNA, 355 bp, Triticum aestivum
  Clone ID: PAT_TA_48812
catgcacaagcttccggggactagatttttggttgacgcacaaaactccatggacacgattagatgctatcatacgcgtggtggagcctcactcgagagacctagggtactgagcatcataagctcaagctgaggcacatcacattctaaacaaccgaagatgcattggcaaaccgagtgctctaaggcataccaagttctagcagtcagtgcttacgctatgagaccggttatgattcgtgatcgagtatgctaaaggaacgtgtatggatcgcgcagaggaaacttatgcgatcacggaacggggactcaaaggagaccatcatgccgcgcgatctcttagacaaaatatgag

SEQ ID NO: 48813 - DNA, 100 bp, Triticum aestivum
  Clone ID: PAT_TA_48813
ccacccgaattgatgactacacctaatcctatgactacgcctcagaataatgacaatggatgctgtgactacgactgaaaagactgaaggtcgtgccttc

SEQ ID NO: 48814 - DNA, 279 bp, Triticum aestivum
  Clone ID: PAT_TA_48814
acccgcgccgacgcgcacgctcgcgcgccgcgactcaacctgagaccctgagcggggcgcccggtgtctatacccaaggccctgagcacgacccatcatcgccagcgccacgttactcgagttcacccattctggcgggcaacctattacccgagctggcctcttggggcggtgaacctaactgacaggccgtcctccgtgcggcgtgcttttgactcataagtggaccgcccgtccggctgtatactgatacactaggggagctcggatgcggacttt

SEQ ID NO: 48815 - DNA, 236 bp, Triticum aestivum
  Clone ID: PAT_TA_48815
acagcatcccgtggtagacacgagcgtgcgagggagagaggccactactcgctctgctcccagggggatgaagatcgacgattcactggacttcgagggggataacgacccaatgctaacgggccggcggatcgccaagaggaagacggttattgcgctggatgatctctcaaaacattacttgaatagcggaaaggatgagctcaaagctactgctgctaagactaaggctcgcc

SEQ ID NO: 48816 - DNA, 312 bp, Triticum aestivum
  Clone ID: PAT_TA_48816
ctacgcagaaaaccagatttccgaagcctatagacagggaggtttgcaggatcccttgcgacgatggtcaaaatcttttccagagtgtctttcagggccgggcaacgttgcgccaagagatgcagacagggtgtggtgacactggcgcccaacatggggactggggtgactgacccgggagccgattctggatatagcccttacagcattctagggggcctgtggatcaagcccgaggagcgcactgtggaggctgtgaaccttgtacaatcaatgaaatgaccgctttctgagacatgtattctgcatgat

SEQ ID NO: 48817 - DNA, 320 bp, Triticum aestivum
  Clone ID: PAT_TA_48817
acctagtgtcgagcggttctgcatgatataggagacctactgaccatagggtatgcacgctctgaggcccaatccgacattggccaaccgctgcacagaggcttagtcggcaatgttgggaacgctaaagacgctgttatccgccaccggaattgagccctatgacatcggactccttggctctaagtgatgattgttaaacgggacaatctcagtgtcaacgatgatagctaaaaggtacaatgtatggggcgaagtgccgagcttatagctatgcagcatgggctggacatgctgcatgatcaccatcgaacttacgc

SEQ ID NO: 48818 - DNA, 354 bp, Triticum aestivum
  Clone ID: PAT_TA_48818
gtgatggcctcaagggcaacgtctgtctctcctttggaaggtcttaaaaccaccgtaggcttgccagttagacgcaggttcaacggatctagcctatgcaggtgcagccactcgagaacgatcagaagcatgcaagtgtggcttatctagcacatctaaacacggaagaccttgtcttacatgtcaactatcagcaccgatgcaattgtcaaccttgtctactacctaatacggtccaagtgattttcttgcatcacgtataatatggtgggtactatgatggccgagcacgaacaatgtgctggctactatatatggccggtgtcggacactgtacaagctatctatgttggg

SEQ ID NO: 48819 - DNA, 199 bp, Triticum aestivum
  Clone ID: PAT_TA_48819
tttcggatacatatctaccagcgttaacatggatcgctcggggcgcttatcctgtctcacttactgtaacggcaagcaggcaatccatcttgcaccagattgcgacttagctcaggcaatacaccacgaccagattagactcaactgcagctttaaagcctggcttatctaaacttatcacatgagtgcaagcctgata

SEQ ID NO: 48820 - DNA, 286 bp, Triticum aestivum
  Clone ID: PAT_TA_48820
gacacccagaggttgccgtccgagaattattgagggccgtctctgttttgcttccacgcgagtctcgccttcatatttgtgctccgaatcctcagatctacgcctcagattggcgggcgcaatcctgagcaccaggttcttggatgacggggggagccatgggcaggttgcccaagctggccaagaggtgcatggacacggtcgcgccggccatggtgaaaatacaagagctgctggaaggggccacggatgtgatgccgatggcgcacggaacagggtattggca

SEQ ID NO: 48821 - DNA, 171 bp, Triticum aestivum
  Clone ID: PAT_TA_48821
atgtacaagaaaatgtctgaaaggctaaaaacagctgatctatacaaggttgaatacgcaaaataagagacatagaactctggatggctccaacagctgaaagacttagagcaactgagctatcgaagaactgtctactctagaatgactagcctataccagcacctacta

SEQ ID NO: 48822 - DNA, 341 bp, Triticum aestivum
  unsure (1)..(341): unsure at all n locations
  Clone ID: PAT_TA_48822
accgtgctgacaacctgtaccactcgatcgcgcacagctctggtattcactgtcagtgctggctcgtcatggccctcggtggtctgttgcggcacggacngcggtggtcacggtcgtgtccatggcggtccacgtcgcgctcaactggccgatccatacggtcctgataacgtcgtcgaccggcgggcgctaccgggctaataacctcctacagggcctggagaagctggcggaaaggcagctgagcgcgccacacgacatatacgtacacgcgacggctggatggacactatacacggcgacgagggacgggtggcttcacaggatgcaccccaaccggt

SEQ ID NO: 48823 - DNA, 284 bp, Triticum aestivum
  Clone ID: PAT_TA_48823
atttttgctgagctggcaacggcggtgctggctcaaattagaggatcgtggcaccggcttcaattgctccgactaatatacttaggacccagctgaactaagtggtgtcgtacagaaaatcgacagcgtctccaactgctggaacacaaaacatggtctgaatctgtgatcggttcaagaggacgcctggagcgaaggcatagaccaccagctcggccagttgtagcgtgcgcataggcgaatagattggcacgaggtactgttctgacaggaggatgtacttg

SEQ ID NO: 48824 - DNA, 227 bp, Triticum aestivum
  Clone ID: PAT_TA_48824
cgtctccataccttctccaatccggtgctggtgtagcttggccaccgtcgcaaattagcaaatgctgtagctgtgcagctccggccctcggtgaaatcgctagggcctgtgcctacggcgctccatgcaggcggcggcgcccgttcggacggccgcggcgggttgttgtcacacgcgctcgtggtcgtcggcgtcgttgttgcaagatctgagcgagctagtgcggc

SEQ ID NO: 48825 - DNA, 371 bp, Triticum aestivum
  Clone ID: PAT_TA_48825
acgagcagtcagcatggacagagcaacaatggcgacgggggcgtacagcgccttgaggagctgtaatgccgtgggcgtacctagcctgtttgcgccttcatctaggtcaggacgttccgggctgtcgttatgtgcgtacagcaccacctccggccgcgtcaccatgtccacctagagggttcctggccaggcgagtccaggccacatcgactggtcctcgctaggggactgccagttcaaccacctgggcagcgctgcgcgactgggcaagcgacgtacctatgcaacccagtgacctggggcaacttgcctaccatgctgacgatcgaattactggacatgaccttcacagagcaaatcgcaccatggag

SEQ ID NO: 48826 - DNA, 322 bp, Triticum aestivum
  Clone ID: PAT_TA_48826
gaaagtgacagagagaggtacagagagagagggggggagagtgtgggagatcagaccctatccaatgccaagatcaagaccagatcagtgaggaggacacgcgacaatctccaccctgctagaggagcggagacaagaccggctccgggctcctgcaagaacaaaaccaacaaggactcccggagcacgagggaataaagctgtcgattaccggaaaggccgatggatacaaagctgttgatcgacataataggcgatgtattcggcgctgctagactacatcatcgccagaatgctcgaggtgacgagcctcaaatccagc

SEQ ID NO: 48827 - DNA, 207 bp, Triticum aestivum
  Clone ID: PAT_TA_48827
gcgacaattatgcataatgacatggacgtttgaggtgacgtcgcatctcaataccatccactgagatacatgaacggcttcacaggagcatcagacgttccacatgccctgctcacatcttcaatgtgaccaaagcctagcatacgccagaacttgtgtatgcagaaagcgtaagtcactcttgccctgacgctgcacatgctctcg

SEQ ID NO: 48828 - DNA, 246 bp, Triticum aestivum
  Clone ID: PAT_TA_48828
gacacgctttcgctaacaaccgcatacgaggcgcgaagcaatatctcctgagatagtgtatgggccatgggacattcgatgctaatgtgctgcgtgaacggcgtggcctccggcaggagcctgctgtatgcggcgcggccgtcttctgcgtgcacgccgttgtcgaggatagcgctatgctggtcgtcctcggccgcatactacaagcacatgcgcgagaatatccatgcggaccatggccatgtt

SEQ ID NO: 48829 - DNA, 315 bp, Triticum aestivum
  Clone ID: PAT_TA_48829
acgccatacttctcattcctcacagcatcctatcagggcttagctgacttccctctgcggcacccaccaaggaaaggaggatgtcttgctgcgccggcaactgtgggtgcggcgccagatgcaagtgcagcaacaggtgacgcgggtgcaagatgttatgggacttggaagccactgccagaacgggagctatggtcatgcccacagcctcccacaaagcgagctctggcagttgccaaactgccagtgagacacgcggttgcgactgtactacctgcaattgcagtaacgcgtgccgctgctcgtgctgcagct

SEQ ID NO: 48830 - DNA, 327 bp, Triticum aestivum
  Clone ID: PAT_TA_48830
gttagcttggatactgacttataggcgcccatggcataatcccgcacaccgatgaccaacgccactggctaacgaaccaatcgcgacgacgaagagtgtgtatcaacacactgtcttgtactaggttgaactactatggcgacacagggattagccgggtataactaacctgattgacgacggaataaccccacattacgtgaactatggttgggagagcaatgcaaaacttgcagaatacggcttaacaaggacaggaataggcaccctcgaatgatcaaaacgcaacgtcgctgtggacacttggctgacacaagtcagttataa

SEQ ID NO: 48831 - DNA, 323 bp, Triticum aestivum
  Clone ID: PAT_TA_48831
gccgatacctgcaactatccagtgggtttgcaaagaccagactcggagatgttcttggtgcattgaatgagaacactctgcattgggaagggttcactctatgcgaagatcgaagaacgggacggattattcacgtgctgtaagctcggtacaatcctgtagaggggcattatcttgaagcgatctcgtcgcatctaggctttaacatcaatgaagatcacgtgattaatttattaagaaaccagagataaagatttgcccgggatatcacataggagagattatagtccgagttaggaaacacatacatcgagattattctc

SEQ ID NO: 48832 - DNA, 346 bp, Triticum aestivum
  Clone ID: PAT_TA_48832
ccctccgtcgacgcctacgctcgatctatggtctgcgaggcttcagtctcaaactctcgactttctccgcgaggaattgctatgcaatgcttgactgtaagtttcgccgcacggaatgcctgtatggcgaataaattcgtatgcccgaataagcctgcttgcgagaagcaatggatacctgcaagggctctctcttattggacagcttacacaaactctagcagacgctacaaggttgccactggggagtgtcccgaccgtccagatgatggcaggcgttcacactggagatctttcgcatcaagtttgaatttaaaaaatgggcctgcaccatcgagctcgacat

SEQ ID NO: 48833 - DNA, 273 bp, Triticum aestivum
  Clone ID: PAT_TA_48833
acgggtacctgttagtcaggcaatcatgggggagacggtcaccaatgtatcggaataccatgccattactaagcatacgctgccgaagacgggctaccactactatgcatccggggcggatgacgagtggaccttcaaggagaacaggtacggattgtcgaggatactgtttagatgtcgaatactgatcgacgagtgaaccattgacatgaccacatgagttctgggaatgaatatatgcatacggatcatgattaacgacagcgcctttca

SEQ ID NO: 48834 - DNA, 247 bp, Triticum aestivum
  Clone ID: PAT_TA_48834
gcaagcccggagcttatgaacctgtacgatacgcgccagatcggaggctatgagctcgaaagacaagcgcaccctatgaggcctgcggatgacgacccgcaagcggaatatgcaagcgcctagagacatttggacgatgcttgatgcaatggaccagatgcatctggattatgctggtgacctggaacttgctgacgtaagtgtagcgctatcatagctgaacttctcacgtgacggcgacactatc

SEQ ID NO: 48835 - DNA, 174 bp, Triticum aestivum
  Clone ID: PAT_TA_48835
acgttaacgcgtctgatctgatgaccgatagatcggttgatcgacacttatgggactacctatcgcttgctagctggacggctcagggaactagcttggctgtgcgcggtcgatgggtcgcttgaacagcaaggctgtggtgagccgcgcggtcctgcctcggtggtgctgatg

SEQ ID NO: 48836 - DNA, 253 bp, Triticum aestivum
  Clone ID: PAT_TA_48836
attcattgagcacgatactctttttctttcgcggccgcacggagctagattctcctgctactacgctgatgaaggacgcaacgatgaccggatacaactctcataatgcaggctaggaggccggcatggtgctcatacactcgcggatgtcgtagcgaatacctggccatgccgacgcagatctggtggtcacgacctgtggatctctagggattcggtaaccttggtgaaggtggtcggctgcgtcttggct

SEQ ID NO: 48837 - DNA, 336 bp, Triticum aestivum
  Clone ID: PAT_TA_48837
acgacaaagctagctagctagaagaagaagtagagaaagattttgatacattaagctaggcagcatgtggatgatctccagcatgctgagccggacgcagccgcccacacagccaaaggcgaaggagaacgcggcgggccacacggccaacggccaccgccacggatgcagatgctacaacgtctcatagacgccaagcatctacatgctggagccggtcatggatgccatctcgctgactgccttccgctgtggcaggtgacgatcgactctgaggctgacgctatcgaccgcgagcatagactggaaggagacgcccacggcgcacgtgttcat

SEQ ID NO: 48838 - DNA, 231 bp, Triticum aestivum
  Clone ID: PAT_TA_48838
caccatgaattaccaagtagacccacgcgtacgagcagatcggcgaggaaagaatagcaagcggatgatgatgggggccgcggcaggaccggtaatcgctaatgctggcttttgccgtatctctgctcatgagcaccaccacctactttctaatgtggacgcgccagagcaactacccatgcttcaccagcatccaaagctaggagctccggatgcatcccgtgcatgcta

SEQ ID NO: 48839 - DNA, 393 bp, Triticum aestivum
  Clone ID: PAT_TA_48839
tagcacacacatacgcaaacacgtacgatcgagctaccacccaaacacccaaacaagcaagcttctggatcgaccaaccccagccgacagatcgtgatcgtgatcgatggactccatccgctaccgtgtgccggcggcggcggcgctcgttgtgctcctgacggtggcgaccgtcgtaggacgctctggctcgcagctggcgatcccggtgaggaccgacgggttcctgtaccgcgggaagtcggacgctcctgcgtggggcgactgcggtggccgtcgaggcctttttcgaccgcgtctagacccacagccgcaactcctggccggcgctggagagggccgtcgaccacttctgcgcctgccttatcaccgtagttgtttaattgtttgctc

SEQ ID NO: 48840 - DNA, 347 bp, Triticum aestivum
  Clone ID: PAT_TA_48840
acggagagaaacacatggcacgaagagtagagagagaatcaccgctcgagatggcgcaaaccatggcgtacatgaccgggctgtgccagggcgtgcgtctaccaggccggaccggcaggcgcgccagcaggttcaccgtgagggcgtcgtccgcggatgcagaggccgccggccgccgcgcggtccttggtctcatggccagcgcagtcgtccgcagcgcgttctctcaggtggtgcacgccggcaccgttgcggccatcatagttggcccaccgacgccgatctgcggtggacttcccggctcggacaacttcaacgaggctagggacttccacctgcccctggag

SEQ ID NO: 48841 - DNA, 189 bp, Triticum aestivum
  Clone ID: PAT_TA_48841
acgcatactacaaagcaagagcgtgcggcacaccaagtgggcgaccatggccgcctcggaggctatcacgatcttgctgctgatgctggtgacagggcaccatgctattgccacagcgggaggggacgcggacgcaggctactcggacaccgagaccgacacctgttggccggtgctggacctgggcgg

SEQ ID NO: 48842 - DNA, 169 bp, Triticum aestivum
  Clone ID: PAT_TA_48842
agcgtgcgcttcgtctctgtatatgcagactctcataaaggacatcatcgtgcaacaagcacacgctaatgcgctactcattggtgcggctgacaaaggctaacccgctatcgatggcgggggctgattcgtggcgctggccgttgtcggccttaatctgcttcggggc

SEQ ID NO: 48843 - DNA, 188 bp, Triticum aestivum
  Clone ID: PAT_TA_48843
ccataatggcgatctactacgtacctttgggcggccatggaggcgttctactacctcgtggtatctgcggacttgccgccaggacggcggggctagagctacggaagttcaggtaaggacagaacaactacgtcgacggctactaactcatgaaagaagaagaacggccgcaggtactctatgatgac

SEQ ID NO: 48844 - DNA, 230 bp, Triticum aestivum
  Clone ID: PAT_TA_48844
acgtagatagccagaattagggcgcacacaagctacatacatatcgccaagcaggactcgctaaacccatctagacgatgtacttggtgacgctcttcggcacgctcgtcctggcatggtggaaccccgtacgcacactcttatgtaccacggcgtgcagcggtaccgacgcatgtatgtccagagacacgacagcgttgggcggctcctacttcgcgagccggtagacg

SEQ ID NO: 48845 - DNA, 306 bp, Triticum aestivum
  Clone ID: PAT_TA_48845
gtacgcgcatctgaattgctggctagacccatcgcgtccgcgcattaactcggctgcgtacatgttgcaggcggctgtctaacgtcgtcggcgggcatgtcgaagcccgctgccggcgtcgttgcggcgcaggcggacgggcacacagcctctgcgccgtagggcggatggctgggtcatagcctttccggcataaggcggatggccgcgatctcgtactcacggagccagggttgctgatgtacaagcgctttcagagaggcgaggcagtggatgtgtaaacgtttttataagggaaagccaaag

SEQ ID NO: 48846 - DNA, 353 bp, Triticum aestivum
  Clone ID: PAT_TA_48846
acggtcctttttggcaacagctgttgttaaaggtattatagtccttggaaacccattctataatgtccgacacggtactgttgtggaaatactattagaccgaacaccgatctatgctgaatcgggtgggcaagggggagataatggcttactatatgtgtatggagaggaaggtggcaaacataatgcaggcatataaatgaacgatgtggcacaattcctggggaacatgtttgggcacaaaggcacaattaaactggggtcaatcgaggactgaaagaagatgcacactgtaattgttggaatactgatgcacggagccacggtttataatactgctacacatctactac

SEQ ID NO: 48847 - DNA, 211 bp, Triticum aestivum
  Clone ID: PAT_TA_48847
aattccgcatggccccgacggagaggcaatccgagccgctgctaggcccccatggctaggcgatgcggcccgttcctgcgcagggtggtgtcctgcgcgccaccgctacctagatacggcggcggggcgcgcggaacggtcacctacatgcgctgatcgggcgatagcacctcgcgccccgtgacgctgatgccgggcgacaggatatgac

SEQ ID NO: 48848 - DNA, 214 bp, Triticum aestivum
  Clone ID: PAT_TA_48848
cacgctcgccggcaccaaagaaggcgcctcggcgcgccgactttcggacgaaagatggcgccggacattcccctcctgcatcctttctagtcgcagcgacagaccagacgaggatgctcactagaatctatcgcacaccaccgtcaggtgggcgcggtaagtactcgcaaatcccacgaaggagggagctgtaggcgcgaacaagtaccatgac

SEQ ID NO: 48849 - DNA, 177 bp, Triticum aestivum
  Clone ID: PAT_TA_48849
tcacggcctaactaaactcaaacgcaacgatgactggcgttggaactaagcccgaatgccaacaacgacgccgctgatgctcagcgcgatagcacacaacgaccccccacatggtaacggatccactactcgcaggtcttccacgccatcatgcagatgctggtgaccggtggagca

SEQ ID NO: 48850 - DNA, 156 bp, Triticum aestivum
  Clone ID: PAT_TA_48850
attcgaggacacatggcggaacatttggggatggactgcgactcataaagcaggcaggacacttcctgaaatcacatatgaaatcggacacgacactggcagaaatcactgatgagctatgcccacgactgagcatcatgcaaatatatgggctca

SEQ ID NO: 48851 - DNA, 334 bp, Triticum aestivum
  Clone ID: PAT_TA_48851
gaagctctagctgatgcatactagggggggccggggtacctgctgctgagactatgatggaggcaaaggttgcagagaaggaaaattatcactaaaacatgtgtttcatactgttcgactaccctcttaactgccttctgtctactgtctgaacaccctactgtatagtctcgtagagacctgacacaacagctcttgcgtattgtacagagactttgagtacgtgctatttagcttgagacaatacatgtgttcagaaccttagtatgtgagtgattactgcttgcagaatgtttgtatctgattgataatttgctggagttatgtttctctc

SEQ ID NO: 48852 - DNA, 356 bp, Triticum aestivum
  Clone ID: PAT_TA_48852
acgaggtcttacagcctgaagccaaacatattatacaatcaggtcaggacattatcattatctcttatacaatattatcgtgccgacataccgcaattgacgttcatcgatcgatgcaaaagccacgggatatacgcctttccaaagaaaaaagaatatcgcgactgaagtctcacctgagcgtggagagtatgagatcaggacacgggatcgaacatgcttggatagacacacttgcttctgacccaacatgctaatatatgcacatataatgcttcatccatttataatttgcttaagtgaagctagcacaacataaaacatattgcctctgtccatacacatgctgaaaaagc

SEQ ID NO: 48853 - DNA, 345 bp, Triticum aestivum
  Clone ID: PAT_TA_48853
ctccaatatcgccgtatccgaccgcatgcgcgcggtgggctgatatcgtgaggccacccgatgcgcccgtgtgcggggaacgagaggccgtcggtgcggtccatgttcggattcagagcggttcgttttcggtgttacctaagagaagagagtatctcgattgaagtttgacctgagggtagagagtatgtgatcatgaaacgggattgaacatgagtgtatagacaaatttgatggtgaatcaacatgctattatatgcacatctaatgcttcattcttttataatttgggaggagggaacgttgacaacataaaaatttttggctgtgtcgatagagagaatg

SEQ ID NO: 48854 - DNA, 324 bp, Triticum aestivum
  Clone ID: PAT_TA_48854
cgcctacactctccgcatttctgacgcgactggcacccaccgaactctgccattcaggtaggactggtacgctggcgcggtctgcaaacctggggcgcgcctacactcaccgcatttccgacgctaccggcggccggcgaactcttccattcatgtaggaccgtacgctggcgcggtctgcggacctggggcgcgcctacactctccgtatttcagacgctgccgcagaccgacggactccgtcattaagaggtagttacacagtagtgacgaccgacaacaacggctaatcagacgcttggctaggtcaccagatagagctaa

SEQ ID NO: 48855 - DNA, 357 bp, Triticum aestivum
  Clone ID: PAT_TA_48855
taacacaatcactgggactgcctacgcctctgcatatgacaaactgtcagactgccttggccggtggggctgatcaaatgttacacgtactaaggaagagcgaacaacaacaggttacctctgtggatgggatgatgacaaaaacacgtcttctgtttggaaaggacgtggtgaaacatacgtattggggcgtgacacaccatgtcgagacgaaagtcacggggcgtgtctcaacgagtgtgggggtgagcctcatggtgaatatcgaataatgtgtggtggcgcttttgggggacgatcagagatttctcgatgacaatgccgggggtcgtctaagggtatcgcaagccatattcc

SEQ ID NO: 48856 - DNA, 199 bp, Triticum aestivum
  Clone ID: PAT_TA_48856
tgtccaaacatccgatctaagcaacaatgctggctatgaaaacaacaattactattatcaacgtgttacaagaagagtacactgtattttatatacagactaataaaagagagcatgttactgaccatacacacacattcaggatattatgcagactaacggacacggaaaatcgtatcttgtatcacacggataaact

SEQ ID NO: 48857 - DNA, 369 bp, Triticum aestivum
  Clone ID: PAT_TA_48857
gcggttctgcttggaggaagaggctccctggcaggaggtgctgggctgcaaacaggggagcgctgctatctgctctggcctcaaagttaaatccatgcgccatctacgtctcgatcagactcaaatgcatctccaggcaaggacgcgattgcaccctgatggagctctaggacgggacgcggttaatgtccaaagcggtgctgggctgggacggtgtcaactccccgaccgcgaggagattggggttctcggagccccggtacacgctgcacatgcagtctcgtggtctaacggactacacttgcacgcacccggtctagtccaaggtgaactacatgtactgccggcgcgtgcgtactggcttatttc

SEQ ID NO: 48858 - DNA, 338 bp, Triticum aestivum
  Clone ID: PAT_TA_48858
tggtaagctgtccctgcacgtaccgttcattaattttgggtgcatcccaagctttcctctatcttactttagtaaggtacgagagcggtgacagatacggacgcgacacgggacgatgcacgaggatagatgccttactgggcgcggacgatgacggggttagtggtgttaatgggcgttaccattgtgcttgttagcaccattactgggatctacgaatagaactgcttccaacggtactgggaccactggagagaactggttctataggaactggaagctctactctgctatggatctgtttacactgttagctaatctcttctctggatgtgcat

SEQ ID NO: 48859 - DNA, 212 bp, Triticum aestivum
  Clone ID: PAT_TA_48859
cgaccgccgtggctaattggtgctactcgaccgtagcgtcgggtgcccggtgctctacaattgttgctagtttcggcacaagcgcatcatgaacatcctcgtccatgcggcgcaagctgatcaggaacagatggacgcaggccgggcgcgtctcacgagcattgatggacaccgccggagagcggcttacgaccggatgcgagatgtttaag

SEQ ID NO: 48860 - DNA, 105 bp, Triticum aestivum
  Clone ID: PAT_TA_48860
attcatatgaaaccgtgcttgtgatgaaacatgaatctatggtcgactgttatggcttgctaacactaaacagacaacgtgtattagtactggctgccactaata

SEQ ID NO: 48861 - DNA, 314 bp, Triticum aestivum
  Clone ID: PAT_TA_48861
acggccatatccagcccaacaaatggcccctctcaaggtgactgttgccatgtgcgtcgtgctggtcctgatgatccatctgaccgcgccggccgctgatcacgacataccatgcgagcagagcgggcctagatgcgcccaagcgtgcaatgcacatggcccatactgttgcaacactgtttgctacatctatcccactctgtgcaactacagcttgctaatccaatccggcttgagcattaccgagtgcgcatacctgtgcagggtcaactgcgagtgatcgaccatgcaggaacgcatggacatgcatggat

SEQ ID NO: 48862 - DNA, 269 bp, Triticum aestivum
  unsure (1)..(269): unsure at all n locations
  Clone ID: PAT_TA_48862
acgactcaagtgctagctagataatcaatcagccagccatgaggtgggagaagacttacaacctgttacattacgaggagaccgcgcacttgcagactctacctaaacggtgctgacccccacacggctacacgaccgatacggtcgtgtcagccaccaggaaaaacagcacgtacacacggagcacctcggagagatagcaccacacgcacacggagcctatcggctatacgagaacaaccangtgcagagacttctgcatctaccac

SEQ ID NO: 48863 - DNA, 112 bp, Triticum aestivum
  Clone ID: PAT_TA_48863
tacagctgccgtaccgttacgcacattcctgggatgacccacgcattcatatgaaactatgcttgtcatgaaacatgagggtatggtcaactgttatggcttgataacaata

SEQ ID NO: 48864 - DNA, 317 bp, Triticum aestivum
  Clone ID: PAT_TA_48864
tacaagcttagtcatgacgatgaggaagcgcggattctgcttctttcttcgcgtaccactcgctgctgcttatgctaatttcaatgactagatatgctgacgggaggcacaacctgaccctaaagaccatcagtacgggcaaaggacgaacccaaatacagaaccacttcgaggaaaacagacagatacaaaccgtcaaacattgtcgggacgactaccagacatacagacgcacacgctacgcgagactaaaactcatacaaaaacgctaccactgttcgaggaacaaacctgggccaaaactcaaacattttgag

SEQ ID NO: 48865 - DNA, 314 bp, Triticum aestivum
  Clone ID: PAT_TA_48865
agcaagcccgcatcgaactcgcccggtaacggcgagcctgaccttgtcgacctcgccaagtaactcaaaggaggacgctatgaaactacaccaggcctaaaaaggctttggcagcgagactacaacagtcgcaaatacacttgctcaccgtgactcactgcagcgtggatacatctaacacgaatactatactatgaactctgaggaactcacacgaaagctatggcctgaactcattggaaaccacatgaaacgacatgcgctgtggattattgatcctgttggacgtgatgcgactgttctgaaagaagctc

SEQ ID NO: 48866 - DNA, 407 bp, Triticum aestivum
  Clone ID: PAT_TA_48866
ctcatgcgaccggtcctgatatccgactaggtctcgttctacaccaccgtgtaacgaaccggaaatggaagcgcggaaggtgacacgcgacctcacattcgtccaagcgctcctcgaggccagcgtatccgccaccgaatctcaggccgccagtgaggcgtcaacgcagacggctacgcctacggagaacacgatcgaggacacgaacgctgtgtctggagctacctgtggctgtactagcgactatgctcgtgcatcagtcattgcaaaatccaacgcaaaaggtgaagcaaaagttctatatggtgttctggcattcaaaaagacccccaagaagagtcaaatgatgaatgacacaatgaaggccacagaaacccctgaagaagctatgactgaagctatcactg

SEQ ID NO: 48867 - DNA, 223 bp, Triticum aestivum
  Clone ID: PAT_TA_48867
tcgatctgtgcgaaagctgaatactgcgcacatgatttgcccctatcacgctgtcgttatgtgattgtcacgtgcttacatatgatctggaagtaggagctagcagcgatcttggagcatagacgggaggcaagctagatctactcacgaaagctacacgatctgacctcatgacagatcagatctgatgatggtgtgatgctgaacagccgatctagatgtt

SEQ ID NO: 48868 - DNA, 411 bp, Triticum aestivum
  Clone ID: PAT_TA_48868
cccacgcgtccgcaaaagcctatttgggggatcatcaaccttctatcatcaccatggatccttacaagtatcgtccttcaagcgcgtacaacgccccattctacaccacaaacggtggtgctccagtctccaacaacatctcttccctcaccatcggagaaagaggtccggttcttcttgaggattatcatttgatcgagaaggttgctaatttcaccagagagaggatccctgagagagtggttcatgctagaggaatcagtgctaagggtttctttgaagtcacccatgacatttcaaacctcacttgtgctgattttctcagagcccctggtgttcaaactccggttattggccgtttctccaccggtgtccacgaacgtgccagtcctgaaaccatgagggatattc

SEQ ID NO: 48869 - DNA, 388 bp, Triticum aestivum
  Clone ID: PAT_TA_48869
ggccccaaccctagctagagctccggaaccttctccctggagggcctcgcgggactgatccaggagtccacggggtgcgcgatgccaccagggggaggagaagcaagccagcatggccgcacggggaaggagcagagcgatccgccggagatccgccgccgcgacgactcccgtcccgcgccgccgttccccgtcgtagcttctcagaagaggaggcagacgcagccggcgtcggaggtggtgagcgtccccgagggccccctcgtcgagatcctggcgcggctgccgtaccggtcgctctgccgattcaagtgcgtctccaagcagtggcgcgtcctctgctccgaccccagcatcgtcaagagggcgacgcagaccctctccggat

SEQ ID NO: 48870 - DNA, 433 bp, Triticum aestivum
  Clone ID: PAT_TA_48870
ctcagtttttcggccagagcaagaaatgctgaattgagccttggaaatcgtgatactatcaagaaatggagagatgtggcgaatgattcacgtaaagaattgcatgagaaagaaaaggaggtttcggacttgaaacaagaagttatagggttgaaactttctctctcagaggccaatgaccaatgcacactgctcttcaacgaagtgcagaaggcatggagagtttcttctacactacaaactgacctgaagtctgaaaatttaatgctcgctgacaagcacaagattgagaaagaacagaacaatcagctaagggaccagatttctcgtcttttggaagttgagcaagagcagaaaattaagatgcatgaacgcgatttaacaattcaatcgctacaggcaaaacttaagtccattgagtctcaacttaatg

SEQ ID NO: 48871 - DNA, 365 bp, Triticum aestivum
  Clone ID: PAT_TA_48871
ggaaacttctggtcgtcgcgacaagtaacatcgagttcgaaccatctgacttcaagcattataagctggccgtgctcaccatctacggctttcagcccggcgatatgttcatgcagtatatgagacgggtgatggaagcggctgtcaatttggaagagatatctctgcatgaccactggtgcgaagagtgcgacttttatccattgacaaggtatcccaagaccgaccaagacagagaattgatacgggaggagatcaatagagggaggccgtcccctatgaggaccatccaagttttattcagtgataacaagtatagaaccgatgattgaccgtatgtccgtatcactgcgaccctgcatgac

SEQ ID NO: 48872 - DNA, 440 bp, Triticum aestivum
  Clone ID: PAT_TA_48872
ccgcaccaccttcttccggcgcgtggcacccgatccagacgcgctccacccgcccacccggtccccgcgctcttcccgccggctccctccggtccagatgcgcctcccactaccgcccgaggccaccgagccccaccccgtagccatcctcgacccctgtccctgccgcgcccgtcggcgaggttaacggtgagatccctccacgtcctctatactccacctccttaattttccttggatttgatcttaaagaatggggcagtagctccggtggcttctcttcagtccatgaacgaggttgctcatggcacgcacgagctggggaggctgcagttttgcggcgcgtacacacagttcgtcgttggcctgtggcatcatgctggtcagcgaccaacggagctggcctgaggcgggtcttgctcgcggcgctaggcgcaact

SEQ ID NO: 48873 - DNA, 372 bp, Triticum aestivum
  Clone ID: PAT_TA_48873
ggaactgttacccaaccttatctcccagctcgcgccaccaccgccgcgcagccatgccactcctcccgccggcggcgccgccgctgccgctctcctctcaccgcctcggcctccccttcctcacactcccctcgcccgccggccgccccctccgccgcggggacctcgccatccgcatgggcggcgggccgcgcacgttcccgggcggcgtctccaagtggcagtggaagcgcatgcaggcccggaaggcgaagcagctcctcaaggcccgcctcgcccgcgagcgccagctctacgagatgcgcaagcgcgccgagctccgcgacgccgtcgtccacctcgagcggccctgggaccccgactcggcccccg

SEQ ID NO: 48874 - DNA, 429 bp, Triticum aestivum
  Clone ID: PAT_TA_48874
cccacgcgtccgcggacgcgtgggcgaggactcacactctccccactcttctcagcccctcctcgtcgaatcagtcgccgaagtgcccgaggatccgctcaagctcggcatggtcgttgggtgcggggcgaaggccgacgcagaggcgcgggactcgtctccatcagatcggcgggcgtggaaatcatgcatcgcaacctccgcgcccggtgccttcctctccatctcgcccgtcggcggctcgcacaaccctttgatgtgccctgccctgcccagatacggcagcagtgccgcggtggctggtcccctccaagtgcaagccggcgccattagaaaatccattccccacttcagctttcatatctgcttacttctgatttgagcttacaagaaatgtattttgaagaccatctaactatctaagagtca

SEQ ID NO: 48875 - DNA, 291 bp, Triticum aestivum
  Clone ID: PAT_TA_48875
ggcacaacaacatcggcgacatcgtcatccccagaaatatctacggcccttgagcggagccgaccgggctgagaggagatcgaggagccggagcgcatggttttcattcatgtttctgcatgcgtcgatcgattgcttgattgccttgcccgctggctctacgcgcgtacgtccgtgcgtgcaggaactgcacaacagtggccgctacttaagctttacacattacaaaggttgccggtcggagagccgacgttcttgtacagctcatccacgctcagacgatcgcacgtt

SEQ ID NO: 48876 - DNA, 439 bp, Triticum aestivum
  Clone ID: PAT_TA_48876
ccttatcttctcagacttaaaacccgtctttgccggcgacacttctctactgaatatttcagtaaataatctcttcttagatctctccggcaatggcaattccgttgcctcttacctcttgctccccaatctcaacttcttcgtctatttcccgaacctccttcgtccctcttacacttcgcaatcgtactttcttctccaaccagaattacagtaggcgtgtacttatcagctgctcttcttctttgtcctcagacaatggttcatctccagactccatgaacggaaacgggaacgggaacgggagtagcttaaacgggcaatcatctttcccacgactgccttcctttgatggaacatccaaaccaccgcttaaatggagaagggttttactcaaagtcagtggagaagctcttgctggagacgaggagcaaaatat

SEQ ID NO: 48877 - DNA, 412 bp, Triticum aestivum
  Clone ID: PAT_TA_48877
tgcgtggagatcgaacagacgaagagcagctgaccaacgggttcatggacatggcggtggactgggcgcccgggctgagcaagcacatgcggctgaaggacttcccgagcttcctccgcacgacggaccgcgacgacaccctgctgaccttccagctacaccaagtggagcgcgcggaggcggccgacgccgtcatcatcaacaccatggaccagctcgagcagccggcgctcgacgcgatgcgcgccatcataccggccatctacaccatcggcccgctcaactccctcgccgaccaaaccatcccccgcggggaccccctgcgcacggtgagctccagcctctggaaagaggacgacgtctgcctgccgtggctcgacggcaagagggcccgctccgtggtgtacgtgaa

SEQ ID NO: 48878 - DNA, 437 bp, Triticum aestivum
  Clone ID: PAT_TA_48878
gccaccgcagcgcgcgccagatcgcacgccgccgcgcgcccggcgcggccggtgctccagccgtggtgcctgcatgtgcactatcacgctcgccccacgcggcatcacatacacactgccgaacgctgcatgtctcgttagccccactcctggtactaagggctgcatccggtgcacggaggagaccgatcgcccacccacatggacccgatgcttcactgctgtcactgcaagcactgactgatcgcaatggcacactcttggtgacaggacccaccgctgcatgagaacagcaccacattcaaaccgatcttgtcatgtgcatggggcaccagaggaggaactccgacatgcgggtgaacttggaaatgtgaccgctgcatcgaatattgatgctaacattaatgggacacactgacatatgcagcttgccggac

SEQ ID NO: 48879 - DNA, 465 bp, Triticum aestivum
  unsure (1)..(465): unsure at all n locations
  Clone ID: PAT_TA_48879
cccacgcgtccgatcatttactaagaagctcatgtggtttgcatatgtggcaactaccacagccttttcaactggtttatatacggtgttgccccgacatctccactggttggccattgcaatttgcattacagtagctttgttgcccattctcacgaagctgctgggcgaatggcctgtcttgagtcttagatttcggctgggaaaaactttcaactctgatctccttgacattgtgtgacctcaggagccatgaatactaatgatagcagaggacatagtgtaataagttgaagcaacttgtgccaccagttcacccggatcaaggacttagcgttggctctcatctccttggatacaacatatgggacggcgggcagatcacccggcagtgctgtctgatggcaatccgaggtatctgttgcttcctggntctcaggttctgggtcaagatgtgatgatgaa

SEQ ID NO: 48880 - DNA, 390 bp, Triticum aestivum
  Clone ID: PAT_TA_48880
gtcgcactctttgccttcggcgcggggctcctcgcctacggcgctctcctctcccacgtccacatcgagccccagcgcgcacgcacgctcgcccgcgatcagttcgtccgcgactacctacgcaggaagcacgacaagtagcccgcaccccctcctagtccgctcgatttctcgcccttcctgttcggcggcgatggctttgtcccccgccagcgtcgggccggtgattgcggaggtggagatgaacgccggcgccgatcagggtgccaccaccgtgcgggccactgtcgtgcaggcctgcagcgtgttctacgacacccctgcaacgctcgataaagcagagagattgatagtggaggctgctggatatggttcacaagtggttctttt

SEQ ID NO: 48881 - DNA, 380 bp, Triticum aestivum
  Clone ID: PAT_TA_48881
gccaggtgtcctggccgttctgggcctcctcctgtgcctggtgctgtcagcggcggccgcaggggacgaggagccggacaagcagcaggtgatccggcgggtcgaccgcggcgacaaccacctggagatcgacttgcagctcgactggtaggtgcaggggttcgggcagacgtacgggaacacgtacgagcacgcgcacgagctctcgcactggaaggccaacttcaagggcacgctccggcacgagatgctggaccagatggtcgagcacggcgtcaagaagggcttcaacatgatctcggacgtgatccggggcaagttcctggggatcatgacgagccgtaagacgatcctgcggtagatggtgcggtagatggacg

SEQ ID NO: 48882 - DNA, 460 bp, Triticum aestivum
  Clone ID: PAT_TA_48882
cccacgcgtccgcccacgcgtccgaatttttgtttcgagcggcgccgcgatggagtcacacgccgttcctagcgagcagcccgcgtacaagccgctgccatccaccgccaacgaggacgcccatgagcaccagggcggcggcgtgaggtggcgcgcgtgcgctgccgtgctggcggcctcggccgtggtgctcgtcgccgccaccacgctaggaagaggagccagggtggacgaggacgccggcgggttcccgtggagcaacgagatgctgcagtggcagcgagccgcgttccatttccagccggagaagaacttcatgagcgatcccaacggtctggtatactaccgtggatggtaccacctgttctaccagtacaacccgaagggcatcgcctgggcctttggcattttgtggggccatgccgcgtcccgagacctcgtccactggcgccaactccca

SEQ ID NO: 48883 - DNA, 399 bp, Triticum aestivum
  Clone ID: PAT_TA_48883
ccatcgctcaccaatgaactcgctgccatctctcccgatctgaactaaagccagcggccagaacctccctaccaaggccgggcaggtggacgtgccaccccctcgatcagcccgagcggagagaagaggcggcaagcagattgattggaggaggtcgaagatcagtcccgccggcgatcagatcgccagtcataataaccctagaaaactagcaggccctacatcgtcgtccccgctcgcagtttctccttggcgccgccgtccatccgaccgctccacaagcccgcgcttcagcggagatgcagaggacggtggatttcaagctcccacacttcttcaactacccgccctactttactttgcagcctgtgagagaaacacgtgaaaagcaagtgcagc

SEQ ID NO: 48884 - DNA, 458 bp, Triticum aestivum
  Clone ID: PAT_TA_48884
agaaattgtctataactggttacaacagtctcagccttcctgattggttcgtgggtattaggcaatatctccctaatctttgtgtgataaagttgaggaattttccgaagtgcaagaacctaccaccacttggtcaactaccaaacctacaagagctgtgtctccgcggtatgccttgcttggaagagtggaacatggcatataccagtggcgagaaatttgcaaatgagctcatgttccctaagcttcagaggttggacataaggaaatgtgccaagttgaggataaaactatgtctttgtagagctatgattttgttcatagtagattgcgataatgtgctatcatcatggggagagatcttgtcacacaacagtgcttcctcctcttccccaattacaaatcttaatgtttctgacagcaagttgtttcaccacctccccgccccgcatagttta

SEQ ID NO: 48885 - DNA, 395 bp, Triticum aestivum
  Clone ID: PAT_TA_48885
cccacgcgtccgcccacgcgtccgcccacgcgtccgttccatttcctcccgtccccgtccccattctttcattcgttctcagagagacgagcggcgaggcgagacgacgactacgaggaggagcgagggggagagctcggatctaccggagatttttgtctagttggtggtgaaggatgttgagggccgtggcgaggtgctgcgggcactggccgccgggcgccgcggcggcggacggcatgctctggcagacggagctgcggccgcacgcggcgggggagttctccatggccgccgcgcaggccaacctcgtcatggaggaccaggcgcaggtgctcgcctccccctccgccacgctcgtcggcgtctacgacggccatggcggccccgacgcc

SEQ ID NO: 48886 - DNA, 393 bp, Triticum aestivum
  Clone ID: PAT_TA_48886
ggagatttttgcccctcctcctgcagacgtctcctccttgaatcagacacaccacgccacaccaccaggcaggaaaaggaggcaggagaagagaaggctctcctccttgtagcaggcatcatcggttctatcagcaagcaattcaggttggcagggcgcaaagaaattggggatttttccgtgtgcagtcagtgttcttggagacgggcatgcgccgcgttcgagtctcgtctcaccactctccggtccagaagctgggcgattccgacatgaagctgacgcccaggttccggctcgccggcaccacctcaccgtcctcaaccgaaccggagcagcaacctccatgggagacgcccctcatcccgggcctcccggacgacgcggcgctcaact

SEQ ID NO: 48887 - DNA, 426 bp, Triticum aestivum
  Clone ID: PAT_TA_48887
ctcacatgatcgaccacgcatccaccctgccctgccctactgttaaccaacaagcacccagctgggatcgcactagttagcagcctgcctgcctactactacatcacttcacctaaaagtccaagcgcgtaatacaaacgcgactaggaggcgcgtcacggcacccaaatgcgcgcgtgatcggagaggcgccgccgatccgagctgcactcgtcctccagatcgacctgtccagcccggctatactggcccacccgatcgaccgctgccgcgcgatcttccttgccggccagcccgacggctgcccgctcatcgtcctcgacatcggagggaccctgataaagctggtgtacacggacatctgagggacccaggaagagctgcggtacgccgagatctggagtcggaagctcgaccaccggttcg

SEQ ID NO: 48888 - DNA, 108 bp, Triticum aestivum
  unsure (1)..(108): unsure at all n locations
  Clone ID: PAT_TA_48888
ncatttcnaatactctnncattcatcncctacacaaaccttactaatccatctccaacctctttcattacgcctccaacaacctcaaactctcatctcacatttacta

SEQ ID NO: 48889 - DNA, 468 bp, Triticum aestivum
  unsure (1)..(468): unsure at all n locations
  Clone ID: PAT_TA_48889
ctcatcgctaccgctcccgacggcgacccttcccacctatctccgatgacgggtgaaggccgcgcatcaccaaacagcgagccctacccacatacgggagcggggcttggtttggtgatttgagcggtccccgccagatctggtggggcagcgctgtcgctacgtcgatcctgagatccactgatggattcgggaggcggaggagcgtcagaccaggagattcaggagctgatggcggagctctcgcaccgggaaaggacgacggcgcgtgcggcgaggagggtggagactccgaatcgcaaagtggcaacattgaggatgaatttggcattgcacgcaatgtctagaaccacggagtttggagcgagagagcatatttgcgatggggcggcctatcacccccgacctgatcctatcctgngccgcggaagaggaagtgtcctactcaaggatacatagaaggagatg

SEQ ID NO: 48890 - DNA, 297 bp, Triticum aestivum
  Clone ID: PAT_TA_48890
gcccacacaactctctccacccccagcaatccaaccacccccaccctccttacccctcccatcccgagcgcggcaatggctaacgctgcgaccggagcttggatccatgatgactgccagctgaggttcgcggagctcatggccaagaggatgcaccgtttcatggcccactagctggatatccagaaggaggcaattgaggactaatctgcggagaccgtggtcaccaatgaggacgtcagcaagtctgcatgttgggaactaatgtagctccttaatgctactgtcatgtttttt

SEQ ID NO: 48891 - DNA, 322 bp, Triticum aestivum
  Clone ID: PAT_TA_48891
tggcaggcagctgaccggcaaatgagcagctaccatccaccagtctccggtcaccgcagccacacactcttcctcctccggcgtttcttgcccccaagcaaccaccaccggaaatctcttcccatttttgtccgcttcccgccgcgcgtgaggcctccacgcatcccccgcttccccctcgccggattcttttccttgcacgcccagcctccctccccacctcgcgctatcctcctccaccaccaccagcagaggtccgtacgagtggaggaggcggggggagagcacgcgccggctggatacgcgcagacagtgtgcaccg

SEQ ID NO: 48892 - DNA, 405 bp, Triticum aestivum
  Clone ID: PAT_TA_48892
cgacgtcacgcgttcgtgacgttatactgctcaaacaccactgggcctcactgtgatggcttactcggccacctccgacgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgtctatgttcgg

SEQ ID NO: 48893 - DNA, 244 bp, Triticum aestivum
  Clone ID: PAT_TA_48893
cacccatggagcaacccgaggcaggagacggcgccccgcagcagcgccacaagaaatcctccgccgccaagaaggcgaaaaaaggccgcgccacccgcagcggcagcggcggggcatggcccgcggtaaaacccaagaaggaccttctggtcaatcgccttaagggcacccaacttcttaccgttcctgactttcttactttcggttaggccaaggctttcgttgacctcgcttaattcatggg

SEQ ID NO: 48894 - DNA, 438 bp, Triticum aestivum
  Clone ID: PAT_TA_48894
cgaagctcccgtacatcttgcagtgcagctccaccaccagcagcctgaggtgaagccccgtcgtcagctcatccggcgaccgacgccacgtctgccgattcggtcgcgccgctgcgcctccaccgccagcggcgccacgcggccacccgaagctcttgcccagcccgtggtgcatcccgacgtgtcgccctggcgatggacgaccagcccatcgatttgcgctggtgcttctccgactgccattagtccccccaaaggattcttataccccgtgcttccatccacaaccaaggagcagcacaaacccctgcatcccgaggtgccagccagccgtccctcttccacctccggtgatggctcccctattcccccttgtcctgccctcctttgaatccaaccgttgcatcctgtatgtattcttttatgtgattcctcatg

SEQ ID NO: 48895 - DNA, 200 bp, Triticum aestivum
  Clone ID: PAT_TA_48895
gtcgtcctgctttccccatactttgtgctcgttttatcgacttcatatatctgtgggaggggcatctttgcgtgaaacatcaactcttccctctcgctgacccattatcggttgcttagacatcatagaataccataaagagtgttgggagcatctcccccactatggcctgttatcacagaaacaagctttttccactc

SEQ ID NO: 48896 - DNA, 234 bp, Triticum aestivum
  Clone ID: PAT_TA_48896
gtcgagtctagtccagatatatatctacagattaaaaccctagcaagttatctccgaccctcggggagcgataggcaccaacctgagcgtgcttcggtcgtgaccgtccatctgcccgcgccgcggtcgcatgccgatggagctgatcaaggacggcgctgccgctgacggtggcgaacttccgggcgctgaggctccgcgcgcaggccacgtacaagagcaggctgcccacgc

SEQ ID NO: 48897 - DNA, 444 bp, Triticum aestivum
  Clone ID: PAT_TA_48897
cggttcttcttggcgatcgagccggcagagtccgacgctctttctttcccgggttcctcggggtcgagtccaaaggtgccttgtgaagaaaaatatcaggtcatcacctaacgtggttggagtttgatctgggttggcctcactgactgccaaggagtctaaatagctggtttaggagcactgcaccagcattttgcttaagtggaagttctcagaggttttccaggtatgtcaaatgtaactgatacagagtttctctgctgcattcggtttgttatttttcttgctattttgttcttgtttcctcgtgggaattcagaccgaaacttatgattggactcgtggtgcggttcgtcaccgataacttctgttcgatgtggttcgtatcataatgcataaatgctagccttgtcttactgaagtcaagatctgccactgcaacac

SEQ ID NO: 48898 - DNA, 447 bp, Triticum aestivum
  Clone ID: PAT_TA_48898
ccgagccgctcaccaaggaggacctcgtcgcctacctcgcgtccgggtgcaagcccaaggagaactggagaattggcacagaacatgaaaagtttggttttgatgtcgaaacactgcgccctataacgtatgatcagatcagtgctatactcaatgggctgtctgagagatttgaatgggacaagataatggaagaaaaccatgttattggtctcaagcagggaaagcaaaacatttcactagaacctggtggccagtttgaacttagtggcgctcccctcgaaacattacatcaaacttgtgcggaggtcaattcacatctttatcaggtcaaagcagttggagaggaattgggagtaggatttcttggaatgggttttcagccaaaatgggccctggctgatataccaataatgcccaagggaaggtatgaaattatgaggaatt

SEQ ID NO: 48899 - DNA, 450 bp, Triticum aestivum
  Clone ID: PAT_TA_48899
agcccaggctcagttttacctctcgcggtctcgcctggtcttcgtaacaccccgccgcgctgtggaaacatccacggctacttcctcgcgcgggtcaaagctcgcgcgcccacgcccatgccgacaccgcccgcgcctcgacccgccacgattccagtcgttggatgcagcatgcccatatctgaacccagcgtagggcatgctccgtcgtctgtgaaccgtctctagtcgcaaacgccacggatccagccagatccagctgatggtgagcgccggtcaagctggcgcggacggaccttccaccagtgatattaggggaactggaaacggcgccgtagagaatggccatgccctcaaggcaaacgaggacaaggaatggaggggcggcagcaaggaagaggactggcccagcacgcacagtgcgccgccaggcttggacgagcacaagca

SEQ ID NO: 48900 - DNA, 436 bp, Triticum aestivum
  Clone ID: PAT_TA_48900
cggacgcgtgggcgggctttaccggcaagtacgtcatccgcgaggccctcaagttcctgccccccaacgcctccccgctccgcaccctcgcgcttgccggccgcagccgggaacgcgtcgccgccgcgctcagctgggccgcctcgccggggcccgtgcccgacgtccccatcctcgtcgccgatacctccgacccagcctctctcgccgtggtcaccgcgcgggcgcgcgtcctgctctcctgcgcggggcccttccgcctccacggccgccaggtggccgcggcctgcgcggaagcaggggcccactgcctcgacatctccggcgagcccgagttcatggaacgcgtcgaggccgacctccacgaggtcgccgccaagaacgggtcgctgattgtctccgcgtgcggttttgcctccaccgtcgcggacctggg

SEQ ID NO: 48901 - DNA, 450 bp, Triticum aestivum
  Clone ID: PAT_TA_48901
atgcatggaagtgcaattagtgcttctattcaacgtgccaattcatctttcattcatgatgtaatgggagagagctccagtagagatgatgaacaaactatgcacagccaatatggtagtgcataccaagaggtatcccgccagcatgggacacctgctgaaggcattgttgtcaatgagcagcaaaatggggacagggcgagccctgtcttgggctcacaatcttctctttgtgtttcaagccctcctagatcacctccacatgtttcacatgacgagatggatgtttctggtgattcgcctgcactgccaacttctgctgatggttatcgtactgtggtatctgataatgaccaagcggcttcaactctagatgcagcaaacataagcagaatcgccacctcaagcacggcttctcacatggaggatgatgaatggccaagtgaacac

SEQ ID NO: 48902 - DNA, 446 bp, Triticum aestivum
  Clone ID: PAT_TA_48902
cccacgcgtccgcccacgcgtccgccttgacgggattttccctggacaggacctcaacgacgacctccagatatgaaattgtccttgatggatgattgtaactaagctcatgttctagatataaaagaggatcgaccggataatgctcttgcaatcactggtttcgctatcaagtctacaatccaatgttcgtcaacatgggaagcagcggccagcggagcgattcggacgagatgcttgctgtcagtttcctcgccatgctgcgaccagcgcctctgccggtcaatgttgttgctgtcttcttcgacaacagcgagatccgtagcacatgcgagtggaagaccgcgctaccagtttaggaattttctggctgtggctctaagctaaatcagcacttgatcaacctcaagccattgtgatggctccagtagcatgcacaagatgga

SEQ ID NO: 48903 - DNA, 413 bp, Triticum aestivum
  Clone ID: PAT_TA_48903
gtgaatgtttgtagggattgtatgaaatcctgagtttatccggctcttacaatctgaacgagggccagcaaaatcaaaccgacgggatcagcgtcacgctctgcagcccggagaggcatgtcattggaggtgtcctgggtggagcattggtggctgccagtactgtgcaggtaacagcaatctactagatcagcctcatctgctaagattcagacatggaaccaagctcctgcatccagatcaacctcatttgctaagattcagacatacaacataaaagtttctaatcctgtttggcattgtgcaggtggtgctagggacttttgtgcaaggaggatccaaatcaaagtccaagaaagccgcgaaaccaccggctttcggtcccgactcgctcaccggcgctgggccagatg

SEQ ID NO: 48904 - DNA, 420 bp, Triticum aestivum
  Clone ID: PAT_TA_48904
aaatgactggtcaaaccaagccaacctgttcactggggagcaccttaatctactgccaaacttattacagaaacaaatatcgcttccgaatagcccaatgtcatcactgctattctctcagcaacagcagagattggcacagctccaaccatcccaccatcagaattacctaaatttaccaccccacctattctaccatcatcaccccccagagataccaggcaggtttgaatctgctaccagtcttccttcatcaagagacaagagatcaagatcaggaaggggaaaacacagtttacgtttttctcaaccaccatctgatactactggtagtcagaacggtgagagtggtggactgaagtttagatccaagtacatgtcatctgaagagatcgagtctattctaagaatgcagcactc

SEQ ID NO: 48905 - DNA, 424 bp, Triticum aestivum
  Clone ID: PAT_TA_48905
cccacgcgtccgcgagagcagagcagagcagagcatccatggggtcgtcgtcgggggaggagggggaggagcagtgggtgccgccgagccggcgtccggagctggcggacgtggcgccgctgccgcaggccgacgggccctgccccgtcgtctccatcgcctaccgcgacgacttccgcgaggtcatggactacttccgcgccctctacgccgccggcgagcgcagcccccgcgccctccgcctcaccgccgacgccatccacctcaaccccggcaactacactgtatggcatttcaggcgcgttgttctagaggcactggatgctgatttattgctagaaatgcattttgtggaccaaattgctgaatctaatccaaaaaattaccaagtctggcatcacaagagatggcttgctgagaaaat

SEQ ID NO: 48906 - DNA, 282 bp, Triticum aestivum
  Clone ID: PAT_TA_48906
gcccaagcacgcttatatgattatctggcaaccagcacttgggttcattactgtgggccgattgcttgagtcgggagtgatcttatgctgagctaaagcgatcaattctttgagagagtgagttcatttttaagctggttctggagaagttttcaagattgggtaaaacacgccttcttttatatctttgaaactaatggtcatgtgtactagtgcttcaatatgcttaccgtaagtgttcacagtgacatgaatttagattgtcaagtttttaatataaaa

SEQ ID NO: 48907 - DNA, 453 bp, Triticum aestivum
  Clone ID: PAT_TA_48907
cccacgcgtccgcagggatcctggcgccaagagctcgccgcccctgcaatggcgaccaccgccaaccccaccaccgacctcttctcgcgcctctcctttcgccgcgccgtctccccctccccactccgcctcccctccttgccgaccccttcgccgcgcgtctccgtcgccatcgtcgccctccacaagcgcaaccccaagcgcctcaagtacgactcccagcgccagttcacgagaggggatggcgggatgctgcgggtgcaggtggaaccctccggcgaggacttctggaagctggaccccgtcgtcgacctcataaacagcggcgccgtcggcgtcatcccaaccgacaccgtggagcaaggaaatgcaccgtgcgcactgcatttctcgttgcagttgatgctcgctactccattgtttgtgatctgagtaacaatgactctattgagc

SEQ ID NO: 48908 - DNA, 452 bp, Triticum aestivum
  Clone ID: PAT_TA_48908
gcccctcctctcttcgtcttcctctcacaaggctagcctagccagcagcaatggctagagcaccgctgctgctgctgcttgttcctcttctcgcggcggtgtgcctcgcgtccttggcccccggcgccaatgcggcggggaggaagatggtcggcgtctacgagctcagcatgggagatttctctgccaaggtcaccaactggggcgccaccgtcacgtccgtcgtctttccggattccaaagggaatttgggcgatgttgtccttggctatgacaccatcgctgaatatgttaacggatccagttactttggagcgcttgttggacgagtagccaacagggtggccaaggcgcgcttcgtgctcgatggaaaagtctaccacctatatgccaacgatggcaagaacgcacttcatggcggtcataggggcttcagcaaagttatatggacg

SEQ ID NO: 48909 - DNA, 169 bp, Triticum aestivum
  Clone ID: PAT_TA_48909
ggaacttatagaatgacgcgtctaggactatctgggagctggtagagatggagagcggaggtttctaaggctactgtacatttgtcaccaactccaattgcccaggaacgtatttagaggatgcaggtgatggccgattcctgcgccttgtgacttttaccagcaaatt

SEQ ID NO: 48910 - DNA, 456 bp, Triticum aestivum
  Clone ID: PAT_TA_48910
cccacgcgtccgctcaggatacccgtgcctgtaggcaccgtcgtgaggcgcaagaaggggtctgttcttgctgatttggcccatcctggtgatgaggtgctcgtcgctaggggtggacagggcgggattagcttgatcgatgcgcccgattacaaaagagtgaaagccatggctttatcgcctaatgtcatgcgtgatgttactgataagatattaactcatggccagcctggtgaggaaataagcttggagttaatcttaagggtggttgcagatgttggccttgtgggacttccaaatgctggaaaatcaacacttctatcagctataacacttgcaagaccagacattgctgactatccattcactacattgatgccaaatcttggccggcttggtggagatcctactttaggggctatgcagttttcctctggagcaacattggcagatttg

SEQ ID NO: 48911 - DNA, 271 bp, Triticum aestivum
  Clone ID: PAT_TA_48911
cccacgcgtgcgcggacacgaccacagacacgtaggctagctcgaccacagactcacgaggtagctagggcaaaggacatcgaggcggctacacccaacgacatgtacgcggctaaagactactgggaccacgcggccaaggacttcttcgacccggaggagctgaccatgtggtaactctacgagccgaccatgtggctactctagggcacgctgatcttcgtgtacatgaccaggctgatcttcatctagatcaaggaccacacggaca

SEQ ID NO: 48912 - DNA, 402 bp, Triticum aestivum
  unsure (1)..(402): unsure at all n locations
  Clone ID: PAT_TA_48912
gttagtgtcgccaatattcagtacttgccagacgtggtgccttggacttacgcaggcgttctgtatcagttggacgtgcactatgaggatcctgatcttttcaatgagtttgaggatgacaatcccatggacacttctgagggaggtgggggttcaggtaccagggatgacaatgctgagagcaatgaggataaggctttgcgaccgtcagggcagtcggagaatgccgactccactcctgttgggctgtcctccacggtaccaactaccacgcttcagctgggttctcttggggccttctcggcgccgccgagattgtcgagtgttaaggctggtcctccgagtccaagacttagattatgtgtggggaggtncgtcgaccacactgatgaggtggggcag

SEQ ID NO: 48913 - DNA, 456 bp, Triticum aestivum
  unsure (1)..(456): unsure at all n locations
  Clone ID: PAT_TA_48913
agaccctgttattgtgagaattcttaattcaagagttatagggagggacttatgtcaccacaggcagaaactaaagcaggtggtggatttaaagctggtgttaaagattataaattgacttactacaccccagagtatgaaactaaggatactggtatcttggcagcattccgagtaagtcctcagcctggggttccgcccgaagaagcaggggctgcagtagctgccgaatcttctactggtacatggacaactgtttggactgatggacttaccagtcttgatcggtacaaaggacgatgctatcacatctagcctgttgctggggaagacagccaatggatctgttatgtagcttatccattagacctatttgaagagggttccgttactaacatgtttacttncattgtaagtaacgtatttggtttcaaagccctacgtgctctacgtttg

SEQ ID NO: 48914 - DNA, 261 bp, Triticum aestivum
  Clone ID: PAT_TA_48914
ctcacaccctacggtacaccctagcggtctccctttttattataactttgatcaaaactttggggtatattcaaaactgcgaggggggcagtattggtttacttattgatctactatggccacaaaaacaacccctatagctacatatatggatacatgggaggtaactttgaaaataaagttaacaaggcttgtggaaggatatggcttctccaaaggatacgctaggcaataggtgagggactattagttaggtaatga

SEQ ID NO: 48915 - DNA, 295 bp, Triticum aestivum
  Clone ID: PAT_TA_48915
ctctcttcctccctcatcatctttccttggctttcttttattattctttgtaacatgaaagactttcatacgggggtgctaattaatctctatgcctacgcctatttcataatactctccttctacttcaaccttcccctagacatattctatgcctcactcatcatctatggtcaccttctcaactcctaccccaaccatcactgaattctttattcatttttcattttccaagcttatttactaacaaaattttttataccatatctccatttctaaatatttcttcatcttt

SEQ ID NO: 48916 - DNA, 365 bp, Triticum aestivum
  Clone ID: PAT_TA_48916
ccatgaatatcctgccatcatttgataaaggtggtccaccatccttcctggaactccgcgtaccacaacttggcccaatatacagtgaggtatgggagcttgggaggcctccacctggggtagatgcacattgtctccaaacagatcctgagggcggcttgaggggactctgggagggcctatgcattcctttccaggcacaaatggtcaagtatgcggggtgggcataagaatgaaatacatggaaaggtgggccaagggactttgatgggatttgggccccctggtggtatgaaaggggacatacatctacgggcttgtcgaaatcccgggggtaccctatgacttttgcatttgcattttat

SEQ ID NO: 48917 - DNA, 415 bp, Triticum aestivum
  Clone ID: PAT_TA_48917
ggggggcgtacgcacacctcacctcgctccccgtcccgccgatctcttctcttaagggcgtccgcgatatctggtgcgggggtagacaccgaggacctgcgccatgtcaacagggggctcctcgctctccgcgccctcatctcctccaagggatgcgcccccatcatgctggcggctctcatggcatgattctggcacctatgatgtgaacacaagaactgggggggcaaatggggcaattatatacgaggaagagtacacccatggttcaaatgctggcgtaaaaatttgtatcgatctcctctagcctattaaagcgaagcatccaaagattacatatgcatacctttatcaactttgtggagtattttcagtttaaaacacccgtggtccaaccgttgaggtcatccctgga

SEQ ID NO: 48918 - DNA, 408 bp, Triticum aestivum
  unsure (1)..(408): unsure at all n locations
  Clone ID: PAT_TA_48918
ttcccggggcgcgcggcgcgtgctcgggctcgtgggtccaaatcagaggggcgtgagaaaatcccaccaatggtcctcctcnctccggagcgccggcggcttgcggcgggcagcggtcacctgcgaccgggtgggancgctngctcnggcatccggtggtcgagggtgccagaggttnatagggccccgaggcggccggcggttgctgcgctngcnganggaaancgggtggtggttgtgcgggactggcagancacctggaacggggacgggcgcatccaggggaggtccgacttctccggggtcacgcccaagggggaggcccanggccggacatcccggctcatggtcctcggcgacttcttctacgcctggttcaccaggccggtcggccgggcccggcggacc

SEQ ID NO: 48919 - DNA, 281 bp, Triticum aestivum
  unsure (1)..(281): unsure at all n locations
  Clone ID: PAT_TA_48919
gggggcggcgcgtgcgcacatcaaaatggggatcaccaatgtgacagagtgccangccatcggcaancaaaangttccgagggtnatctagagggggacggctccngcgccnangaccantngaccctccangagaacagagagggctttngcaggatcctggtccggccggccattctcatcggtggatccaaaatcgacatggcaacaactatcctgggagttaangtctcaatagctatcatggtttcccccactggcatgcagaagatgggtcaccc

SEQ ID NO: 48920 - DNA, 437 bp, Triticum aestivum
  Clone ID: PAT_TA_48920
cgtccggcatctttagtgaagaagtttttgagtggctgtctgttcggagctaccggaagaacaggctggctgccaacggacagagaccaaggcggagaatgaaggtagaagcgagacataatacccggggaagggcgacctcaagacttacttgagccagggggatatttcccttgagttcgagaggatgttcaggtgcttcatcacttggtctcaggtctggtcctcttccaaagcacctagcattattgattatggttggttctgatcacccttaatttttttcattatcacttccttatagatttctcatttttttcctgcagcacactgcctataagtaggctggcccattcattgagcaacggcatgggcaggctggcataacctcatcagccccatttgcgtttcaaccaggatgggcgctggcttaaaaa

SEQ ID NO: 48921 - DNA, 281 bp, Triticum aestivum
  unsure (1)..(281): unsure at all n locations
  Clone ID: PAT_TA_48921
accttntttccacttactttcanggtgacaacagggccatgatcttctatgccaatggctggattggtcttaacgacaactttggcaaggttggctcctgggacaacaacgaggggggatacagcaccctggtgggcgacctcatccggcacatgcacaggaccaagtaaatgagagggatcgaaatacaggggatagggggtttccccacagggtgtgcaaaggctcttcttctgaaaataaaattttttataggattatggcaactaaaaaccttttat

SEQ ID NO: 48922 - DNA, 443 bp, Triticum aestivum
  unsure (1)..(443): unsure at all n locations
  Clone ID: PAT_TA_48922
ggtattgtgagaattcttaattcaagagttatacggagggactcatgtgaccacaaacaggggggaaaacaagtcttggatgtaaagctggtggtaaaaattataaattggcttactacaccccagaatgttaaactaacggtactgatatcttggcgggattccaagtaagtcctcatcctggggttcccaccgaacaagcacgggctggagttnctgccaaatcttctactggtacatggacaactggttggactgatggacttaccaaccttgatcggtacaaagggcgatgctatcacatcgaggctagtactggggaagacagccaattgatctactatgtatcttatacattagacctatttgaagagggctccgtttctaacatggttacttccattggaggtgacggatttgggttcaaaggcctacctgctcta

SEQ ID NO: 48923 - DNA, 195 bp, Triticum aestivum
  unsure (1)..(195): unsure at all n locations
  Clone ID: PAT_TA_48923
atgggggggggcctcanncntctctgcttctccctctccttcccagtaatatcatgatgaccctctccgagctatgcggggcgcgggcaccttttttngtctgccctatccgtatcagacagcgatccatcccctattctgggttgggaacaggcgattccaggggttgtttttcctttacaattggatcttgaa

SEQ ID NO: 48924 - DNA, 412 bp, Triticum aestivum
  unsure (1)..(412): unsure at all n locations
  Clone ID: PAT_TA_48924
gcactcttcctctcctttacttctctctcccctcctataaaatccggcctgctctcctccccctcccaaccacgccttctcctcgccggcggcggcctcancctcctatctatttctgttctattactggttcttcccccctccctgctacaatgtaacatcatctggttttctgcaatcttacaaattggatgggtactctcaaccttcttttatctctgaacaatcatctgtctattttggatcaagtttatttctaggatagtactctcttccaacttggtaaatgcataaatgtttgctccccttcattcatcaacatcccattatgttcttttggtctcaaaagtcactttccacttcctagtcttagaatcctacaggtctatttctttttaatttttccacatct

SEQ ID NO: 48925 - DNA, 395 bp, Triticum aestivum
  unsure (1)..(395): unsure at all n locations
  Clone ID: PAT_TA_48925
ttcctcttactcttttttccaatcattgttnagaatttnacttcctataccggaacttgtttctctgggacagataaaactaaacatancatatnttattaagcattttcattataatatacttactanatttcccaactctcttcatttgatcccctttcattcttaccactttaaaaacattacacttttattcactaaaaattttccttnggatgcctctctaccatatacttcctcatatgaccattccatcattttcattataacaaattttctctattctatttatacataaaaaactgcgtaaattccaatcctccatatttaccataattttcttcgactttaataataaaccttttaatcttctaacaacatttaaacttccattt

SEQ ID NO: 48926 - DNA, 258 bp, Triticum aestivum
  unsure (1)..(258): unsure at all n locations
  Clone ID: PAT_TA_48926
ggaattcccttgtggggggcgcgtactcgcactcgtgcgccaacgcaaacagacatactttactagaactcgcgcaacatctcatcctgcgtggtcaccttgggggtgggcgtgccaactatccttcattacctctacgggcgggacctcttcttcggcgaccactccaatcctggcttcatgatcattggccacatggccgtcggactttgatggggcttcacangctaaataatctgcaactgttacacagtaggc

SEQ ID NO: 48927 - DNA, 269 bp, Triticum aestivum
  Clone ID: PAT_TA_48927
tacattcgggtgggtgcccacacatcctccctcatattccacataccaatcaacaattacatctttttcttcatttatcttcaacgggtggtagctatattcaagaggggcaagcccttcaacatttttccatttctcttccataaattctaacctctctacatctaatacactcctttcagactaaattgttttgcatttcttatcttaaacacaatcaacaacctcatatttacttacattgataccaattataatcttcattatta

SEQ ID NO: 48928 - DNA, 412 bp, Triticum aestivum
  unsure (1)..(412): unsure at all n locations
  Clone ID: PAT_TA_48928
ccggaattcgggtggggacggacgcgtcctcaccacgcctgcctcatctctcggagcangaggaggagcttgcaggaacaatggcgggccagggtcttctctggggggggcggctgcttgggaggcctcttcattcctccatctccaggtcgtcttcctcccggaaggcccccttcggcggcagggcgtcgtccagcccccctggcaagcaaaatgacaacaggcagctgtggttcgcgtccaagcagtccctcacctacctcgacggcacgctgccctgtgactttggtttctaccccttggggctgtcctacccggagggcaccggctggttcatcgagcccaggtggctgtcctactgcgagatcttcaacggccggacggctattattggggtggggggcatgatctc

SEQ ID NO: 48929 - DNA, 390 bp, Triticum aestivum
  unsure (1)..(390): unsure at all n locations
  Clone ID: PAT_TA_48929
tccttaattcggtggtctacccactcttccttccactctttctctaacataaactaattcattttttctatttaaacccttttttaaggattataaattaacttactacaccccatantattaaactaattatacttttatcttttcatcatttctaataattcctcattccttattttccttcctgataaacattttcttcattatcttcctaatcttctactattacattgacatctttttttacttatttacttaccattcttgatctttacaaaataccattctatcatatctatcctgttatttttaaatacaacctatttattcttttatttatcttatccatataaacctattttaatatttttctttttctaacatttttac

SEQ ID NO: 48930 - DNA, 457 bp, Triticum aestivum
  Clone ID: PAT_TA_48930
agaattcttaattcaagagttatagggagggacttatgtcaccacaaacaggatctaaatcagttgtgtgatttaaagctgggggggagagattataaattcacttactacaccccatattattaaactaacgatactgatatctttgcaacattcctagtaagtcctcatcctggggttccttccgaataaacatgtgcttcattatcttccgaatcttctactggtacatggacaactgtttagactgatggacttaccagtcttgatctttacaaaggacgatactatcacatccagcctgtttctgtggaaaacagccaatggatctgatatttatcttatccattacacctattttaagaggtttcctgtactaacatgtttacttccattgtaggtaacttattttgtttcaaaaccctacattctctatcttttgaggatctacaaattc

SEQ ID NO: 48931 - DNA, 249 bp, Triticum aestivum
  unsure (1)..(249): unsure at all n locations
  Clone ID: PAT_TA_48931
cattcaaaccaacatgacccgaaactattgaaccattacaacgtggtgctttgtagcgattgttagtgtnggagggattctattgaaccccatggatgcagagagatgcttaaggggaaaattgacttatttctgaacacctacangcctaagtcacacatnagattggtcaacctaaaacccggtgatctactctttcttgtgtgctcaancacttctttggtcgatgctacaacttggaatttaaca

SEQ ID NO: 48932 - DNA, 475 bp, Triticum aestivum
  unsure (1)..(475): unsure at all n locations
  Clone ID: PAT_TA_48932
ggcgcgcgcgtgcgactcaacgcacagagacagagggggaggggtccggtntacttgcatgcttccctgccccctggcggtgcgctcccaagggggggaatccggtccactctccccctccctctcgtgtgtgcacccgagacgctcctctagatcaggtcctcggtgcgggtacctctcggcggaagccacgccaccatgggggcggcggacgctatccggaccggcatcggggtcataggcaatggaaccggcttggtgctcttcctatccccagggccggcggtcatccaaatctggaagaagaagacgggggagcantactcggctgggccggacctggcgacgctgctgaattgcatgatgggggggctctacgggcgtcccgtggggcacccgcacaggatgctcggcatcaccatcaacgggaccgggatgcgcatcgagctcacctacctcgggctcttcctcacct

SEQ ID NO: 48933 - DNA, 256 bp, Triticum aestivum
  unsure (1)..(256): unsure at all n locations
  Clone ID: PAT_TA_48933
caaatngcacccaanggaccggcagactcgaaggggtacacaaagggggcaaccngcccaatggggacataaaggtcccaggtacagganaatggggtccttctatcaagggangcattngtaatggcgtcangntgaatggcactcttatcttctctggtggaaggtacnanggtggnattngtngttacctcnacnggcttnagggttctgggttngggggcttatcccggggaaccaggngancatccttctt

SEQ ID NO: 48934 - DNA, 129 bp, Triticum aestivum
  Clone ID: PAT_TA_48934
acattggtcactttcttattatggagaaaggaaaattctggggcggagttcatttttaagggggtacattcttattatacaaatcttaatggatcatatatcacaaatttctatcggtgtcaccctttt

SEQ ID NO: 48935 - DNA, 159 bp, Triticum aestivum
  Clone ID: PAT_TA_48935
gctggtatatatatattctagaacttcttaactgatcccttcttctgaatcgtacactctcacagggtcaggcttataggtggacatggagcgcactttacgtatctatttcttttttctcttctatcatttacataccttcctcattaatttcattca

SEQ ID NO: 48936 - DNA, 355 bp, Triticum aestivum
  unsure (1)..(355): unsure at all n locations
  Clone ID: PAT_TA_48936
ggggcgacgcgtgcgggaaagctgaaaatgaangaggccgcggcggagctngggcacctactggtgtgcnccttcctgttctncgtngcgcgtggatgggngcgccnntnatcaccgacgtggccatgggtgcgctctggcccgggcaagaccaggggtccctcggcatctacctcaccgggctggagcaaggcatcaccgggctgggtgccgtggggggcacnccggtcatcgggaacctctccgatagatacgggcggaaggcgctggtctgtctcccggggaccctggccatcggtccactgggcatcatgggttttaaccagacgagggcatacttctacggcttctacat

SEQ ID NO: 48937 - DNA, 335 bp, Triticum aestivum
  unsure (1)..(335): unsure at all n locations
  Clone ID: PAT_TA_48937
ccccaatcaatcaatcatcatcaacaacctaaacctccgctccgtcttcgcctgggcggggaaccctaggggagngcggggatcgagctctctgatatgcnganatgctggatggggtcctaatatgcatatcttcgtgaatactctggccgggaataccatcactctctanggcgatatgatctacaccatctacaacgtcaagggcaatatccaggacaatggtggcattcccccatatcagcaaagggtaattttttgtggaaaggaagttgaatattggccaacattatcttattacaacattcagaaagaggcgaccctccattttgtcc

SEQ ID NO: 48938 - DNA, 162 bp, Triticum aestivum
  unsure (1)..(162): unsure at all n locations
  Clone ID: PAT_TA_48938
ctttccttaattccgttgtgtacccactcgtcctcccactcgtcctcccactcgtcctcggactcttntgtctcgccctacttgtatcactggcgcgggatncgcaaggtctgcgggactgatctcctcacngcgctgcgaatgctctccttccgtgccatc

SEQ ID NO: 48939 - DNA, 381 bp, Triticum aestivum
  Clone ID: PAT_TA_48939
ccttcattaccgatccgttattccggtggggggcgcacgcgtcctaggaacttggacttctcggaggcctccatcacacttgatcggacgcatgctctcatgggccggctttcaagctcatgcagcctactgctaattttctatctgttttcatctggatcgcacctcatcaccgcgtttaccgcctgatcctgtgggagggcgctcttcttctgtctgtctacctctatcggctacaccaagtcgcatctcaatctaatggatcctttcgtgtcgaggtactattccaaagcatttaccctgttgcaaggattgctattgactctcttcataaccacagttgcaatcgtggctattaacatggcatttgttgctaaataa

SEQ ID NO: 48940 - DNA, 314 bp, Triticum aestivum
  Clone ID: PAT_TA_48940
tacggcgccagaagcccataacgctcgtctttcttcgacgacatggccgtctcgcctcttggagtcgtgctcctcctcctcgccttcgccgtgtctctcttgtgacatcctccgtaggcccgcccctctgcgcagcggcagcgatggaggacggaggcatcttccgccgtcaccgcgcgggctcccgctggtcggccacctacatctcctcggctcggtgccgcaccgggccctgcggtccctggccggcgcacacgggccggtcctgctggtccggctcggccgcgtgcccggcgtgggcgtgttctcgcccg

SEQ ID NO: 48941 - DNA, 416 bp, Triticum aestivum
  Clone ID: PAT_TA_48941
cccactcgttccacgactcataggcagacactcctctcgcctcattgcgcaatccctctctcgggagcaccaacaaaatgggggggagcaacctccagggtctgctcctggcgattggaaacccacttgtagacatctgcgacctcctagaccagggctaactccctaaacatgatctgaaaccaaacaatcccattcttcccgaaggcaaacacttgcccatacaccatgaggtggccaccaaagacaatggtgaacatattcgtggaggagccacccaaaactctatcacgggttcccaatcgatgcttcaaacttcttgtacaacaaattacatggggtgcatacgaaatgacatactatggtgaggagattaacaacgccgctaaaacttaatgaggtactgcttattacta

SEQ ID NO: 48942 - DNA, 207 bp, Triticum aestivum
  Clone ID: PAT_TA_48942
gcacgtcgggctccaaggggctggacggcgtcggggggctcggcgcggcggcgctcgccggcggcagcggtggcggaatgggcggggacgagggctactgccactgctccgtgactgtgtcttggcacaggcggttctcatctctacgtgtcgttcaagatggagaacgcgctgatcatcggcgacctcgtgccgtacgtctactgt

SEQ ID NO: 48943 - DNA, 255 bp, Triticum aestivum
  unsure (1)..(255): unsure at all n locations
  Clone ID: PAT_TA_48943
tatcccttttctnttcttgtccgggaggactaaaagttcattttacatccaatttttcttttctcatgtactttgaggttgtgacccttatgggggtccttcagttattggggagcatccattaaaagtcataatatttttcgcacaatttccttcccggatgtggcttaagaattgttattcaggtatactaatttctttttattattccttttccctacataatattccactaatatccttactctctttttt

SEQ ID NO: 48944 - DNA, 250 bp, Triticum aestivum
  Clone ID: PAT_TA_48944
ctatctttacgttatttggggggggggagactcatcctctgtacgcatgtgctgactcgtttgctatcgaggtggcaaaggaggctgtttgtgggggtgggagtcccatgccacatggggggggcattgaaagcgactatgaggtctttcgcaatctgtactctgttattaacagttctccctggatttccttgaccggacccatatataccccacatgatctgctatgggaaagatggggggttgcata

SEQ ID NO: 48945 - DNA, 383 bp, Triticum aestivum
  unsure (1)..(383): unsure at all n locations
  Clone ID: PAT_TA_48945
gcccgcaggccccgattcccaattgggggggggggcgacgcgtccggacgcctacactctccgccaccatccacatccagatgcatcctcggtaggtttcggcatggcgggagcttccacggtgatgcgggtcgctagggccggtcgctcanctgcggcgaccggatctctcttcggccggttaggtggacgagcgggcctctccacgaaggggggggcgggcggatggcacgctcccaccttggggtcccaccgggcaggctccggagatctgggtctggaccggcctcccggcggcggtcctccccccggcatgaccggacctggctcccagacgctcagctacttaaaaggacaaacggcggaagggaagggggaatttg

SEQ ID NO: 48946 - DNA, 316 bp, Triticum aestivum
  Clone ID: PAT_TA_48946
ccaacgacctccggtgccacagggcctcctacgccggctcctacgcgcccaccaaggtgcagctcggcagggtcaccacctccctggcccggcccggggcagcgacctgcggtcatcggatcggcaagactagggccggctccgggaccggcgccgggcccaccccgggggctgaacctccggtgctacagcgcctcctacaaggctttctccgacgggaccggccatggcaagggggccaactgctgcaccaccaccggatgcacctgggcctccgggcggcggcggtccctcaacctgggggggtacaccccct

SEQ ID NO: 48947 - DNA, 426 bp, Triticum aestivum
  unsure (1)..(426): unsure at all n locations
  Clone ID: PAT_TA_48947
cacgcgtccgcccacgcgtccggaccgaattcttcgcgattcctctcccctcgcctcctggggctccccctcctaggggatcggcggagaggaatcnctacgagggcttcctcctatcagttaaatcaaaggcatggagcacaaggagaccgggtggcagtctcgtgagggccccatcctttgcgtcaataactgcggcttcttcggcagtgcggcgaccatgaacatgtgctccaagggccacaaggggatggcgatgaagcaggagcaggccaagctggccggcttctcttttgacagcatcggcaacgggggggatgccgcgaaagaacatcttggtggtggcaacacggggggggcaggtggtcacgtagaggcgaagactcttattaccggacaggcttctgatatcggcggtgccagcga

SEQ ID NO: 48948 - DNA, 340 bp, Triticum aestivum
  Clone ID: PAT_TA_48948
ctttccgaaattcccttgtgggccgacgcgtacacccctcgtgctccatcgttcgcttacctttagggacaagctcctcatacaatgtgggggttttcacaggagggtgggggggacctatttcacatattaccatgccatcggcaagcaaaatctttccaagatgatctacgactactacgggtgctgctcctaggactattggactctccatgagaacatagatgcctttggcaggatcctggtccggccgcgcattcttatcgatgtatccaaaatcgacattgcaacatctatcctgggattcaatgtctcaatgcgtatcattatttcccccact

SEQ ID NO: 48949 - DNA, 435 bp, Triticum aestivum
  Clone ID: PAT_TA_48949
cccacgcgtccgaaggacccgtggcggtccatgagctacgtgctgcgcgacgtcctggtcgtgctcggcctcgccgccgccgccgcgcgggccgacagctggctcgtctggccgctctactgggccgcgcagggcaccatgttctgggcgctattcgtcctgggacacgactgtgggcatgggagcttctcaagcaacccaaagctgaacagcgtggtcggccacatactccattcctcaattctcgttccatacaacggctggaggatcagccacaggacgcaccaccagaaccacggccatgtggagaaggacgaatcctggcacccgctaccccagaggctgtacaatagcctggacaatatgacaaagaagttgcggttcagcatgccatttcccatgcttgcattccccttatacttgtttgcgaggagc

SEQ ID NO: 48950 - DNA, 364 bp, Triticum aestivum
  Clone ID: PAT_TA_48950
cgcctgctgacgcccacatccaagaccaccggtgggcccctcgtactgcgtcggctaccttcgtcaggtatactgctggcatactgctccacattcaacctttgttgggtgcctacatagacatgaattacgtaatcaatgcctcaaagacgccctgcgacatcgatgccacctctggccatgagaggagccgataagcacacagccttcaatattgataatggaatagacaaccgctgtgccgactaaacagaaccgggataccataggcggagcggcactaatagcgcctgatgctggtgaaaagaccgtgcacatgggtgttcagatagagctgctgggacagattgagcttttctataca

SEQ ID NO: 48951 - DNA, 423 bp, Triticum aestivum
  Clone ID: PAT_TA_48951
agaagggcgacggggttggctgcggaaagacaaagagcggcggatagcggcctcgtgaggtggtgatggaaggggaggcgaacggcgagagtggtgaatctggaaactgcatcggccatggtgctgacatccagatgaggaagcatcaggagacaaaatcggagattgaagtatccaacaagagaggtcaggttgcggcattgatttccgcttctgttgacacaaaattggagatgggggaaactgatgggatgaaggagaacatgctgtcggagatccagctcgaggggacatattcggggactcagtcggccacggagattgtcagggctgatatctgctccttactcagtcgtttctccaatgaaggtcacggagctgaaagtcgtacagaagctgatgattatcgactatagcagtgac

SEQ ID NO: 48952 - DNA, 461 bp, Triticum aestivum
  Clone ID: PAT_TA_48952
ctagaacacatatgttgatgtcacttattgttcagtatatagcttgcataaatcaattgttggaaactttcattcttgctgccactttttttattattcagatgaattaaggggacttgaatggaatacacgttataaaataattagaggcatctgtgaaggtttgcatcatctgcacaacgaaaagaagatatatcatatggatctgaaacccgacaatatactactagacaacgatatggtgccgaaaatcacagattttggtttatcgagacttgatgagaagtcaaaaaccatgagtgaagaacgtcatggatcactaggatactgtgctccagaatacctacatcagggaaatatgtcattcaaatcagacatgtacagtctgggcgctataatcatcgaattagtgacaggagaaaaggcaatccgcagtggtaataacaatgtacttaggagat

SEQ ID NO: 48953 - DNA, 478 bp, Triticum aestivum
  Clone ID: PAT_TA_48953
tcgccgtaagcttccctgcaggctgcagccatatcgtccacaggccggtaggcaggaaaatttcagcagctcggtgtcgatagattccctgcgatacaagactagacgacgacgacgacgacaacaacaacaactagtcactcaatcagtcagtcgcctcaagctttcttcaaagttgcaccggcgctagccctttctctttcttctgcggtgtgtgccgccggccggcgatgaggtggtgggagagcgtcaagagcctgttcgccgacggcggcaacctcggttgcctgtcctgcgtcgggaggaaggcgcccgaggatctccactcctacccgatggagcccgcgaagcggaaacgatcgcgcggcgccgctccggcggcggaggaggagccgggcgccatcgaggtgccggcggtggcgctccgggaggtgaacgagctgaccggctccttcgacagggagaagctgatcgggga

SEQ ID NO: 48954 - DNA, 469 bp, Triticum aestivum
  Clone ID: PAT_TA_48954
cccacgcgtccgagctagctagccgcgcgatgcctcccctcccctaacctttccgtcttcctcctctcctctcctctccctctccccacggtcccaacaagctctcctccctccgcctgctttcccctcccctcctccaaatcccgtgcaaaagctgggatctttttaattagcccaaggagggtactagtgctacatgagatcatgagctccgaggactcgctcaagtcgctgtcgctcgactacctcaacctgctcatcaacggccaggccttcagcgacgtggccttcagcgtggagggccgcctcgtgcacgcgcaccgctgcgtgctcgccgcgcggagcctcttcttcaggaagctcttctgcggcctcgacccgagccaccagcctccgccaccgcctctcaactggccaaacgcgggaggcggcagcggtggcggtggcggtggcggctcacgtgggggca

SEQ ID NO: 48955 - DNA, 473 bp, Triticum aestivum
  Clone ID: PAT_TA_48955
gcgaagcgcgacaggaaaggcactgaactagtttgcaacaaagaagagagaaaatgtctaccgctgaggcaacccgtgaggagaatgtgtacatggccaagctcgccgagcaggctgagcgttatgaggaaatggtcgaattcatggagaaggtggccaagaccgctgatgtaggtgagctcactgttgaggagcgcaacctgctctctgtggcttacaagaatgtgattggtgcccggagggcttcctggaggatcatctcctccattgagcagaaggaggagagccgtgggaacgaggcctatgtcgcatcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggag

SEQ ID NO: 48956 - DNA, 449 bp, Triticum aestivum
  Clone ID: PAT_TA_48956
aatttagggcggaggagcagtgggcagggagggagatccatctcattcccctccgttccgttccctggcggctggctataaagccaggctctgctcctcctctgccgcggctttgactcctacgggcggatggcgcgcaccaccgtggccgtggccgactcgctggcggcaccatgattggcctaccccctgccacactgccttgtctactctgcccaccgcatcaccccactcccctcagtcaccgagtcactcccctcccctctcctgagtcctgaccgagcggagttcacgccgccgccgcattcaaggcgcggtctttgaccggacccgagttaagagggggcgtcggtggggagcaggaagttgaagaagatctgccgccgccggcaagatgcggagatccgcgccggtatttcaagcccttttggttttcctgacaataattg

SEQ ID NO: 48957 - DNA, 470 bp, Triticum aestivum
  Clone ID: PAT_TA_48957
actgaattgaacagaaaactcagaacctgggaatcctgcgccctggcgatctcgtacgccggattgggcgcatctgttggcttgccctccttgtccatgagcttgggcgccggctcttctctgtcggggttgatgtaggcgacgagctgagcgccgcggatggcagcaatggcttgggcacgccacaccaggaagttggagcgatggaggtgttcggcgatgggaatgagggctggtgcagcggcggcggtggtggagcttgaggccatggctagggtttgggatgtgcttagaggttaggctctgaataccatgtaaaattggttgaagcgtatgccttagcagggacgcgttgcttgttatttatagatcatcggtacaaggtcggtagttcaggttgttggtggattgatcctcaagctaagatctatacaagatagagatcaatcctaaccaacctaaactaccta

SEQ ID NO: 48958 - DNA, 287 bp, Triticum aestivum
  Clone ID: PAT_TA_48958
acatcctcttcgtcaccctgtccactccacttcatcagataggcttaggactgttgaagcgcacgtgcagcatgagctgggagaggatggtgcgagctataatcgctaggcacatcctccttgccgtgctcctcgtcggaactgacgtggcctatggtttcagccaggccgacaacgctggtcggggccttgcctagaagctcacccatgcctgatccgtatccgatgccggaccaggagccctatccggatcccaaaccagagccaatgcctatacctgatcccat

SEQ ID NO: 48959 - DNA, 251 bp, Triticum aestivum
  Clone ID: PAT_TA_48959
cccacgcgtacgatcaccctggtcatgaaccacaatacgatctaaaagacccagtcgccgtgagggatgacaccatcatcaccgtcgggatcaccggcatagaggttgacggagactgcttcagtgctatcgacatcacgttacactaattaaagatgacttccatagcatagagccggtcagacgataggccacgccatgggcgctcaagatgagacggagatcgagacatcgtggagcatgcacacatg

SEQ ID NO: 48960 - DNA, 223 bp, Triticum aestivum
  Clone ID: PAT_TA_48960
cccacgcgaccgctctctctggtctccttcctcattctttgctaaaagactcaggagacgggagggaagccaccgccttgagcgtctgcttcaccggattggctgtcgactgcgagatattgggcgcgaataagacgaggccacactaattaagtatgatgtcaagttagaaagtgggacagtgaaccgggacacgcacttgcacactcatgatgtgtacggc

SEQ ID NO: 48961 - DNA, 406 bp, Triticum aestivum
  Clone ID: PAT_TA_48961
agtcggtgaagttggacaggagcaagagtttgcagggaggcgattcggatggccggagttccaggaggaggttcacgggcgatggcgatgcatcatctggtcgacgacaggatagagagtcagttgatccaaggaagaagtcatttgagaggaatagaggggctcaaagggacagagggggtgaccaaggcaggggtgagaggctagcgacgaatgacagcgcagaagaatttactggattggtgggaaaaggaatggtgggtgatgttaaaaacagcaatgatggtcagaggaaagttgaagaatatgtacagagaagaatagttcgaggcgaacgaagcagaattggggacagttctgatactgacgaccgcaagcagtttccatcagcatcatatgtgaagac

SEQ ID NO: 48962 - DNA, 170 bp, Triticum aestivum
  Clone ID: PAT_TA_48962
aggaaacgtgcttataatctgaggagccggtatgcggaggtttgaaggatgatcgtgcacaaaacatgcaattaactcgacttcaaaatggcggatcgttcaggtgcgcgacaatggctatgcgccgacgcatgtgtccgacgccctgtgcctgcacggacgtagcctgg

SEQ ID NO: 48963 - DNA, 328 bp, Triticum aestivum
  Clone ID: PAT_TA_48963
ggccggcgaggtttccgccgagatctcctctggaaccgcactctctatctgacatttgaaatcagacgaggactgcagctactgccgacatggctctcgtcatgcatctgggcagggataacaagaatgccttcaaggctctcattgctgcacagatctgtggagtcaacggtgagctgaccaataatctggagatgaatgtctaaaacaaaacctctgacttcatcaagatgtacaccattatcaaggctcctgtcatggagactgctgatgatactgctgatgagagcaatgctattagacgctatgttgcccgctcaaagggcga

SEQ ID NO: 48964 - DNA, 379 bp, Triticum aestivum
  Clone ID: PAT_TA_48964
cccacgcgtccggcggaagttcataccaatgttgatagctcacagtttactgttgaaggtggccatcacaaggtggatggtgaaactgatggcgattatgaactttctgatgaacctgcgtctgcaccaatcgttgggacaaacaatgctttggaatctcctggaaaagaaatggaggacagtgtgcctgcctccaagggcacacactttggtctggatgattcagatgaggatcagctggatggtgattatgaagttgaggagttgagtggaaaggagactgagctttttgattatgcagctttagctgagcttctcagggcggcaaacagatcacctgcacatggcaaggccaaggtgtttccagttgaaacctctg

SEQ ID NO: 48965 - DNA, 342 bp, Triticum aestivum
  Clone ID: PAT_TA_48965
cctacgcatccgcgtcctctgactcatgaaacaccatcgggccagaagacaccacacccgcactcatacaggactcacgcacccttgagctggaccaggaagctgtagagcccgctggtgccatcacctcccttcagcaagaccgatgaggagcactgcgaggactgtttgcttgccgagatgctactgagcgactagtcaatgcccatggcacggaggacgtgctctgcgacagcaatcaaaatgcatatcctcatgcggatggcggagccggccgagctggtgtacatgatcaacgacctgatgctcatgtgcacgcagatcatcctcgtccacctcggc

SEQ ID NO: 48966 - DNA, 453 bp, Triticum aestivum
  Clone ID: PAT_TA_48966
tgtagagagagaaagagagcgtcttcctccccgactccggcgggcggcgcatggcggggagcgaggacggatcggtggcgtaggcagtttaggggctgaggaggtgaagagacaagaaaagaagaaagaaggtgacaccatggtgatagcttccggagtgattgacaggggacacctgtcctcgttcggcggcccaccgccagactcctcctcgtcgttcttctccgaagatcttgtccccacagagaggcaggttggattctggaaatcggagtcaatggttgatcagagagggagcaagccagcttttgcttctccacttgagaagatccatccgatgggggcgaatcctgaaggcggtctggaacagacaggaggccaagtcttcaagggcctagatgcccttcgcgtcagttaagcgatggggcaagaaaatgcttaaagttcgccgtc

SEQ ID NO: 48967 - DNA, 426 bp, Triticum aestivum
  Clone ID: PAT_TA_48967
atacgcctagcactctctatcaggcacgcacagccacacggatcacggacgcactagctgaaggtagccaggctctggcagttctggcatatccttgcatacacgaccgcaatgtccatcggtgatgtccagaaccccacgttcgcgctgacagaagaggcatcccaaggggaagactcacggctccgccgtggaggcaaggatgacagaagaggcccccgtgccattcgatgtcgaggctaaggcacctgctgccaacagggaagacctggagaccaaggaggtaggacctggcatcgatgatactgaggaggacagggagcccgagccagaaactacgatcgaaccataggccgaggccgctaaagagacagaggctcgagccgtgatcgatacagataccaatgagggcggaactgaagcaga

SEQ ID NO: 48968 - DNA, 393 bp, Triticum aestivum
  Clone ID: PAT_TA_48968
gtcgcactcaacccaaagcatagtgtatgggctgaaaacgcagaccattgatcttgcatacctattaatgaatgcggcattacccaaataggtcacctattagattatgaatctggacgtctattttaatggtcgtgtgatcgatgagacaatcctagcatatcctgaggcatgcgctgcacctgaatatgagaaagcagcgtctacgacatatcctattaataatgtcgataggactgcgcgctgccggacaagctgtatcaccgctaagaagcccggtgatgctggctctgaacgtcagctgaacattaccgtcaccatcagtgcaggacagcctttgggctgctgtttaacaaatggcatgaatgtgccgctacgacgagaggccaacga

SEQ ID NO: 48969 - DNA, 217 bp, Triticum aestivum
  Clone ID: PAT_TA_48969
tcgcccacgcgttccgccacgcgttcgggaaaaaaacaggtatgggcaggaccgggctcgggcttttgaccttcttacttcccgggcacgacacccggcttcggcggggccggcgggcgggccccggcgtcggtgctgtctttccgtccgtggttggctccggggaactttgggccctgggggggcggcaattggtggaggcggtgggggttggccc

SEQ ID NO: 48970 - DNA, 455 bp, Triticum aestivum
  Clone ID: PAT_TA_48970
gcgccgaaggtgcactgaccggcctactcaccctgtcgcggccgtcggtatcaggcgcggtctgacccatctgcagcaccactcccaccgcctacagctatcccaacccctgtctcgtatcgccacacccaagaacaacctaccttgccttgggtcgcgtcgactactgtacgacgacgcctatgccccggacgacgagccggcgactccctgtgctgctgcctcggccgccacgccaccgactgcccctacggcagtcggcatcgacgtcctaaacgatgagttaaagcggaggttggaagcttactataaggtggaggatgagctggaactatcgcctgtcgctatggctgtcctcgagcggaatcctgcatatgcacacagtgatactgatgatgaacttatggaggagctgcgcgacaagccacttgctcaggtccatgatcgggacattg

SEQ ID NO: 48971 - DNA, 395 bp, Triticum aestivum
  Clone ID: PAT_TA_48971
ctcatttcctcgaaaccttactttaagcactctgatgaacgtcaaagtgccatgacttggcttatggaagactcgccgttagatgcaaatctttctgagttggatgtgcaagatgcggttgatatcttttacaatacaatattattctacttggaacctcagtttcatcctctaatacgggagggtcaaaaggacttccttataaaggtagctcaccagttcgtttttgcagaagagaccaattcttgcaagcccctcgaaccagaatcacgtgattttcctggccatctgcagccttatgcaagttcatacatccatacaatgaaggtacaatctaaagtttttacgggacaagaacaattccgtcggcatcaggaggttgatcgatatttggc

SEQ ID NO: 48972 - DNA, 361 bp, Triticum aestivum
  Clone ID: PAT_TA_48972
gtcacgcctcatccccccaccccctcccttgccggcgagccaccctcctcctctatgccccagccagcgcgcacgccacagccgacgccgtgctaagcttcggcgcggaggcctcgtggccgtggatcgtgatggaggcggcgacaggagaggcgatcccgccgcgacacccggcttcggcggcggcggagcaggagcgccccgccccgccgtacctccccaggctcgttgccggcgttctctccggtgtgctcaccggcctcttcgcggtcgctggaggcctgacgggggcagtcaccggcgcgttggctgggagaggcttcgacagcagcgttctccggggagccggactgggggcatt

SEQ ID NO: 48973 - DNA, 477 bp, Triticum aestivum
  Clone ID: PAT_TA_48973
tgaattataaacttaccatctgcagtccataattcaactctctttggaaaccttccacagggtacaatataggaatatggacggtggatagaagaaagcatcaaatatttgtcatctggtgatggatcaatggatgtgtatacagcaggaggccccattggcttcacagttccatccaaagagaccaacatgagctgtgaggttgcatagtaatcaaataaatcagcatcatattcatctttcagaagatcctggaatgttctcacttggaccacattctttgtctcattagactgaatttttggaccagatggaactgatggcttctgtggtagagctccacgtgatacagggatggtgcagactaacaaagtagagttatcaacccatacaaagctgtcaaaaatagcattcaagtatatatcaggagatttaaaaagtggtcgtgcttctccagattccacgtctgcaatccat

SEQ ID NO: 48974 - DNA, 299 bp, Triticum aestivum
  Clone ID: PAT_TA_48974
ccaagctcatgacccgtgtcacctacaccattgacgagatggaaagcccgctcgaggtcgtcaccgacggcaccctcaagtccgaggagaaggacggcatcaactacgcggtcgtcacctgtcagctgcccgaatgcaagcgcgtgcccttacttttcaccgccaagcagctggtagccaccggcatgcccgagagctctagcggtcccttcctagagcccagctacaggggttcgtctctcctcgaccacaaaggagccgggcggctgtactgactacgacaacgacgtggcgctacc

SEQ ID NO: 48975 - DNA, 465 bp, Triticum aestivum
  Clone ID: PAT_TA_48975
cgtccggccatttgagaatatactgtgtattactcaaatctcaaaacaaatggcccattctgaccagaccataactattccaaaagcattgataggcttttttaaacatcaagatatctgaatatttatcttagcagtgtccaaaaaccaaatggttatgtttgttcagattttcctcatttttatgttctttgaattatagtgcttgaggttaataataaatgattgttggtaacttaactagctcttgagaataatgtgtgatataggttgctcctatatgtgtcattgactatgttgcttgtggagagtaataaggatttatctagctcatgtacatctgagcctgagacggagaggacgactgtcgtggctccattgatgatagtggttgcgacgcagagccgtacgaatggacaacaagcaagccaagcactccctgggaatcgccgtgattctgaaacg

SEQ ID NO: 48976 - DNA, 415 bp, Triticum aestivum
  Clone ID: PAT_TA_48976
cgctcgtcatggagacggagccacccaaagtgttcgcttctctcaccctactgttgctgctggcgacggccaccgccgtcgcgctcgcgccggtgcccggagaacaagcgagggcactcctcgtctggaaagccagcctcagcaaccaaagccagcacaccctgcggtcttgggagaacatgtcggcgccgtgcagctggctcggcgtcaggtgcacagcgcaccgacgctggcgccggacggtgatcagcggcatctctctacgggggatgtggctgagagggacgctagagtccctcaacttctcggccctcacaaccttgacgtgccttgacctctcgcacaactaccttgccggggccttccctcctggcattgtggtcctcagagagctccaagctcttctcctgcaagg

SEQ ID NO: 48977 - DNA, 296 bp, Triticum aestivum
  Clone ID: PAT_TA_48977
gcgtacgccgccccaaatccatgcccctacgcacgctttccgttgccgaacaaaccttctgtaccccgattcggttcggtttaactagctggcgtctccacccgaccgactgcactgcaatatgctatagcccgcggagcctggggcagtggttgtactgtagtagattcccgcctgatctgccggggcgcccggagccggagaacgcgacaatggcaacccctgcaaggaacaggctgatgagggatgtcaaacgactgatgcaagatgctgctgcgggcataagtggcacacct

SEQ ID NO: 48978 - DNA, 369 bp, Triticum aestivum
  Clone ID: PAT_TA_48978
acgacggcgggtacggcggatattactcacacggcggattgcgggggagcaacaccatgctggggtggcagctcaccgggtaccatttccaggcggagaagaactaccagaacgatcccaacggtgcggtgtactacataggatggtaccacttattgtaccagcacatccaggggggcaccccatggggcatcatatcatggcgccatgcccagtggcgggacatgcatcactggcgtcacctaccggtcgccatacatgccgaactctggtacgacatcgagggcgatctcaccggatccatgacccgacttctcgaccgtagtgtcatgctgctttacacggcgaacacccggacggttgctcatg

SEQ ID NO: 48979 - DNA, 428 bp, Triticum aestivum
  Clone ID: PAT_TA_48979
acgcccacgcgtacgctgaagttgtatgctgccgtggtccttgcgatcagtaaatcgccatttggctgccgccacacgcacaagaacctcgtctgtggggtggggtcaatcacctgcgccggtgccgtgaacggggcaacaaaggacgtctgctgtcgacgacaacagagagcaccaggacaggggctgcgtgtggcatgatcatggacgacgacctggccggagtgaatgatgatgaactacaaaggcctcacgagatcattctagcttaacccggaaacgtttaaagagtaaacatgatactagcgatgaggctgatggaggatatgatccattcagtcaacggagaacaaggttgacaggcttcaagcaacgaaacgacagggaagattttacccattatgcaaaacttgctgggcagcaaacac

SEQ ID NO: 48980 - DNA, 379 bp, Triticum aestivum
  Clone ID: PAT_TA_48980
cgtactcgctccagaataagctggtccacccacacgtacgcagtcattcatcactgatcaccaccacacgcgcgcatccaccgatgatagcacggtcgagcaagcagcacagagatggttgttgccttgtcctccaccgacggcgcccctggttgtacgccgaccaacttcctcgggaagaagctcaagaagcacgtgaccttggccgtgaactaccatggcaagagctgcaacgtcaacaggttcacggtcatggcagaggtaaacatcgacgagaagaggaacaccgacaagtggaagggtcttgcgtacgatatatacgacgaccagcaagacatcagcagacggaatggcatgggggactccgtatttcaggcgc

SEQ ID NO: 48981 - DNA, 275 bp, Triticum aestivum
  Clone ID: PAT_TA_48981
cccacgcgtacgcgtgcacgcatcgcacaccatgtccgccacaagatctgaaatcgctgatgacatggtgggggaataagctaccaataccagatgcatgcctgggctcttattcaatcggaggcttgtagagtgccctgctccggtcatggcccatggtcgcgtacgtaccagcccatggatccgccattggctacgctatctatgacctacatgaagctgcagctggttaggctacttgggctcttgaagaatgctcgtgtgaaacggccatg

SEQ ID NO: 48982 - DNA, 376 bp, Triticum aestivum
  Clone ID: PAT_TA_48982
cgactcactacagaataagcgtgtcgaccacgcgtacgcggacccgtatttctgtgttgacccaaacgaacaagcacgcgtggtgtttttctgtccatggccacaacagaaaactggcgcatattggtgcacacgcgacatgttaccctaaccaagctgtaaaagatgggatagagcaaacatggcgtagcttagaagttcactgaatagcaaaaatggaggagggtatagatgaaatatataacaggttgagtgaaggcaattttctacttagcagataaactttgggaggcttgataggtattaaaaatctgaagatcacttggattgacagagtggactaatgggaggatctatgaaatatgcggagtaacca

SEQ ID NO: 48983 - DNA, 293 bp, Triticum aestivum
  Clone ID: PAT_TA_48983
cccacgacgtacgcgttcttctgatccgacaagtgcgccaccggcgtggttattaaggtgcttgctgaccacaaggatcaactcgaagcacctgctttgcccatgaaagcattacaacgacaaggccgctgtggcggtacaagggttatgaaactgccggcgcgtacgcatgccaaaaaggaaggaacgccattggatgctttatgttacacccgacaacgattttgccggagaggaccatgatatcagattgcaagagatcaaggaagcgacaggctattactaaccacaca

SEQ ID NO: 48984 - DNA, 283 bp, Triticum aestivum
  Clone ID: PAT_TA_48984
acgcaagacgttatcgccccataagccgaaacattggtggctgacctggaaaatggtgctggtttgctcctggaaaacccaggattttacaaggaagaggataagaatgacccaaagattgcacagaagcttgcatcactggcacatctggttggaaacgatgcatgcataacagcccacagagcacatgcctggactgagggagtcaccaaactcttgacaccttttgacggtggattccttctgcagaatgaactcgactacctgtatggagctgttgcaa

SEQ ID NO: 48985 - DNA, 263 bp, Triticum aestivum
  Clone ID: PAT_TA_48985
acgagcatcttaacacacacaccgaccctagcttgtcaattagtcaaggcacacacgatcgccaaggacatcaaggcggcaccccccgacggtgagtacggagacaaggactactccgacccgccggcagcgccgctcttagacgtagaggagctgactaaatggtccctgtaccgagcggtcatagccgagttcgtggccactctgctgttcctctacatcaccgtgggcaccgacattggttacaagcaacatgaagaccc

SEQ ID NO: 48986 - DNA, 370 bp, Triticum aestivum
  Clone ID: PAT_TA_48986
acgctacactgcactcccatcacacacaccgacacacctgcaagagcgtgagccatgacatacatggggaagaagcagggggtggcggatctgatgcttgtgctagaggcgctggcggccgcgcctgacgctgcgcacgctgggtgccaggcgtgacacctggcggggtgcgcttgggcgatcctgttcagagccaagccgagcggctagtgctgtggtaacctgcggccagcaccagccgtgcttctggcagtaccccaaggaccccacctacgggctgttcatacgaagccaagacgcgcgcgacacgctagagtactgcgggctcgcacgcgcgcactgctatgcaccggtagggccctggcgcaca

SEQ ID NO: 48987 - DNA, 334 bp, Triticum aestivum
  Clone ID: PAT_TA_48987
acgactcactacaggataagctgtccaccacgcgtaccgccgccagcatgcggcagcacacccggcctgctcgctgtgtacacctgcgagtgctggcggcgaagaaaaatctcgcttcggataaaacaaagcgaaaaatggaagcatgagctgcttcacaccctgcgcactacggtgatccgccgtaaaccataccctcggcctagccactatctcctgctaaccggagaccgaccgtacgcacgccctagtcctagcccgagcccgaccctgcgggcgagatgccgccagacggagatctggaccgcgagatcgagcacctgcgcgagtgcaa

SEQ ID NO: 48988 - DNA, 361 bp, Triticum aestivum
  Clone ID: PAT_TA_48988
acgcgccacgcgtacggcgccgacatactagccctcatggccagcgacgcagtctggctgaccaagggtccattctgggaacttactttgggtcggcatgaccgcattgtgtccatctccaacgagaccaaccaactgccacccgcgaccgtcaacttaaacgagctaactcagatcttcgacggcaagaacctcgactccaacgaccttgttgtcctctacgaccgtcacaccataggaacgtggcactgtttctgcttgtcacaccgtctgtacaacttaaccggcagggtgaacccacaccgacattgaacatacactggaacgcgaacacatggcgaatctgacgaacaagggcacc

SEQ ID NO: 48989 - DNA, 366 bp, Triticum aestivum
  Clone ID: PAT_TA_48989
acgcggggagtggcgagacggacgtcgccaggtccaccacgtggacaggacagacgaggacagcttctcacagcgcgttactgtgcgcaggctaccttgaggaggaggtcggcagtctcaggcgcttacccatccgaagccacagggaaaaggaaggaatgccattttgcccttgagagcaaaacataagcacatacaactacaaaaatctatactactatgtgcgcaggatttaacaccaaaaggatctgctacatggcaatgacaagattctagattgatttgtgtcgccctgagacgaacaagaatgatttgatttctttggatccatactaacatataaacatggaaagatgggatctgatg

SEQ ID NO: 48990 - DNA, 274 bp, Triticum aestivum
  Clone ID: PAT_TA_48990
cgtacgcgtccctcgcgattcaaattactagccactgaaatggttgtttctagaactaaaatacatctagatacatgcatacgtgcgacatgtaattcagaacggagggagtatgcgtgcgacgaggaattcggaacggagggagtatgtatgatcgacgggtgaaagcatatatatgagctctgaagtgcactatggtaagcgtggaggtataatattaaatgaagtatgcgaaaccagatgggggcattgccgaggactgaactacatgttt

SEQ ID NO: 48991 - DNA, 429 bp, Triticum aestivum
  Clone ID: PAT_TA_48991
acgcccacgcgtacgcggacgcgtagcatccattccgctcaccgccgccgtcactccggcgatgcagtcgcctagatgggtcgcgtgatccgcgcttagcgtaagggtgctggctccgtcttcaagtgctacacgcaccaccgcaaggtccccgtccgagtcacgtagctagacttcggcgagcgcaacgggtacctcaagggtgtactcaccgatgtgatacacgaccctgagcgtggtgcgccgctgtccaatgtgaccttccgccacccgttcaggtacaagcaccataacgagctcttagtcgtcgacgaaggtatgtacaccggccagtttgtctactgccgacgcttagccaccctctcacgtcgcatcgtgctgccgctgcgctacgttcttggaggagacgttatttgcaatgtggtgcac

SEQ ID NO: 48992 - DNA, 325 bp, Triticum aestivum
  Clone ID: PAT_TA_48992
tccacccacgcgtacgcgcctcgctattgtgagaattcttaatacacgagcgatagggagggacttatgtcaccacaaacagaaactaaagcaggggctgaatttaacgctggcggtaacgattataaatggacttactacacccgagagtatgaaactaaagatgctgatctacaggcagcattccgagtcagtcgctactgctgtgttgcgaccgaagaaacaagggctgcagtctctgccgaatcttgtactggcacatggacaactgtctggactgatggacttaccaacatggatcgctacaaaggacgatgctctcaca

SEQ ID NO: 48993 - DNA, 380 bp, Triticum aestivum
  Clone ID: PAT_TA_48993
acgcgccacgcgtacgctccgtgccgctgactcgtattcccacgtgtctgttgggcgcaagcgccggcgccgacatggtatgtaagcggctgacacgtattctcacacaacgttcccgatctggagagggaggtaaatacacggccacatgtgcgtgcgccggcaggatgtttcttgagggtatcatcaaccgttgtaggcactgctagcaacagcagcatgcctcattgccgacaaagggatggcacatggcgcgcgtgactgccatctaaggagaaggacatgccacgatgaacctctcgcattatctaggaagttgtcatggaagacgccgaagaaaagttcatgtgagctcctgtgggactcttacataattttta

SEQ ID NO: 48994 - DNA, 418 bp, Triticum aestivum
  Clone ID: PAT_TA_48994
gcgtacgcctgcaggcatagcagagttgaccgtgtcgtactcgtacgagatcaacatggcaactgcatatgctcctgcgatggcgagccatgtgatgaagagctgcttgttgagctgcaagccacgtgatctagaccgcgcctcactgaccaaaacgccccggtttgtcctgaacgtcactaagtatgacaaggggacgtaccatgtgggccagcccatctaccgcgacccgttcataggcagtctggagactcacgggacctccagtcatctcgtggcgtgatacctctgcaacctccacgcgtaccgtaccgtcgtaagtctgctacttcgcggcatacaggacggcctcgagcacggttatctgctcgttcgacgcttcgcgctcacacggctgtttcgtaacacgccatttcac

SEQ ID NO: 48995 - DNA, 358 bp, Triticum aestivum
  Clone ID: PAT_TA_48995
acgccctgcaaacggttcagccggaggtaggcttcagtggtcggaacagcaccgcacgtggcgcggtgtacggtgcggacctgaccagcccgtcgctcttctccatcgcgctccgtctaccagcgcaggctgtcgtagccgggggtggagctactgaccatatgccagctgatgccggagcagtacaagcacatgctcggaggaccctcgctcaaggtggatccacacactggcgccaccgttgaaggagggctaaccttacacatgacctgtgcctgactgtgcattatcgttaagggacacctgaaccgcattgtgaagacaggcatgctgtccgtgtacaccgatagcctagacc

SEQ ID NO: 48996 - DNA, 467 bp, Triticum aestivum
  unsure (1)..(467): unsure at all n locations
  Clone ID: PAT_TA_48996
gtaacgaagaactatcatttgggtaccaagttccacttcaggccaggaaaatttcttataacttcaaaacggcaagggatgcaccattgtcttcaggtctgccttgcaggttggagtgcagctttcagatatctttctttccttgggatagttggaatggaatactatgactagatatacaatggtattgttatcagtgttcggccttcaatgatttcggtgcagcatgtctagaccatcaacggcaatttgagctccttagtgaagtaggtttgtaaggcgttgcttcaactcaagaaaatcaatggccacaattgggaagttgactgacaatccaaagagagtgccaattttcaatctcatgtttaggtgcttacatcaatctcgtgcatagtctcgatcaccaccaccggngcagctacttctgctggaggggctgngcgccgccgtgcggatgctatcaccca

SEQ ID NO: 48997 - DNA, 151 bp, Triticum aestivum
  Clone ID: PAT_TA_48997
cgcgtcgcctcatccactgccgtctaaaccccaacccctcctcccatttcccccagcacatgcagttacccaggccatggcaaagcagaagctaggcgtacgcgacgcgagttcgccgtcgtcgtcaatgtccctcctccttcggccgtcg

SEQ ID NO: 48998 - DNA, 397 bp, Triticum aestivum
  Clone ID: PAT_TA_48998
ctcgagtgcagtgtactgcgtttccttctcgtcgtcggtcttcttatctcatccccgactccgacgagcccaaccggcgacggatggcggcgacgaagctgagcagcgggcacgagatgccggccgtggggctcggcgtctggcggatggactccgccgccgtccgcggcctcatccactccgccctccgcgccggctaccgccacttcgactgcgccgctgactacaaaaacgaggctgaagttggcgatgcgctggcggaggcattccaaactgggcttgtcaagagggaggatcttttcatcactaccaagttgtggaactcagatcacgggcatgtggttgaagcctgcaaggatagcctgaagaagctgcaattggataatctagatctcta

SEQ ID NO: 48999 - DNA, 416 bp, Triticum aestivum
  Clone ID: PAT_TA_48999
attcatcattcaaaggatattattgctactgggggtatcgatacaaacgcagttcttttcgataggccatcgggtcaagtattgtgcactctcactgatcactcaaagaagattacgagtttgaaatttgttccccgggatgagcttttgataacgggatcagcagataagactgtccgtgtatggcaaggtaatgaagatggaagctatggttgcaggcacacaatgagagatcatggtgcagaggttgaagctgtcacggtccatgctagtcagaaatactttgcaactgccttcagagataacacatggtgcttttatgatatttgaacagggtcttgcctcacacaggttggcgaggcttatggacaagatgcatacacgtgagcagctttccaccccggtggtcctattct

SEQ ID NO: 49000 - DNA, 378 bp, Triticum aestivum
  Clone ID: PAT_TA_49000
ccgtccggccatcgtcgttcgttgaggtaactcaaggagcgtagcgatggaggggaaggccgaacgcatctatccatccaccgggtgtgacgactgatctgatactccattaattagattgttgatagcaattacctgcactcaccccacgaaaagggatacctaaactgccacgctgacggtaacttcaacaaatccaaaatatacaacattgcctcaacccttgtgagaacttgacactcttggaaacaagaactatgagaaactacatcacactaaccattgaacgcataaggaggcaaactatgcgaacacgattggctacactgcatgccaagatgctggcgaatagcatgatgtctgcaccacattacatac

SEQ ID NO: 49001 - DNA, 469 bp, Triticum aestivum
  Clone ID: PAT_TA_49001
cccacgcgtccgcgtgcctgtcctccccaaaaagaaaaaaaagcctctgatccaacccccaccccgtagcctcccgatccacctccaccttccacctccaggcgccgtctccgtgacccgccgtcgcgcgccaccccacaacccgccgctgcgcgccacccgcaactcgccgccgcgcgccaccccgcaaccccctcccccggcgctggccaacgcccagcaccgtctccctggcgacggcctccgaccgcccccgtccccccctggcgacggccgcagtttaccccctgtcctcccctagcgccggccgcagtccagcccccgtcctcccctagcgcgggccgtcacccgttgcatccacacatggcgccagccgccccatcttcccctggcgttggccaccggcagattttttgctgtggtgctacatcactcgggcgacaaggaggcgacagtgacgacttcaaca

SEQ ID NO: 49002 - DNA, 422 bp, Triticum aestivum
  Clone ID: PAT_TA_49002
cgcacgtgctcaacaacaagcgcgagttcccgctggcctccggcgtggaggacctgctggtcatctccatcggcagcggcgagggcgagcagcgccccgccgtcggcaccggcggcgcctcgacgtccgagatcgtcaggatcgccgccgagggcgtgtccgacatggtggatcaagcggtggccatggcgttcggacataacaggacaagcaactacacccgcatccaggcgatggggtcgccgcggggcggccgatgcgcggcggcggcggcgaaggggtgcgtggcggcggaggagatgctgtcgcagaagaacgtggagtcggtgctattccgcgggaagaagctcgcggagcagaccaacgcggagaagcttggacggttcgcgcacgaactagtcaaggagcacgacccgccgcgt

SEQ ID NO: 49003 - DNA, 410 bp, Triticum aestivum
  Clone ID: PAT_TA_49003
ggtagtccctgtactcaggtaaatccttttgcatcatttcactattggttttgttgtaattgtattagatttccgccatggacgccgcctcgctcatgggctcctcctccaccgacgcacgcaccgacggggagcaccggatgggcatcaccatcatgggcgtctgctacgacggcggcgtcctcgccgctgacactcaggaccagcaccggtacccccccccctcgcggatccaacagcagcggctaggtcagggtcggagatggcgcatcggccatccgattccgccggtcgtagatcaaacagagggcgtgataaagtccagcagaagtggtggccgggatttttactgttaaattcgatctgcaaaacagtgatcaatatagtatatgtgcaagaaaatagacatg

SEQ ID NO: 49004 - DNA, 419 bp, Triticum aestivum
  Clone ID: PAT_TA_49004
cccacgcgtccggagcagattcccacgcgacgcgagcgatctcgatcgaccgacgagagaggaggagagaacccatccaagaaaggaaggaaggaagggcggcgggcatggggctggactactacaagatcctgggggtggacaaggcggcgagcgacgacgacctcaagaaggcctaccgcaagctcgccatgaagtggcaccccgacaagaaccccaccagcaagaaggaggccgagagcaagttcaagcagatctccgaggcatacgaggtgctgagcgactcgcagaagcgcgcggtctacgaccagtacggcgaggaggggctcaagggccaggtgccgccgccgggggccggcggcggcgcgggcggtccgaggggcgccaccttcttctccacgggcgccgacgggcccacg

SEQ ID NO: 49005 - DNA, 395 bp, Triticum aestivum
  Clone ID: PAT_TA_49005
gacacattgcagcttcctcctcccacctttccccacccgctgctagcagcaccgccgcgtccagatccggcggccgatctcccccgcccgtctccccatggcggccggagccctgggcctggccctcgtcgcggcgttcgcgctcgcgctcgcgggggcaaactccgagggcgacgcgctctcggcgctgcgccgcagcctgcgggatcccggcggcgtgctgcagagctgggaccccaccctcgtcaacccctgcacctggttccacgtcacctgcgaccgcgacaaccgcgtcacccgcctagatcttggtaatttgaacttatctggtcatctggtgcccgagcttggtaaattggagcatttgcaatatctggaactttacaaaaataaca

SEQ ID NO: 49006 - DNA, 402 bp, Triticum aestivum
  unsure (1)..(402): unsure at all n locations
  Clone ID: PAT_TA_49006
ctccacttccattcgcatcctcctcctcacttccccagatccaaatcgcgcgcgagagagcaaagggaggaagaaagagatctcgccgagcgccaccccgaatccgccatggcctcggcagcgccgcccctcctccccaccaccgtcccggccgccgcgcccgccaccgtcctccccgccgccccggacgccgccgccacctccatcgcctccccggacccggccgccacgcgcgccttnctgggccgtctctacgactccgccaagcgctccctctcgggcgcccgcccctggcccgagctcctggaccgcgccgtgctctcgcgcccgtacttcctctccgacgccaccgcccgacttcgcaagaacctcgcctacttacgtgttaactacgccgcgctc

SEQ ID NO: 49007 - DNA, 315 bp, Triticum aestivum
  Clone ID: PAT_TA_49007
attaccttacttgcgtcgagcgaggggtgccgatccatccatccatacctatgacggaaggaaggattcaatgcgtgcgtgcccagcaagcaccgatgcatatggtgctgggggtaaaacaccggtcggctctgtatagcgccagcgaggaagcacccgatggggatgggtcgctcaagtcagcactctccgtattcaatggcaacgaggagcacatcgctaggaagattctcggggtcagggacacggacttcgtgcaagtcgatcgcgttcaggaacagtccaagcgcctagcattgatgcgacaggaactgg

SEQ ID NO: 49008 - DNA, 433 bp, Triticum aestivum
  Clone ID: PAT_TA_49008
acgctgctactacagcatgcacccatccatgcatctgttatttttttattattgcaacgaaccgagagcatttagcttacagtgagctaaagattccaacgatggccgttcttgtggcaaggcaagagcgcgagctgcagcggtacagcgcgagcaccggcgggcgcattgtggtggggcgcatccagtaccgggtgcgccatggcggcggcgaggacgaggtccagctggaggtgctggtgatcagatcgcaaaagggacacggcatgatgttccacaagggcggatgggagctgcacgagtacatggacgacgcccgccggcgcgaggccctggaggatgcacgactccgcggggagataggcaatgtgctcggctgctggcactaccaaaaccggcgatgccataccatctacgagggcataatgtaccc

SEQ ID NO: 49009 - DNA, 432 bp, Triticum aestivum
  Clone ID: PAT_TA_49009
cgtacgcggacgcgtgggcggacgcgtgggctcgcgcggctcccctccgcgtgcggatgctctgtcgggggggatcgccgggccgtacagaatggtggtgcggggtgacggctccaccttatactacggctgctcgggttgctgtttcgacgtacccaggacccaccgccgcggcctcttcagcaccagtgcgcacgctgccgccgggccggaccgacgcctcgtgccgcgcgccggtggtcgtgtacagcccgccgctcacgcgcgccgctggtcgggggcacgccaaggtcgaccgctgcggccggttctgcagacgccgagccgggcgcgagctcgcgctgatggtctcctacgccggatgcctaggaggcgctgacggggtgcgacacttcaaccgtcgagggcgcgcaagaagagagcctgtctatg

SEQ ID NO: 49010 - DNA, 434 bp, Triticum aestivum
  Clone ID: PAT_TA_49010
ggtcggcgaggcgtccggtggtacgaaatcatacacccatgcatgtatagcttatagagccatccttcttacttaacatgtgctcttttgttacagtgagcgaaagataacgacgacagcggtgatagggggaagaaaatggcggggagctgcatgcatgcagagcgagcacacccggtcgcgttgtagcgctgcacatccaataccgggtgcccgatcgtggcggggagggcgctgtagagctggtactgctgcagagcagttggcataagggtgacaggctatgatgtttcctaaattggccaaccgcctagagtagatgctggacgacatgacatgcccacctggtatagaggagggatggcggatccgggtgatcgactatgcactggtctgatggctaatggagtactcgcactgcctggccacctaca

SEQ ID NO: 49011 - DNA, 386 bp, Triticum aestivum
  Clone ID: PAT_TA_49011
acgaaaaatctagctcacaagcacgacgtgtcgtgatcgaatccttcaagcttatcacagcattcgggaggcagaggagcaaagccaatcaaacaaagcagaggggagcagccatgcccgggcttatcctaaacaccggcggccgccttgccaatcctagtagcctaaggccgggcttcgcttgctcccgccaccggcaccgatgccgagccggtggcttctcctcatcggcgtccaactctagcggctgcgggctccggtcgtcttgggcgacatactacaacctgtacgagctggtggggggggaaccactatagcctgaagctgacattaaaggcggctaccgggcgctgcaaaagcgctgtcacccggacgtcgccggcggt

SEQ ID NO: 49012 - DNA, 290 bp, Triticum aestivum
  Clone ID: PAT_TA_49012
cgcgtacgaggcgaggatcacatgcggtggcaactgcaggagtcatggagagggggcgagagtgagcaggggctgtcgaccaagaaggaagaggctagggcgaggaccggaggacgaggcgctcatggtggagcataggacgatggaggcggagtgctactgcaacggatgtgggactgggcgaaaggatcaaattattggttactttaaatgggcgtgctggagccaatgaaaaaagatcactgcagctgtgaatgtaggcacacgtcaaatgaaactattggatggag

SEQ ID NO: 49013 - DNA, 391 bp, Triticum aestivum
  Clone ID: PAT_TA_49013
gttattgtgagaattgttaattcacgagcgatagggaggggcttatgtcaccacaaacagaaactaaagcaggtgttggatttaaagctgacgttaaagattataaatggacttactacaccccagagtatgaaactaaggatactgatatcttggcagcattccgagtaagtcctcaccctggggttccgcccgaagaaacaggggctgcagtcgctggcgaatcttgtactggtacatggacaactgtttggactgatggacttaccagcctggatcgttacaaaggacgatgctatcacatcgagcctgttgctggggaagacatgcaatggatctgtcatgtagcttatgcattacacctattggaagagggttgtcgtactaacat

SEQ ID NO: 49014 - DNA, 407 bp, Triticum aestivum
  Clone ID: PAT_TA_49014
acgcccacgcgtacgcccacgcgtacggacggagtcgagaggaaaccctagcacgcccgcttgcggggcgccggagccggagtcaggtcgggatgggcgccgaggaggacgccgacgcccgccgcgagcgcctcaagggcctacgcgccggcaaggagctagtgtccgagcgcgatggcgcctgccaagaacctgctctcggcgcctgacggggcgtcgcggaacagcataatggtgaacatgggatgacagaagaacaagtggactaaccaaaattgtctggttctgtggatgcacccgatgatgctatcaaggggaacgttagccgcactaagggatctgatgaaattgaatacagatgggaggtaccattgtagttaagaaatctccctttcttatgttatgcg

SEQ ID NO: 49015 - DNA, 445 bp, Triticum aestivum
  Clone ID: PAT_TA_49015
cccacgcgtacgcggacgcgtgggggcggtcgagcgcttactgcccacgcactgcgctcgattcccctcgtgctcatcggtatggaccccgtagacgcagttcaccgtcgctgctcctgaggcagctcgggcaccgccgccgcgcgcgccatgtactacttctgctactgcgggtgggcgggccataccctctacacgacgctcgggggccgcgtccgctgcgagcgcgagatcaagcgcaggacgttcatggtaggcgccggctacgtaccggacgagcgcgacggcatgtccttcctcaacgaggtcaaggatcctcgtgccacccataattgatgagcgtacaaggtgggagagcacctacgatataacgatgaccggggaccttgtagcacaactggaaagccaatatactgcgccattcatttcatgtggcatagatatg

SEQ ID NO: 49016 - DNA, 367 bp, Triticum aestivum
  Clone ID: PAT_TA_49016
acggtgagaattcttaattcaagagttatagcgagggacttatgtcaccacaaacagaaactaaggcaggggttggatttaacgctggcgttaacgattataaatggacttactacacccgagagtatgaaactaaggatactgatctcttggcagcattccgagtaagtcgctaccctggggttgcgcccgaagaaacaggggctgcagtatctgccgaatcttgtactggtacatggacaactgcttggactgatggacataccagccttgatcgttacaaaggacgatgctatcacatggagcctgctgctggagaagacagccaatgaatctgatatggagcttatccatgacacctattgga

SEQ ID NO: 49017 - DNA, 466 bp, Triticum aestivum
  Clone ID: PAT_TA_49017
cgactcactacaggatacgcgtgtcggcccacgtgtacgcccacccgaatgccttatgcgacacacggaatgttcccagcacaagatttatcacactcacgagacgttacctagacggcattgtcactactacctgcaattactggagactgctatgacgctgcaccacgagagttgtggctattgcgagaagctccatctgcatgcactgaagacagcgaactgtgacaagaccaggggatttgcaataatgtaacacggacccaagcacgggacccaacaccatcggtgatgtccccagtaaacgaactcacaatccttgcaaggatgggggaggagcaacaatatagtcgtggcactagcgaggaagacggtgcacacagggtgtaagtacatcacacaatgcgcttcaccgagtgaaaaggttcttaatgcgagtggagtgactgcaacagatacatatgaa

SEQ ID NO: 49018 - DNA, 368 bp, Triticum aestivum
  Clone ID: PAT_TA_49018
cgtacggagcacagtacacgacgcgaccgcgagccaaacgctaccgagaacacgtcgggaatgagctcctacaactgcaacggagggaagaagcctgaaccgttcggagggcgcgggggcatacaaaccctcaccgacatgaaccgggggccgtatgggtacccaggcgcaggcgaaagggggagcgactgcgatgagccccacgagtactacaccgggggagagaagagtgcgatgcttgttcaagatccaacaagggaaaataatgtggactgaatctgtgaccaagctagagtgatgggtgctcagaaagtttcactgagttatattgaaggccaatcttccagctcaactagctttgcaggaac

SEQ ID NO: 49019 - DNA, 319 bp, Triticum aestivum
  Clone ID: PAT_TA_49019
cgtacggatgctgcatgcaagggtggaggcatgccaaagctgcgtaaaacgcaaacgtggggggaggaggattctaaatcgaagggactacgctttagattgggtgacgtaggcgaagacaatgttccatgccgttggtgacatggtgggaggaccactaagatagccgttgaatgagaatgttatcactggcaacagaggatataattgggacggaatagtgagctgtaccatggactctatccatttagacagggttgaaagacaatggatcctgtcttatgtgaaaatcattgtgcatgaggtcatgagaaatata

SEQ ID NO: 49020 - DNA, 409 bp, Triticum aestivum
  Clone ID: PAT_TA_49020
acgcccacgcgtacggcctgatcaactcactccccctcccatgcctccaccttattctaacctcagctcagctcacgagttcgccctatcgtctccaatggcgagggccaacgccatctccaccgcctccattgtccgctccttatgctaccaggggaggccgaggaggtccatgaacggccgctcctcgcgggtggtggtgcgcgcggaccccacggaaatcgcctttgaccagaagtgccgcgccgagctacatgccggtgtagaaaagctcgccagcgccgctggagtcaccctcggaccacgagggaagaacgtagtgctggatgagtatggcaaccccaaagtgctgaatgatggtggtaccattgcccgcgctattgagctaggtaacccaatggaaaatgcc

SEQ ID NO: 49021 - DNA, 395 bp, Triticum aestivum
  Clone ID: PAT_TA_49021
acgcatttcagtgcatctgcatctgcataagcggcggttctcactgcgcagtccaatatccggaaactttgtgttgacaatgaaaaaatcggtgttctgatgctaaatcttggaggcccaaagacccttgatgatgttcaacctttcttgtttaatctctttgctgatccggatatcatccgtgttcctagggcgtgctgctttttgcataatccgctagcacaatttatttttgttgcaagagcgccaaatagcacggaaggttatgcatgcataagcggcggttcaccccttcggcaaattactgatgcgcagggagaaacacttatggaagcattatgttgaaaggacatacgcactaatgtggacgtggtaatgcagggtcgtcatccctt

SEQ ID NO: 49022 - DNA, 364 bp, Triticum aestivum
  Clone ID: PAT_TA_49022
acgctctagccctttgccctcccgacccacaccagcatggtaagcctgtagtgttgcgcgaacccaccggatctcaaccccgccgtcgtcgagggcaaggtcgtggacagattcggcgggatcaaggcgtacgtcgccggcccccatgactccaatgacggcgtacttctcatctgcgacgtattccgatgtgaagcgccgaatctgatgaagatagtccataaagttgcttcctctggatattttgatggcgtgccaaatttcttacatggggatccatgtggacctgaaaacgctgacacgaccaatatcaatgtggataaaggaacataccccgagaaaagcatttgaagatgcaaaacct

SEQ ID NO: 49023 - DNA, 454 bp, Triticum aestivum
  Clone ID: PAT_TA_49023
ccacgcgtacgcatccgcccctcgctgccgctgcatatggtttccaccaccccacttgctcccggacccaggaggatcgtcggagatgtcggacaccgatgagcaccacttcgagtccaaggccgactacggcgcctccaagacctaccctcagcaggccggcgccatccgcaagggtggacacatagtcatcaaggcccgtccctgcagggttgctgaggtctacacctgcaagactgggaagcatggtcacgcaaagtgtcactttgatgccattgacatctttaatggaaagaagcttgaggatatcggtccttcataccacaactgtgacggccgccatgttgaccgccaagattatcagctgattgacataactgatgatggatatgtcagccttgtaactgagagtggcaacactaaggatgacctgaagctctccactgatgatgtt

SEQ ID NO: 49024 - DNA, 460 bp, Triticum aestivum
  Clone ID: PAT_TA_49024
acgggcaccgcgagcgactgttcgaccgaggccacagacacacacgacgaacacggcggtgcagatggcggacccagacgcgtagctctgctccacactcggctacccgctcgccgactctctcgtcgaccgtctgctagccggctgctgctcctctaggaagctatcccaagtgaaggtattaagggtcgacagattgttcaagagtgacatcattagggaccgtatcattctctctgaaaacctcgataagctcggtgaacaggttaaagctcaggatgtggcaggatgggactcaatttaatgctatgtcaatggcggtcgctttgtgccaaaaattacgattgaaccatggattgttgatgctatacgtacagagactgatcttgacatgggatgtgcatttgaagattgaggaacctgaacatggaattgatgattttattaatgcaagtgctga

SEQ ID NO: 49025 - DNA, 365 bp, Triticum aestivum
  Clone ID: PAT_TA_49025
cggacccgtgtgcaaactcggtgcacaagaattgctgccacgcggaccgtctcgtcgtcgacaccaccgtcgcagctagatcagatgaacaacagagagagaggcactggtcggtagggctcgagatctgtgtagggagacagggaattctggagatcggactgggaacaagcagacgcgctcgtgatcggcgttaccataccatgtttgccagcaacctatagtgaatgcgctactggagtcaaagggggcgccaaacgatagcactaatagtgccatgatgtacgaagcacccctgcggtacaacattgaagacgttcgacctgctggaggcgcccagaaattatatgctgcatactcgaact

SEQ ID NO: 49026 - DNA, 337 bp, Triticum aestivum
  Clone ID: PAT_TA_49026
gtaccgcacccgtattcaaatgctgatcaacagcaagctcctacacgtgctgaaattccggtctgaggatgcgcctggatacgatgggaatcctgtctgtagaattctctacagaccaccatatcattgtaaatgggatgcatcaacaaggcacaatttgatgggaaatggggccaacattaatgtatgtgctaatcactgtgttgtgacatgcttatgaaactgatgctatattagcagtgacatgtatatcagaacatagtacattgtaacagcaattgcaagatcttgcataattggtgctggtagcctcgtaatgctaagaaggacttaactg

SEQ ID NO: 49027 - DNA, 296 bp, Triticum aestivum
  Clone ID: PAT_TA_49027
tcgcccaggcgtaccgcacccgtattgcagtgctgatcaaagcaagcgcctacgcgagctgaacttctggtctgaagatgctcctggatacgatgggactcctgtctgacgaatgctctacaggccaccatatcattgtaaatgggatgatcatcagcgacgatctgatgggaaatggggccaacatgaacgtatgtggtaatccgtgtgttgtgacatgcatatgtaacggctaatatctttgcacttacatttatatcagaacattgacattgtaacccggaatgcaagatctg

SEQ ID NO: 49028 - DNA, 176 bp, Triticum aestivum
  Clone ID: PAT_TA_49028
aattcaaaccttgactcacgcgaccgcagcaatctactcaaaccgtgactgccgcgacgtctgcaactgactcgctctgttaccaccgcgcctttatcggctatcaaccgtatagcccacagtgcctttagtggctatcaacagaatagtgaatactgacaatgatagcacgtgtc

SEQ ID NO: 49029 - DNA, 389 bp, Triticum aestivum
  Clone ID: PAT_TA_49029
aattcttaatccaagcgtactcgggagggacttatgtcaccacaaacagagactaaagcaggtgctggatttaaagctggcgttaacgattataaatggacttactacacccgagagtatgaaactaaggatgctgatctcttggcagcattccgagtaagtcctcacgcctggggttccgcccgaagaagcaggggctgcagtagctgccgaatcttgtactggtacatggacaactgtttggactgatggacttaccagccttgatcgttacaaaggacgatgctatcacatcgagcgctgggctggggaaagacagccaatggatctgtgatggagcttatccattacacctatttgaagagggttgcagcactaacatgtgtact

SEQ ID NO: 49030 - DNA, 271 bp, Triticum aestivum
  Clone ID: PAT_TA_49030
cccacgcgtccgaaatcgtctaatattacaataaaaaaaaaaaaaaaaaaaaaaaaaaaaaagaaaaggggaaaaaaaagaaaagaaagaaaaaaaaacagagaaataatgtgaaaaaagggaaagcagagctggagggggagagcggcaatttctgatatcgctatcggcgcaagcagttgcgcttggaatggatgctaccatacaatatcccccaggaagctgtagagaatatgctaatggactaaaaggggggcgaaaagaacagcag

SEQ ID NO: 49031 - DNA, 453 bp, Triticum aestivum
  Clone ID: PAT_TA_49031
tccgccagccgtaccgcatcgggagaatcagacatgacatacgcgatcggacggggcttgagttaccacaaccagaggggcagggaggggctgatgttaccgcaaacataaactatagtatatggtgtatctacagctgggggtatagaagttacactgctgatctatacccgacattccgagactaacgctactgtgagcttgccaccattcaaggactggctgcagactcgggctgcgcctgaactagcacgtggtgcagtgtctgaagtgtgttatactgcaccatggacccctgcaagggccgatgctcttacatctagccatgtggttcaagggaccacgccatgacattgggctggtggctatcgatgacagccaatggatgtggggtgggagacaggcatgaccgctctgatccgagaggaaagatactgtgatgtaatctttcat

SEQ ID NO: 49032 - DNA, 357 bp, Triticum aestivum
  Clone ID: PAT_TA_49032
tcgccctggcgtaccggatcgggataatcgtgtacgacccaagcgttcgggtgttgcttgtgttatcacatccagagacatagggaggggctgatgttaccgctgacagtaactattgtaagtggagtatctacagctgagggtatagatcttaagatgctgttctacacccaacattatgaaactaacgatactgttgtgttgccaccattgaaagtaaggcttcagtctgtggctactcttgtactagcacgtgctcaactggctggactgttttatattcgcacatggacacctgcaaaggccgatggtcttacctggagcgttcgtttcaaaggacacatgctatgaatctgg

SEQ ID NO: 49033 - DNA, 429 bp, Triticum aestivum
  Clone ID: PAT_TA_49033
ggtcgcccaggcgtaccgctcgcggtagtgcggattcgtactacacgagcgatcgggaggggcttgtgtcaccacaaacagaaactaaggcaggggctgaatttaacgctgacggaaactattgtaagtggagtaactacagctgagggtatgaaacttaagatgctgatctacacccaacattatgagtctgtcgttactgctgtgttgcgaccatagaaactagggctgcagtctgtggctaatcttgtactggcacatgctcaactggctggactgattgactcaccaacatggaccgctgcaaaggccgatgctctcacatggagcgttgcggctcgaagaacacagctatgacatctggcttgatgttatgcatgacacctattggaagagggatgcagctctaacatgtgaactatcattgga

SEQ ID NO: 49034 - DNA, 279 bp, Triticum aestivum
  Clone ID: PAT_TA_49034
cgcccaggcgtaccgcagctagaatccagggtcgacctactgcgttcgagtagctagcagccatggcttcgctgtcatgggtagcaccgtcatgcccttcattaggatgcaagggtgccactcccttgcccagaaggaggatagcgccgcgcgcctccctgggcacaaaggcatgctgctccgcggttcccctatggcccaggacgatcttcttggccccaacggcgatgggccaggacgtgctcctaaccaacaacgggggaaggccggcgagaccat

SEQ ID NO: 49035 - DNA, 382 bp, Triticum aestivum
  Clone ID: PAT_TA_49035
gacccgagcgtccgggagagccacattcacgctgtgtcatatgtgtctggctgtgtcaccttatgtattctcacgatacggtagggaggctgtcgccgtttcttatgagtgagcacataagaagcgagggccagaaagataagcaggggaccatcaactggtcaagatgacagttggcttacagataggagtgatcggagatgtcacgctctccactgcatgttgagatgccattgttatctgtaacaaaggtatcatcagcacacttggttatccatttgatacaacatttacaagctggcatcttatgatgacctactgcacactcacatgtggcacaacacggacatctactggagcctacaggaagcgatggacatac

SEQ ID NO: 49036 - DNA, 375 bp, Triticum aestivum
  Clone ID: PAT_TA_49036
cgactcactacaggataagctgtcgaccacgcgtacgcgcacctttattctccgcgggggcgcacgagggatctgccttcgtcctgagaagacgagcagatgatgtctaggaaggccctgaactaccaagagctcaacgagaacgtaaagaatgtgctacacgccgtgcacggagagctctacctacgcgccttccacctccagaaggagggtatgacgatcatcttcaccaatgtagacaaccggcacgcccttcatcagaacccactcaccttaccccgacacgttgtggcactatgccatgatctatttctgctagatgatcccaatgtgggactcatctttcctgctgattgcatcgaaagggccaatcac

SEQ ID NO: 49037 - DNA, 358 bp, Triticum aestivum
  Clone ID: PAT_TA_49037
gatcatgcgtgtgtgactaattccacctacgtattcaggccctggagagacagctcccactaacttatctgaagctacgatctacagccggcagatacgagcataagaacatgacctgctgccaataccacgaggcttacatgactgtgatgttgaaaatgtaccgcgttgggctgcatcttgaggtgccgtttatataggcatctgctctataatcagcacacttgggtactcatacgcttgaccatatccaagcacgaagcttacacatacctactgcatcctccatgtggcgcctatggatctggtactgcagctatccattacagctaatcgtacagggttgtcgctcaaacat

SEQ ID NO: 49038 - DNA, 317 bp, Triticum aestivum
  Clone ID: PAT_TA_49038
ccacacttcccgaagagccacatgacactgtgttatatgtctctgacactatcaccgtacgttttctgggtatgatgtggaacgcgggcctgccctttaggcgacaatccaggagcggcgcagcatagcagcgagagcaaccatcaaatgatcaagagcatgcaagggtgacacgatatgagggcatcaagaatgtcgagaccttggatgagtggtcagccgtattcacagaggccatcctgaagctggtcagctacttgagccgcctccaaggaggacagcattgactagagtgcagtatggtggtgttctactgc

SEQ ID NO: 49039 - DNA, 343 bp, Triticum aestivum
  Clone ID: PAT_TA_49039
attctcggatcgacccaaactttcgtcctacttattgaacgacaccctacccgtgggctgctaaatatggggaaggctccacaccccttaacgacaatgtttagaatgcgtctataacgatactcgacttagatctttatcgagacttacttaagatcttacaaggagggtataaggataatcttcagaaacgtataatgaccgcacgcgctaaatcttaagccacttatgttaccctgacacgtggtggcactatgccatgatatatctctgatagatgatggtaatgtgtcattcatattttctgactattgcatgggttggaccattcacttgctcttaa

SEQ ID NO: 49040 - DNA, 404 bp, Triticum aestivum
  Clone ID: PAT_TA_49040
ccagcctagccgtaccagctccctaattaccgattgcgactccacacttgctagctaactagtgagcgacgccctaccgtgtggctcctaactatcgggaaggcaccacaccctgtgacagccgtctgtaggaacgtaaaaacaatactcacctgcctggtctcgagacctactaacatgatacacttactggttcacgagaatacctttgctcttatcctgacattctaagcgaaatacttgcacactctagctacaatgctacactagctgactgctatgccgaacacctaggcggctgcatgtgctgctatctggacaaacataaacagatgcatgtgctgacccctttacctgtatgtaacaagtgctactacttagctccatactgtgtgtaacaagta

SEQ ID NO: 49041 - DNA, 412 bp, Triticum aestivum
  Clone ID: PAT_TA_49041
tacgactcgctatagggtaagcgtgtcgacccaggcgtacgcgcacgcgtacgataccttcgactcacgtttctgcttacgtttccgatagcaccaccgccgcgacggcgatccctttccagccgcacgacgaagcgacccgctacgccccgaccgcgtccggctagggctagggtttccgcctcctctgcgtacccctaggctgatgcacgcggcgcgctcgtccacgccgtagcctggtggattcctcccgcccttttaagctgaaaatcggcggttttccgctcggttcttgagcacaaatcggccattgatttgctctggttatgcgccggtttcccctgatgtctcggggcgcgagcgggggccttccgaggcgattggtgctctgcagcagtctcttgcccgacgc

SEQ ID NO: 49042 - DNA, 358 bp, Triticum aestivum
  Clone ID: PAT_TA_49042
tcgccctggcgtaccgcacccgtattgcgggaatgatcaatgcatgcgttctcgcgtgggacttaaattattacatacagaaactaaggcaggggctgattttaacgctgacagtaactattgtaagtggtcttactacagctgagggtatggaacttaagatgcttttctacagccaacattatgaagctgatgctactgttgtgttgcgaccataagaaagtagggcttgcagctgtggctacatcttgtactagcacatgctcaactggctggactgatttactctccaacatgtgacacgtgcaaaggcacgatgctcttacatggagcgctgggctcgaaggacacatgctat

SEQ ID NO: 49043 - DNA, 328 bp, Triticum aestivum
  Clone ID: PAT_TA_49043
acagacatgacctacgcctgcggtccacgtgggatcaaacatgggcttgcggaggcgcccgaggggaatccaatagttgatggttgtagggctggtaactcagcaaggcttaaacgctgctaggactgctataacagagaggtttatgcatgccaaacacaaaggtgggagagaaatcactggatgctgactgcaaccggaggctactttgcagcagacgctaactgcgaccagcgggaaatatggggcaaacttgaaccgctttggccacgagacaaccacatagattgagcagtgaatgcaatgctcatgaaacatgtctccactg

SEQ ID NO: 49044 - DNA, 380 bp, Triticum aestivum
  Clone ID: PAT_TA_49044
tacgactcactatggggtaagcggtcgcccaggcgtacgcgcacccgtacgcccacgcgtacgcacacgcgtgcgcacacgcgtgcgctaacaaccggatacgtatgggtgctggtgttggatcacaacacaaatctgataagcgtgctgctaggatgaataaagaaagataggaattttgcgcttaggggtcttaactgatgaaagggatattgtggacagggcgcactcacgagatagcggcgcatgcaaaatatctacgcaacccagatactgggcgcatacacatattggaggaccaaaagcatgggatggtgactcatgagacggaacactaattaaaaatatgacggtgatgtgacaaatcacggattaaaaat

SEQ ID NO: 49045 - DNA, 171 bp, Triticum aestivum
  Clone ID: PAT_TA_49045
gcggactccgtcccgacgacctcgcggttccactcacctttctgctaacgcgcttaacgcacaagtggcggggggggtattcctttcggggcgcacaactaattatctatatggtccctaccgtcgcctttttagtcactggcgctgaccttttcccgatcgcgatcgatc

SEQ ID NO: 49046 - DNA, 171 bp, Triticum aestivum
  Clone ID: PAT_TA_49046
agtacgcctggatataagcgccacgggcgcacggagtttcacagcaaggaggcgctacctgtcaaagacgatgtaccgcaggacttcttcggctttcatagggaacctgacgccttcgttttttcatttattggggcccgccactgtactagtattagcatgcatggatgg

SEQ ID NO: 49047 - DNA, 269 bp, Triticum aestivum
  Clone ID: PAT_TA_49047
cgctaacacgactcgctacggggtaagcgggtcggcccacgcgtacgcgaaaaatgttcatccatgggacagacacatacgcatataccacaccaaccaaacgccacccgatctgcatagaaaaacgtactcacatggaagcagagatgctactggctcgcgcctccccgggcttcctgccctctacctgctcgcgtaccccatcgctgcatacgctaccgccgttcgcgtacttcaggaggagccacggtaccggcggcagcctaacc

SEQ ID NO: 49048 - DNA, 248 bp, Triticum aestivum
  Clone ID: PAT_TA_49048
tcgcccagccgtaccgcatcggaactattgtggagaatcatgcttctgaaccttgtaaccatgatcgaagattctgatgctataacatgtgtttaggatcttacattgacatccgacgatatatatgtgggtatgaaaaggaactatgacctatctatagtgtggcattgaaacacagataaatctgtggcttatgtggcttgtgtactaagtgtgacatttggctgatgctgtttgtttaataaatg

SEQ ID NO: 49049 - DNA, 416 bp, Triticum aestivum
  Clone ID: PAT_TA_49049
gtgtccacctaggcgtacgggcccgcaatttccgatctgaccgacacatctgatccaatcgaagtgaaacctaggctatatagctcctctgatcaaaacgcagatattggtgtataccctcactggtaagaacataaatcttggggacgactcttacggcaccatccacaaccctaggggtaaaatccaccaccacgatggcctacgtccgggctaacatcgctggatcggcggtgataagcacctagcagctgggctggcccttccatactacaacattcaagggtagtcgaaccttgacctagtgctcaagctagaaggaggcctgcatatatttgggaatacagttaccgggaagaacataaatctggatgatgagtcttaccacaccgtccataacgctgggggtagaatcc

SEQ ID NO: 49050 - DNA, 456 bp, Triticum aestivum
  Clone ID: PAT_TA_49050
acgcaccttctatcctccaacaccatggaccccactgtgatggctttcttggacacctacgtcgcaccctgccagggtctcaaggcgaccgtcggcctgaccatcagccggcgttacagcagcgccggccttagcagcgtcagcaacggcggaaggatcaggtgcatgcaggtgtggccgattgagggcatcaagaagctcgcgaccctgtcttacctgccacctctatacacggaggcccttctgaagcatgtcgactacttgatccgatgcaagtgggtgccctgcctcgagctcaacacggttggattcgtcttccgggagcacaataactaccgcggatactatgacggtcgatactggacaatgtggaagctgcctatgttcgggtgcaccgacaccacacaagtgctcaacgaggtggaggaggtcaagaaggagtaccctgacgcctat

SEQ ID NO: 49051 - DNA, 323 bp, Triticum aestivum
  Clone ID: PAT_TA_49051
cggacgcgtgggcatgtctgctatatcttagtacatatccagagggctacctattcttgaaagaagatttggtgaagcaatgggtagccgagggttttatatgtgcgaacgaaggtgaagacatggaggaagttgccaagagatattttgatgagctcgtcagcatgggactgattcaacttatggacatcaactgcaattatgagttgttttcttattcagtacaccagctggtacttgatctcattacatacaagtccattgaagagaatttcatcactgtggtggattattcacaaacaacaataccacttaatgataaa

SEQ ID NO: 49052 - DNA, 251 bp, Triticum aestivum
  Clone ID: PAT_TA_49052
accactcgtacaaatatgaagtgcgggcgaaaatcataattggccataggactaagagaatggcacagacgcgccctgacgatcatactggagaagggctcccaggaccatttgatgcatttgcggcggataatatcacgtatcttcatgagcattcgggcgttattggacacatctctgcatcaagcacactatgaaatgaaatgatgcctacaccacagacatattgccatggagattgctgggcaaag

SEQ ID NO: 49053 - DNA, 391 bp, Triticum aestivum
  Clone ID: PAT_TA_49053
gccccgacgtacggtgccgaaacttccggagcgagccacgcctcccatgaccttcgtgccaccagccaagccctcacgctggtcccctcatgccgatgcatctcaaaccccgggcgttccttccctcagcccgcatcagcagcagcgccgtccgtgatagaggagcatcgtccgcccaccacccgccgttgaggagcagctgcgccgtccgttgctgaggagccgcccgccgttcttcttcctccaccggcgacacgtgtacctccagatctcaacaggagattaatcaaaggggaaaaggaacatttgaccaccagctagcataaggatttcattttcagtggtttgaggtttaaggcgcatggcatgttggcaccattcacagctggat

SEQ ID NO: 49054 - DNA, 478 bp, Triticum aestivum
  Clone ID: PAT_TA_49054
aggcgtacgcacatacacatacacacacacacacactgatggcgctatatgctcatgcccatgcctacacaggctgcccggtgtgctactgccagaaccttgagacgcttgaaagggactcagaccatggaggttattcaccatgcataggagaactatcaattcttgcatctgctaaacctatggaatactcggggcgttcttcatagctcgattgtgcgaatcggtatgatacaatgggagcattatggacgattgtcgagaggatgagcaacacggcactacgaagtgaagactctgggagccgtctaaatagttcgacgacgtacacgacgtagactgggatagcacgttattactacgacaacttacactgtgcaacctcgttgatctgcccgaactttaccacctctacaggcaagtgattaacgaatctgtgtcacaagtctacatgaacgctgactggatccacaagtta

SEQ ID NO: 49055 - DNA, 359 bp, Triticum aestivum
  Clone ID: PAT_TA_49055
cccacgcgtccgcgcagtgagcagaaagaaagaaagagatgaggtctcccgtgcccgccatgctcaccggcccatcagcagcggcggccggcgacaagccgctccccgtggctcgctgcaacacgacggcggcggctctccacgcgacggtagacagcaacaggcgggacgtgatcgccgacacgggcgtggaagcggcgctgctgctgcccctgtggccgcatcgcacgcgtgctgcttctgacgacgagtacctggcggacacgaccgaggtgatcggaaaagtgcgggcgacgatcaacatggacaagacggaccccacggtggcggacgcggtgacagagctccgggagatgtgc

SEQ ID NO: 49056 - DNA, 247 bp, Triticum aestivum
  Clone ID: PAT_TA_49056
acgcgtacgcgcacccgtacgcccacgcgtaccaacgcgcgatacaatgcagagaagatcacgatcgatcgagctgtccaatccatgctctatgaaagcagctggatgctcctaatgaacactatgtgcaagcaggtcaatactcctcaaggacgcatcaacggaggcaaccaggatttgacactgagctgtaatgcttgttaacatgctgacgactctgagctcaactacttgttctgctcccgac

SEQ ID NO: 49057 - DNA, 380 bp, Triticum aestivum
  Clone ID: PAT_TA_49057
gcgtggccataatttccggagcgacacatgcgtaggttggcaatgcggtggctggtgtacatacgatagctcgaagctgccgcggctatttcagccacaccaactggaacgtggactgagcatgtcatccacacgttaagcacaggataatcagccaatggtcaaggtgtcatggacaatgtgaaatgaaaatagccaagatggcattgttgatgctgaccggatgaaaacaagatgaatttattgaagtgcatcgattgaaaacatgaggacaccactgaggtgactcgattgaagtaacacgttgacaacagtgatgactcgaatgaagtaccatgtacaaaacatcctgaagatgaatgggataaaatggacaaaaa

SEQ ID NO: 49058 - DNA, 342 bp, Triticum aestivum
  Clone ID: PAT_TA_49058
tcgcggacacgtgggcggccacgcatacgcttagttcacgcaactggctgctcataccaaaacccaagctgaaactcatggtcacgcataacataatgctgcgcgcaattcaagctatcggatcacattgaagggtgctaaaatttgtttgcttgctacacattaccggtgctaaacctgatattctccctgttgaattcccgagcttgatgttaatatcacctgcttaaatagaagtgagaggatttgagagcagcactgttgtggacattgtgtattgcaaacggaagaatgcttgtggattatagctctggaacaccactcatcacacagtgtatgatg

SEQ ID NO: 49059 - DNA, 372 bp, Triticum aestivum
  Clone ID: PAT_TA_49059
acgcgagagacactcactttggttgctgcgccgaacgccgccggtcgccttgtgtggaccaggccccacgcctccggctgccttctctcgagcaggactcatcctttcccgacaagacgtattatgaccacctcagccttaccgcaccacctataccaacaccaccatagcctcacccggtcttatatccacaccacggtctcgcctcgacgtcttttatccacaccacggtcttgtcgcggcaaatcctgtgaatatcgcgtacttggattgtcgccaacccagtatattgttgctagatcgactgtgacgccagcatcatactgccgtacagcagatcgcgatgcgagatgctcgacacaacacggcagc

SEQ ID NO: 49060 - DNA, 280 bp, Triticum aestivum
  Clone ID: PAT_TA_49060
aacatttcttggtccaaaccagcaggggatgtgaaaaatggggggcgccgaatattccgtgcaccctactaacctattcctagctatttgctgaactctaagacaaccatactataataagctgcaatacacttatacacctttgatattatatgcagacattgacttatgcagcttcaagaataccttgatgtatttgaacataatatgctcagaatgggacttattgtctgaatcgtattccctagcacctgtatttaatgacaacattaccttctat

SEQ ID NO: 49061 - DNA, 340 bp, Triticum aestivum
  Clone ID: PAT_TA_49061
gcgcccacgcgtccatggggctagaagataacatgaccacgttttagcatgttgctctgcttgtagatcactaaccatgcagccgtacaggcatctgcttgttgggctatgaccatggctcgacagcatccgcgcagcggctagccggacccatagtgtaaggaccgggagcgtgcacaagggcaataaaggctgaggagcgtgacagcggccatagcccttaaggcggaggcgcccgaaagtagcacaagacgattgagatggggctgccctagctgggaccgccggatggagattgctgtcctatacaagcaaacgccttgtaaccagggctacagtt

SEQ ID NO: 49062 - DNA, 300 bp, Triticum aestivum
  Clone ID: PAT_TA_49062
cgcacgcatgctcggcaaaatgcgaagatagcgactaccgcacgctagggcatcggcgaagctcgtgattcctacgtgcgatgggcggcggcgggcccgggctttccacttttctacagccgctgtcgaccgacgctttccctttctgcataccgtgtatccagcgacgccggccgtgtccgtctcgtctgtatcatgtgcggacaagacgaccggtgtcgctggtgtaagctgcgaagaagacgaagggggcatgtgtggcagagcgatacggccaagatggaggggatgcctaccgag

SEQ ID NO: 49063 - DNA, 360 bp, Triticum aestivum
  Clone ID: PAT_TA_49063
acgagcgatctggtgttgcgagaattattaattcaagagtcatagggaggggctgatgtcaccacaaacagaaactaatgtaggtggtggatctaaagctggtggtatagattataaattgccttactacaccccacattatgaaactaacgatactgatatgttgccaccattcaaagtaagtcttcagcctgtggttactctcgtactagcacgtgctcaactagctgcactattttatactgctacatggacaactgcaaagactgatggtcttacatctctcgatcggttcaaaagacacatgctatgacatctggcctgatgttgtggatgacacccaatggatcagggtgcagc

SEQ ID NO: 49064 - DNA, 392 bp, Triticum aestivum
  Clone ID: PAT_TA_49064
accaactaactgaacttcaaaccaactggggctgtgcataatggtggccgagaaacagactgtgcttatgaatcaaggtctcggagcactaagctatgctcgttactcacgctattagaacgctgagcaaaacacgattaaacctatgataaaacaggcaatcattgactgatgcagatacaccaacacctcgttgccctggaagatggtgatcgcgcacttgggctgattgtctggatcgaatgcgctagcactgtgatctactgacaacatggacatccatgggcgctggctctatttacaacacccaccactgaaagcgtgtgtgctcctgaacaacatgcctgataatgacttcaacacaacggtgaagagcctggtcacactatgat

SEQ ID NO: 49065 - DNA, 362 bp, Triticum aestivum
  Clone ID: PAT_TA_49065
gcgattaattcaagagtcatagggaggggctgatgttaccgcagacagaaactaatgtaggtggtgtatttaaagctggtgttaaagattataaattgacttactacaccccagattatgaaactaaggatactgatatcttggcagcattccaagtaagtcttgcagctgtggttacacccgtacaagcacgtgctgcagtagctgcccaattttatactggaacatggacaactgcaaagactgatggtcttacctgtctcgatcgtgtacaaaggacaatgctatgacatctggcctgttgctatggaatacagccaatggatctggtatgtcgctcatacatttgacctattttaaga

SEQ ID NO: 49066 - DNA, 322 bp, Triticum aestivum
  Clone ID: PAT_TA_49066
tctactacacacaatctcactataggctatgcgggccgcctaccgtaccggacccgcctggccggcccgccccacccatccggccacacatgcggacggttgggggggacgaacccgctggcgacgtgatacttgaagagcactggttggatcacctccatgacgttaccgggccactgcttaccgaggtgacctgcacgcgatcgcattcgggctgatcacgtggctgactccgcagagcatccctctgatcaactgcaacaggttctcggcgcttttcttttacagcatcggtctacgagctcacccacttctcctgacc

SEQ ID NO: 49067 - DNA, 306 bp, Triticum aestivum
  unsure (1)..(306): unsure at all n locations
  Clone ID: PAT_TA_49067
ccatgcttgcatcaacgcgtcctacacccaacgctggtgatgatatcagaggttcattacttgaaggcttgccaaaatggcttgtggtatattcccgttgattgtactgaacgcagatagcttgttcaccggatcttattgcgttcattgtccacgcatgaaagtgctctcactgactctaatatacaccatcctgattgccgagcttatttgcatcgcttcccatcctncaatcgaccttccattgctattcgataaggcatgcaatggaagctttctcttatgatcaagtgtgatgtgctcgcc

SEQ ID NO: 49068 - DNA, 295 bp, Triticum aestivum
  Clone ID: PAT_TA_49068
cgtaccggaactgcatgatcgatcaatgcgttgggtcagacacacaccaaggaacataacggcgtggggtgaactaagaggcaagggaaacaatggcaacgtggaaggtgtgcgggtctgccatgtggacgaacgtgacccggacgatgttgtgcatgtaggtggtaagggcatagtacaaagtagtcgacatcattttctaggacatggtgtacaacaaccccctgcatttcaggataaacatgtgctgatatatgagtgacttgcaggatggagatctgtttttcttaaagtc

SEQ ID NO: 49069 - DNA, 405 bp, Triticum aestivum
  Clone ID: PAT_TA_49069
tttcagggacgacccaagcctcctccactaccccatagatcagatagggggggccaatatcaagaggggatggccgaccaccgacagacatcatcaaaacagcatgcgcaaacacacaccccatctttaccaacaacaagctcaccgtcacccacttcgggacccacaaggtctgccgataaactcaatgagctacggaacaaggtgatcaaaaaagctcaaggagccatgctccaaggaaatcaagaacggccgcatggccaagccacccgaaacggacgcatggatacaggccgaggacaccggcaccgaccccatcaacaacctattttctcaccttgtcgacccaagccacgcaaacatttggcggtcctaagccaacacggaaggaacacagcggggagg

SEQ ID NO: 49070 - DNA, 372 bp, Triticum aestivum
  Clone ID: PAT_TA_49070
cactacatcggtttatccacactcatgggattacccatagcttgctagctagcagcttaaggaactagcttgcatctaccgatcgatggctcgcttcaacagcaaggcttgatggccgccgcggtcctgccctcggtggtgctgatgatggccggctgggctgcctcctcggccctgtcgtgcggtccggtgcactccaagctcgctccgtgcgtaacgtacgctactgcgagggcctcctccttcaccaaggagtgctgatccggtgtgcacggactatacggcatgggccccatcagatcctaccgaacgatatcatgcacgtgcataaagagcctggccaccagcatcaagtccattaacatgggcaag

SEQ ID NO: 49071 - DNA, 393 bp, Triticum aestivum
  Clone ID: PAT_TA_49071
acgtttagcgcggtgcaccgtcgacacggaggctacatgcacgtgcctgaagagtgcctcctgaagccacctgaaccaatccgtctggtgactgctgcaaccgcgtcacgaaattgctcgatttagcgcgctgcacagtctacacgcaagcttcatgcacatccctgacgagtgttttcggtggactcaaccccaacaaggccgctagaattccatccaattgctggactagtgtaccatacactaacagatcattcgtggactgctttaacatccattgatcgattgatggacgctatcatcgtcgattatagatacacacatatatgcttattcctgtatggatgcacacacacatatttacatatacatgaatgaatgctctcatatgat

SEQ ID NO: 49072 - DNA, 190 bp, Triticum aestivum
  Clone ID: PAT_TA_49072
acgacgtattgagctacaaagccctacgtagctatacaaaagcaggatctaccaattctcactacttatacaaaaactgagcaaggcccgactcatgggatccaacttgaaagagataagctatacaaccatggtcgggctttatcgggaagaactatgaaaccacaagtgataagattctacaaaaatt

SEQ ID NO: 49073 - DNA, 344 bp, Triticum aestivum
  Clone ID: PAT_TA_49073
acataatgcaccacccttgcccctgctgtgatggatatattacataccgatggcccaccctgcgatgggttcatgggctcacaccgtctcacccttggacgggcttaagtccacagccggactaccgttcggactggggtacagatcaagcccatgcagggttagccatgggggggggttaagaagcatgcgaccgtggccaacctgggacatctatacactgaggaccttgtgtcacatggcgggtgcatgaaccgatgaaagtgtgtgccatgtctactacctagaacggttaaattgggctccctggctcacatcaactaacgcgggttctacgtctggcg

SEQ ID NO: 49074 - DNA, 239 bp, Triticum aestivum
  Clone ID: PAT_TA_49074
cggcggggcgtaccgacccagaataccagactagacctacgcgtacatgacgaagacctggggtccatcgctgggcgggcaaccacaatacatacgatggttctgatacaggcagatcactttctacaagatgtggctaacacgtgcaaacgggtcactgagcaagcttaccaacatgtacaaccggagcacatcgaaaggatccgtgaggctcagcatgaaaagatcgtcagtgaagt

SEQ ID NO: 49075 - DNA, 114 bp, Triticum aestivum
  Clone ID: PAT_TA_49075
atgcgccccacccattcgtataatctcacagaatatgcacagacgccgggtttttgctgggggcaaataaagatgaactgcgctggctctttcagggctccaaacttacaaacg

SEQ ID NO: 49076 - DNA, 353 bp, Triticum aestivum
  Clone ID: PAT_TA_49076
tgctgcgcaaggagaggaatactggggggtgcactaccgggccgctcggcaaatacggcgtttttcacgaaatggtctgactaaaaccatggttatcttgactaatggctatgaacaattgctgcatcaccatgaaattccccaacactccacccatgcccgggttaggagtgctttcctgccctgaagatgggcaagacaggaatgctagcctgacctgttcaaggcccaacgcagtttcagcgactgatcagtccacaccagagcccgcgatacctcaccatacgaaacacacacatgattctgatgctccttactatgtggcactcccaaaatttgaagactgctttcta

SEQ ID NO: 49077 - DNA, 337 bp, Triticum aestivum
  Clone ID: PAT_TA_49077
acactactatagggaagcggggggccagccgtaccggcacggtattaccgggctgacctatgcgttctgccaagcatctcaaaggcctacacgcgcccctatccctttataccgccgcccgtgccctggtcatgatccgttggcaccgatgcgttgcgactgctcatcatgaagacggccgccatgtcgggcgaccgccaccagtaacagcgccccgtaaggggaaatacgaatacgctgacgacgtcggtgaaaggataaagcgattccatgcacgctgtcaatagggagatggggacgttctatgccaacgccgacgaggggttagtaaagggcg

SEQ ID NO: 49078 - DNA, 164 bp, Triticum aestivum
  Clone ID: PAT_TA_49078
atgacatgctattgtccggccagtggggcatcttgcggaatgtgaatacaacatgattgactaacgtcatacatgctctggatcgcctgattccctgtaaccttagaggcgcttacaccttggtcaaactcacaatactcataggagcgtcgtgctacgtctgc

SEQ ID NO: 49079 - DNA, 171 bp, Triticum aestivum
  Clone ID: PAT_TA_49079
actatagggaaagcgggggggcctacacgtaccgataaccaaattccaggatcgtcccacacatgcgtagaaacacatagcacaaacattgggggggatcacaggttggggtggggcgaaaccatggtctatattaccgcactattctagcgagtacgtttaccatgacgg

SEQ ID NO: 49080 - DNA, 278 bp, Triticum aestivum
  Clone ID: PAT_TA_49080
aacgtacggactgtaatggatctgcctggcacagggatggcaccacattaagaatgcgcgaggatagatgttactacgtgatcaataacgcatacctgaatcttgcacttgaacatgacttgcacatacacggatatagggaacgaaacgaatagaagatgactgatctacatgagacaactagcatatgacaattctcatggggcgagaagaaccgtggatggtctattcatgcggggcgagaaaccgacgcaaagggcaacatgtacccggaagac

SEQ ID NO: 49081 - DNA, 174 bp, Triticum aestivum
  Clone ID: PAT_TA_49081
acgagcacacgtgggctggcatagtggaggggggactagcaaacggtggattgcaaaattaacatctgacatgactttgaaggtgtctatggtgaaccatgtatcttacttgccaaatgcctatccttatgggactttgtacgatgaaagtatcgatgcatgatttgacttttc

SEQ ID NO: 49082 - DNA, 324 bp, Triticum aestivum
  Clone ID: PAT_TA_49082
tcgtgagatgaaatgaccgacatatgggtgggggctttgagcggaaatagaggtctcatgattgtagcccttgaaccaattgctcaggtatcactgatattttggcttacctgcttctaggctaatgctataatagcagtttggtgaaaaccgatgcttatggaatgagacatatcgtgtgctaatatgtgtgatgtgcgagatgtatcacttgatgcatggcttgcggtctcaaactgacttcagagatgcttgaccatgctcactcaaacattacatggcccactgtcaatgctatgttggtcctatactggcccactattt

SEQ ID NO: 49083 - DNA, 392 bp, Triticum aestivum
  Clone ID: PAT_TA_49083
agccgatgtcctactgtcacatgcgcgcgctcaagtgctagctggctcatcaatcactcagccatggcaggagagaagcaccagcctcacctgttgcacctcacgaaggagggcgaggacttccatcctgcccctgaccggggcgtacacatgtacgggtactcgaccaatacgggcgtgaccgccaccgggaacaagggcaaatacacacggatcacctaggagggaaagcaccacacgcacacggagcatttgggctatatgggcaccaccaggggcagaaccttccgcctctaccacacgcacgcagcaaagaaggacccgtggcccgcgcacaagcccaagatcgaggaggatgtggccgccaccagaaccatcagaacaagcaggtt

SEQ ID NO: 49084 - DNA, 232 bp, Triticum aestivum
  Clone ID: PAT_TA_49084
gcgggatagcatcttgcaccaggcaacaagggagggcgttgatcatggcgcgacatggcacatgcaagatccctgtgatcggggcaacgcgctacatgggcacgcacctctgcccctccagcgcgacgctcggccatcccaccctggcactgggcaggtactcaagaccttccaacactggcacggcgcacttgttaaagaccttctatgactccaccgtaacgctgctaac

SEQ ID NO: 49085 - DNA, 322 bp, Triticum aestivum
  Clone ID: PAT_TA_49085
aaattaaacccacgcgcgcgatcgttacccgctcaaatgaactccagggggggacctactaacgcgtccacgttgttccacggaacgacctactcaagctcccaacacggcgaacagaccagtgcctgctgcctccctagaatgtcaggtggagagagcatactacccccctaccatatgcagttgtcccgcacgagaacgccgcgagcagaggcacctctcgcgtcctccgcgggcgcctgctgttcgactgctgcagccctctcgtcgacactgctaattgactgcaacagcttgcttttaaacacacttaaggacgggc

SEQ ID NO: 49086 - DNA, 184 bp, Triticum aestivum
  Clone ID: PAT_TA_49086
cttaaacacacatataggaaactggcgggggggcgtcaccaccccacattcacaagtcaagccatacgttcggagccacacaaacacattgaaggcgctggggtggcacccacaaacagggcttgctgcacttccaaatgcatgctccaacatggcatccgccacctcaacaatcatgctttca

SEQ ID NO: 49087 - DNA, 179 bp, Triticum aestivum
  Clone ID: PAT_TA_49087
tcgaccacgcataccctaataatccaaccgatgggggcgcgcccatagtgggctaacacacccaatgcacacactcacctgaggagctaccaaaggccaaccacacacttaccagagcacctcctaactgacctacgccttggggaaggcgaagctcctcgctgtgctggccctcgtgg

SEQ ID NO: 49088 - DNA, 274 bp, Triticum aestivum
  Clone ID: PAT_TA_49088
acataccatgacccttagacgatcacgtagctgggagtggtattgccatcacaaggtcatcttaatcctcctgatcatccctgcaacatgacatcttcatacgatggatgatatgtagacacatgactccttcgagacgataagcccatccacacacatttttcttcgtctctacatgcacccacgcactcatttttatcaattgctagatacaaccagtgaatgggagtgatcaactaacagatcaatctatttcataccaataccttcacat

SEQ ID NO: 49089 - DNA, 244 bp, Triticum aestivum
  Clone ID: PAT_TA_49089
tcattctgcgtctccactttcctctcaatgtcgagcactctactccgacggcgacgacgcagcttactccccacgactaccatggccaccaagtgactcacgccccaattgtactctgtgctctcagccaccgtcgtaaccatacgcatatccgcctttagactgcttacaaacatgaccgggaacccagaattcatggtcaacatgatgaggacggccgctacagttgctcacgaaccatgag

SEQ ID NO: 49090 - DNA, 294 bp, Triticum aestivum
  Clone ID: PAT_TA_49090
tggccaaccctgaccacacacatgcggcgggctctcggacacgcagacgtctcacataccgccagcccaccgcctctcctccctctggactccatcccgccggaccccgaccaccacataatacgccatgacaaccgagccggacgacaacatcatggcatagaactactcaagacctacggactaagaccatattgcactagtaaaaacatacgggctagggccatactgcacgaggataaaaacggccatgaacgatatcaaagaaatgggcaagatgatgaactaccttta

SEQ ID NO: 49091 - DNA, 174 bp, Triticum aestivum
  Clone ID: PAT_TA_49091
gcgggaacccacgcttcctaccacgggggcgggacgaggacggtggggtggctgacaccgtcgacgaacttgaacatggatggagtagacacataccccgtattcgcctgcccctcgagtatctgctgaaccatcataaggattcagtatgcctatgttatggatgtactcaag

SEQ ID NO: 49092 - DNA, 266 bp, Triticum aestivum
  Clone ID: PAT_TA_49092
attacggaatctgctgggtctggctccactgctcccggattatggcgccgctgttctcggaagatgctggtgctctcactcgccgcgatgtccgtagacgccgtatctctcacccaccgacacttgcctaacaggtggatcgtgcgggcacgcaccatggactaccacgtggaatgggcggctgctgaacttagaagggatcttatgatgtcaggcacattgactctttaagggtatattaccgtcacgactaccaagaatatggg

SEQ ID NO: 49093 - DNA, 306 bp, Triticum aestivum
  Clone ID: PAT_TA_49093
tgaaacccaagcgtccaccaccccatgcgtgacggtacataggaggcagcccaccacccgtcgggaagcgaacttccttacccactggcacgggactttgggcggaccagcttacccaatggcactggcccttggcggctcaagcacccctaacatgggtccttgcattctgacttagcaggcgtcacatactatcttggatactgacttataggccttcaagcataataccccacaccgaagaccaaatccactaactaatcaaccactcgcgattaccaataatgtctatcaacacactctctt

SEQ ID NO: 49094 - DNA, 377 bp, Triticum aestivum
  Clone ID: PAT_TA_49094
acgaagacgcgtgggcgacacttacagcgggggcaagaaaatgctggaggggcatacacagcatacgaagcggatagatggaagggagcagcatacggacgccggagataaccatcgtgccggcgcctaggccggcaacggccggaggaaggggcccattagacgcggctaacgtggcgagcacggaaccgatcaccccgggctcgccttcctgggccagcaaggagcgcactggctccgtatggatgccaggttggaaactggactgactgtgcacggagtccatctcggcaaccgccatgatggctcgcttcctctattagtgaagccacgctcgtatatgtcatcctgtgctagtatttcccggctgggatatg

SEQ ID NO: 49095 - DNA, 397 bp, Triticum aestivum
  Clone ID: PAT_TA_49095
gcgtagaggggaacatgcacttacgttgggtgtcaactagacctgcaccatgcatggccgaaccacccgaggagaccgcgagggcgcccccgccgtctccgggagtgcccggcgtgggagccacgcctctatcgacaaagccgccgggtatgaccgtcgcctggacacaaaaggcaggcccggctgggcctggctgggacacgacgacaacgtcccgcacattgaggctggtcgcggaggacacgttcatgcacaaggagctaaggggaagaaaaactgcggatgtactgtcatggaaagacatgaaaacaactgctgatgtgatgggcgggacaactaccatatggcttttatatgaaatgctaggattccactcttaactatgttatcccatggg

SEQ ID NO: 49096 - DNA, 286 bp, Triticum aestivum
  Clone ID: PAT_TA_49096
tcgaaaaaactggtttatcacgcacatccactcgtctcgctaagaggcgagacatgaactttcccaacactcgctaaaaaacaccagctacagcttacggatgggcgccaacatatacgcgccaatcgggagggatgggcgccaacacgcacccgactctcgccagcgccaccgcccagaacgagtaccactctaccggcgacggcgacggaagacgaggaggtgggggccggggagggggctgaaaccctaactccggctgtacgggggaggcactccggcacga

SEQ ID NO: 49097 - DNA, 185 bp, Triticum aestivum
  Clone ID: PAT_TA_49097
ttcttccaatgacgcgttggtacctcttcaaatggtgggggaattccaaggtgcatgctcatgattcgtgctcttgagggtgcactctcttctaccactttattggctgggaccgtaactgtcttagagtataccatatacttgcaccttaaagttgcaagcaaataccacaaacttgtgtattg

SEQ ID NO: 49098 - DNA, 220 bp, Triticum aestivum
  unsure (1)..(220): unsure at all n locations
  Clone ID: PAT_TA_49098
actctaatacaactcactatanaaaaacctgggggcgggaccgtaccgccccgcaattcccataccgacccacgcctcccgctactccaactccgacacactacaggggggggccctcggagaggtggggctcactaccattcaaatccccccaacgcgtcctacttcatcccacgctaggctcgaccgcatcccctacagcatccgacccacgcctaaa

SEQ ID NO: 49099 - DNA, 215 bp, Triticum aestivum
  unsure (1)..(215): unsure at all n locations
  Clone ID: PAT_TA_49099
cttaaaaactcatatagaaaactgtccgcggaccgtacacaaccaaaattccctaatctacccacccgtccccaaataaatacttataaaactaatctgggggggacaaataagcgccttaaacaccaanccatacaatacctggattctgattaaatcgactgaaacactctctctagattatcatagaaccgacgccaaaacctcaaaatcac

SEQ ID NO: 49100 - DNA, 168 bp, Triticum aestivum
  Clone ID: PAT_TA_49100
acgcatgcgctctcgcatggggggggaattctcactggcagagacttacgtaggggcttaatttatcacacacagaaactaatataactggtgtatctacacgctcaggttatgaatgacaaaatgctttaatatgcgccacattatgaaacataaggatactcttat

SEQ ID NO: 49101 - DNA, 290 bp, Triticum aestivum
  unsure (1)..(290): unsure at all n locations
  Clone ID: PAT_TA_49101
caactcactataaggaaaggctgggccccgaaacaaacccttcactnaattctcctaaacaacccatccaataatctttttctaaaccctataaaatggtcgtgaagtaagaaacgtgtgccattctattctaattataagccaatagacacatccattctagactaactatacgcatactgcaaatctctccatcatcagccatatccatgctatccgagctctcgatcctccttctcatccccctagctctatgtctctactccccacatttccttaccagattcata

SEQ ID NO: 49102 - DNA, 335 bp, Triticum aestivum
  Clone ID: PAT_TA_49102
ccctgttattgctaaaattcttaatgggagaatcatagggaggggctgatgtcaccacaaacagaaactaatataagtggtctatctacagctggtggtatagaatataaattgccttactacaccccacattatgaaactaacgatactgatatcttggcaccattccaactaagtcctcagcctctggttacatctgtacaagcacatgctgcactagctgccctatcttatactcgtacatggacaactgcatagactgatggacttacctgtcttcatcgtttcaaaagacacatgctatgacatcgagcctgttgctatggaatacaccc

SEQ ID NO: 49103 - DNA, 349 bp, Triticum aestivum
  Clone ID: PAT_TA_49103
ttcgctttcctcacgacgtcacctgcgggggttcttctgggtgcagaccagctaacataaatggctgacgcacaggacatttaaacgcttgtttgccacaatacaacccgaatggtcaaggctggctttacctgagacgatgctccacgtactgttttgcctagtattggatgccgcacacacgacacttattgttatggtaaggatggaacaaaaagatgcttatgttggtgatgaagcccaattcaacacgggatcctgacttttaagaccccattgagcactgaatcataagcaactggaataacatggacaagatttagcatcacaccatctacaatgatctaca

SEQ ID NO: 49104 - DNA, 297 bp, Triticum aestivum
  Clone ID: PAT_TA_49104
tatcacatgcgtccctgcacacgttcgcaccttgtatgacctgactcactgccaagggggccgctatagaacaactgcaactcgcaccactgccggctatcgacgccggtctaaaccccacacctaccagtagcctccgcctccctaaggttcagaccgagccggagcctggcccggcctgtgttttcgaccacgaccgacccgggcccgatgtctgccctgaagcacgagctaccctcctcgaatgtggcctgagacaccgaaaattttccctgctccaggcgggcaattcgcccc

SEQ ID NO: 49105 - DNA, 306 bp, Triticum aestivum
  Clone ID: PAT_TA_49105
aacactgaattgctgggccgacccacccctccacataactgtgatgataaactggggaagccattcaaatatgaatgctgaacacacactattcacatcgaaatactcttacccagcacttatttttctgaacaaaccaattggctacacgaatactattgctactgacatgaaaaggatgctccagctactcgagtacttgcaagcacagctagttttaactcgcggaggaagaggatgatcagattatgacacacatatgaagaactggatctgatgctttatacacacaaaaaaaaaccttac

SEQ ID NO: 49106 - DNA, 318 bp, Triticum aestivum
  Clone ID: PAT_TA_49106
aacgtgcctgccagcccaacaaatggcccctctcggggggactattgtcatgcgcggcgtgctggtcctgatgatccatgtgaacgcgccggccgcgtgatcaggacataccatgcaaccacagcggccctacatgcgcacaagcgtgcaatgcacatggcccatacttctgaaacactgtttgctacatcaatcccactctgtgctactactgtgtgctaatccaatccgggtcgagcattaccgagcgcacatacatgtgcacagtcaaatgcatgtgatcgaccatgcagggaacgcatcgacatgcatggattc

SEQ ID NO: 49107 - DNA, 363 bp, Triticum aestivum
  Clone ID: PAT_TA_49107
acgatcctcactccagctgaacattggtgggggggccaacaccgggggagctgaccatggtctggaaagagacgacgctggacaccgagccggaactggagagcggccacccgggaacggaggtccccaaggccaaggcgcccacggaggacagcgcgctcatcaccaaggacatgacggaggtcatcactaatgcaaacgaggtggaggacgaggattatgactaggacgacgcggatgaacacagcaaactcggtgtgagcagaagagacgggtggacacaaagacgctccgagtaaaacacccgaacggccatgatgaaactaccattgaaagacgcaaccacattctgcaggatgacca

SEQ ID NO: 49108 - DNA, 202 bp, Triticum aestivum
  Clone ID: PAT_TA_49108
actatagataaagctgggccgccgaggcgtaccgaaacctgaataccctagtcaacacacgcttccgtaaatacgaaaatcgtagctaccacggggtgggctcactacgaccctcggcgtttctaggaactacacgcagtaccaccacaggactgtgttaggacaacatagcttacccggaaaggatagggttaggtttccc

SEQ ID NO: 49109 - DNA, 143 bp, Triticum aestivum
  Clone ID: PAT_TA_49109
atgcgatcaataaaagaaacatagggaggggcggatgttaccactggcggaaactaaaacaagtggacgaactacagctggggatatagatcataaattgactgactacaccccagattatgaaactaacgcttactgatatc

SEQ ID NO: 49110 - DNA, 220 bp, Triticum aestivum
  Clone ID: PAT_TA_49110
cacccgaacaaacggaaccacaccacgcgtccaaccacacgcccagaccgaccccggggaggtaaataagcgacgccaatccccccttctacttcttaaactcccattcacacccgcaccggcacgataccatacgccctataatatcgacaggcggatgctaccgcacgccattcacgttccacctaccctgtggacccccgccgcgccacgatgctcc

SEQ ID NO: 49111 - DNA, 332 bp, Triticum aestivum
  Clone ID: PAT_TA_49111
accgacccatactttcacccgatccagtactcataccgcggcagctgaaactccgagcggatgcgtatcgcactcaaactcaaatgaatggattatgatttcaatcccgattaacctactcaagatcctacaaactgatcccctgtttatgaagcttaatactatgaaatccgtccctgtctcgcactaccattacatattaatgacaaactcttacacaataccattgtatctggaggacaaatacacaaaacgtcctattttcacttaagacctttaaaagaatgcccctgattatccacataacaagcatagtgtggtgagatatataa

SEQ ID NO: 49112 - DNA, 388 bp, Triticum aestivum
  unsure (1)..(388): unsure at all n locations
  Clone ID: PAT_TA_49112
tcgagcgagctcctggggcgcgaggaatattgggggcgagatgcaactgggcggcccaaaaatcatggctgtaaatggagtggcccatctcacagtgacagatgaacttgtaggcgttactgttatctcgaaacggctcatctatgtacactcagtatgttccaccggactataccctgtaacagaaaccgtcttgaaaccaccaggaggagacctcgtaacatactttgtcaggagaatatatagggatgctcagtgcaggccatgntgaggcgattcatgaaggacactacaaggaaggctaagtgggtatgacatggatgaggatgacacgaaaaactcgttttgcagacattgacgaggatggggcgaaaactgctattaccgg

SEQ ID NO: 49113 - DNA, 114 bp, Triticum aestivum
  Clone ID: PAT_TA_49113
attacagattagacccacacgtcctaccacttatcctaagaattacacatagggggggttgaaatttgcgtgcaaaactataaagtccaaaattgatattttaaacaaaaactt

SEQ ID NO: 49114 - DNA, 263 bp, Triticum aestivum
  Clone ID: PAT_TA_49114
ctctatactactcactatagggtaaagctggggggcggggcgtaccgacaccaaattccaggatggacccactcgtaacctacaactcggcggagaaggataggactgggaaattatcgctggggggggacgggttgcacaccgagatcaacggcaacgcggctgttgaccccacataatagtgatggaaccgagtgtcctgatccgacttactagtgatggccaccacggactccatttcactggcttggaccgcgtgaact

SEQ ID NO: 49115 - DNA, 151 bp, Triticum aestivum
  Clone ID: PAT_TA_49115
cacacgcgtccgggctgttctcatcggggggcggtaccgacggcggggggcttttcatcaatctgctggcaagggcccggagtttcttacttcgttctgttagcaaggcgggggagttgagcgcgccatttgtcttgcgcgccgcagctcc

SEQ ID NO: 49116 - DNA, 279 bp, Triticum aestivum
  Clone ID: PAT_TA_49116
acaccgcttctgtggaaagcttgtgctggagcggacacatgggcggtcacgatgacactatggtgttgggcatactgaggttaccataacactatgctgctgggcatactcaacgaagcaaatgtgccttgtctggggaaatcacgacaaatagaatatgtctggactaaactaaaggcaaaccaaacatgatttcttgataaaacttattgccaaccacactggtccctattgagggaggcatgacgagaccactatactgcagacttaagcactgca

SEQ ID NO: 49117 - DNA, 273 bp, Triticum aestivum
  Clone ID: PAT_TA_49117
tagggaaagcggcgggcctacacgtaccacaccctaattcctgcgcccacccacgctttcggcaatgcctgcgctcactcttgggggggttctatgcaccggggggactcgctccaactaatatgcttacgtcccagcttaacttactggtgtcctacagattatccacagggtctttaactgctggatcacaaaacatcgtctcactttttgatcggttcaagaagaaaccctggccgtagtcaaaacccactcgcttggccacctgtactg

SEQ ID NO: 49118 - DNA, 301 bp, Triticum aestivum
  Clone ID: PAT_TA_49118
ccggaacggaatgacgggatcgacccacgcgatcgagcaatgagaggaaggccaagggggggggaaggcagcggcgggggcatggtccaccaagaccaagaccgatggttggaggctaatcaactaccgcgggaacaaaagcacggaggacatcaaaggttcccggtaaaaaactcaataagcgtatgatcacggccggatcacagcatggatagaggtcgacagccaacagatggagagcacggactgcggaaaggagataccagacgagaaactcgacaagctggaggggattaccata

SEQ ID NO: 49119 - DNA, 421 bp, Triticum aestivum
  Clone ID: PAT_TA_49119
gccgtaccgctacggaattacaagcaaagaacgacgcgttcgatctagccgaccaaaaaagactacgggagggcggatggcgccggcggggaacgcccactggtgggccgggacgacgttcgtggcgagcacaatgttgtgcctataggacgcccgctcggagaacaagctcaggatcattagctgggcgggaaccgatcacggcaggtcgcacttcttgaggacgaaccccttacactaggtaactatgctgcaagacggacaccctaccttcttgaagccatgcgcgatccttatgtactgtctctcaccagcacacgcagaatgtagttgggcgtatagctaataggatgcgacacctgatcataaaccttgagctagtgcattcttagaacatacataaaccttgggtttattgctt

SEQ ID NO: 49120 - DNA, 394 bp, Triticum aestivum
  Clone ID: PAT_TA_49120
acacgactcactataggataagcggtcgcgccagacgtaccggacccgaattaacggagcgaatcacacgggcgcccacgcctacgaaactatcttatcaaaacttccccagccacgatgtcaatatcttgccaagattatgtctgttaggcaaggatcaacttaccatgctcatgacttttggaaaaggctagcatgatgattcgcacgaccgggggtacggctatgatcgttggctctacctgcccccggtacgtgtctaatcgcgtacttttcttaccgccgaattctggggagactatgagctatacaaccggggaatgtcccggtgactatgagacctacaccaataaccgtgagctgtaaccgatacactttcgccaagaacatgctt

SEQ ID NO: 49121 - DNA, 180 bp, Triticum aestivum
  Clone ID: PAT_TA_49121
agaacccacatgccacttcgaacaaggcaatggacaaacccgcacgacctttgctagatgggattggactactacggtggatctctgtgctctctgccagctctactgctttggatatcgctggtacaccccaactcgcggggttctgggacatccgcaaacccgaccaaacggcctctg

SEQ ID NO: 49122 - DNA, 217 bp, Triticum aestivum
  Clone ID: PAT_TA_49122
ggagattcttcatacaattattggagcggattgagttatgacgtaggatctagattttcgatactagctacccaaaatccgatgtagattttccatgatagctgatggattttcgaatactagtgcacgctctacatgatgcatacttttgtactcggtcatgccaaatcataggccttctattgagtctcgtaagactattatcactcctcgtctt

SEQ ID NO: 49123 - DNA, 338 bp, Triticum aestivum
  Clone ID: PAT_TA_49123
gatgcgacggctcgacccacgcgtgcgctggtgttgcgcgacttctcacttcaggagtgcatagggaggggctgatgttaacacaaacagaaactaaagtaggtggagtaactacagctgatggtatagatcataagttgcttaactacaccccagagtatgaagctaaggatactgttatgttgccagcattcaaactaagtcctcagcctgtggctccatccgtactagcacaggctcaactagctgccctatcttatactgcaacatggacaactgcatggactgatggtctcacctgtatcgatcggtacaaaggacacatgctatgacattga

SEQ ID NO: 49124 - DNA, 334 bp, Triticum aestivum
  Clone ID: PAT_TA_49124
cggttgggggtcgatcgatcgactgcgggggagcaggatgatcgggccgcagcattacaccgcggaagccaaccatcaatgcacaccgtaagagctcgaggaccaaccagaagttctcaaggtcgcatgtcaaggcccgaacgggcaacttcacaaccggatgcaccatatgcatcactctacttgacaacatgaagcagtgaaacgatcactatgaatcaatgcataccgactggtaacctctagatgcatgaactatacattgactgatgctaaagggatgcaatagctatactacgcctgcgtctgaaggcgtacaatctacttcacacat

SEQ ID NO: 49125 - DNA, 200 bp, Triticum aestivum
  Clone ID: PAT_TA_49125
tggccctggcgtaccggacccgaattatcggatcgagcgacacatacaagtacgcgttgcatcacaaagcagcagaaaagaaaaaattcgcggtgcagggctgagcgcgcactagtggagatcgtggtgggaggatgtcgtgcatctattcgcctacacgttctcgcgcgctcgtatatatctctccatacacctttttc

SEQ ID NO: 49126 - DNA, 311 bp, Triticum aestivum
  Clone ID: PAT_TA_49126
agctggccgccaggcgtaccggacccgaactgccaacgcgacccacgcgtacgaccatgcatcctgtgaaggctaaccctggggaggaaggtacagcggtgcgagctgcaaccttggtactcaggcaccatggctcggatcgcgccgctcgcgctggtggctctgctatctgtgctggccgcgccatcgttggcatgcccgcagtgcccgacgtgaacgacgcctcccctgccgccgtcgtgcaaggtgaagcccacgccgactccgtcgtgcgtgcggcgccgtcggcggggacactggccgtgcgacgc

SEQ ID NO: 49127 - DNA, 273 bp, Triticum aestivum
  Clone ID: PAT_TA_49127
gcgtaccgcacccgaatgctcgactcgtcccacgcgtgcgtccactcatgcgctccactactttctctcgggaatatactcaagatcggcaaacgttacttcttgcgataagggacaggaaaggtgaccttacttgttctgcttccgcaaaggtgagctgacttcatgacgcagcttatacattacgctttgtcgatgcagcacccggacatgacccacgctggatctggtgcgcagacgatcctgacccgtggcgtatcttgatgcacagaa

SEQ ID NO: 49128 - DNA, 417 bp, Triticum aestivum
  Clone ID: PAT_TA_49128
acccctattaccggggcgtcccatgcgttcggtgaaacctaccacccatgactgatgtgtgacttctttattgggctcgagtcacataaacatcatgtgagccgtttaacatgcgcaacaaatatgcctctggctttgaggactacagggagaacataggatgcatgcatggagctctgctattataacagacattataaccatgatctttagcgtcccgattctacatatttgcgatgctctgtagcgtacctcatctaaacatgaaccaatgagtgaaacttacattagtacaaggaccagacttgacgccatgcaccgggtggatcacgaatagcttgatcagctgatcttaaaccgagagcaactggattccttgacttactataaacctagagttggtagcttcttaaaaat

SEQ ID NO: 49129 - DNA, 296 bp, Triticum aestivum
  Clone ID: PAT_TA_49129
cgcgggcgcctgcacgtaccgtgcaggtacagaaaaatcgacccacgctttcggatgtatttacaacaaaatgggaagcggccattgcagggattaaacacattactgtaaaaagcctggccctcttatatacccaaggctgagaaggggctcagtctttatttcaacccaagggaagaaggagacaaaatattatatcaccaatgctgttgagccacgcataagatgaaactacgcattctgctgtggagctattcggagagaacatgatacttcactctgaaactttatcaaaa

SEQ ID NO: 49130 - DNA, 285 bp, Triticum aestivum
  Clone ID: PAT_TA_49130
cccacgcgtgcggatctgactgaaaaccaggctgggagggggggaagaaggggctggcgacccgacacgcatgatacgaaaggcagctcggtgaaggacaccacgagcgagacacaactgagcgtgattctctgacgaccagactggcagacctgccagagtctctggtaaggactaatcgcagaactgcttggaccctgtggtcaagctcatagaagaacatgctcaactatatgtcctgacttaatatctcacctggataggtattatggccgatacgattac

SEQ ID NO: 49131 - DNA, 292 bp, Triticum aestivum
  Clone ID: PAT_TA_49131
gtgtagcgccaggcgtacgagtagctgtaaacgagggttgacactggcatgcgattagctgtcaacgacggctctcactgtgatgggctcaagtgcaacggtggcctctcagttagacggggttaaagcaacgggtgtggtctcagtaaggcgaggatccagcaaagaatccggcgcatgcaggtgtagcctatggaagggattaaagaacatgcgagcgtggcctacctgacgccgctatacacgggagaccttgtgtaacatgtcgactacctgaatggatgcaaatggg

SEQ ID NO: 49132 - DNA, 446 bp, Triticum aestivum
  Clone ID: PAT_TA_49132
gccaagcaagcatcaactcctgcgtccagcttagcacttagcagttagaatcaccacctgctcttagaatggcgggctactacaacggcggcggcaggaccatgtcctactccaacaccgacgagtgcttcgacggcggcaggaccatgtactccaacaccaccgaggagtgctacgacgccggcatgcacggccacggccacgggcacggacatggacacggcggggcaaacatgtacgccaacaccactgacgtggagtgcttcgactccggcaggcacggccacggcggtggcggcaggaccatgtactccaacaccgtcgacgaggagtgcttcgactccggcaggcacgggcatgggcatgggcacggacacggccacggctacgggcacaacgacggccgggctatgtcctacttcaccaccaccgaggagtgtttcgga

SEQ ID NO: 49133 - DNA, 180 bp, Triticum aestivum
  Clone ID: PAT_TA_49133
ggcatggtggattgatccttatgtccaacgtgatagcaactggacttatatcgctatccgctgagtcgtgacacatgaggacctaagactgacctctgggcgagacacaggtgggccgattatctgcttcggtgctaccgtcttctactgcattatgctgcatcgttgaggccgtgttgt

SEQ ID NO: 49134 - DNA, 331 bp, Triticum aestivum
  Clone ID: PAT_TA_49134
acccagcgacgtacgcgagcctatattcatggactgatccacgcatacctgaggatattaccatgatggtaatacccggagacctaccgccggtaccgtacggcatatcccaggtgaacatcgacggttacttccggggtgtgacaggtgaacatcaacggacactgaagatgtactgccataccaacaccaactacggaatgtacgtactctacggccaggcggtactggcgcctgtcaaatcgaaagagtaatacgagcactggatcatggacatgaagtggtgcatccgcataatggatcagggacactacgcggacttccacattgt

SEQ ID NO: 49135 - DNA, 435 bp, Triticum aestivum
  Clone ID: PAT_TA_49135
cccacgcgtacgatcatcctcgacaccaaagctcatcttcttctccttgaaatctttttgggttcatcagatttggaggatgtcttgcaactgtggatccggttgcagctgcggctcatactgcaagtgcgggaagatgtaccctgatctgaccgagcagggcagtgccgcggcccatgtcgccgccgtggtcgtcctcggcgtggcgcctgataacaaggcggggcagttcgaggtggccgccggccagcccggcgagggctgcagctgcggcgacaactgcaagtgcaacccctgcaactgttaagctgcatgcactcgtgtgatggtgtgagagtatacgtgaataacgagcgtccctctgatctgatggagccgagcaagggtgcgtgtgcgtgtgcgtgtggattacttgctcggtctccgcctatgctc

SEQ ID NO: 49136 - DNA, 335 bp, Triticum aestivum
  Clone ID: PAT_TA_49136
cgtacgccatgcagatagcatttcctgcacaaaccataccagaaggagatctcctagcacgcgacgacttgtccacaccggcaactaaaatggccccacatggtggcccaggagggaatcactgtgacattaatgctctcactccgaccaaatagatggtgcgcatacacattcggagcactgattcctaatgcgaacgtgccaacggggtcatcaactgcatcatgctcaggtatcttgacatggaacgacaacttatcccctaggtttcatggcgctcccagaccgctaaaccccacgtgatcaacattgttgaagaccagcgcctgatcact

SEQ ID NO: 49137 - DNA, 347 bp, Triticum aestivum
  Clone ID: PAT_TA_49137
tcgcccacgcttcctgccaagctttctggtggagtggccgtcatcaaggttggaggggcatccgaaacagagctcgaggaccgtcatctgcgaattgaggacgcgaagaatgccacttttgcagtcattgaggagggcattgttcccggaggtggcgcggtttatttgcacaatgttacttactttcctgcgatcaaagaatccatctaagaccttgacgagcgcattggtgccgacattatccataaggtattgcatgcactggcgttccattatcgtctactactcctatattaaaggagaggtcgtgatctagaatatcttggtgagcaagtagtaaatgggtt

SEQ ID NO: 49138 - DNA, 380 bp, Triticum aestivum
  Clone ID: PAT_TA_49138
attcaagagttatagggagggacttatgccaccacaaacagaaactaaagcaggggctggatttaaagctggcggtaacgattataaatggacttactacaccccagagtatgaaactaaggatgctgatatcttggcagcattccgagtcagtccttcaccctggggttccgcccgaagaagcaggggctgcagtatctgccgaatcttctactggtacatggacaactgtctggactgatggacttaccagccttgatcgctacaaaggacgatgctatcacatcgagcctgttgctgaggaagacagccaatggatctgtgatgtagcttatccattacacctattggaagagggttgcgctactaacatgtttact

SEQ ID NO: 49139 - DNA, 387 bp, Triticum aestivum
  Clone ID: PAT_TA_49139
ccacccaggcgtacgcactgatgactagcacagtcgaccatcccccgctgactgatcagcagagcaagcacccctgcaacggttgttgcctggtcctgcacggaccgcacacatggttgttcgcttaccatctaccttgggaggaagctcttgtaccccgtcccacttgccgggaacgaccatgaggagagctgcgacgtcaaccgggtaccaccattggcagagctacacagccaccaggataacagcaccggcaagtggaaggatcttgcatacgaggtacaccgccaccagcaaggcatttgcagacgatatgtcatactaccctccctacatcacgcgccggctggggatggtggactcgatgtcgcacgcacctaatgccaa

SEQ ID NO: 49140 - DNA, 376 bp, Triticum aestivum
  Clone ID: PAT_TA_49140
acggtatcgggagaatccttaattcacgagctatcgggagggacttatgtcaccacaaacagaaactaaagcaggggctggatttaaagctggcgttaacgattataaatggacttactacaccccagagtatgaaactaaggatgctgatatccaggcagcattccgagtctgtcctcactctggggttccgaccgaagaagcatgggctgcagtctctgccgaatcttgtactggtacatggacaactgtttggactgatggacttaccagccttgaccgctgcaaaggacgatgctatcacatcgagcctgctgctcgaggaacacatgcaatggatctgttatgtatgttatccattacacccatttgaaga

SEQ ID NO: 49141 - DNA, 348 bp, Triticum aestivum
  Clone ID: PAT_TA_49141
acactggtattgtcgggtcgacagacaagttcggatacttgtctcgtgtcgtaccgagagatcctctcattcgccatgggcatgattaagatcggaataatcggtttccgagggatcgagaggctcgtgaacagggtggtcctgaagagcgacgatgctcatctccagggcgtcaatgaacagtgtataaccaccgattacatgacctacatgcccatgtacgacaccgtacaccgtcactgacatcacaatgtcctaaagctcaaagacgacatgacactgctctgtgatgaaaatccaggtccagactacggtgttatgaaccctgaagagatccaccggggtgag

SEQ ID NO: 49142 - DNA, 419 bp, Triticum aestivum
  Clone ID: PAT_TA_49142
cccacgcgtccgcgccaatttccatgtgagagccgaggacccaagcgagagcggaggaccgacatccggatctgcatcctgccgctcaactcgaccgctggaggaagagaatcgatggtgcacggaacgctggaggtgctgctcgtcggcgccaagggcctcgagaacaccgatttcctgtgcaatatggacccgtacgcacttctcaaatgccgctcgcaggagcagaggagcagtatcgcgtcaggcaaaggtagtaaccctgaatggaacgaaagctttgtcttcaccgtgtcagaccaagctacggagctggtgattaagcttatggacagcgactcgggcacatcggacgacttcgttggcgaagcaacgattcctttggaagcagtttatacggaagggagcattccaccaac

SEQ ID NO: 49143 - DNA, 459 bp, Triticum aestivum
  Clone ID: PAT_TA_49143
gttggttaatgtttcagttcttctgataatcttaattttcatgctagtcacctaaatctagtattctggtgcttaaagtacaaaagatatgcttgtacagctttttgctgttttttttatacccttagaaccatctggtttaccaaagaacataattatttccagcttcttgccttctgatgtaaactgtaaaattgttcttgtatttgtagatggatgatgctcttacaactggaagcatcagaagtacagatggagagaagaagcgtttagctaaggcttctcttgcttacaactgtgagagcaaaaattgcccgcacttcaggaaactgtttcctgagtatgttgagaagtacaaccaacaactagaaaaggagcaaactggagcggaaccagagccccaggagaaccctgccccagctccttctccttgccgtgtccagcaagcggcagcaatgg

SEQ ID NO: 49144 - DNA, 460 bp, Triticum aestivum
  Clone ID: PAT_TA_49144
cccacgcgtccgcccacgcgtccgcccacgcgtccgagaaggcgtcggcaaaatcagtggaagtttatgaagcatccagggatgctattataccccactttgtaaaatttaaagaagtttctgatccctacttccaggaagctaagaagatctctaaaccttacattgatcaagttgctgaggtcacgaagccacatgttgagaaagttaggagtactcttaagccttatactaaaagagcagttcatgtgtatggaacatttctcgagtctgcaaccacataccatcgacagcacgaagaagcagaagagatcgcctcgtaatggtaacggaaacaatggcaataggagacacaagcgccgacatgctgagaagtaaactatcgtcggctaccatgtagggttgcagaaatcagagcatgtccttccctgacgaggctgtgctcctgtccatggtagaa

SEQ ID NO: 49145 - DNA, 412 bp, Triticum aestivum
  Clone ID: PAT_TA_49145
cgtaccagcacatacatagccgaatataaccacgcttacgaacgtatccaacgccgcagacaagggcggtgaggaaagcgactgacactgcctgcacaacatgctaggctatcaactggcacggactgagctagacactcttctccgaacattccaggacggaatccaccaacttcagaccaagttttgagaacatccaacaccaattgactaccaatacttcaaaaaggccatcgcctcgaaagtggtaattctacacaagggggctcatgacaacagtgagataccaatacatggagactcttgatctcctgaatacacgccaatgtgttatcccttgctcttctaaatgcatgaagcagataggacatctgtgaatggatcagaaaggatcaaagaagacatttctgaa

SEQ ID NO: 49146 - DNA, 372 bp, Triticum aestivum
  Clone ID: PAT_TA_49146
tcgcccacaaccactcccccctcccacgccgccggcggccgggcgccatggtgaaggcctacctgcggtacgaaccggcgctctgcttcggcgtggtcgccttcccgaagtccaacgtcgttcacgacccctgcggccgccgactcctcgccggcgccctagaccgcttcgccgcctgggacctcaagcgcggtctaccgttcgccaccttgaccccctattcgttctccgccttcctcgacgtttactgcgttgtcttcttccctgccgctggttgcgtcttcggttcctcggttgcgagtggccatgccgatgggagcatcatgctgtgggacgcccataccggcgcctgcgaggcgacgcttcacggcc

SEQ ID NO: 49147 - DNA, 295 bp, Triticum aestivum
  Clone ID: PAT_TA_49147
cgcagtaccgatccggatttccggtcgacggagcgggcgtttgaacgtgcaggatataaaggaatcagcacagcctgatgttcggcatgaaatatcgcaacgggtaaagcccatgactgaggttcctactgttccttactgttgcgggtcattaccttaacttttgagaatccccatgaattatctgagcttatgagaatgcctttgtcatgatttagcaagacacattttcatattttgaaagcagaaggatttgggtcacagcaaatttttgtatagaatgcttttattttaa

SEQ ID NO: 49148 - DNA, 164 bp, Triticum aestivum
  Clone ID: PAT_TA_49148
cccactcgtccgtccacgcgtccggaggattttgagtgtagtgagcccgttggcttgcacagatgcagctggatcaccaagatcagtgatgaggcttatgtccagtttccacgtacaaatctctggggttgttccctgtgttacagctgacgatccgcactgtt

SEQ ID NO: 49149 - DNA, 253 bp, Triticum aestivum
  Clone ID: PAT_TA_49149
tcaacgggtcgaacacgcactctgcgctggccagtcagtgcgtaaagcacgcgcgctgatgcgtctagtcgctgactatggagctagatgagactggtgtgcctgtggactctgtgaaaatctgatactcgccgttctcgcggacgacggacacatgtcagggtgctagcctgcgtgctgcccgtgccatttgagggcgctatctgcaacgataccgtgaaactttgtgacactaattgtgtaccatcgtatg

SEQ ID NO: 49150 - DNA, 375 bp, Triticum aestivum
  Clone ID: PAT_TA_49150
tcggccactcattcgtaagctgaacctgaacttgtatgctcatgactcttacgcagcaccgtccgattgatatacgccttactgaccggcgttttgatcatccccatgttccttattgagcgtctgtatctactaccctatcgcctgtattttgtatcagttcatgttctagtgtttatgttcctgtggatgttctctctaattcatgctatattgtgatgtattgtccaccttttgagtactactttgtcatcgtgagtaccttcttggataaaaaaaaaaaaaaaaaatataatactaatttaaaaaagggcggatgctataaaagtatcaggggggggcgctctaaaggttcaaagcttacgtccggggggg

SEQ ID NO: 49151 - DNA, 256 bp, Triticum aestivum
  Clone ID: PAT_TA_49151
tcctcgcatccggaaagagcgcctgaaaatacggcgcttgcagaactaatgggcgcctgaagacttgtccgatgcctacatgactcttgacctgggacatgttcgtcacctacaccactcttgctgtaggtgcttctgctgcatccgcttaaccgtcttaacgtgctacattgctatgaactgagccattataacagggccaagctcttcgcaccaaagacagtataccgcatgcatacaatgatattttgcaata

SEQ ID NO: 49152 - DNA, 224 bp, Triticum aestivum
  Clone ID: PAT_TA_49152
cgcatacatggttggtagcatggtggaccaagcagtactgatatggctgctgcactgtcctccaccgatagtgccctcgggctgtacgcttaccaactaccttgggatgaatctcatgaagctttgtgaccttctgctgataactaacattgcaagagttttaatgtaatctggtatacagtcatggcataggaaaacatccactagatgaggaactcatatat

SEQ ID NO: 49153 - DNA, 419 bp, Triticum aestivum
  Clone ID: PAT_TA_49153
ctcgagttcgatcatcaccaacacatgtcgtgctgcgcaggcaactgtgggtgcggatccggatgcacgtgcagatacagctgcggagggtgcacgatgtacactgagatggactagggagtgaacaccgcctgggaaacccttatcatgggcgttgccccctccacggacaccccatgtttcgaggccactgcccataacggagggtgcaagtgcggtcacaactgcagctgcaaccagagcacatgaaagtgatccatgaggcctaaatcaaatcagatcaaggagatggcatgcatggacctgatgaaggagcgagtagtaataatgcatgaatcgaaagcacgagatctatcgtaaattgccacccataataagacgagatctatcgcatcttatcgatgctaccaaatggatta

SEQ ID NO: 49154 - DNA, 299 bp, Triticum aestivum
  Clone ID: PAT_TA_49154
cgcattgacgcatcgtcccacgcgtacgggcaaactcagagccacaacatagcatgggtagagatcctataagaactgctactgagtaatggccaagctccttgcagtgacgctcctgatgttgatgctgaatcgcgtgcatcgacgcgctagagctgaataggaaagctcggtgctggtagcgctgtctgccagatcaaggctgcgttgccctaccgccacttgccggcaccacatgatgagggggtacctggcagggtgtcggggacagcatcatcggttatttgggggggagtttt

SEQ ID NO: 49155 - DNA, 114 bp, Triticum aestivum
  Clone ID: PAT_TA_49155
tcgcacaccgaaaatggcagatcgcctactcttctagcctacctactctcccagaccttccacccatcgaccctccatactcacgcacacataccgctgctcctataccgaccc

SEQ ID NO: 49156 - DNA, 371 bp, Triticum aestivum
  Clone ID: PAT_TA_49156
ctccatttttgctctgctgggcacgccccttctccctcaacttaagactctaggcactggcgtcactcgctccgactaatatgctcgccacccagctcaacttactcgtgtcctacagatactccacagcgtctccaactgctggaacacaaaacatcgcctgaatctttgatcgctccaagaagaaacccgccgcgtagccatagcccacccgcttggccacctgtagcgtgctcatagacgactagctttgcaagtggtactgttctgacaggaggatctacttgcccaactgtatccttgaccggtcggaggctccggatttcctcacctgagagggtgcaggagactacaggtatgatccttttggc

SEQ ID NO: 49157 - DNA, 372 bp, Triticum aestivum
  Clone ID: PAT_TA_49157
tcggccaagcgtacgggagctcacccaggattggcaggcagactgaatcgtgcgccgtcctccatgcgcaagtggtcactatcctgcgcgctccagctaataatcttcatgacaacgctgaggaaagcagctaagaagctgcaaactaatgcaaaggagagcagaaactaggggcccgactttatgaatggagaagagactcttggggccgtcacagatggctcgagcacagactccgaagtagcccaaagagcgtccgtgacaagctcgaggaacacgccgaggaactcaggctaaaagacataattataaactgagtcgacaagaacaatgaccattatcatcaagtgactatacaccatgcatgacatg

SEQ ID NO: 49158 - DNA, 348 bp, Triticum aestivum
  Clone ID: PAT_TA_49158
acgaccacgcgtgcgctaacgctttctacgagctagcacgcataacgttctatggatccatataatgttgggcataccggcatacaaggagccacattattataggattaccgttgattacggaaatacttcatttggaaattctcattccttctttcattcgcttcattagcgccaggccagaccgggtgcggagtacattggtacaaggagaggagctacgagtggagcacatcggttcatggaggagagatacatacggcgtcaggctgcttcttggcatgttgagtctccttgccatcacaactcgtgggcataccgacgcagatgaacgtaaccaatcggaag

SEQ ID NO: 49159 - DNA, 191 bp, Triticum aestivum
  Clone ID: PAT_TA_49159
tgaaaagggatcttacttgtcaatatgcctgcgctgcttggaggtaccaggcatatgcctgctgccactgcagtgaactgcacggggtggatatgcgccgcattatcgtggggttagagacgcatatacctaccgacatagccggtggaagagacacagtcacctatggtcaggtgcgcttgattatggct

SEQ ID NO: 49160 - DNA, 339 bp, Triticum aestivum
  Clone ID: PAT_TA_49160
aaacgaaacgtttatggcccgcccggaataactgaatctgctgtggtggcggacacccggcttgagtccctacgtgctgcgcgcccatacggcgctcggcacaaaggggctgagctacaactacctatccgaggaccgctggtgcacaagcgagctcctgatctcattcaaccccgtgtacaagaaggtgaccgtcctcatatacaacagtacgtccgtctcccagtcggtgttgatcctggagtacctcgactactccgtgggcattgctagaaacgggaagcccatcctttccggagaccctttctgacccaccagctgttgcttttgggcccccta

SEQ ID NO: 49161 - DNA, 234 bp, Triticum aestivum
  Clone ID: PAT_TA_49161
cggacgcgtgggaaaaaaaaaaagaggtagtaatataaaaataaaaaaaaaaaaaaaaaaaaaaagaaaaaaaaataaaaaaataaaggggtaaaattttggggggtccatttttaagattccgggcgttcggtctcaaggtcccaagtttctgccccttcatttcaaccccttggctcttttttatggccccctttttccaattaattggccggggaacccaccttttttcct

SEQ ID NO: 49162 - DNA, 179 bp, Triticum aestivum
  Clone ID: PAT_TA_49162
gactagagatctacggaaaagatgattccggctcgactccagatctgcatcgtccttgctgccgtactatgaacagatgggctaggtgcttggagctctactatgagtaagacgagttgcccagtcgcttccttagtgcaatggacgacatgccgaagtcacgctctatgccactgcag

SEQ ID NO: 49163 - DNA, 302 bp, Triticum aestivum
  Clone ID: PAT_TA_49163
cactaccctcgcgtgcgctcacccgcgatcgtcggggtcaagtcgactcctcgcgcgaggcctgctgcatatcaaccccacgccgcgcgagaggccaaaaagatgccagcgccggccggggaggaggacaagaacccatcaagcgcaagcggaaagggcagcatcgcccacatgaacctcaaggcaaagggccaggatggcaatgagggaatctttcgcatgaagagatctaccgacatgaagaagctgttaaatgcctactgcaaccgccagactgtcgatatgaaagcaaccggcatact

SEQ ID NO: 49164 - DNA, 383 bp, Triticum aestivum
  Clone ID: PAT_TA_49164
actcagtacaggaaaagcgggtgcgcctacacgtacgcgcacccgtattgcgcgttctaccaacacgttctatcactccttaggtgactcagggtagcaagctatatagctacatagtacacctatggccctcatcttgatgggctcaagtgcaacctccgtctctcctttagaggggcgttaaatccactctcggcctgccagttagactaaggtccaaaggatcaagcctatgcaggtgtagcaactgtggagggataaggtgcttgcaagcgtggcccatctggggcatctaaaatctgaagaccttgtcttacatgcgaacgatcagatccgatgcacttctgtagctggccgtctacctaataaggtccaagtgattt

SEQ ID NO: 49165 - DNA, 359 bp, Triticum aestivum
  Clone ID: PAT_TA_49165
acggacgtgggtgagcctgccgaacggcagaggcatcatgctcaccatcattctggtgcaaaggaagcattatgccgctgcccatgctgctgccatggcctgattctgaggcggatattcacctagctatacccagccatcttcaatgatatagacctatgtgtcctggagaccggcgaacttaagtgttgccggatgatgtatggtgtacgaacatcctgattagctggctagatgtaagacggatgcttaccatataaaatgctatagatagacctcatgcaggtatatctaatatgtgccagataaagagagggcgttatctgaaaaattgctttatcttcaaagtttgaagatgg

SEQ ID NO: 49166 - DNA, 346 bp, Triticum aestivum
  Clone ID: PAT_TA_49166
tcgcagaaaacacaacgatgcggatctactcaagttacatcatcaccaaccatgtctggctgcgcaggcaactgtgggtgcggatccagatgcacgtgcagaaacagctggggagggtgcacgatgtaccctgagatggactagggagtgaacactgcctgggaaacccttattatgagcgctgccccctgaacggacactgcaagttccgaggccactgcccataacagaggtgcaaattgcggtcacaactgaagctgcaaccagtgcacatgaaggtgatccatgaggcctaaatcaaataagatcaaggagatggattgcatgaaccgaaagaaggagcaag

SEQ ID NO: 49167 - DNA, 321 bp, Triticum aestivum
  Clone ID: PAT_TA_49167
gcggggtcgcgtgggataccatggcccacgccgtgatggcttcatgtgctaccaccgtctgacccttacacgggcttaagtccacggccggtctgcccgtaagactgcggtacagatgaagtctatgcagcggcagcaatggcaggaggatcaggtgcatgcaagcgtggcctactgaggacatctataaactgaagaccctgtgttacttgccaactatctgcaccgatgcacttgtgtagcatgtctactacctaatacggtccaagtgggtgccctggatcacgttcagcaaggctggctctaccactggcgagcaca

SEQ ID NO: 49168 - DNA, 283 bp, Triticum aestivum
  Clone ID: PAT_TA_49168
acggtggataggattcagcccaccgcccgtctggaagggagcttcctggcggcctggcgcggcactttgggcgcaccggcttacccaatgtcactggcccttggcggcgcacgcacccctaacatgctaccttgcagtctgacttagcaggcgtcacatgctatcttggacactgactcataggcccactgtcttaataaccaacaccgatgaccaacgccactgactatccaaccaatcgcgactaccaattgtgagtatcaacgacactctcttgaactag

SEQ ID NO: 49169 - DNA, 394 bp, Triticum aestivum
  Clone ID: PAT_TA_49169
ctagtataggggaagcgggtgcacgtaccggtacaggatcacagtgccgacccacatccaccggagtgaaggtcgcagtggctattggtatgcacagtttgcgcgcgcccactccatgagcgtgactgcctcctgcaacctcgactagattgaaagccgatggcccccctgccatcgacgagcctgcacgctgatggttggtcaaacatggacgctctcatactcatttttctgctaaaaatggaagctatccacatacaatggctgttctatgccgtgaatatatgcactagcgtggtatatcgctactggtggatagggacgctgcgttttgtaacgcagttacgagatcacgctgggtggctgtgttgttatcgtcgctaacaggatcacg

SEQ ID NO: 49170 - DNA, 290 bp, Triticum aestivum
  Clone ID: PAT_TA_49170
ggctggtcactcgcgcagacggacttcgactcgccggtcatcagtccgccacacggagctcgaaagggcggtcataactacggcaccagtcggaagaaagcgaggcactaactaccaaatgagctgggaatggagggtgcaccgacggagaactccacggagcccatggtggctacggaggcagctgaccatacatggcaccatgtgcatggttcgacggagaccatggtggtgccagatgcgactgtcgacacatagcaccatgtgcagcgctcgacagtgcccatggt

SEQ ID NO: 49171 - DNA, 283 bp, Triticum aestivum
  Clone ID: PAT_TA_49171
acacaccatacgcaagcagacctaggcggagctcgaagacatgaatcgcggttacctaacccatgctaacagccatagttaggggtttgaataaacacttgacaaggctgaatgacctttctcactggatgcatgacaagcttgttacaacttctgccagcaagccattatgatgctcttacatgggcacagactgccttactctgatacttatcgtgaagaacagactgtaatatatccatcacctaccgataagtgcaggatatgcttatactgacaatat

SEQ ID NO: 49172 - DNA, 274 bp, Triticum aestivum
  Clone ID: PAT_TA_49172
ctagcattatctatgtctgagctgaccaccacatactagcgctagctaggtcgatgcgtgatggcccatgtctgctgttgctcacgtcgcagctcccgggcgtggcggccggtatgctcctgggagccactgacgcggccgcatcgtgcggtatggacagctctgccttgagcacctgcatgtggtatgcacgcgggaacggaggcgacccgtctgctgactgctgcacacccgttaggagtatagccagctcaagccggtgcaccgctgtcat

SEQ ID NO: 49173 - DNA, 232 bp, Triticum aestivum
  Clone ID: PAT_TA_49173
ctacgcggacgcgtgggtgtcctctctctagccaccgcatgttagagctcctatcccttgcataccataaccgtgtctggcatctaaccgatcgaataccgaacaccaggctcttattcgctagatcgatcagcgagcaccagaccacaagcttcagaaaagtactttatgctaccaaccgggcgcttcagtcatgctaggaatgttaccagcgggttgtcacgatgactct

SEQ ID NO: 49174 - DNA, 287 bp, Triticum aestivum
  Clone ID: PAT_TA_49174
gggagatcgctcgcttgttgctcaacgcctgcccacgccgacgcgtagctctctctatctgatggcgtccgtccaaccgtagctcggtgcatctgatggcgtggctgtagctgtatctcggggcgtccgcctaatcaggggctggcggatcgcgcgccgtgggccgagtcaaggtatcggccacggagcatcgagcgaggcgcccggctacccggagcttaccatccatcagagctgcgtcatcacctgatagacgcattgtgccagccagagccaccgtcgcacag

SEQ ID NO: 49175 - DNA, 189 bp, Triticum aestivum
  Clone ID: PAT_TA_49175
acgtccacactttcgtaaatgcaagcgcgaagtaactgaccgaatttcgttggacagttggctggcggtatgaccaaccttcttgggaacccagtatgggagctggactgcaatgtccgctgttgacagagaagaagctgtcaaccagcatcggtctttagttcgcggtggcgactactagtacaactg

SEQ ID NO: 49176 - DNA, 295 bp, Triticum aestivum
  Clone ID: PAT_TA_49176
atgtatttatttatgttacgcatgcgcactaacgaacgaatttattggcaacgcatgcacagtgaaaagtacaaaaacggacaggatctgatgtatgcaagggacattacgcggactatatgcgatgtacataacggcctgtccgtggaatcaagcccacttttattactggctatacaaagactcaacagcggctaactcaagagctagcggaactctgtcttgctactctgacaaataatgcaagcacttcactcatacacatgtccggcatattttcaggtcaccacctttc

SEQ ID NO: 49177 - DNA, 257 bp, Triticum aestivum
  Clone ID: PAT_TA_49177
gaggacattgacggcggcttgagcagcattcgccgccagcatcgacagcggactgactttatttgacaccggagtattatacggctcatcgctgattgcatcagggaattcaaaaagcctactgcgagatttgataacggagaggacccatttgggggcggtggatgtgacggcggacaccacgtttgcggctctaccctgaaggttcggacgtagcaccgtcctctccgcgctcaagaagtctatgaagcgccttg

SEQ ID NO: 49178 - DNA, 172 bp, Triticum aestivum
  Clone ID: PAT_TA_49178
cgtaccgagatcctgaattacccaatagagccacgcgtccggaacccttacccatgcaagaaggtggtttcactttacctcatgcacttggcgaggacttgtccgtatgcacctaagccagggtccaagaatctatgccgatgctcaatgccaacacggataagatctatgc

SEQ ID NO: 49179 - DNA, 238 bp, Triticum aestivum
  Clone ID: PAT_TA_49179
gcgaccacagcctgcgagcttgagcaggcgagcgagctagatagacttgcagaattgatagtatacgaagacagcttgccgtgcctaatgcatgctatgcgcaagcaggtgactgctcctcaagagcaacaagccctaacaggccacgactccgtgaggaggatgggccataacggtcgttaacatgctgtcgactctgagctgcactgcttgttctgctcccgacgactacgagtgc

SEQ ID NO: 49180 - DNA, 286 bp, Triticum aestivum
  Clone ID: PAT_TA_49180
gccgaactcactagctagcaactgaaggaagcagccgaagctcgagcgtgagcgagcgaccgtgcgagctgaaaaaccaccctacagagctcggggtgagccacccgtgcggtcggcgacgatgccgatgcttatacccgacgacgttcgcgccaaggcgggaatctacacctgctacgcgacacggcacgagacgacgcggctgatgctgtcagagacagaactccgcagcggtctgctgacgatcaaggacatcatcgagtgcggctacatggaggagaccggc

SEQ ID NO: 49181 - DNA, 258 bp, Triticum aestivum
  Clone ID: PAT_TA_49181
tctggagacagatattctccctgaggttaagtcgattcgtcccgtgttgcctttatcatcctacacgcatacacattatgacattaaaaccaccctacaatgtcacacatcaagacaacaaatcaacacttgtatgtttgatgccaatcaaaccaaacaacatgttcatgactcatctgctcatgcaaattccaactgcttctgatccgtttgctgatgcaaaaactatggacttctgcgctggcactagatcaaaga

SEQ ID NO: 49182 - DNA, 282 bp, Triticum aestivum
  Clone ID: PAT_TA_49182
cagggtaagctggtacaccagcgacgtacgcggacccgtattatgcgacatacccagccgttcgtacattcgttgcttgattcgtgtggaacttttattgcataggtgcacgataatcaagccgtacttagattaggctccatgtaagctatagatcagacgctgtaccatatcgacatcattatacactcctttgacactagttggtgtggcagttataaactgctacgcaactaactgtttcaggtgtacctacgtggatcccaatgaaaatctacatga

SEQ ID NO: 49183 - DNA, 325 bp, Triticum aestivum
  Clone ID: PAT_TA_49183
caagaaaacataccgtgacctaggatgacttgaccaatctaaagtacctcaaactcgtcatcaaggagaccatgaagaggcattcaaccctgccactgcttttgcctacaaaggacatggagcctcgaaaaatcttcggattccacatacccaagggcaccacactactgataaatgcatatgcgatcagccgaaaccctaaacattgggatgatcctgaggagttcaagccggaaaagaccgagtctgcattggacgacttgcaaggcacaaactgtgagctcataccatacggtgccagcacgagaatgtagactggaatgac

SEQ ID NO: 49184 - DNA, 214 bp, Triticum aestivum
  Clone ID: PAT_TA_49184
gcggcgtgtcgagcagctacccgtgctcttcaatggcggcgaaggaaccattgcgcgtgctcttgaccggatcattacgacaaatgggatatgctctggataccatgatggccaggggagtaatgcttgtagcaaaccagcctgtgattctgcatatgctggatatgagaatatgctgctgaagctcttaaaggagtcatgagggagttgattg

SEQ ID NO: 49185 - DNA, 198 bp, Triticum aestivum
  Clone ID: PAT_TA_49185
gcgtgctgacttgttaagattgcagtctgagagtgattggcatctgacacaacacagtatgtaaggctcatcgtgatcaaacacaggcaatgacgagagtgtacccgaggacaaataggcgcaatagcacgtatgcatgtgattgcacaaacgcccgatagtccatttttgtgcgattgcacactcgcgctagattca

SEQ ID NO: 49186 - DNA, 357 bp, Triticum aestivum
  Clone ID: PAT_TA_49186
gcgacgacgcttgggcggacgcgtgggtcttcgggttacaggcatactgttaccgaaaagtgctacctgctctacagacaggtatggacgcattgctgttggactgagctaggtgagatatgcacgccttttggcgcttgaaaaatgtagaactatcgcataagcagacacataaaagctatgacacgtcgatcattggcaaacacattgcgaacaaaactggacactaatctcagggacaatgcgtaccactatagaaactgataactggaacaggttatccagctttgactggataactaatgaccagatgagacagatatgactggcttaccacttaccaaataccatccacaa

SEQ ID NO: 49187 - DNA, 276 bp, Triticum aestivum
  Clone ID: PAT_TA_49187
atgtgcccgcccatgctggcgaaagttaacggccatgtactcgccgactctgcgcaaagggaacgcctgtgtcataggacacaacgaggcaccagctcctatggccagatacaaccgtgcgaggacgagttcgtactcggagcggcacctattggaggtggagccgaactgtaggaagtgcgtacgggcaacgccgccgtgtggaccggaggtacatccaccggctcccggagtgtcgaccggagctccagaccgctgctccggtactccagatcg

SEQ ID NO: 49188 - DNA, 259 bp, Triticum aestivum
  Clone ID: PAT_TA_49188
acgatattatgctcacaaagaaaatgctcggtcctttacaatcttggaagatgcgaagtctaaggacttgtgatctacttacagttacactttgtaatgacgtgcttcctacttacacatagaatattttaagagatggttacttcaaatgcgcaaaaaattctttgtacttaatttaacgccatgacaaatatgcgtgtatcacttattgatcaccatgcgatgaatataaccttggggatgcaggtattgtaccata

SEQ ID NO: 49189 - DNA, 319 bp, Triticum aestivum
  Clone ID: PAT_TA_49189
gagctgacgcgtccactgacatggatccttccgcgacctgctctgtccactccatggtatccgtgttccgcgctctgcgtgcgggctgggagctggacgctcctcgtctgggatgcggactgagagcaggatgctctgcgccagcatatggaagagctgccacctgagaaggccgaacggtgattggccattgcacgatcaccagagaccactgttgggccggatgtcacgagccgagaaaccttccgcaaagcaaaagctaacattcatagcaacccgacaaagagcaagcctatttgagcaagccagtaccagaaaa

SEQ ID NO: 49190 - DNA, 317 bp, Triticum aestivum
  Clone ID: PAT_TA_49190
tgtgtgttaaggttgttatgaggagagctcgctacgtctctcatgctggattgacattaccgcagctacaactattcttatgtgcttggattgatccaaggaagtagcatactacattaactgcgacatctgtagatataacaacctacactaccaaacgatgatgtgaatccaattcactattgactgtgaccatgctcgaaaccacagatatagtgacatccgaaaccacacactatgctgcatcactagaggtccctagcaccatatgggcatccgatgctgttggtaccttgtatgacaatgcatacattgat

SEQ ID NO: 49191 - DNA, 310 bp, Triticum aestivum
  Clone ID: PAT_TA_49191
acggacttgtgtgctgcatggtatacttgcgcgcacggcacgaagaaagggaaggacaatgtccaccagccgtaagattatccagactgacatgggcatgctgcccttcaactgcaaagacaccgctacgcacgctttatctgacctgaagactggcaaccaaaagctgaagagcaacctgatggacctgtacataaacactgcaatgcaaatggttgtcgttggcatcaggacaggcgctgtaatacatgtcctgttccgctctgacaagcgcttgaagaagatccatgtcacgctcgtaatggagctg

SEQ ID NO: 49192 - DNA, 312 bp, Triticum aestivum
  Clone ID: PAT_TA_49192
agaacggcgcaagtagacagatgaggaagccctgagaacttggcgagagaggagatctggaaggccgcctagctgtggcactactcacctctggtggactccttggaccacacaaccaacgcctacaatgtaatgcacaggaggaacaacctatgtgctctatctgcgaaacaacagtcagtacatgtagatgataatgtcgcgttcgctgacggtgctgtggccgaacaacctgtatctactgaagcgctaaatgagccatcagagcagaatgaccactgcactaactctcccattgatgcaatgccgaca

SEQ ID NO: 49193 - DNA, 303 bp, Triticum aestivum
  Clone ID: PAT_TA_49193
tgatggacaagtaagcctagaagatctaggagctctaatgatatggaggcgattgccatagatgtacgctcggcatatgctactgcgtggcagcaatatctagtcttgatagagcatggggtggaaacaattcttatgcttgacggagcagtgggtgggaacaattctgcgacgctacaccagactgagtttgtgcaagtcttggacggttcacacgtatcaaaccatgaaatctttgataggggcatgcctccctaccaatgtagataatgatgatgacatgctgcactctgtaaatgcaga

SEQ ID NO: 49194 - DNA, 305 bp, Triticum aestivum
  Clone ID: PAT_TA_49194
accatgcactaggaacagccggatatggcaccgaactacagactcgggagctgcagacatggcatccacaataatgggcgcctcatcccgcaccgtcgtggccaagacgccagtcctctgcgggaaatggcgggccggcagaaccagacaattgcgatacataaccactgggggcaacggccgaaccaccatgggcaactacttgtggttctggccgaaacgcgttaagaacttgagcgcgtgctccgcgcagactacggcctacacgaacggcgagtttcctggcgactacgaggtggacactc

SEQ ID NO: 49195 - DNA, 106 bp, Triticum aestivum
  Clone ID: PAT_TA_49195
actcgcacgcatgcacgcacacgttcgcaagatcagtggttattacgtacggggaccctcacatggtctggtctcgctgcctactaatgcgcatatctgacgaccg

SEQ ID NO: 49196 - DNA, 326 bp, Triticum aestivum
  Clone ID: PAT_TA_49196
gacggaacactagcatctcattgttgtttctggagatattccactggcctgcccgcgtcggcgtcgaactcactcgttggccacgtcggaggtagtgtccaacttgcgcgatggccactacctaggtgcttttcaacctgcgctaaatatcatacatgtgcgcgtaccagtccgccatgaacaacagcgacgcgacggtcctcgactccgatgccacatccgagcgcgacgctatcagctggcgatcctacatagcccttggatcctagcaactggtgttcagggagatcaactggtcgggggttacctcactggaggccaggaag

SEQ ID NO: 49197 - DNA, 241 bp, Triticum aestivum
  Clone ID: PAT_TA_49197
gggctataccaacgcgtgcagcaagagtcagacgggaccgtaacacccaacggatcacgaatccgacacgataggaaggaaggaaggatggcgccgtcgacaccatcgcccatctccgctactggcgcggccgcctggcacacgcacgtcgggttgtcggccgtccgcctgtcgcaggcacggtaggccgctgttctgtcgtctgtgtgaacgaggttgcccggttcctttcttgtaggcg

SEQ ID NO: 49198 - DNA, 285 bp, Triticum aestivum
  Clone ID: PAT_TA_49198
gccaaggcttgccgtggatacctacgcaccgctagacgaggaaggacgtaaccagcgacccaatgcttccgagagtggaaaatattcataactgcgtggattatcaattagctcaaccttttcaactggctgatctataccatatcaggcgccagacaacctgacggcctgaaccatttcagtagccacaggaaacgaaagcaaaaccgactccaccagtaacaccgagcgaaatgagagcaatctaaaccgtgtactcgtagtcgtagcagagcaatacaagcc

SEQ ID NO: 49199 - DNA, 351 bp, Triticum aestivum
  Clone ID: PAT_TA_49199
tcgcaaaggctcaatatggcgcgactccatgtggttcccatgacaacctttatgcagacaccatggatgacgatgtgccaacgtacggcaatgatgccaaaagatacttgacatacatgctgggttcatacccagcaccacctgctatggctttggaattaccggcaaccacaagaaaatccattggtccggtcagcgggcctatgtagattacagtcacagcgggcatgatgcaagtcggcgaccacagaataaccggctactaaggcagctggtcacttgtaaagaacggagcctcgaacctgctactttcattgaccgtggagagcaaccagtcaacaaactgcattg

SEQ ID NO: 49200 - DNA, 345 bp, Triticum aestivum
  Clone ID: PAT_TA_49200
agtatatgaccgcggtggtgatcttcttgcgccactctatcacacccggaatatcacgaagctcgcgggctactagttcatagggctagcaccgggtgctggactactagtacaagccgttcgggagcgcgtagtcacacctgctctgacggatgatggcccccctggcgtgagcgaccaggatgaacatcacgctcgctgcaaccagggtccttaccttcatttatgaagccgcaacatccttcatgtacatgaatttaatgacctgctatatgactctggaccatgacatgactgccaagctctccaaatttggcatgtctaaagacggatcatggggacaca

SEQ ID NO: 49201 - DNA, 295 bp, Triticum aestivum
  Clone ID: PAT_TA_49201
tcgaacaatttgaggagggtcgaacctttgcggagtacaacatctagatggaatccagcctacaccttgtactacgcctactgggtggactgcaaatctgtgtgaagacccttactgccaagaccataacgctggaggcagaatcctcaaacacgatggactatgtgaaggccaagatccagtactaggagggcattagcacgtagcagatgggtgtaatcttggccactacgcaattcgaagatagtcgaacccttactgactactacatccagaaggagtccaccctgcactt

SEQ ID NO: 49202 - DNA, 412 bp, Triticum aestivum
  Clone ID: PAT_TA_49202
acacaactgaaaacattgctctcaactcgctatgacaaagctccaggccttactaacaacgcgctaccaaaaggtgcaggcaccatgtaatttgtggacacatgaagggcaggggtgcatatgtcgtctaagctgatcgtatcccgagatgattaggatgtcgtgccagaactggccacaacaagaatggctatcgtgcaattgtctggctataaccgtatggactattgtgcatatgtatatgctattgtgacaagtactttatgcacatctaatcgacaagttgaacgtggtctattctgaagagcgcggatcttggatcctggtgagaggataaatgcctttcgagtttatgctcatgatgggatgaatgccctttgtttttaaaaaaaaaaaaaagggggggcccttt

SEQ ID NO: 49203 - DNA, 274 bp, Triticum aestivum
  Clone ID: PAT_TA_49203
ctcctctactgctataatacaataacaatggcccacgccttgatgggttcaagtgctaacaccgtctgacccttacacgggcttaagtccacagcctgtctgcccgtaagactgcggtacagatgaagtctatgccggttcagccatggcaggaggatcaggtgcatgcaagcgtggccgactgaggacctctagacacagaagaccctgtattacttgtcaactatctgcacagatgcaattctatagcatgtctactacctaatacggtcca

SEQ ID NO: 49204 - DNA, 322 bp, Triticum aestivum
  Clone ID: PAT_TA_49204
catcagactttccgagtggacccaggcttacgatcataacacattcccagcgctggtcgtgttaacaactatggagctcctttccgatggcgtggctgaccatgatggcgcgcctgtccgcggccgtggccgtcgagcggcgcgcggcagccacgtgccggggcctcatgatgccccgggccagctaggtcgcggggcaccaggcgccgacggccaacatggcatgctgtgtgcccgccaccgtcgggcgtcgtgccgcattgtctgctggcgcctctgcgggcttgtcggccattggcggagtggcgttcgccaagtcaaa

SEQ ID NO: 49205 - DNA, 127 bp, Triticum aestivum
  Clone ID: PAT_TA_49205
tcttcggaacagaatctggcctggatcgaggccatgttgagcaccgatgcatggctgtccgttgcaaaaaggacaggcaggtgcattgcagtggtttgcaataaagacttggacaaggcatgcaatg

SEQ ID NO: 49206 - DNA, 265 bp, Triticum aestivum
  Clone ID: PAT_TA_49206
tgtcgggtacaccgtcgttaggtgctgctaggcctcaacggcgacgcatcttcggcgctcccctccgaccaatgtccaggcgctactgccaaacccatgcagtccctaaaactccgcaactgacaaactgctgacctacgcaacacaccggcataaaccaactgctgccggacgccggttactggcctcaccgagtttgagctgccgcccacttactggacgctccgcttgcgtccagctacgcaaatggcggacgcctaattaa

SEQ ID NO: 49207 - DNA, 301 bp, Triticum aestivum
  Clone ID: PAT_TA_49207
acggtcggacttctggcccaagatatcgctgaggatcgtctacaccctgcgacaccagatacggcacggctagctaaagtcctgctccgacttataagcaccaatgaagagatgcatgctctagctgttgactaccaaaggcagcaagacctaactacagctcgagttaacgaagccggcaggaataatgattgagggagtgaacggtagcgataagacaacataggtaggaaagcttggctacagatttaagaatgattgcgcgcaggtattgatggccagatgtgataccttgctagca

SEQ ID NO: 49208 - DNA, 296 bp, Triticum aestivum
  Clone ID: PAT_TA_49208
gcgcagacgcgtgggacgtacccaaaaagcatgctgccaatggaggacgctggcagcccaccaaggaattcctttgatatattaagtaggagtactactgaacgacattgataaaatcatcacgtgtactacaggctgacatgatcagatccatcctttgggtaaacaggcgcccggccgtgatccttctgtcctgggcgcatggcccccgcgcgggcatgtctattgtgggccgcgtacaccttctgagtgatgacgagcgctggtagtttatagcttttgacttctgcgttcgc

SEQ ID NO: 49209 - DNA, 101 bp, Triticum aestivum
  Clone ID: PAT_TA_49209
accacgcctacggcagggacttatgtcaccgcagacagaaactattgcaggtggtgtatctacagctgatggtatggatcataagatgccgtactacaccc

SEQ ID NO: 49210 - DNA, 274 bp, Triticum aestivum
  Clone ID: PAT_TA_49210
tctcctcctcctcccagttgctagagatcgtgcctctcattgtccgatcacccagcatagacggcatgacacatcttaagatacccgtgcatggtccctaagagggagctaacgtttgccctgaagtctttatgggatggaacgagcatcgccgcagattttgagaacggaggcaccgtgctgaggaccagcatatggaaacagacagctgatgctactatcaagaacatcctgagaaacaccttatgctactatgatcacgatattgacacca

SEQ ID NO: 49211 - DNA, 355 bp, Triticum aestivum
  Clone ID: PAT_TA_49211
taggtgagcgagctcactaaacgaaggatgaactcatgtgagctactgcagtcaaggaaggatggcaccatgacagctacgaccgacgagcagcttccacacgaagacgacaacgacgaactcacggcaggccgtgtggaacgactactagtggctgactaccagccgctggagaagaatgctgatttaggactacaacgcattggagaacatctggcacttgccgcgcgagcgcatgccaaagcgtgttgtgcacgcacggagcacctcacccaagggatctgtggagagcacctacgagcgcagggggctcacatgcgcggaattgctccgttctccaggggcgtgcacgagc

SEQ ID NO: 49212 - DNA, 296 bp, Triticum aestivum
  Clone ID: PAT_TA_49212
ctacgtaatagaccgggcggacgccacgcgtcgcggactaggcttagatcgagcggatggacaggctcgtcagtgattcttacacgcacgatgaaaaggttaataactttgtcgctcaagccaaatgtgacagttggaatactaggactctacagtactatattggcaatactatggcgagcgcgggagtttatattcacaaatactagtatgataacagggagtatgacgacgtgttttaattctatatacatttatttttacctctaaaaaaaaaaaatattatataataatgg

SEQ ID NO: 49213 - DNA, 210 bp, Triticum aestivum
  Clone ID: PAT_TA_49213
aggaaaaaactatgtactttgagccacgccagcgaggacgagagatgaaggggggagaggctccgtcaccgacggcggtggtgtggcaggacccctgatcgacctcttactggcaggtgacggtgcgcaagaccacgatctcctcaccggcggactggctttacgcctacaaacacactacgggcgcggtggcctttcccctcgagacct

SEQ ID NO: 49214 - DNA, 345 bp, Triticum aestivum
  Clone ID: PAT_TA_49214
gcgaagaggaccagagcttgttgaggaggcactagagaatgctggggaagcttactgttggctctctagataaatttcatctagacatcaaacaactgttcaactcaaaggtctttatgcgtctatcaaaggctgagcaaaatgctgatcaaaaggctcgtgacgacagtgtaagattgctgcagctagagcggcagctagcacttgagtagcgtatgcgtgatatgacacttggtgctcgctttgctgcttacgctgatgtaaagatgtcagaacgtttgcccattcaatgaggtgatcattacaaaaagctgaacagtttccttatggaatttttaattctgg

SEQ ID NO: 49215 - DNA, 200 bp, Triticum aestivum
  Clone ID: PAT_TA_49215
accaaattctgtggtttgaatcgagatgcggacacatagagcttgactcacgatgcccttattgaacacatggattgggagtccaaaatcgaggagcgtgataggcctattctgcatgacaaaacgctgtctgctatgtatccggttgcatcgctcaacgagactgtactatctggtcactggaggcaccatatggacag

SEQ ID NO: 49216 - DNA, 320 bp, Triticum aestivum
  Clone ID: PAT_TA_49216
tgccatattgcgcctcacccgcaaggtggtcccatgcatgattgtcaccgacatggacgtaccctagatccactgatcacctagaatgggaccgaccttcacctccatgataatgtcctgccacaaggcagcgcacttggcgctaaacgcactaacgcgaccgaacggcatcaacgggacactatacaacgtgaccccaacactggacacatagatgacccttacagcgaccaactgcagcaacatcaccaacacgtaaacctacgctatgagaccacggacaccaaaatgcgtacattcgctggtgtatcggagcgcaa

SEQ ID NO: 49217 - DNA, 241 bp, Triticum aestivum
  Clone ID: PAT_TA_49217
tggactaccagataacacgaggtggcggagaaaacgtactgcccacccgtatgaaatggtcatcgcaacattcatatgacacataccataacctgaaacgagtgatagaatgccattaacgtacacctgctaccgatagcaaaagtgtactcctggacactgtctagctaaaggcagtcatcacgcatccggtttctctatctgaaatctggtttcaatcaggatggagccatttttagaa

SEQ ID NO: 49218 - DNA, 325 bp, Triticum aestivum
  Clone ID: PAT_TA_49218
tcggcagaaatggcggcttcgtgtacgcttactgttccagtccagttcgtcgctgcatgctactcctggtgcacttcatgccgagcgtccaggcgattgggggcggttgccatggggagcgctgcgcagacggcgtacgcttcccgagtgaccgtctccaatggcaacaggggactgacgaagatcagcctctaatccgcgcacgcgagtgaggctgagatgtatctgatgggagcgagcgtcacgtcttggaaggatacgcatggaaaggatctgctatacgtatgaccagatgcagtgcacaacggtcagaaacccatgagcg

SEQ ID NO: 49219 - DNA, 261 bp, Triticum aestivum
  Clone ID: PAT_TA_49219
acgcgcaggctaatgagaggcacgcacgacgagaaaaaaaatggattggtcgtcccgcgccggcgcctccgccgctagatctgctcttcggcgggcgccattctccgcctgctggtgctgttccgccggcggaatcctacgcacgtcgacagcggggggcctggggaccccgatgcatcttcacagagcggagttggcggcgctcctgtgatactgcattacccacgattgcaacaatgctatgtgatggatctgcatgcg

SEQ ID NO: 49220 - DNA, 315 bp, Triticum aestivum
  unsure (1)..(315): unsure at all n locations
  Clone ID: PAT_TA_49220
gttcggagacgaccgacgttcgccgtcgttgcggagtggaatgtgtacccatctgtacatactacttcaaccggttgacccgaacctgtaaagatctcagatgcaccactccaccgcatgctgtgcactcttgggtgcatactagtaagccatgttagtacacgtcgaggaggacactgcggacgtccctaggagacgaccgacgttcgccgtcctcgcggcctgtaatttgtacccatctgtacatactccttacaaaaaaaataaaaaaaaaaatatattaaataaaaaaaaaaataaaaatatnttnnttgg

SEQ ID NO: 49221 - DNA, 343 bp, Triticum aestivum
  Clone ID: PAT_TA_49221
tcgtggactcctggtcgtactcgtgggcctggctgctgcacctgcagtcgttactcgtgccgggggcggccagaccgacaggcctgctgcgagactggtgccggtggctacacacgtctgcggtgaggctattgcctgccgctacaacgagacatgctgagtcgacagggaccgtgaagatggagacacgcggaggcgacagggagggggaggcgaggccgtggtcgacggacttcaactcctggtacacggacgcgatcggtgccccatagctatcggtctactgggccgcgcgatgtaccatggccatccggcactactgaatcgccatttgggggggact

SEQ ID NO: 49222 - DNA, 275 bp, Triticum aestivum
  Clone ID: PAT_TA_49222
actaaaacctacaagcgcaagtccacatgttttggcttagacaacgtgctgccaaaccgtatgaaatggagttgtgagcgtgcgtatgacacatacgagaacctgaaacgagtgcctgaatgccattgacggacacctgctaccgatgcgggaggtgtacggctggacatctgtctggagaaaggctgtcagcacgcatgcggtctcattacctggtagctggactccagcaggatgtagcattcttagagtggtgatgacaactggcgggccat

SEQ ID NO: 49223 - DNA, 225 bp, Triticum aestivum
  Clone ID: PAT_TA_49223
tcaagaacccacgtagtgcccatcgtcgtcactggcaacgatttctcgacgttgtacgccactgtgatccgagatggtagtacggagaagttgtactgggctcccacccgcaacacaccgtatgggagtctgcaaggctatcttacaaaccgacaatgtttgcgacgagtacgcattgaagatcgtcgacaccttcccacgacaatgcaccgactctatgggcgc

SEQ ID NO: 49224 - DNA, 184 bp, Triticum aestivum
  Clone ID: PAT_TA_49224
gcggttcattaatttaaataatcaagagaaagtgtgttggcatgccgctgccagctgtgttgattcttcatggtcattatgcatgtcgcgttggagatctgactaactatgatgcatttacacttggaggaccttactcatttaggggcgttcgggtgggtgaactgggtgcatctaacaatgt

SEQ ID NO: 49225 - DNA, 298 bp, Triticum aestivum
  Clone ID: PAT_TA_49225
tctacattatgtagctgtttcaggcgatgcggtgattggcaaaacgacctttgcagctttctgacttgattgctgcaactgggattgcaaaaatgagacaggcctacatcaagacggatagcctcaggaggtcgtgacagaaacagctctggtgtactaagaccagaatgggccatatggatattgattatcaagatccgcatggaccagtcttgaaatatcaaacaatacccggtttgactaggcatggtgatctgtattatgaaaggcaagagttcgaggcgaagctcatggaaat

SEQ ID NO: 49226 - DNA, 313 bp, Triticum aestivum
  Clone ID: PAT_TA_49226
gcgaacaacaccgaggatccgctcctgcggcgtcggcgacattcatcagctattgtgcccgcacggacctacacattcacctatcgtttcgttccaacgcgaccaggaattacatcatgacgcgccttcaagccaggctgcgacatctatgtgaccttttccgatgagaggagccggcagccaggtgcgaccaagaacgataacggaaagacatccacggagacggctttacagagcctgtagaccataaacggagagggctcattagcgcctggacctggctaaaggatcgaacacatgggtgttaagacag

SEQ ID NO: 49227 - DNA, 274 bp, Triticum aestivum
  Clone ID: PAT_TA_49227
tgctgtgctgaacacgccccttttgtttcaacttaggagtgaggcaacggcgtcacttgctccgacaaatatgctcgtgacacagctgaacttactggtatcctacaggtatgccacagcgtctccaactgctggaacacaaaagatcgtctgcatctttgatcggtacaagaagaaacccgccgcgtaggcatagaccgcacgcgttgccagctggagcgtacgcataggagagaagatttgcaagtgggactgccctgacaggaggatgtac

SEQ ID NO: 49228 - DNA, 317 bp, Triticum aestivum
  Clone ID: PAT_TA_49228
gagctgctgcaatcatgacactggttctttcattcaccaacggaaatgaatgggacggtgcatacaccctcatgttcaaggttccaaagccatggttcgtcacgcctttgagcttgttgaacgatgggctggctgacaagctcaacatggaaggctcctgctaccaggccatcttaccagatgagaacatcatgatgacaagctgcgacatcagctggtcatacgaggcgggtggatacccccgcacgctggacattttgagcgagtgcatagacccgacctcggacatgttccacccaattgtcatcatggaggac

SEQ ID NO: 49229 - DNA, 256 bp, Triticum aestivum
  Clone ID: PAT_TA_49229
aacgggcttgttcgtacgtacataacaacgagctaactggattgcttgcatgtcatggaccaggagctagctagattacatatatgacatggtggagtgcccggcggcggctgtgacaagagctccgggagaggttcgcggccaggcagacaaggccgtcggagtggccaccggcacagatgcgaggagttccgacgatggccacggcgatggaggcggggatatgagacgagctcacacgccgacctctatatgt

SEQ ID NO: 49230 - DNA, 283 bp, Triticum aestivum
  Clone ID: PAT_TA_49230
actacatacggtcacaaacatacaaaaaaacttggtacctggcgctagtgaacaagaataaaaatcctgggggaggagtacgacagagcaagccatctacccggagaacgggcgcgaccgtcccttagatccggtaaaccatgtagttctggtgatccttacagccggtgatccacgggatgatcacggaccttacggacgatgtccggcaggatgagtactgcgactacttagcatagccgctaggagcctttcatggagtccgcgacatatacgatgtaat

SEQ ID NO: 49231 - DNA, 253 bp, Triticum aestivum
  Clone ID: PAT_TA_49231
tgcgtagcgattttacattagttcaggtcattcaggatacattgagagcgcgtccacaaaggcgaggatggagatactaccagcacggccccggagtgaatataaaagacaaaccacttatgggggggacccaatgctggcgtatatgacctgatggacgtaacgatatgctggactgtatgatctgatgagcataccgctctgtgccaagggctatcataaaaagtggtgcacaccatggaagccgtaaacc

SEQ ID NO: 49232 - DNA, 257 bp, Triticum aestivum
  Clone ID: PAT_TA_49232
catatcaaagggtagatccaagcgtacgagccacgctctcaaaacctaggtcccactgcagtggccagcgtgtttctacccacgacaatctgctgatgcgcgcatgtagctgcaatcgagaagcggatgcagcgaaaaagcatctaccatggcgacccgtattcaaatcgaaaacaaccgtaaagtcggtgtgcaatccaaggtcacaaaagcctacagagtgcatgcaattggaggatcagagaatttatacagtg

SEQ ID NO: 49233 - DNA, 223 bp, Triticum aestivum
  Clone ID: PAT_TA_49233
tcgcccacgcgagcgtggacgcgtgggcgagccttggtcttgtccagcttccgttgcctgtctgcaatcgatgttgacctaccgacgaagactatcggtgatggaggtggtcagatccgatgaagagaacgcgagccagtgctgcttacatccctgtagagaagggcaacagtagctgggccaggcacatatgcctggtcctagccgcgtggtggccgacaca

SEQ ID NO: 49234 - DNA, 182 bp, Triticum aestivum
  Clone ID: PAT_TA_49234
tagcatcctcctctacggctataatacaatacaatggcccacgccgtgataggttcaagtgctaccaccgtctgaccgttagacaggcttaagaccacagccgttctggccgtaagactgcggtacagatgaagtctatgcaggggcagccatgggaggaggatcaggtgcatgcaagcgtg

SEQ ID NO: 49235 - DNA, 362 bp, Triticum aestivum
  Clone ID: PAT_TA_49235
tcgattatgagcagatagtatatgtatatatcgatatttcgtgcgctccatatcatattcatctattattggacataccctacataacatatacaactattcttggttgagggttttgcgaccccgaagactaattaaattagcggtttctggaaccccaaagattcaatgctatatggatatggcaaatatcagattcccgatcctatctggaaacggcggggagcacatacccaataggacataggacccttgggaggaacttatgggaacggacttgaaccgaaatgctattatttatttgaacataaatctaatgaaccttttatattcttttaaacaaaaatgtaataaacgaaaat

SEQ ID NO: 49236 - DNA, 310 bp, Triticum aestivum
  Clone ID: PAT_TA_49236
tcgtccacgcgtacgtcgaccaacgcgttcgtattcattcattcgaagtacaatcactacatttgtgtaacagctctgcagccatactccgtccaatggagaaacagactagacggcctggtgggggcattggcatggcgaactagacaggatggaggcggaccgcgaaaggcggacgctggatgtctgggccgcacccgtggggcgggacgatggacatatccaacgccgtctccgcgacggactagaaccggagccggtacctgagacggagcaccatgatgcggtagccggtggacgagacgcagcc

SEQ ID NO: 49237 - DNA, 104 bp, Triticum aestivum
  Clone ID: PAT_TA_49237
gtggtggtgaccgcccccatcgagtgctagggctgaagcaccagacacgcactgtgggtgttcgacctcaagtccaagatctgtaccgttgtgcgatcacctcc

SEQ ID NO: 49238 - DNA, 253 bp, Triticum aestivum
  Clone ID: PAT_TA_49238
agcccacgcgtacgccaagatacatctccctagcaggcacatacgacgcgcgaagcaatatatcctgagatagtctatggaccatgggacattcgatgctaatgtgctgcatgaacggcgtggcctccggcaggagcctgctgtatgcggggtggccgtcttctgcgtgcactcccttgtggagtatagcgctatgctggtcgtcctcggcgcggaaatacaagcacatgccgtgaatatccatgcggaccat

SEQ ID NO: 49239 - DNA, 172 bp, Triticum aestivum
  Clone ID: PAT_TA_49239
atatgcacgcatggtgacatcatcatgctcgctcacatggacactcattgagctgagcatgcacccagtgtgtctagagcaggcacgagaggaagtgttgcctcacttcggatgaaccacacctgattgtgagaacttgaggcgcctgaagagtgccacacagattctttat

SEQ ID NO: 49240 - DNA, 182 bp, Triticum aestivum
  Clone ID: PAT_TA_49240
ggatttgatcgcaatgtacaggacgagccatctggggttcaacgatgatattcagggcacactataattggccctggcaggcctgttgaccacactgacgatgatcttgggacgccttggggatcagacctacctgttacttggtagctggttaggctggaactggcatagcagacctcatt

SEQ ID NO: 49241 - DNA, 256 bp, Triticum aestivum
  Clone ID: PAT_TA_49241
acgagttctcttggttctaacccaccacatactaagaatatagtatagtatcaagccaccactagctttgtttcttgctgagcatcaatttcatacaatcctaatatcaccctgctagcagcgctgatcagctctaataacactctgatacgaatccactctatctccttgatctaattatccatgaaccactgggatctcatgaatgcaatcaggcgctactactggtagctgctggctgacctagggagctcct

SEQ ID NO: 49242 - DNA, 216 bp, Triticum aestivum
  Clone ID: PAT_TA_49242
taggggtgcacaatggcctcctgcttactgtgactacggctccgtacttcctgaatgcccaacgcgacgtcgtacggggcattccggtatcctctactccggtccggaaggtgcgacccgctgtcctctaccctcgcggcgcgtgttgtcaagccggcggcggaggcttcgtatccactgtagaacctgatgggcgacaggatcctatgcacgcta

SEQ ID NO: 49243 - DNA, 139 bp, Triticum aestivum
  Clone ID: PAT_TA_49243
tctgaaccacgtgtaagcctacgcatctgtgcgctatccatggaatctaactgtacaaggctgtgaaggacctgtgcatgctccgtgagcaagcccgtagaagcattagcttcatggcgggagcgatttccgaggaaca

SEQ ID NO: 49244 - DNA, 193 bp, Triticum aestivum
  Clone ID: PAT_TA_49244
tcgcgagacggatacaaaaaagaccctgggacagtccgcagatgcaattccactagacccaggcacaggccggaattcaacacccacttctcccatgcaatacctaggatccaacaccacgctagtagagccagtgcctaatccaggatatccgtctaggagaggcggcacctcaccgaaggtggcggttccg

SEQ ID NO: 49245 - DNA, 212 bp, Triticum aestivum
  Clone ID: PAT_TA_49245
ctcacgcgttcgcccacgcgtcagcttgattctcttcctcgagtacatgatgtcacacatccactcgatgcctgaagtagatcatctgtaacatcctcgcgaggccagacggcagataccttgaatgctaacgctgaggcaggccttacaaagcttgatggctaccttccgaggaggacttacattgtgtggataccaagcttacaaggatg

SEQ ID NO: 49246 - DNA, 272 bp, Triticum aestivum
  Clone ID: PAT_TA_49246
tcgggatgctgtatcgacaactgaataatatgtatggtcatcagtgcaattagtatgttcaaggacgaaacaccctgctgacacgagctttgaccatgtcataaggcgcggacaatgcggagtcggtccgaatatttcaacacaaactgatggagaacgtcctgcctatcgttttaagaccttagagagcgtctggagcaatattgctggaaacgattgagtctggcagcgtagatatagatagttcttggggagttatcttgtattgcttc

SEQ ID NO: 49247 - DNA, 365 bp, Triticum aestivum
  Clone ID: PAT_TA_49247
gctaaggctcctggtcaccctcggtgccaacgtcatagaggtcggcatgcaggtctgcgagccctactccgacggccacgtcatccaggcattcgttgagcggtcgctttcgggcggggtgtcaacggacgccgcgatggccatgctgaaggaggtgacgccggagctgtcctgcccggtggtcagcttgtctgacttcaacccaatcgcgcggcgagtaacggggagcttaaccgctagatccagagaggccggcgtacaaggtgctgttcacagcaccatttacaaaggcagacatgatggatgagatcacaattgctttcgcagggtctgttgaccgtgtaagtatcaacggaagtacagga

SEQ ID NO: 49248 - DNA, 350 bp, Triticum aestivum
  Clone ID: PAT_TA_49248
ccattgttggtggattttatttttgtcaggtcggacgggcgcgcagccgcacctgttaacatccaatttcacaagaaggtgctcttgcaggataagccgagtgagcacctcggctgtgattttgtttgaaccaatatcaacactttaattggctctttgttatttgagatcaaatctgaagtaccacagttatgaccatctcttttcacgcgctgcatagtattggtgagatggtctaaaataagatgaagaatgtgcccttgtattatacatatcccatgatggatatggatttacatgagcataaggaggtatccatgacattggcattagcggcccaaagcaatagc

SEQ ID NO: 49249 - DNA, 401 bp, Triticum aestivum
  Clone ID: PAT_TA_49249
ccgcctgcaggtccggccgtttcggcgttcgggtaggcgtaccgtacgcgcacgcgtacgcccacgcgtacgcacgggccaaaaaacgggcatggcaatgggcgcttacttcgccgaccgtcaccatcacgggcacctagccgtcggccttccctacacccctcaatcgggcggaaggactagccggatcggtgccaccatctgcatgaaggctcataaaaagcagagccaccatcctggaaatgggaaaggggacggggaccggcgagctcagccgtgggcggggagggtggcgtcaccggaaactgaccaaagaggatgacatgttgcgtgacaagtctgaacgtatacctttctttgttgagctacagggagaagcgcagggggttgggaaacttgtg

SEQ ID NO: 49250 - DNA, 430 bp, Triticum aestivum
  Clone ID: PAT_TA_49250
cccacgcgtccggactagttctagatgcgtcgccggccccagttctcctgccgcaccttccacaacatcattgtcctctccatcaccgctgaggaacgttatttatcgagttttggatcagatgcggggatttctcctgaactccaccgcctcaagctgtcgtagttggtgttgtctgtgctggattcgattggcctaccattttctgctaccgtgagaggttggtccgctgcgggtgctcgtgcttctggtcgattcgtcctgctgcgtcggtctttgttctgcagggccatgtctgttggtgccatgaaacggccgtggcatcgcttgtgtgagccacgacggcgctacccgcgcgcctgccccaaaacgctgccccgagccgagccggcggcattcatctggagaagcgcgggaagaagaagatgga

SEQ ID NO: 49251 - DNA, 409 bp, Triticum aestivum
  Clone ID: PAT_TA_49251
cccacgcgtccggttttaaagtcggtaagctgcaccgcccctctccgccccgcgaatctcgccgccatggccgccgcctccgcgccgctgctgctcgccctggcgctcgcctgcgccgcctccctggccgccgcgggggacaccaaccgcgtctacgacccttgcaccgacaccaagatccagcgcggggacggcttcaccttcggcctcgccttcgccgccaacggcgccttctactccggctccacccagctctccccctgcgaccgccgcctcacccagctctcccagctctccctcttgcgccccaaggtcgacgagatctccctcctcaccgtcaacaccaccactggctttagccccggctcaagtggtgggtacatggtagcatttgctggcaggaagtatg

SEQ ID NO: 49252 - DNA, 278 bp, Triticum aestivum
  Clone ID: PAT_TA_49252
cgcgtacgcccacgcgttcgagacactagtgctgctcgtcaccaaacctttggaaacttcactggtgacggatggaccatggcttctgacacttccttccattgccattattacgagagagatcacaatgtcagctgttagagagcgggctagggctcagaatacccaaattcttgaggctgtggcagtctacaatttacggaatgtggacaacagcgacccatatgacaggattgactgtgctccttgccagcacatacccgagtctacactttcaa

SEQ ID NO: 49253 - DNA, 460 bp, Triticum aestivum
  Clone ID: PAT_TA_49253
cgagcgcgaggacacttttcatgtgtttcgcaggtgccctcgggcggtgcatttgtggcggactatggcggaggtgtggagtataccggacatcgagtcagtctataacaccgcacagagtggctcctgaacctaattgtagaaagcaatgaaggggaccggctgcgcctgattatgctgttgtggagatgttggcatgtgcgcaacgagatcactcatgacaaactggcgccgcctgtggaggtatcccgtcgccttttgcagagctacgtaacctcactgctcgggatccagcagtatccacagggagattgggacaaagggaagatgaccatcgaacaagaaggtgcagaacaacctatatcacatgtgggaggtgtgccacgaatagtccacaaatggagtcccccacccgccaactggacgaagctgaatgtcgatggcttcttttcccatgatg

SEQ ID NO: 49254 - DNA, 396 bp, Triticum aestivum
  Clone ID: PAT_TA_49254
acgcgtacgcttgtgtttagactcgctcttgccaccgcattgattgagcttctctgctgtccccaggcagggggacttcgtcgacgaacgcgccgaatcccgaaccccgtatctgagattcgctcgttagaacacattgcactagcccccacgtccacatatcgctcttttttctacacaccgtgcgctttatgcatggcctgaatggcaccagagggatcccatgttgacgctaagcagtatgacagcaacgatgacctacttctgtaccaaggtgactctgagtgagccttcacctcatatacactaggggcatgaaagtttttatgacaccggtcgccaagcgaaccgtatgagaggcatgcacacatataggtttgagaagccatcatccat

SEQ ID NO: 49255 - DNA, 407 bp, Triticum aestivum
  Clone ID: PAT_TA_49255
cccacgcgtccgcccacgcgtccgggccgtcttcgtctcgacttgcttcccctccgagagaccgacctgcccccatccaatccatccactttcctgcaaagggttaggggagaggcagggattcggctccgctccacgccaagagtagcaaggatctctgattctgatttgagagcggcaagcatcgaatcagccgacaggaggaggtctcgttcaccgacccagcagcagccatgagtgccatgaagttttgccgtgaatgcaacaacatcttgtatcccaaggaggacagggaccagaaggtgctcctcttcgcctgcaggaactgcgaccaccaggaggtcgcagacaacaactgtgtctaccggaacgtggtgcaccacagcgctggagagttcacccaggtg

SEQ ID NO: 49256 - DNA, 193 bp, Triticum aestivum
  Clone ID: PAT_TA_49256
aaccaatcgacatggtcatggttgatctccaccgtcaggttccaactggttttgatccgtttgctgtagcaaatgcctgacgacttcggagactgtgcttgatcaaaaaaccttggtcctggacctgttcagcggggccacggaagaaagagtctgaccactggtcagggcttggagaaagaataccggttcc

SEQ ID NO: 49257 - DNA, 430 bp, Triticum aestivum
  Clone ID: PAT_TA_49257
gaagaaatggagaataatctaccagtcaatatttgtgagtatgaagaactcgccaagaaagcactgccaaagatgcactatgattatatcaatggaggagcggaggatgaacacacattgagggacaacattgcagcatatggaagaattttggtgcgacctcgttttcttgtagatgtcagcaacatagacatgtcaataaacttattgggatatgacatgccctcgcccataattgttgcaccaacgggatcacacatattggctaatccagaaggggaggtggctacagcaagagctgcagcaacatggaataccttaatggtgctatccttctcaaccaggtgcaaaatcaaagaagctgccttcagttgtaatgccattcgtttttaccagttatatgtgtttaaaaaccaaaatattttaacaa

SEQ ID NO: 49258 - DNA, 410 bp, Triticum aestivum
  Clone ID: PAT_TA_49258
tcctgtgcctagaatgcgatggaacaggtgagcccaacattgaaccgcagttcttggagtgggttggcgaagacacaaagtgcccatactgtgaaggccttggctacactatatgtgatgtttgtcaagggattaatacagtgcacagctaaagcagaagaagaatgagcaacattcagccttagttcaacgtctatggcagcttatatagatgttaactaactattccagttttgtcgcaacatgttttcagtaatataatcacattgtcatactaaagaaaaaagaaatataattacattgctatactgaaactattattgattaagtatataaaaataaaaggttaaaattaatttaaccgatctaataagtagaaagatttttttaaggggggggcgttttaaagg

SEQ ID NO: 49259 - DNA, 225 bp, Triticum aestivum
  Clone ID: PAT_TA_49259
taagcgggtcccaggcgtacgggagcgagctgaagtgagactggccaaccgtgcaccaagccagcactgcgagactggcgacgcttgcagagatccatgagtccggggcgccggacacttgagaggaacggtgaccgcagcacggcggcaatccgacagggctggagacataagcacgccggagctcggacaaagctgaacagaccactatgcttctgctcggag

SEQ ID NO: 49260 - DNA, 305 bp, Triticum aestivum
  Clone ID: PAT_TA_49260
acaaggagcaccatcctttatggcatgcattcaaatctgaatgatcgttcataatggatacattattgcatttgccacagtgatagagcaaagcattatctctgtacatggcaatgtttatgtttcgatcaatctctcttcagcactatatgcaccaactgtggaaaggaataatacaacggttgggatcgcctaaggcaagcccgttatcgatgacacgaacatgccctgctatacccgaattttcagcatacaccggtgcatgttcttctcccggaccgagacgttaaccgttactagccccg

SEQ ID NO: 49261 - DNA, 180 bp, Triticum aestivum
  Clone ID: PAT_TA_49261
acgcccacgcgtacgcccacgcgtacggacccacgcgtccgtaagctaagctaaacagcagggagcaatggcgtgcacgttctgcttactacaacagtgcaccgggcgcctggtcgtcttggctcgccctgcgcacggcgtgggtcgcaccctggtggtcttctgcacggcccataagaa

SEQ ID NO: 49262 - DNA, 307 bp, Triticum aestivum
  Clone ID: PAT_TA_49262
ggtagcaccaggcgtaccgcacccgtacgaactaccctatctagccgtccgtgcacccgttcatactaccgattgtcgctgtcaacggacccgggcatgaagcgcgatcagggggcaccacgcatgtgcgctgtagtggcttaacgggtgaccaggcatgtggacggtaactgcataaatgctatcgagggccgcggacaggaaacgactgaacgtcataaccacaagtgggacagaaaccactacactggcaacacacaagtgggacacattgtgatagacagaccagacaagcatctgacgcctg

SEQ ID NO: 49263 - DNA, 277 bp, Triticum aestivum
  Clone ID: PAT_TA_49263
ccaggcgtacgcaattcacgttctccggcatggccccagccgtgatggcttacttcgtcaccaccggcccgcgcttcgatgggctcaagtggaccgacggcctcgccgttagacggggttacggcagcggcgggcttagcagcgtgagcaacgtccgaaggatcagatgcatgcaggtgtagccgattgagggcgttcagaagcacgcgaccgtggcctacttgccacccctatacactgaagaccttctaaaacatgtcgactacctgaaccgatg

SEQ ID NO: 49264 - DNA, 418 bp, Triticum aestivum
  Clone ID: PAT_TA_49264
cttccaacaacacaagcttatccatgacgatgaggaagcgccccttgtcctctcttctcgtaagagcggtgctgtttatgctctttccagcgtttgctcttgctgcggggaggcataacctgagcactagagaccctcagtacggcccacaggtgaacccaaatctataaccactgccaggaaaacagccagatccaaaccctcaaccattaccagatccacaaccattgccaggaccacgaccagacccatagccacaaccgctacccgagcctaaacctcatacaaacccacaaccactgtcagagccacaacctgatgcaaacgctcaaccattaccggtgccacaccctgactcgaattcacaaccattgccaggccaaaacctgcatctgttgttgaacccacaacctaaccc

SEQ ID NO: 49265 - DNA, 298 bp, Triticum aestivum
  unsure (1)..(298): unsure at all n locations
  Clone ID: PAT_TA_49265
tttccttctcgccctctacctcctctgaagcaatcgaccgagcatctcttcttcttcttctttttcttcttcttcttaagcagtgctgctcacgccaactctgcgggccggccggacgcacggggatctgatctgaaaaggcttccgaggcagaccaggcaagtcgaccgatccatccatcttggggttggaatcctgtcgtggtgatcgatcgagctccatgatgaatgtgctctccagcggcataatccatcaccaccatcaacacgacattntattatgtccacggcggagcagc

SEQ ID NO: 49266 - DNA, 169 bp, Triticum aestivum
  Clone ID: PAT_TA_49266
tcgcccagccgtaccgcacccgtattcctggggagacccattcgttcaagcactcttgcgtgttgcttgtgttaccacttacagagtcataagggaggggcttatgtcaccgctgacggtaactattgtaggtggtgtttctacagccgatggtatagatcataagatg

SEQ ID NO: 49267 - DNA, 205 bp, Triticum aestivum
  Clone ID: PAT_TA_49267
tcgcggactcttagttcttcccgagtcaggaagatctgagctaggggcagtcactgagatcattctaaaaagatctcatgcccaatgtaaatcgtctactcttacaatttttatgcagttatacatgccaagatgggataaattgcatacatttatgtacgacgatacattggacttgaactaagcgcactattgatgttgaaca

SEQ ID NO: 49268 - DNA, 353 bp, Triticum aestivum
  Clone ID: PAT_TA_49268
gactcactaaggataagctgtccaccagacgtaccggtcccgtattgagacctgcgacccacgcagtacgcggacgctaggcgagaccgtcgcgccggtggagggcgaacatagactcaggtagcctcatgatgatgcacgtacatggagacgagttgcacgcggaggttgagcgcgctcgaacacgattcggacacgacactcgagcgctttcgaccgcagtacggcccgaacaggccggcgcatatcacgggagagacgaccaacacgaccacaacagaatcgtcaaacgacgacaacgattacagagacagctttgccaactgcacgatgggatcaacgagcaagctgag

SEQ ID NO: 49269 - DNA, 328 bp, Triticum aestivum
  Clone ID: PAT_TA_49269
acgactcactacaggattagcgtggtcgacccaggcgtacgcggtacccgtgtttcgtgacagaaccacgcttcaccccgcacttttgctgtcacagaagcagggggtacgccgttgcatcgatcgagctgccacgccaagcgtgtggccggaccactggtgcattgtagccatgtccgtcgccggacgattgacccatagggccattgtcgtatgcttggccgtgatcacctggatccatatcgacacggtcaacgtgaagctgcatgtgcccaagaaggacatcggccgggatattgctggtcccaaataccgtgacctgctagga

SEQ ID NO: 49270 - DNA, 393 bp, Triticum aestivum
  Clone ID: PAT_TA_49270
cccacgcgtacgagaattcttaattcaagagtcatagggagggacttatgtcaccacaaacagaaactaaagcaggtgctggatttaaagctggtgttaaagattataaatggacttactacaccccagagtatgaaactaaggatactgatatcttggcagcattccgagtatgtcctcaccctggggttccgcccgaagaagcaggggctgcagtctctgccgaatcttgtactggtacatggacaactgtttggactgatggacttaccagccttgatcgttacaaaggacgatgctctcacatcgagcctgttgctgaggaagacagccaatggatctgttatgtagcttatccattagacctatttgaagagggtttcgttactaaca

SEQ ID NO: 49271 - DNA, 253 bp, Triticum aestivum
  Clone ID: PAT_TA_49271
tcactatatacaatcttaaggctaagagaacggctcacttgactaacaggtgagaatacgagaaacagtgcgcctgtcgaacagtctgttcagctcgatccagtgcgcgatttgatgggccttatggtatagatccgttacggtcatggttagggctaaggtggatatggggcctgataaaagctacgtctagtgtgggtactggcctgcgtatgacgtcttatcgttctctgtactatagggtctatggaga

SEQ ID NO: 49272 - DNA, 212 bp, Triticum aestivum
  Clone ID: PAT_TA_49272
cgtacgcgcacccgtactcacgagacaaggaacacttgcatccacgccttccatcaatacatggcagagctgctccatgtgcaaaggtgactacgctgaagccataatgcacatagacagcggcccaggctgctgccagtgccggccgtgcaccttcatcaacgagctcgggctgcggctcgtgctcgtcgagaacccggaccccattatgt

SEQ ID NO: 49273 - DNA, 250 bp, Triticum aestivum
  Clone ID: PAT_TA_49273
agagctcgcttgctgaggtgcatggactgaacgacggactacgcgttagaagcgattgtcatctactacagtacaagtgtatgctacgcaccttaaatgctgacgtgcaaatcgatgccaaccacaccataagcggacgcggagataacatacaactagaccataacagtgacccgctaaagcatccatgtgccgtgctacagatacacattcaaactgacgtgacccgagctctcgatcaacatcccca

SEQ ID NO: 49274 - DNA, 289 bp, Triticum aestivum
  Clone ID: PAT_TA_49274
acgactcactacagggaaagctgtacagccagccgtaccggtccgcaatcgccggatgctcccacgcattctgacttagcaggcgtcagatgctatctgggacactgactcttaggcccactggcataataaccaacaccgatgaccaacgccactgaataacgaaccaatctcgactacgaagtgtgtctatcaacgacactgtcatgaactaggtagaactacaactgcgacaacagggattaaaccgatataacgtaccttattgacgacggaacaaacccacact

SEQ ID NO: 49275 - DNA, 228 bp, Triticum aestivum
  Clone ID: PAT_TA_49275
cgactcactacaggattagctgtagaccaggcgtaccgcacccgtactgatgctgccagccatgatatgctcgtctcatagatttactcatgcatgtgctatgctgaaccaattggaactgcgaaacttgtacatggctcataccattaggtactgtgtgactgatggtgcgtgcttctatgataaccgtttgattgtagagctaatacactgcaacaaaccccgact

SEQ ID NO: 49276 - DNA, 393 bp, Triticum aestivum
  Clone ID: PAT_TA_49276
cccacgcgtccgcccacgcgtccgggtgtgctgaaggcgaacataatcaagttcgagcctgagctgccctcctggaagagctccgccatcgcggacctcggcgtcggcatagaaaacaaggtcgccatgcacttcgacaaggccttctggcctaatgtccaggtgctgggcatggtcggccctacgccgaagacctgcggctacttcccgaactcgctggggtcctactcgtgcgacctggtggggaagccgtcggttcgcccaggatgtggagaagctctcagacaaggaggccgtggaactcgtcatgtgtcacctgaggaagatgatacccgacgccactgaacccagtcagtacctggtattcgggtggggctcggacccgaacttcgc

SEQ ID NO: 49277 - DNA, 412 bp, Triticum aestivum
  Clone ID: PAT_TA_49277
gattgaaatgcctatcgacaaagctatggagacgctgctgcggttgggtctggtggttgagctgtcaactaatggcagcagctcctccgtaatagctcttccatgtccagacgcttatgagatcctcaaaggccgctgggatagtctgctggaacataagacataacaaggttagtaaacgttgatgaactctaagcatagcatagctcttcggcagaggtgtagtaaccaagtaaaggattgtgtgatggagaatgctctttgaagtggaagggctttgcctaagatccatgctgtatgttttgcagggtgatgaaacctcgctatcaagttttgtttgtacagcggagaccgaaattacagtgtagtcaagatagctgatgggaactgctgctgattttgcttgatctct

SEQ ID NO: 49278 - DNA, 433 bp, Triticum aestivum
  Clone ID: PAT_TA_49278
ggtgtatcgcctgaccccatgatgagcgccaagctcggcgcggcgacgccgtccgtgctgctcacgccctgccctgggccccacggcctccgtccctaccccaccgccgcgtcatgcctgcccgacaccgtcaccggcccgcctgtaagcgcgggaccggaccaagagcactctggcgcgcccgggcaagaggaggcagcggtcttctgcccctcccagccgcgctcgggagcgagctcgcagctgagccgatggtcccgcgcgcgcgctctccggtccggccggaggctggagctggcggccatacgggcgagcgcggcgctcgaggtgccgaccaagtcgtcggcgcccaccgagcatgaggccacagcaacggatgacgacgaccatggcgacgaggcggttggggtcggaagccaggcatcggggaact

SEQ ID NO: 49279 - DNA, 307 bp, Triticum aestivum
  Clone ID: PAT_TA_49279
acccgtattgcgacatagacccatgcgttcgatgacgcttacggggacacacgtatatggacctccatgctgctaagcagctcagatgtatgcttatactgggtaaacaccaaaataaagggcttctgtatatggagtgataacacgcgaccgcatgtgcacatgaatgaatgttgccaacatgggtgttcctttgagatcaatgtgaataacaatatgtggttctgggctagaattgtatattaccgaacttaaaaaatatgcagtgcgaaagttatttcccgggcttacagtaagaaagtggaaa

SEQ ID NO: 49280 - DNA, 188 bp, Triticum aestivum
  Clone ID: PAT_TA_49280
cgacagaacctgcgtgcgtcgcacacctaccgtaccaccacaagagcacgccacgcacagatttcattcactgataagagaattgccgcgtcgtcgttgctggactggtcccacatctccagcatcagcactaccagatccgcctcggatgatcacgacgacaaccaccaggtccggctgggatggtc

SEQ ID NO: 49281 - DNA, 404 bp, Triticum aestivum
  Clone ID: PAT_TA_49281
acgatctagcgcttgtatttgcgaaccctggagtagaatcttaaaaaaaaattcagtcgattgcgattatgatctcgcattcttcaatttagataatagctatattgatttcgcattcccaatattattaatgctatattctatttactgctacagattactcccggaattatgtatggatgggtacagatttatccatcattctaggatggccagctttgtatattatgaacttagaagataggctgagcttgttatttccttttcttagttgaagaaagtggacagaacattccttctatttgaggaatttagcgaacagaccatacgtacaaatgaagtctttcaccggtcctacaaggcgtctgactgcatctaaaagaaaatactagggcggacgtttt

SEQ ID NO: 49282 - DNA, 375 bp, Triticum aestivum
  unsure (1)..(375): unsure at all n locations
  Clone ID: PAT_TA_49282
actacacgtacagacgcgcgcgctagtgttggcaaatacagggacatgcagtgagcgtactgctggaacaacgatggggctgttctcatcattgtgctgcaccgccgtcgcagctctttcctggaatgtgctggccaggccccggagctccttgctcggtgctgccggcaaggcgggngcgtcgagagcgtcatttggcgtgcgcgcagcagcgctcgtgaggggcatgtggttagccgtgagcacgacttctgcgtggatcgacgggagccttgatgcagacttgagatctgacccgtgaactttcggatccgacccggagagcttgcggtggaacatgcaggcggagctggtgctctgcctgcgggcgatgct

SEQ ID NO: 49283 - DNA, 384 bp, Triticum aestivum
  Clone ID: PAT_TA_49283
gcgccgcatattgcatttcacattgatgatgaaggaaaccttaacggcactgcacttgctcaagagaacagaactcaactgtctgtagcgatcaatgaggagctcttctactttttgtctagttatcaccttgttcgcattttactagttgattgactgcaacgctatacccatgtcaagagtgcagagactggtgccattgcaacaagtcctagagcaagtaccatcattcatagaaagcacttctaagacaatgatggacacggctagacagatcctacactatgataccatgaacacccgcacatggatcgcactagacacgcaagactacccgctctgaactgcgatcaaccaccacaagtcaccactttgatactgatc

SEQ ID NO: 49284 - DNA, 147 bp, Triticum aestivum
  Clone ID: PAT_TA_49284
acgctgtatgggcagttagcccatggccaccgcaaacctgtcaaccttggtggtctaggctgaccgcaggacagatagcatgtaggccctgccctggcccttggatagcttgaggttaaggcaaaaccgggctttgtcagtgttcta

SEQ ID NO: 49285 - DNA, 229 bp, Triticum aestivum
  Clone ID: PAT_TA_49285
tcggacacttgtctcgtgccgtaccgagagaacctctcattcgcgattggcgtgataaagaccgttacactccgtcgccatgggcacgatagacatcggaatagacggtttctgaaggatcgcgaggctcgtctccagggtcgccctgcagagcgactatgtagagctcgcatgcgctaactacccatgtatcaccaccgagtacatgacctacatgtcaaagtcctac

SEQ ID NO: 49286 - DNA, 313 bp, Triticum aestivum
  Clone ID: PAT_TA_49286
atgccgagcaagctcattgacctgtcaacgatgtacgacatgcaatgccagacaacttgctaggatgattcctcttgcgggccataaaaatagctaggcagacgtatttcgacttatcgtgatacgagtgatgcatacttcctcctacttatgacgtaccattaactaatcaaccttgtttataaaacctgactcataactatgctatatcctaaaaggtaccgcctcagctatgtactaaagcctacgaggtaaacgctgctgatgattgctgagctggacgttttgctgctgcatatcattgcagggttgt

SEQ ID NO: 49287 - DNA, 159 bp, Triticum aestivum
  Clone ID: PAT_TA_49287
tcacacgcgtccggctaaggtgtcagggcatgcatcaacagcttatcgtttaggtatcatgacatggcaagacacctaatcccctcgtgatcaagatgcttgaagaccagcgcaccgaacctgattaacattgcagaagacgagcgcctgataactgtc

SEQ ID NO: 49288 - DNA, 261 bp, Triticum aestivum
  Clone ID: PAT_TA_49288
acgatcgcctacacgtccgtctacacggcctagaaccatagcctgctctgcgctatccacccgatcgaactgtacaaagctgtgacggacccgggctagcgcgctgagcaagcccgtaaagggactaggcttatggcgggagcgctttccgaggaacatgagctggatatgcgcaagaatgtgctgggtcagcttgtcgtacatgagcacgagggagctgataaacctggtattgttgggcgctatggctctttccacctt

SEQ ID NO: 49289 - DNA, 306 bp, Triticum aestivum
  Clone ID: PAT_TA_49289
acatacgctctatcatcagatcagccacagaagcacacaagcactagctttagcttgcaagactgagacactcagggcatatgttcacatccacgacggcgatggtcaccggtaatgtccacgaacccgacaggcgcgctgacggaggaggcgcccgcaatacagacgacgttcgccgcccaggaggcgccgaagacggaggatgtgcccgcgccgacggaggcgcaagcaaaggcgagtgcccccgcgcaggttgaagcgaccaaggcagaggcaccgagcgccgatgtgacggcggacgccaag

SEQ ID NO: 49290 - DNA, 299 bp, Triticum aestivum
  unsure (1)..(299): unsure at all n locations
  Clone ID: PAT_TA_49290
aacgattntgcgggaaacgcgactccaaccgtggaaacactcttgccgctcctggtcttccaccttgtaaaaaggctgggccgtcgtcttcgtcctcctcctacgatggccgggcggacggatcgacccggcggcggcacgggcggggcgccaggaccgagcacgacggctacagcatcgtgcaacagctaccggcactagtactacgacattatcaagaagtcagcggaattggtcgtccggtcataacaggaggccagatggatacggcgaccagcatggaggggagtcaacatgga

SEQ ID NO: 49291 - DNA, 356 bp, Triticum aestivum
  Clone ID: PAT_TA_49291
tgtaccggtggtgaatgctactttatctgataagctgacgcagccgggctccatcgagtgcagataaccagacaaagccggccggtatggtgcgcgagagtcaaggacaataaggaagcttgacggagagagaggtgatgaacgctctgcaccaggactggtgggaggaggaggtgcgctcggcgctggcgatgattccagtcacgatgctatttgccgagtgctacgactgcacgcgtaacatgattttggagctgctgatgatgtgcaggtaccacgtttactcagctaatgatggtgtcaaagactgctaattactaatggaaaaatacttcataatatatctgggtctcact

SEQ ID NO: 49292 - DNA, 390 bp, Triticum aestivum
  Clone ID: PAT_TA_49292
tcggtttcatgctgctggtcgtgctgatagatggatgtggcatcgctgccattgctggaggaagtcgaaatactcaggaccatgatgggtatatgaaggcacatacgctggaccatggttgaatggtgaggcactgctgatgctggggaggtcccaaggatggatggcaagccacggccggtcgagccgcaccatggaagaaaagctgtgatggatggaggtgaaccggaccgacatgaaagctatcgaggcggcgaaacgggacagacggatgagatacaggattagtgagacgccatgtacagaactaacaaacaacgagtatatgagcatgtggagaagacacgactcacaactatggctggccgaggacacgagggcgatgacaac

SEQ ID NO: 49293 - DNA, 269 bp, Triticum aestivum
  Clone ID: PAT_TA_49293
gcgcggacgcagtaggagtatcgcatcccgcacggggcgaacgagctatagagatggcatacttccgatggagaaggggctctcgctggtggggccttcccattgttaggtcatacgcgctcggtaagctgggcccctccttgtgcatctgatccggctgccgcgaatgcgacctggattgcctgatttacagctcaggaattgaagctggattccatggtttaacaggtaatattctgagcctattgctggatgtaaaataatgaata

SEQ ID NO: 49294 - DNA, 252 bp, Triticum aestivum
  Clone ID: PAT_TA_49294
atctggatcgacatcacgtatccaggataggaggaactacaccgccatctggtagccacgataggacgctttacgatcccggttcgctgaaaccacgccgagatttcttatcttgtttttctccggtcacgctgcgatagtctggcttgtttataccgcgtctcgctaccagaataaaacacgttcacaccttccttggacacctactcaaaagatggtccatgcttccttgctggcgtactgtggaactct

SEQ ID NO: 49295 - DNA, 142 bp, Triticum aestivum
  Clone ID: PAT_TA_49295
acattcgttcactcatgagtccacgcgtgggacgagagtgatcacttacagagtcataggcagggactgatgtcaccgctgacggaaactattgtaggtggactatctacagctgatgttatggatcttaagatgccttact

SEQ ID NO: 49296 - DNA, 179 bp, Triticum aestivum
  Clone ID: PAT_TA_49296
taagaagaagatacgccgctacgcatccatgcatgacgcacgcgatggcctgtaccgcgtccgtgtctagaagggcagggcccttgtgcgtctgccggctgaaaaaggccacatggctccggcccctgtcagtggtcaggggcgcgacgcccgctgcgaggatgacaggcgtacgggcg

SEQ ID NO: 49297 - DNA, 267 bp, Triticum aestivum
  Clone ID: PAT_TA_49297
tcgtttccctcctgcaacaccatgggccacactgtgatggtttcctgggccacctgcgtctgacccttacagggtcttaagtccaccgcgggcctgcccgtcagacgaccctccagcagatccggcctctgcaggggtagccacggcgggaggatcaggagcatgcaagcgtggccgacttggggcctctataaattggagaccctgtgttacttgtcaaccactttcaccgatgcccttctgtagcctgtcgactacttaatccgg

SEQ ID NO: 49298 - DNA, 229 bp, Triticum aestivum
  Clone ID: PAT_TA_49298
tgcgtgccgctggagaatgctgctggttagtacacggtcatgctactggcggcgctgtcttgattccacggccagctagccgcccggcatggacggaggcacgcgcctgcagccggcgccgtggtagggttcgttcagcctggccgggcggccaccgatgctgctacttcacgggggccagccagcatgcggtgccactaccggaccgtccgctgggagaagggcctgc

SEQ ID NO: 49299 - DNA, 255 bp, Triticum aestivum
  Clone ID: PAT_TA_49299
aggcgcactagatctcttctctatgctacgccaggtctagccttattatatcgtgcaacataggaacgctatactagtactgcatcagctcatgtatggaccaaattatggatcggtatgagcgctactcttatgcaaaaaaagctgtcgttacaagtgtatgagaactgtagggaaactggtgtcactactataagagtctgagcgtgtgaggtgagacgatacagaattgtcgaatgcatctgatgggagagg

SEQ ID NO: 49300 - DNA, 414 bp, Triticum aestivum
  Clone ID: PAT_TA_49300
tcgtttccgacgtcggctgccctcctttagctattattcttggagtaggggaggacacctatacccaccagccatgggtgacgtgaagactcacatcaacatcctgccaattggccatgtgaactctggctagtaggcaaccactggccacctattctacgggcttggagggattgacatgcgaggaacaaaaaggttctagagggcacccggttgcatgaacagcaggtggtccaagcgcacataggtgctagactagctcaaggtctatcgaaagagaggactaaccatcactactgctctgtggaagatgcagaccaccaagtactactgatcaagaacaggtgcacctggacaccgcaacttgattgagaacatgataacatggacctcacaagctgactgtgctgggct

SEQ ID NO: 49301 - DNA, 364 bp, Triticum aestivum
  Clone ID: PAT_TA_49301
gctcatcatcatgcaagatgaccctatccctgtggatgatgaggatgcggatcataatggatgaccatgatgttgaaggaggtgctgctagtccatgatcaaggtgtgcgtaaaagcccttgctggccatggccaagctactcttgaacgccactactgctgtgcgccgggtctctatcaaccagacctagaccagagctttcgctctgtaccctacatactgtttcaagagctcacactcgaagacctatgccctgatctgggtgcacaagacggaggacatggacactcacctgctaccagcagcggcatctcaaatgatgggcccggcaccgcacaacgtcatgtcaacaagtgagccgtc

SEQ ID NO: 49302 - DNA, 138 bp, Triticum aestivum
  Clone ID: PAT_TA_49302
atgcagtgatgtgaagggctcgtccctactagtcaggctatcatggcagagacagtcaccaacgtatcaggatagcatgccattactacgcatacgcttccgaagatggactagcactactaggcatccggggcggat

SEQ ID NO: 49303 - DNA, 371 bp, Triticum aestivum
  Clone ID: PAT_TA_49303
atacgacacgtcattgcttgcgcgtccactccgagacatcgaatacaaccagcgcgaatgctgtcaaagccggggttgaggagcagttcgtgtgccattgggtgagcggggcaatgacaagggacagggagactgagccgacggcggccgacataggaggtggagcgcgagacctaaccgttcaccatcgaggaggaggtgtccgacctcacccgggtatggatggagccgtgcccaagaacccgctctggcattcatggatccaagcggaagaggagcctgtcggctctcgagacggtgtcttctagggagtccgcccgctctatgggcggcggaatctgttcgggcgaccaggcctatgccgcctgaaa

SEQ ID NO: 49304 - DNA, 280 bp, Triticum aestivum
  Clone ID: PAT_TA_49304
ttgtacgcccacacactcatgcaagatgccatcctgttagcgcaagacactgatgtgggaagtaaacacgctgcagatgaccacggccgtcgacaggtatcacagcacacgtgagcgcgacgatcgccatgtattggagcaaccgccgtggatactccctcccggatctcgtcttgcgcctgtatacactgcgtcccgcctgccgtcatccatcgatatccacggcggctcgcgtgctgctgcacatccatacatgtgtctgatgacctgcaacagcaag

SEQ ID NO: 49305 - DNA, 375 bp, Triticum aestivum
  Clone ID: PAT_TA_49305
gcctgatattgcgggctggacccacgcgtgcgatagatcatactgtgggcggcgccgccgctgcgcacaaaacacatcctggtcagtgtactttctccggcgtccggacaacgtgctcactagcctatcgagttcgtgcacatctccgctcctagacacggtccaggtggtgccatgctgtggtacaagacatgggcgtggagctcggaggctggagcagcgaagctgatggcgcacgcggcaaccatgaaggcagtctcacggtgcagagacagctgcatggacggcgtgctctggcttgggaaggcaatgggactgcggataggagtggcagcgaccaccaggaggcatgtggcaggggctaccgatgacctt

SEQ ID NO: 49306 - DNA, 251 bp, Triticum aestivum
  Clone ID: PAT_TA_49306
tcgccgtggtcgggtccggtacccgctcctcgcatctcctctcagtgctgcagcttgaagttgtacggagaagtgacacttcgggatcaggaagagcgacgggacgagagaggaatgccctctgtccagccgccgttaccggtaccagctttcctctgtccggcacgatgtactcctaccacccttctgccgccgggcacgatgagctgccgccgccgctctggcccccctccgacgaggggcggcccagg

SEQ ID NO: 49307 - DNA, 120 bp, Triticum aestivum
  Clone ID: PAT_TA_49307
tgcatgttctaacatagaagccaatgacactttgtgcatgcgctccattgattgccactctatcctaggaagatcgcacgaaaatcaggaattggattagaaggtcatggagaggaaccc

SEQ ID NO: 49308 - DNA, 160 bp, Triticum aestivum
  Clone ID: PAT_TA_49308
acgggcggtgtcgctctccacctgagaactgcttaccccgggcgtccgcgccgtgtcgagtaccagagacaggagcgctcgatgcctagtacagtgccaggggatgaggtgctccatgccgaaaaaggggactgacccggagatctttgacgacgcgaag

SEQ ID NO: 49309 - DNA, 326 bp, Triticum aestivum
  Clone ID: PAT_TA_49309
tcgaggcataagagatgaggtggtaattggaagccaaggcaaatttatataataagggcacatgtgtgcgggacacatagatatgagcagtgcatgatggtggtattgcgtaaaagaggaagcagtgctggagatgacatgtgaagagagtggtacaagctctggatataacttgtactgaatgtactagaaactgcggttacaacggttactgagattactgatatgtgctggtgcaaccttggggtgctataagtacatatggtaggtcatacaacgtggctgaactgtaggaatgaacatacatacatctgaggaatgatgat

SEQ ID NO: 49310 - DNA, 333 bp, Triticum aestivum
  Clone ID: PAT_TA_49310
tgctggaggaatgacgcatccggttgctatagactggtgcaaccatagcgaaacctacatcgatagaagcgcgaaacccatgccggaagcaccgtgtatcgagcaccaaactgacgcccatcgcccgctggataaatctactgactgacaacaaatgctgtctggagatgtgctcctggaactaaaccatgctctctgccgttgacatactggcaatcatacatgatgactggcatgagtcatcttctcatgctcacagacgactgggcggaacagctcttatctacactgaagcgtgccacaagaacagtcttgaccaacatggccacagga

SEQ ID NO: 49311 - DNA, 336 bp, Triticum aestivum
  Clone ID: PAT_TA_49311
gccacacacgtacgaagatctgtgcgatcccgaccgtaccgaggaatcgttgaatcggactgccggtgatcatgccctgctctcgttccgccgacgggcacgtggcaggcctgctgtccggcggctggagcgtcacggtgcatggcttcggtcgcggcgctggagctgcggctgatatgttcgttatccggacctgccgtggcagcgaacttgcttgtcatcaggatgtcgacgggcacctagatgttgtgtggctaggtaacaaccgtatacatgggctccgcctccgtctgatgctacggaatgcaagcgctcgggtacacgcctgatgctcag

SEQ ID NO: 49312 - DNA, 284 bp, Triticum aestivum
  Clone ID: PAT_TA_49312
gctgccaggttgagtggccgccgcagcaccagcccaatccacgttccgaggtcgccggtaccaagcagacctacacgcgctgcactggccggtacgaagcagacacgcagctagtccaccaggcgcaaagcacctcgcaagcaactacccaccaaggcaacaagcaagtccgctacaggcacggcaccagtgaagtagccgagatgctacagtacgagcacagcacgcatctggtagatccgaaggtaccataacagcacgtagctcgtgatacccaagatgac

SEQ ID NO: 49313 - DNA, 190 bp, Triticum aestivum
  Clone ID: PAT_TA_49313
acacagtacgacacacgacgtgcggcctgagcgcacacacactgtcgaccgacgtgacgccttaaggcacacaccctatggctgtgcgtcaggcccgtcgctggtaccacgaagcctgccctcaatgtcgagctcttctccctcacacgggcccatccgcgtcgacctcatgcacctaacgctagcaagt

SEQ ID NO: 49314 - DNA, 253 bp, Triticum aestivum
  Clone ID: PAT_TA_49314
accagccgtaccgatacacaattcctgcctcatctcacgcatccggcacacacaactcctgcctcatctgtcgcccaggacgagtatctggcaggcacattgtcagcccacgctcttatctctgcatggccactgctggtgacgcctctgagtccctccatctccagagcgcattgctcacgcaagttgccatgcaaaatgacgacatgcagctgccgctctggcacgcacaatgacatcactaccttgacgg

SEQ ID NO: 49315 - DNA, 237 bp, Triticum aestivum
  Clone ID: PAT_TA_49315
accagagcgacccacacatacggccagaaacaataacaaagagtgaggtacatatcgactgaagctcttgcacagaaatggctaccgccgggaaggcgatcaagcgcatagcatcgatgacgtggaaggcccgcaagcccctgccattggaggacgcggaagtagcctctacacaggccattgacgcacgcgctaagattctttacacggcactgtgccacaccgacgtctacttat

SEQ ID NO: 49316 - DNA, 209 bp, Triticum aestivum
  unsure (1)..(209): unsure at all n locations
  Clone ID: PAT_TA_49316
tctgtctgcgtctaatccggcgatacaccgaccgtctcgctaccgtcagattggcgacacacccactgccgtgcgatcgtatgatgcggaggatgatgcttgccgcccggagcaatccgcggaatacgatgctatgctccggcaggagctagctagggatccgccggatgctggggcaggcactgaggaggctaggngctactgctgcg

SEQ ID NO: 49317 - DNA, 258 bp, Triticum aestivum
  Clone ID: PAT_TA_49317
gcgacacccaagcatccaatgacgcatgggcagagccacatacctagaaccagaacttgatctgcagcgacctatatctaccgtgagagttgagagtgagccgacacgatctcgatcatggaggatgacgaggagcacccaggacgtccagggaggtgaggtcgtcgagcaccgtggaggtgacagacaggggcctgctgacaaagctactaaggaagaagaacgcggcagaggactaggagaagaatgaggaggaga

SEQ ID NO: 49318 - DNA, 333 bp, Triticum aestivum
  Clone ID: PAT_TA_49318
gcgctggaacatttgtctctttctcaatgcctgcgcacctctctggcgatatctatggcaacgagcgtacatgactactgcgaaacggacagtcgcgtgctctggcgactagtgcccaatgtgcaatccgttctcgtcgggggtcgtgtgcaatctgcagaggacgctggctgcacggcggccgacgtctcccgaggacgaggggtgaacggcggccgtggcctaccgcctaacagtggagaccgtgtgacatgacccaccggcttcgactgtcctacttttgacgtgctccggcacgatctagtcaacggctgtcgatgcgatcgtcaactc

SEQ ID NO: 49319 - DNA, 205 bp, Triticum aestivum
  Clone ID: PAT_TA_49319
acgagcacgcgtgggctgcatatgaagcgacctgactagcctcatgcggcatcaaatgaaggtaactattattagtgctgcgctagcaacgctagctagggcttattagagctggtatatttgctcttggtactccttttcattgttcgaaggctctataaggacatctttctcaagattcgaaggtttcgtatgtgcagctagc

SEQ ID NO: 49320 - DNA, 248 bp, Triticum aestivum
  Clone ID: PAT_TA_49320
tctacctagcttgcggactcatggtagcaagctatatacctacatagtacagccatggccctcaccgtgatgggcttaagtgccacctccggctttcctttagaggggcttaaaaccaccgtcggccttgccggcagccgaacgttcaaagggtctaggccctgcaggggtagccactgggggaggatcaagagcatgcaagcgtggcccatctggggcctttaaaaactggagaccctgttctacct

SEQ ID NO: 49321 - DNA, 282 bp, Triticum aestivum
  Clone ID: PAT_TA_49321
gacacagtagacccacgcgagcgcttagattaaagacacagcatctacttgatatgccttgcagcgacataagggcagaatccatcttgtggcgcacgactgagggagctgaacacttactgagagcatactattgtaacaactgctcaaaaactgaatatattgactttctacaagtgctgatgaaatgcctattataagatgctgacaacgatgatgcttcccaagttgcagcgatgttgacagcaatgagtaagctcattcagagcatcactacctgat

SEQ ID NO: 49322 - DNA, 373 bp, Triticum aestivum
  Clone ID: PAT_TA_49322
agtcacacaattccacatcgacccacgcatgctgatcacacccttgggacatggcgagggccatgctctgcacggccatggccccactacactggggcatgttgcagttctgcggacatgacgagctcgacgactttatctctgcggctgaatgccacccgcacccacttaatgcccgcggtttgcttcacaacgtacccactgagcaccaactcaaggtcgcgcacggcgcctacggacgccaaactcacagcttccatcaacgctttcacgcgcatggggcccaatttcctgtggaggtgatacggacgcaacaacagctaggcgttaaaggtgattgccatcaactaaaaccgcagtgcgaactaggcat

SEQ ID NO: 49323 - DNA, 362 bp, Triticum aestivum
  Clone ID: PAT_TA_49323
agctataccaacgcgatcatccacgcgttctcatagccatatgatggccatgatgtcactcctgtccttgatacttatggtaatggcagctgaggggaggtcatcacacaaatttggcaacgtgctcaacggatatgtagctcacaatcggaaacagctcttacagactattggcaatcaatgagctccaactctcatatgccactcgtcatactcacactgcttatcacagactaccgcacctgacgatcacatggtcaatcgacacaccaacaacatgcacacacctaattaatggaccggcgagaaatacgtctacacattaccattgataccactgcaaaatcggctacctcctacca

SEQ ID NO: 49324 - DNA, 246 bp, Triticum aestivum
  Clone ID: PAT_TA_49324
gctatcacacttcctactacttatgatccgagtggacaagggaccgcatacaacttatgatccaagtgtgccagagaaagcgagtgattttgtcctatggcttacgacagatacctatgtggttgctgctatatcataggacagatttatgcgtgtatatactcccattactggaggtgtctatgcctatgaattctacaattacaagcgtgctgagatgctatcatgtgttgcattatcggaatt

SEQ ID NO: 49325 - DNA, 337 bp, Triticum aestivum
  Clone ID: PAT_TA_49325
tttcggcattgccaaacggtttccttgaagggccttaaggcattgaccttaattatggaaattgggcgtggaaggctggaacattttaatgatcaacgatgatggtgcccgggaaaaagaagggaatggaggtggtgcctgtaatggcctaaaaaccaattgccgttggccccggccaacaactaaatcccatggccgaatatcgttggccaaaaacttggcgcctaccataaaaaagggttgcccaaaatatggttctaacaattcagattgggggagaaatccacggtttgaattaaaaaatttgggggaaaaaaccgcggtttaatttaaaaag

SEQ ID NO: 49326 - DNA, 239 bp, Triticum aestivum
  Clone ID: PAT_TA_49326
atgccactcgtctgagcagcaacacacaagaggaaaggcgcttaactattttgcaacacataagaagaatgttgtcttccgctaactcaacccgcgaggtgaatgtgtccatgaactagctcacctaacaggctaagcgttacaaacaaatggttgagttcatgtaaatggtcacaaacaccgcttatgttgttgagctcactggagtggaactcatcctgctctgtgttgcttacaag

SEQ ID NO: 49327 - DNA, 227 bp, Triticum aestivum
  Clone ID: PAT_TA_49327
actttgaacccgttgaccaacgccctggtatttgaatgttgcccctgccaaaaaggaccatccatgttattggcgccccatggaacatccaaaatcctttggtcggggccaacgggctacttggccagcccatcctggcggtcaagcgggcggctggcccctccaaccttgccactggcccggtactcagacccttccagccctgcaaaggcccacttcttaaggac

SEQ ID NO: 49328 - DNA, 443 bp, Triticum aestivum
  Clone ID: PAT_TA_49328
tcggtgttgaggcgctccttattcatcttgttgctggatcttgtgctgaccatcatgcgtctcgaccgtccagcttcggagaagcacctcgtgacccacattacgggctttgaatgagcgctgacgtgcaaacactacggcggatgcataagcacggactagagcaatggcaggaggatgtcctactacctggtgctgtctgagcgagacccggccgccgacgctgtagtgctctgggtaaacggcagcacaagctgctccagctctgacagatccgtagacgagaacgggggctgcaactgcgagcgctgaagcactatcggagggctgacgaagctggaccgaaatacctatagttcgtcaaaggtgtcaagcatgatgtacctggactccaatgccggtgctgggatggcatactgattgaacaaatcggatgacacaac

SEQ ID NO: 49329 - DNA, 245 bp, Triticum aestivum
  Clone ID: PAT_TA_49329
acgcccacacgtccaccagatcgtgaggtcagatgtgcagttggttgcaccggtgtctcaagacctatgtgcgggtgcgtgcaccgctgtcattgaggctattgctgggaccgaggtgcaagctcattgctgtgactgattgcccccagctcagaggaaagttcatggaccatatgccgactacgctgaggtatgatgatgcacctgatgctggctactaagtgctttacctgcacgcctggacc

SEQ ID NO: 49330 - DNA, 238 bp, Triticum aestivum
  Clone ID: PAT_TA_49330
tatcatcataaccatctgctgggtctgctgttcctggcagcaagatcagcatgagcgtcggaagccaccaccgtccagatgggcatgaggggcgagcccgcataggctaccgcggcccacgaggcggccgcgcacatcgtgtgcgtcaaacgcgcacaggacgccgagccctaggaggtgcagatacggaccctggcgcgggtctttagcagtacagacaaggccacaggcgctgttc

SEQ ID NO: 49331 - DNA, 321 bp, Triticum aestivum
  Clone ID: PAT_TA_49331
gaccagtatagggaaagcgggtacagcctgcgacgtacgcgcacccgaacagccagctagagcaacgcgtccgcacacacggacatgcagtgatcgtactgcggcagcaacgacggcgctggtctcctcatccatgggctgcaccgccgtcgcagctctttccagtaatgtgctggccagggcccggagctgcttcctcggcgctgccggcaaggcggcgggggcgacacaagcgccatttggcgagcgcgcatcggcgctcaagaggtgctggagggtatcctagagcaagcctcagcctttgatggaggggatattgga

SEQ ID NO: 49332 - DNA, 259 bp, Triticum aestivum
  Clone ID: PAT_TA_49332
tcgcctgagccaccctgccatggacgacggggcttctgatttgagcgactgggaggcgctatctgcatcctcgggggtcggaggcgatgactccacccttgcgtccggcgaaggcggtgacgttctacacgaccacttggccatggactgctgttgctgcactggcttctccggcgagggcatcgggtcggaggctgactcctacgacagagaaattgtattctgcataagctcactggactgattggggtctgctatg

SEQ ID NO: 49333 - DNA, 350 bp, Triticum aestivum
  Clone ID: PAT_TA_49333
ggcaagagctggggactaggccaaggtccgaccgctattgccttttgaggcgatacgacatacccacgctcgatagattggtatccgaacccgaattccttgcgggagaaaaggctgaaatttaaggcataacttgtgcagtggagtctgaattactgaggacatgaaccgcttatccagcgctgatgaacctgttcttgttagacaattgatcggtttatgacatgatctggtgtcaagacgaatgattgtatgccacaacttgtctgtagagcatcatatctggatcagtacatgcgatgtctattgcttgactctagaactgtacatgcatgacatattgagcacct

SEQ ID NO: 49334 - DNA, 210 bp, Triticum aestivum
  Clone ID: PAT_TA_49334
gcgacgcggacttctagggtcgagcaaggcgtacggcacactcacacctaagcctacgcgcgctacatggtacacttctagcgttgcatacacacaacacgtgctgctcctctagcatcgtatacttaacacatggtcgtcaccgacggactctatgactcacgcgcgacctgccggcgatcgccatgcaggacgtccgtggacgctgcg

SEQ ID NO: 49335 - DNA, 386 bp, Triticum aestivum
  Clone ID: PAT_TA_49335
gagggggagacccacacgaactctcacgcatacggagcaggatgcgaggaggaactctaccggagagggcatacaaggccaatgcttcctcgcgcgggggtgtgcgacatggacgacgccgcatgtggcatgggtggggacgacaaatgcccgctcaagttactggagccgagagctacgctaacacaacgatggatgatgtacaaaatggacgataggatgaagatggctgctggggctaaagccgtagagcctgcactgaagtacgaggactcgcgcgattgcattatgaccaatgaacgcaggtgcactagtcttaaatctgaatatgtcaccgaggatggctgcctgaagagcaagatgttatgagcaagatggtctactga

SEQ ID NO: 49336 - DNA, 355 bp, Triticum aestivum
  Clone ID: PAT_TA_49336
tgcacacattgtaattctgcacagatcactgcatccgtctactagagggtgagcgctcttgactgcttgcgcatcttacggtctgggagctattactgcttggtccatctcttgttccggtgacgaccactgctcggcgctgaccatgtccgtgtcaccccggcggccatggtcaacgcaaaccattgcgacgccatcttggatcgcctgtgtgtactagggcacaggcatcttcgagccaatcgctgtagccatgtgcagcataatggcacgcaggtgctctaacaagttaacacgcaatgccataagactatactcgctggcgatcaccaaaggctgggctagcattcgctct

SEQ ID NO: 49337 - DNA, 232 bp, Triticum aestivum
  Clone ID: PAT_TA_49337
agttatttcattcgaaggaacaaaacactgtatcagacaatccatccttatgtacaaattataaaaacacacatgcttgcgaattgatcgttcaatacacggggcatttgtgagtaaatatgcaacgaattaacgaggctgggggggtatattaatactactctgaaggattcaaccacgttttgtatgaactttttgcctcgcttaaaccaacttttgtctccggcttggg

SEQ ID NO: 49338 - DNA, 289 bp, Triticum aestivum
  Clone ID: PAT_TA_49338
gcactcgttccttgtgtcagatacagtgctcggtcgacctctccactgtaccagcccaagtctcgcgatgacgccgctacggaagatgaccgactcttgccatggcgtcgttcccgacgatgatgcacctctggtcgatgctgatgacgccccctcctactccttcggccgactccaaggacgcggtccgctactccggcctctgctttaaacagcagctcacgtgcttgtgtcccctgacctggaccccaacccagtttctgacgggctcccacagctgctcccaccc

SEQ ID NO: 49339 - DNA, 286 bp, Triticum aestivum
  Clone ID: PAT_TA_49339
tcattctctgatctattcattcggaacgatggtctaatgctatggcgtacccaaaacaacctataggctaacacgagtgtgccccatcaacaaccccgtcgctaacgcgcgtcgtcgctatcgtcttcgccgcttctactttaccggacacttgtcgttgacggccactgcggaaatcttgtcacaggcacttgatgggaagtgtggaaatcatgagccatacacatgctaagatggatcaaactacataacagagacggagccctctagggccatggtaaaacaa

SEQ ID NO: 49340 - DNA, 346 bp, Triticum aestivum
  Clone ID: PAT_TA_49340
acaccgcaattacaggctcgacccacgccagctgcacaaccagcagcagccgtcacttggcacatctcccgcccccggaggaacggttgactgccaaatcgctcgtatacggcaggatgggggaggcctgatctgcagcactcgccaaggatgccaccacactgatcccgaacactccgtgggggtacctcaacacggtgaccgacgcatgcatgcggcgcgcagcctccaagacaggattcatggcaccatgatcaaccgcgcaggacaggatggggtactgcatgaacaccgacgcgtacgaaaaggaccaaacagtgccaacccagacattgctcattgcacc

SEQ ID NO: 49341 - DNA, 298 bp, Triticum aestivum
  unsure (1)..(298): unsure at all n locations
  Clone ID: PAT_TA_49341
cggacgcaagggcgacccacgcgaacggacggagctaaacctcncgacgagagctacaaagggccgagagncagcaaggangacccgaccgcgagaaggancacccgaagggagaccggacggagcggagggagcccgacggagcaagcgcacgaacacgttcatggcgacaactgcacggagattgcgtgcttgctggatccagaccatattggtgccaatcaggttcagcgtatggagtagcagattgaaaaagtgcaaggcttcgaggtcgacaaggattatattatcgaccctg

SEQ ID NO: 49342 - DNA, 342 bp, Triticum aestivum
  unsure (1)..(342): unsure at all n locations
  Clone ID: PAT_TA_49342
tcgttttctctatcttacaagcttntatccaacataattcattcttttccctaccgttattgccttaatcgttcattcttaatgatccttttcaggggcttaagtccactgttggcctacctgttagccgccgttacaacggtactagcctatggagcgtcagcaacgtttggaaggatcatttgcatgcatgtgtggcccatctagtgcatttagaagttcgagaccctgtactacctgccaccgctcatctcgtaagctctttttaagctggtcgactacctgatccgatcctagtgtgtgccttgccttgagttcagcaaggctgtggtatatcttttc

SEQ ID NO: 49343 - DNA, 286 bp, Triticum aestivum
  Clone ID: PAT_TA_49343
gagaattcttaattcaagagttatagggagggtcttatgtctccacacacagaaactcaagcaggtgttggatctaaagcgggagttaaagattatataatggcttactacaccccatagtatataactcaggattctgctatcttttctgatttctcaggaagatctcatcctcggggttcgcccgtagatactcggcgctgcagcagctgccgaatcttttactgtgacatgtacacctgtatggacagatggactcaccagtcttgttcggtacaaaggacga

SEQ ID NO: 49344 - DNA, 290 bp, Triticum aestivum
  Clone ID: PAT_TA_49344
cctcctcatggtctcccgcttaccacctacacaatggacacctgggccatgacattaggtaggggcagggccacggacgcgttcctctttaacgccacaagtccagcccaacacatgcttgcaccggcctccgcatccctcctagtcattgtagctcgagcgccggtgctaggatccaccggccccagggttcccctaacgcccgtcgtaggatactccgacgcctgcgtggcgggcctcgactgagccgacgctgacgaagccaatgagacggttaccgaggaggagcc

SEQ ID NO: 49345 - DNA, 446 bp, Triticum aestivum
  Clone ID: PAT_TA_49345
aagcaatcaagtaacttagagcatgatgaatacattgcaagggcaggttgaagcggccggccggaaccatatgcagagattaaggtcaatgtgttagacgcaacatctttacagacattgctgacagctaggcccctatcacacgttcctgtagctgagcaggaccactatcaggccttgatcgacgaggctttgttgcagatcctacaaccagatggacgcgccttcgtcacactccggacacgctaagcttaagaatctattgaggctggctatggtcgtcctggccgccagcgtactcgtactctcgcccgtcaataacgccatggccaccaagtcaagcggccggatcggccgtaaggcgttccagatgcgacaggccttgctctttccatgcaaggataaacaactcaaggacgaacatctacgttaatcccggcgtggcg

SEQ ID NO: 49346 - DNA, 465 bp, Triticum aestivum
  Clone ID: PAT_TA_49346
cggacgcgtgggcggacgcgtgggctccaacccattaaacaaccggagccgtcctcctcctcctcctccccccaccagatctcagatccgcggagctccgccgcgcctcccatggcggtcaaggtctacgtcgtttgcaggacagcaattaaaaggccattttcttttgatgtggattttccactacaaccccactgtctcctgtgatggatctttgcttgtagcagtgttcaatcttattgtttcctagtgtcaacaccaccaacatggacttttagcttttccacaattatgcctgtctcaataaaagcttatctgaagcacaaaagtaaccagtgcataattattatcgaaaaagtatgagcaagtccactggccttctgaatattggaatgcaatacaagtaatccgtaaagtgtgagaactcacatcagcatttgaagaatgtcactcctggtcagattc

SEQ ID NO: 49347 - DNA, 449 bp, Triticum aestivum
  Clone ID: PAT_TA_49347
cggacgcgtgggccacgctaccgcctcctcccccccccccccccccccccaaactcccaactacccggtccgctcctgagttccgagcccgcccgatctcccgccgcagccatcccgccgacgccgctccgttaggtcgcacggggaacctcgccatggccgccgggtccttcgccacctccgtccacgacttcaccgtcaaggattcaagcggcaaggacgtcgacctcagcgtctataaggggaaggttcttctcattgttaacgtcgcatcccagtgtggcctaactaactccaactacaccgagctgagccagctgtacccaaagtacaaggaccaaggctttgagatcttggctttcccatgcaatcagtttggtgggcaggagcctggcaccaatgatgagatagttcagtttgcctgcactcgctttaaggctgaggacccc

SEQ ID NO: 49348 - DNA, 197 bp, Triticum aestivum
  Clone ID: PAT_TA_49348
tccacccgtcttcacccagattaccaccagtgatatttcgttcgtcccgtccaccgactaacggctgggaaaagtgtggtgattatgagcaccatgtctatttctctgcttaaccctctctctcccatgtttattccgttggctttaagaatgtgtaggactacttttcaccatcgtgggagctacttaagatcacc

SEQ ID NO: 49349 - DNA, 439 bp, Triticum aestivum
  unsure (1)..(439): unsure at all n locations
  Clone ID: PAT_TA_49349
ccttcgcaccagatccatcccttcgccgccgccgatccatccgttcttcgtgcccgacgtcgctgaccccgcctccgcgccgctcgcccgggccttcctcagttcctctccgacgcggccgacaagcccccgcagctcctccccgtcgacaccgcgcccgtcgcccagcggctcttcctcgagttccctggctccgacgagggcccgcccaaggccaaggggtaggggggatgcggtgggagaggagaatggagggattagggagcggtgcagaggttcgaggggntagaggtcgaggcgctccagcggaaggaggtcgccttcaggctcatcgttcagatgctcggnggcgagggcggactggaggccgacaaggttgccaagagataatgcgggtgtcctccttgcttaagcaccagcctgatggggactttgagag

SEQ ID NO: 49350 - DNA, 470 bp, Triticum aestivum
  Clone ID: PAT_TA_49350
gctaaacgaagaacccaaccgaccggcgtcgccgccataccaacggcccttctacttctcgtgtaggccgccgtcttctcctagtagtctggtattagcatggcgcggctggcacctaggcccatgctcgtgtgcttccccatgcgcggcagccgcatccatgccgatgtggagctccgcctagccgccgacacacccaacggcgctgacagggcggcctctcccggccagattccgagtgccagctcagggggcagccaaccacctgcccaaaaacgcgaacgatgaggctactggaatacgttaaaggcgcccagccagagactacggcactattggtaaaatgagcccctgcacatgtcgttgatgccatgccccatacagagacaaatgtgattgggactatgactgctgactttcttgctgtaaccgtaacaacggctggtgaaaatgttgacagcttatgtaca

SEQ ID NO: 49351 - DNA, 415 bp, Triticum aestivum
  Clone ID: PAT_TA_49351
ctcacgcgttaggtaaggcctgatgatgaaccgggtgatctgctccaccacgaggagcaacaggaggcgtagcgcgaggcctgggccatggacattccaagtctaatacccaatagagaaggcactggcgacaggcctggaatgagacataaaatgcgggaaacgcaccttcaccagccggctcatcggcagcgtctgtaggtactaaagaggaaaacaaaggcggcaacacagacttcagcaacctgacgacagtcatgtcgacggagatataccatgatgacgacagatccttgctcaaaaccagagggaaggacaacggtgtcaccaacctgaaccactaggcaaacgagtctgatctcatgtatgacctggtggaggcgatgaatgttggcaaggctatcgagaagcccat

SEQ ID NO: 49352 - DNA, 438 bp, Triticum aestivum
  Clone ID: PAT_TA_49352
gcagcagacacccaaccgcagacgtacgccgaagatccgacgtcgcgcacgctagggtttcgggcctgggagagagggggggcgatggacgtggtgaaggcggcgcaaatctcagggcggacgctggagaaagtggtggttcaaccggtggtgctgttcagcatcgtagaccactacaaccgagtaggccgctacaccaggaagcgcgtcaggggattactactctgcacatcctgtctgggctgcgacgacttaacaaactggtactccttaccgatgtaggataactactccgacccaaggatctgcctcgtctagcataaataccagtagtctatatcttccatgtgcacaatgatcatccccaatgctactgctgtcggttctggcaaaagtggtacctaactatgggagaacgcacttgctgctcatgcgttg

SEQ ID NO: 49353 - DNA, 473 bp, Triticum aestivum
  Clone ID: PAT_TA_49353
gtaagtttagtattggtatatggtctcggcccagtcaggatgaagaacttgtagctggtggttcgtcttccgcatgacgctggttaatctgaagcttttgatccagtgatgatggaaggttgtaaactttggtcgttgcgtacagttcaaagattttctcttgtttacatgtaccaattatgggagagaacgaatctgcactctgaagtgtgaaaactcagctggcagggaccctctgtgaggctggtatacattacttggtgctggcaatttctgatctgctcacgtggtttcatcttgtatgcacacggttttgtttgaaagagattgtccattccgtgccaattaaccgcgcggctactatctacaagctgtcggacatctcatgaagtctatgtaagaaattggtttactctgttcaatttatttactatatatcttctgaaataccggatggggattgttgatctttt

SEQ ID NO: 49354 - DNA, 448 bp, Triticum aestivum
  Clone ID: PAT_TA_49354
gacccacgcgtccgcccacgcgtccgaaaaaaaacactcgagtctcagtcgtcgtcgctgcaaggagagagagagggagagggagagagagatagagagagaatctagtggtaccccaatggcgcaaatcatcgacggcaaggccatcgccggcgaaatcaggcgcgagatcgccgccgaggtcgccgcgctctcgtccgcccacagcatcgtgccggggctggcggtggtgatcgtggggagcaggaaggactcgcagacgtacgtgcacatgaagcgcaaggcctgcgccgaggtcggcatccgctcctttcacgtcgacctccccgaggacatctccgaggccgcgctcgtcggccaggtccaccgcctcaacgccgacccccgcgtccacggaatacttgttcagcttccattgcccaagcatatcaacgaagaaaattattaa

SEQ ID NO: 49355 - DNA, 434 bp, Triticum aestivum
  Clone ID: PAT_TA_49355
ctcgaagaagtacacaagtgatgagccaaaatctggaagaaggacgccttcatggtgcgaccgaattctttcgtatggcaagggaatgaggctattgtcctacgaggcggttgatatgaggctatccgatcaccgccccgttaaagccgtgtacacggttgatatagaggttttcagccccaaaaagttgcagagagctctcaccttcaccgacgcggaggttgaggaccggctgtcctctgaggatgagcgcatcgccggaatctacagccttgggctgtcgtaagtccaaggttaatatttgggccatggcctcttggctgtctgctgagaccagcagcagatcattctggggttgcttggtcatgtagtacgtcgcctccatgctctgaccatattttgaagagaaccagggcatgctatgtatgcatatc

SEQ ID NO: 49356 - DNA, 219 bp, Triticum aestivum
  Clone ID: PAT_TA_49356
cggacgcgtgggttcatccgggcccaccggtcaggcaccgtgccatggaacaagctcctgcttagctggaggagattagggagatcagcaaaatctggtgggagctggccggtgaagttctggcccctgaggaatctgcgaagatgttcggaacaacgcaaaaagtgagaagcgccaaagagtcatgcatgcatacatacattttaatggcatggcaca

SEQ ID NO: 49357 - DNA, 402 bp, Triticum aestivum
  Clone ID: PAT_TA_49357
cccacgcgtgcgggccgtcatgaagcgcctcaagaccgtgatgaagaagttcaagaccgaggtgtacgacatgaagccggatttcttggagcccctgaaggccaagcacatgcccaagtacatggcgttctcgtgtgccgactcctgtgtgtgcctgtggctcaccctgggcctggagcccagcatggccttcatcatccgcatcatcgccaacatgtgcccgtactactgcactaacatgtactctggcgttggatccgccatctaatacgccaagtgtgctgtcaaggttgaggtcatccacatgattggccacagacgctgcggtgtaatctaagttatggtttgactcaacgattgcgcacactacttcttgcacttggtcaaggactgggtcaggat

SEQ ID NO: 49358 - DNA, 413 bp, Triticum aestivum
  Clone ID: PAT_TA_49358
cactgacgaggtagctcgccggttgctcggtcgtttgttcgttcgtcccttgagccggccgcgcgcgcgtgccgggcgggcgggagaatgggacggcacgcgggcaccggcggcggcggcggcgtccagcagaagctgcgcaaggggctgtggtctcccgaggaggacgagaagctctacaaccacatcatccgctacggcgtcgggtgctggagctccgtgcccaagctcgccggtctgcagaggtgcggtaagagctgtcggctgcggtggatcaactacctgcgccccgacctcaagcggggaagcttctcgcagcaggaggaggacgccatcgtttgcctgcatgagatcctggggaacaggcggtcgcagatagcgtctcacttgccggtccggacggacaacgagat

SEQ ID NO: 49359 - DNA, 314 bp, Triticum aestivum
  Clone ID: PAT_TA_49359
tctgagcgagactaaacagtatcgggctaagggggagacatcttaggttcatcaaacacagcaccgagcgcctgggcggctcggagcgccctgcgcccgccgtctgacgcacccagctgttcgtctgcaaggcgcaaataaacgaccaggctgcacctgacgctgccgtcgtcaccagccggcgcgccgttcctgccgtagtagcaggggccgccgtcgctgccgaatatgtctctcgcgccgttgccgcctactgggaatgcaggaacgtgcacggcatggcgaagcaaaacacggacttttgggcatacagc

SEQ ID NO: 49360 - DNA, 369 bp, Triticum aestivum
  Clone ID: PAT_TA_49360
cggacgcgtgggcggacgcgtgggattattgtgaagaatatggccgaggcaacatatgtatgtgactatatacttggtggccaacttgatggatctagctcaactagagaggagttccttgagaaattcaaaaaggctgtttctccaggattcgatcctgatgttgacttggaaaaggcgggcattgcaaatcaaacaacaatgcttaaaggagaaactgaagaaattggaaaacttgttgagaagactatgatgcgtaagtatggagtcgagaatgccaatgaacactttgttgccttcaacactatttgtgatgccacacaggaaagacaagatgcgatgtatcacctaatgaaagaaaagggtgac

SEQ ID NO: 49361 - DNA, 447 bp, Triticum aestivum
  Clone ID: PAT_TA_49361
ctctgctgctctccccaccgttcgtccccttcctgccattcgcctctctctgccgctcgcgccgccgtcgccatcgaagatctgctgctcgcgctgccgcttcctgatcgcctcgcgcgtcacgtcgtcgggaggagaggaaggtcgcgctgctcttccccgaggagcgcgccgttgcgccgtcaacgggaggaggccaggcggagtgacgggaggaggtcaaccggagcgcgccctccgcaccgtctggcgcgttgacgggaggaggacaggtggtgcgcgtcattgcaaccggctagcacacgggcggagccatcagtagcggtggcggttgggctgatgtggacatggctgcaagctcgacgtgaggcagcggtagcgacgagctcaccaggtaggttcctgcaaaggggatttaagagatgttcggatctagctaaacatgaa

SEQ ID NO: 49362 - DNA, 129 bp, Triticum aestivum
  Clone ID: PAT_TA_49362
acgcccacctgtatcgcgaatggtcaccacaatgatactcgcaactgccgtgctcacagaagtcacacatgggctgtccactgcaggcaagactatcacccaagtctaacggtatttagcctatggagc

SEQ ID NO: 49363 - DNA, 439 bp, Triticum aestivum
  Clone ID: PAT_TA_49363
cggacgcgtgggcccacccatcgcctgcaatggatccgccgccgccctgatcccgaccatgcgccgccgctccctgccccatccaccaccggtgcttaccgctttcaccctctggtgcatcccagcaccttcatagccaccgtggaccatctctctccttggtcctctctcttggatcagcatgcggcgacagatgctttcagtcgcgtggtggtgatgcggctggtcggggaacgagggtgaggcgggctgtgtcccattccttgatcttcctccacctccaattccttctctcccaccgaacgttatgtccgtagttactgcgacaggcgctctgctcttccgtggtagcgatgcggatagcgacaacaaatgtcctttggggccccttcactcttcagactgccgttgcacgaaagttcgcggagaatatcatgcc

SEQ ID NO: 49364 - DNA, 452 bp, Triticum aestivum
  Clone ID: PAT_TA_49364
acgagctcggcgacgagatcggacacggcaagttcggctccgttcggatctatgaggttcgtgctgatcgggcgggtggccctggtgaactacagcaaggactacggccgcctcgtcgtcatacgtcacgttgttgaccagaacaggctgcattgctctgtttacacttataccactgcttattggtatatccccaagaacgtataggacacggtccaccgtgaggtcgagattgtgcaacacctctggggccaccctgccgtcgatacgctgaacgccgtctgcggcggctgcaaatcgaagcagctgaaaggggcaaggcgattgggactcagggactacatatgcctcctgtcctttattttctagccaaaatataaggaagacgtatgggttctcgtgaaatgcaagttgtactactgtgaaaaagtgtactaatttttacagtgcat

SEQ ID NO: 49365 - DNA, 438 bp, Triticum aestivum
  Clone ID: PAT_TA_49365
atgccccagtgctgtgggggtaataggaagttaaggacatagtatataatatcgattcttctgtccgggacacatttatatgttcagtgcaaatggttgtcgtgcctagagcaggaagcaatgctgcgggtgttatttgaagagagtggttggtgtgcaggatataacttgaattcagtgttctacaaactctgctcaatttggctactggatctactgtgatgtgctgctacaaccttgcggagctaaatacattttgttggtgcagtagcttgtctgcattgttgtcatgtcagtacatacaatggggttaactgttaagaagaaacatatttcatcttaaaaatgataatgctgtcttatcatgttttgtccgagagacatagctggctctatgtctgggtgatgcctttagcttcaggactaggatattttttt

SEQ ID NO: 49366 - DNA, 451 bp, Triticum aestivum
  Clone ID: PAT_TA_49366
acgcgagaattcttaattcaagagttatagggcgggacttatgtcaccacaaacagaaactaaagcaggtgttggatttaaagctggcgttaacgattataaattgacttactacaccccagagtatgaaactaaggatactgatatatcggcagcattccgagtaagtcgctaccctggggttccgcccgaagaagcaggggctgcagtagctgccgaatcttctactggtacatggacaactgtttggactgatggacttaccagccttgatcgttacaaaggacgatgctatcacatcgagcctgttgctggggaagacagccaatggatctgttatgtagcttatccattacacctatttgaagagggttcgcgtactaacatgtttacttccattagaggtaacgtatcttgttataaagccctacatgctctacgtttggaggat

SEQ ID NO: 49367 - DNA, 163 bp, Triticum aestivum
  Clone ID: PAT_TA_49367
agaaagcggcgtcgcggagcgggcgcggaccaagtacggccggtcatggacctcgccaacttcatgaaggccgtcggcagggtgcccaccaagcgctcctttttcttcttctccttcctcctccctaagaagctaacatctaacatgggtccttcgtcctttc

SEQ ID NO: 49368 - DNA, 417 bp, Triticum aestivum
  Clone ID: PAT_TA_49368
ctccggcatggagcatgtgtggcactccctgctcatgtggtgactgtcttctgcagctgtcgtgatccaccgcgcgagcctgctgttggtgacctcaatctctcaccgcagcttctccagcttttccctccggtcgttgcccctggtggtgcttcgctcgtgttgccccatcgtttgaggaggctgcgcctagcaacgtcgcccaacctccggatgggcctgcccgggtggatctggtggttgctgcccaacgggaggaggtgctagctggtgattcctagacggttgctccctcccctagacgcagcccccagatcagccgtgcttacgatggggtggatgttggctccatcgagcgtgcaaccaagaggaaggccgtggcggattccaactcggggagtgacgctccccggcgcc

SEQ ID NO: 49369 - DNA, 450 bp, Triticum aestivum
  Clone ID: PAT_TA_49369
cccacgcgtccgcgactctccatgttattgatctggtacaatgttgttgtgcgtgaggacgactcagggaaaggtgcaacaaggcagtgctcgcgttgcagtggactggagtccgccatcaccaccgaccattgctcgccgatcgtcgtccctcatcccccgtctaggttgcacgtctttggccttgtcatcttcttcctcccagttttctactcttgctttcataggttctttgacaatctaatattgatttcttgatttttttttgaacaagatgtttgcggatcaggcgaagaagagaggtaggatcaaggtttacgagtcgacaagtcgacgagtcgttccgaggtagagactcatagactaatcgagactagtctagactagtgctagactagtcgacatggtactgtagtactcagctactaatacctagtggtagtatgtagt

SEQ ID NO: 49370 - DNA, 442 bp, Triticum aestivum
  Clone ID: PAT_TA_49370
attgtgggcttgacgaaggacgtgccgaagcagagttggtggtcttctctgtgatggatgaccttttcgccaagacgtgcatcaaccacggcacaattggtgctcttatcaccaactgcagtacatttagtccggtaccatctatggctgacatgattgtaaacaggtacaagttacgaggtgatctccgtgtcattaacctctctgggatggcgtgttctgcatcagtgaccgcagtggggctcgcaagcaacatgttgcaagtgatgccttgggggtcacatgtgttggtggtgtcgacggacaccattgggccattctactatgcggggaataagcgttctatgcagttggttaacgtcttgttccgcataggtggtgctgccaagctattgtcgacttctaggtccaaggctcggtttccgcttgggcatttcacacg

SEQ ID NO: 49371 - DNA, 451 bp, Triticum aestivum
  Clone ID: PAT_TA_49371
cccacgcgtccgcccacgcgtccgcccacgcgtccgtgctactccagcatccacccatccatctctcatcttcttcttcttgcgaccaaacgagcgtctagctagctaaagattcgaacgatggccgttcttgtggcgaggcaggggcgcgagctgcagcggtacagcacgagcaccggcgggcgcatcgtggtggggtgcatcccgtaccggatgcgcgacggcgtcgacgctttcctgaggcgcagagtcgtcgtcgccgtcgtcgcggcaaataatggggacgaacttagaaatgtgtgaggtagagatcgaaagcgaacggggcaggaaaacttgtcaaaacactgccgaacgaacatgctcacgattctttccttaggctctgggagtaaaagatcaaattgtaaattaattctagtgaaaaccgttcttggtggcacgatcgatc

SEQ ID NO: 49372 - DNA, 442 bp, Triticum aestivum
  Clone ID: PAT_TA_49372
acgcgccacacgaccacagggacggcgctaaggtaggaccgacacacagaccttgatgccgtcccgatggcaagcaccaacatggcgtccgacacctccagattcatgctcgcagatgtcatccccaccggcaccaaccacggtgtgagcagccgtgtcagcttccacctctgctaccgactgtgcttgaagctggtggcccgcgtcgaggaggatgccattgacgctgcgcctgcggaaccagcaccggcccgcgaggagaaaccggacgccacctgggccaccaaggggtgcggcaaagcccacccgcctgccaagggacccaagaggggaaccaaagtacgttactacactccattgttagcatctctgtgaacctgcttgcgcaatagtggctgcactcttgcctgaaatgtaatatgatcaggtgtaaaatcttggg

SEQ ID NO: 49373 - DNA, 139 bp, Triticum aestivum
  Clone ID: PAT_TA_49373
ctaggcgtctgaaaatcattagataagaaacgaagagagagcagcactagatgtgagtgctctagatctgtatcgcgagacgcggaattcttgctatcgaatgtggacaagcaggcgcgctcggtatcagcgttaccat

SEQ ID NO: 49374 - DNA, 455 bp, Triticum aestivum
  Clone ID: PAT_TA_49374
gcgggcctcaaatccgtcaatggcgtccacgccctccctcctcaccctcttcctcgctcttgtgctgcccctcatccctctcgccgtcgcagctccggagaagcacctcgtgacccacctcccgggcttcgacggcgccctcccgtccaaacactacgccgggtacataagcgtggacgagagcaatggcaggaggatgttctactacctggtgctgtcggagcgtgacccggccgccgaccccgtcgtgctctggctcaacggcggccccggctgctccagcttcgacggattcgtctacgagaacggtcccttcaactttgagcgcggaagcactcccggagggctgcccaagctgcacctcaatccctatagttggtcaaaggtaatccgcatacctgattctgaacacagtttaagagcacaggcctaccccgcagcagcctgcccagaat

SEQ ID NO: 49375 - DNA, 413 bp, Triticum aestivum
  Clone ID: PAT_TA_49375
acgcgtacgcgtccagcaatgctgtggctgtgcggaaaaaaaagcacggatcgtgtaatcggagagccttcagtaatctgtcatgcataagcagagtggcgtctatagtggatgcgcacatcaacaaggcggactgacgagatgagtgcggctgccccgcacatggcatgactaacgcacacggctaggagagctcgcatggcagcgggctactacttgaatgaataagagatcatgcctgtgctattcagctctgctttgcgtgttgaaagaaatataaatcagatatgagacactgatgtcatgcctttgatttggcctagtaacctaccatacaacggaatatataatgctatgtatgatcatcatacacaaatatctatgtgcttgcgtttcaaagattctatgatcgg

SEQ ID NO: 49376 - DNA, 396 bp, Triticum aestivum
  Clone ID: PAT_TA_49376
gagaaacacagagcaagaagataagagagaagcaaagcttgagatggcgcaaaccatggcgtccatgaccggcctgtcgcagggcgtgcgtctcccaggcccggccggcaggcgcgccagcaggttcaccgtgagggcgtcgtcggcggaggccgaggccgccggccgccgcgcggtccttggcctcatggccagcggagtcgtcgggagcgcgttcgctcaggtggtgcacgccggcaccgtctcggccatcaagggtggccccccgccgacgctcttcggtggactccccggaacggacaactcggtcgaggcaagggacttcgacctgcccctgaagaaccggttctacctgcagtcgctgccaccggcggaggcggcggtgcgggccaagga

SEQ ID NO: 49377 - DNA, 341 bp, Triticum aestivum
  Clone ID: PAT_TA_49377
ctggaaacgatccataaccaccatctaatccaaagcctacaaattggccgtcagattgttggcggccaataacttgggggcgttcaagatccgcgacagagcgaaaaagacagatgccgccatggatacctacacgcggaataggacgcgctgcacttattctgttcatgcctgcgtggctcttggtgtaactgcttaaatacgctatgaacatgaacgttggcaacaagtgcaaaacgggcggtgagtggctgatgagctagagctacattggactacggcatctgacgacgtcacggcctacaagctgaatggcgaggacaacatgggctttgtactct

SEQ ID NO: 49378 - DNA, 448 bp, Triticum aestivum
  Clone ID: PAT_TA_49378
aaacctgtgactgcaagaagaagaagaagaaacagcgagggggggcatcgactgaagctcttggagtgaaatggcgaccgccgggaaggtgatcaagtgcaaagcggcggtggcgtgggaggccgggaagccgctgtctatggaggaggtggaggtggcgccgccgcaggccatggaggtgcgcgtcaagatcctctacaccgcgctctgccacactgacgtctacttctgggaggccaagggccaaactccggttttccctaggatcttgggccatgaagctggaggcattgtggagagtgttggtgagggcgtgactgagctggtgccgggagaccatgtcctcccggtgttcaccggagagtgcaaggagtgtgcccactgcaggtcagaggagagcaacctctgtgacctcctcaggatcaatgtcgacccgggtgtcatgatc

SEQ ID NO: 49379 - DNA, 413 bp, Triticum aestivum
  Clone ID: PAT_TA_49379
cgcaggcgtacgcgtagcggatgtaccgggtcgtcccaaacaggcaaggagatcatgagaagaacctgttccagtacaaacggtccctgaaggaggttcacgtcctaccacgcctgatggcgctaatactgtgcatctctacgcgctgaagtgagctccgcactggtgtatcatccctactggagagacccgctctctggtggaccatacttacatgagacgcatgctcttgactaactgatagtactgttgacgcgagaaaggatttgatccaccaggctgggagctagcccttgttactgctccaaagagcacagattcatctgcttcagactgcctataggatggtggactcagacaagctcatctaggacagcctttgggatgagggggcctacagtcaggcacagcaa

SEQ ID NO: 49380 - DNA, 352 bp, Triticum aestivum
  Clone ID: PAT_TA_49380
acggacacttgtaccgtcccgtccccagacaacctcccatactcgtctcgcgtcgcagcggcagttccactccctcgccatgggcaagattaagatcggaatcaacggtttccgaaggatcgggaggctcgtcgccagggtcgccctccagagcgacgatgttgagctcgtggccgtcaacgacccctttatcaccaccgagtacatgacctacatgttcaagtacgacaccggtcaccgtcactggaagcacagtgacataaagctcaaggacgacaagacgctgctctttggcgagaagccaggtaccgtcttcggcgttaggaaccctgaagagatctcccggggtgag

SEQ ID NO: 49381 - DNA, 448 bp, Triticum aestivum
  Clone ID: PAT_TA_49381
gcacgcgttcaaccaggtccagacataccaaggattgacagactgaaagctctttgttgattctatgggtggtggggcatggccgctcttaggtcgtgaagcgatttgtctcgctaacttccctaaccaaccgataccttatgctgctaactagctatgccgagccatccctccgcatctagatttttagagggactatcgccggttaggcgacggatgtttaacgcgataacaggtctgtagatgaccttagatgttctgggccgcacgctgcgctacactgatgtattcaacttaaccctcaaggaccaggacggctagacggtatcgctctccaagttcaagggcaagcccgtcgttctctacttatacgctgacgatgagacgccaggctgcaccaaacaaatcattcgccagaacacattgagtactcttggttctgccggag

SEQ ID NO: 49382 - DNA, 454 bp, Triticum aestivum
  Clone ID: PAT_TA_49382
atgagaggaatgctgagacaaaagaacaccatcagcagatgcctaagcactctgataaaaaccagccactaggtggtcgtgcaaggagggtggacctacactactggcacagctgacctatgtagtcctcaaccaatacacggccgctagcaaaatggacacggataccacctacacggtggcgtaaaactacttggcggaggtggacatcatactggccgcggtcatgccggtgggtactacacacgcaactaagaaggtcctgcaagagaagcgtaatcgcctgcctgagatcgagcgcgccttcgtgcacctggactactagattacccatcgagccgagcacgctctgttacatgagaaagagcttcaggatcggctcagggatgcatctttgtacagattaatggcactcgatagagaaatcacggtgtagctcaaggcgtatcataaa

SEQ ID NO: 49383 - DNA, 445 bp, Triticum aestivum
  Clone ID: PAT_TA_49383
acgactcggtatggggtaagcggtcgcccaggcgtacggggagcggacgtcttggctcgttccacacggccggaacggtaaacccaattctcaaaccctagagccataaaaagaaaaaaaaacttcaaacctagacctcctcgccggccacatgacgacccgacgtcaccacaggcatggtgatctttacagagaagtgcccgtcaccgaaactaggcgactctatagtatggcgggtcttcccgactggaggcatatccttgacggtgacggttatgccaaggaggtatatcctctattgagatatgcacgctagggcggctactccgatctcgagctatcgagaccaaggggactacatggacgtatggcagtcgtgcgctaccacatccaaacgaggcattgcaatcggccactgcctccacagtgtgaggcagtgaacatg

SEQ ID NO: 49384 - DNA, 319 bp, Triticum aestivum
  Clone ID: PAT_TA_49384
gacccacgcgtccggaagcgaagggaaagagaaggaagaatagtctgtgcatcggccggcgacctgctggacctgctcgccgacaagctgatgccgccggatccggagctggggttcctggtcgaggcctccgacgacgagctcggcctgccggcggccggccgggcagtactactcttgggatgacgccgggcgcctggggccggaggaggccggacgcctgttcggggagcaaatatggggctgtcaggacccgattgacggcgcatactccttgctcggaggacgctactcaccggacgcacgcctggggggtggt

SEQ ID NO: 49385 - DNA, 393 bp, Triticum aestivum
  Clone ID: PAT_TA_49385
gcctcgcctcgccgcattgctcttgttctagttggcggtggttgtcgccctccccctccccaaaccctaacggaaaaggcttcttcagattcaggtcccccccctcgccgtcgtccatggcgctgcagtacgtggaggcgcagcggcaggcgcggccggacctcgccgactggtacgccgacctcgccgacctctaccagcgcaagctctggcaccagctcaccctcaagctcgaccaatttctccagatcccggccgcacagactggcgacacgctcatacagctctacaacaacttcatctccgatttcgaaacaaagatcaatttgctcaaacttgcccagtttgccgtcatagcctcgcgccaatatcccgacaaggatgccgccatcg

SEQ ID NO: 49386 - DNA, 431 bp, Triticum aestivum
  Clone ID: PAT_TA_49386
cctctcctctccaccgtagatagagcgcaggccttttcttcggttcttcactgatatagatagcttccatttttttggttcacttcctcctcttgcatgttcttgatctcttctcgatctaaaaccaccgatagatcgatcctagctagcatccttgttgtttttcttcccaaggatctagctagttcttgcagatttcatgcaaaactaatactacaagttcttccagttcttcattcccatccttctttatttcttggtgctctcttaattcttctcctcctactcctatctagccagacatggagaacgttctgctggatcgttcttccggaagcttcgagtacccgaagaggggcgtctatggcgggaggccggcgaggccgcacggcgcgtacggctcctcccgcacgtgcccgcagtaccatcac

SEQ ID NO: 49387 - DNA, 454 bp, Triticum aestivum
  Clone ID: PAT_TA_49387
gtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtcccaagtgttctatctgaaaatgaa

SEQ ID NO: 49388 - DNA, 483 bp, Triticum aestivum
  Clone ID: PAT_TA_49388
cgactcactacagggtaagcgtgtcgccccaggcgtacgcagaacctagtctggggcccaaaccgatctggcgaaagatacaaacaggacatatgcgcgagctgctgagtgtggcaacagcgatatgggcgcacttctatgcttccgtcagcgggaggatggctgtgaaatgaacaagccttacagcaaccgaacagtatccatcatacatactgaagagaggcgaatgcatcatccatgactacaactgaaccgaggaactggtgacggaaaacaaagaacaagtccctctgaccgcggactgactgctagggacggaggtccttcaccacgacgatcttaccagagtatgaggagaccgaccattaaaggcagaccagctaacaaactaccacctctttaagcacgggttcccggacgaacaacgcacgatcgcagaacctgtcacgaacgccaaaggtcccgatcacaatggaccggcag

SEQ ID NO: 49389 - DNA, 435 bp, Triticum aestivum
  Clone ID: PAT_TA_49389
cacgaaaggaccccaaggatatgagaaccatcccagcgaatagatgctacagcattgcaagaatcccgctaacgttcaggagcactacaagactaccgccccgctaatatcggaggacacactcgggcaggtggacatcattgtcatgggaattgcaagtggtgggaccgtgaccggcctcggcaagtacctcatggtgaagaaccctaacacagggatctatggagatgaacctgcctgactaaatgtcctgaactgagggaagccaaggcctcaccttatcactggaaatggagttggatttaaggcaaatattgtggatatgtatataatgagagaagttctagaggagagaagggaggacgccgttaagatggtgcaacaagttgcaactgaggggggcctgctggtggggatatcatcaggagccaacac

SEQ ID NO: 49390 - DNA, 444 bp, Triticum aestivum
  Clone ID: PAT_TA_49390
cccacgcgtccgcccacgcgtccggccattcttgaaactgcggctattggggttccacctgtagggggcggccctgaacagttgaccatagccgtcgtattcaaagatcaaagtccgcaagcagaagatttgaaccaactgaaactaatgttcaactctgctctgaagaaattgaatcctcttttcaaggtttcatcggtcgttgtggtgccatcgctccctcgaaccgcctcaaacaaggtcatgaggagagtcctacgcaaggagttcacccaggcaaagcactctaaaatctagtagacgtgaggaagtgtattctgcgcctattaaaatttcagggaattgcacaccaaactgtgaatatatacgcaccagctcatgctcatgtcttcagaaattcaggtgtattatcacatatccattgtacagcgaggctaattcaca

SEQ ID NO: 49391 - DNA, 475 bp, Triticum aestivum
  Clone ID: PAT_TA_49391
atacgactcactacagggtaagctgtcgcccaggcgtaccgcacccgtacgacccgatcgacccaatcctcaggcgacgcccctgagctgatcgaacagatacgcaggccctgctcctctcctgcctgacaccataactcttccctgctgccatcccgcgtgacagcacgatgctccatacctgccgtcctgctccagagaccacgactctactccgtcggtattgcttgggacagcacgatactccacacctgccgtccggttccacagaccactatctcatacggcgggtccctacccgacaactgccatctggtgccaacctctgctacagcacactatccaatacctgccgatcgccgctagagaccacaatataatttgcgacagtcgccactgtaaaccataccatccgtcgccagagtccatagttctacttcggcgacacctccgctgcctggattaatatgcctgg

SEQ ID NO: 49392 - DNA, 259 bp, Triticum aestivum
  Clone ID: PAT_TA_49392
accggacccgtgttccggcgccgacccacgcgcgtgggctcgcatggcatgctccccaggctcacatcccgactgcatactcctcatgttccagaaccgatgacgtggggctcctcttcctgctcctgtaccctttaccatgaccgcctcttctgcctcagcgccggcgaccgatgatcccctacccacactcagccccagggatcgctcaatgaggtgtgtcgcagccgcgttgatctggcttatggtggagtgtgaa

SEQ ID NO: 49393 - DNA, 427 bp, Triticum aestivum
  unsure (1)..(427): unsure at all n locations
  Clone ID: PAT_TA_49393
tccatatgcgatccgaacagagatgacggcctgatgacggtgcatntgacctccatgtgtcaccacactggtgctcgcgatacacctgactgcacggggtggtgcgcatgatataccatgataccagtgtggtccgcgatgcacccacccgtgctatgcgtacgggccctacttatggagcagcttatgctgcatatctggaaccctgtgcaactactgattaatcatgcaatccagcttgtgcatttgctagtgcacgaacctgtgcttgttcaactgcaagtgatcgaccatgcacgaacgcatcgacatgcatggattaccaggtgcaaattaacgatcatgacctgccataggtatattagctgctctatgaacaataagtcgatgccggtccggctgcatgcatgtattgcgtgcgagtgcc

SEQ ID NO: 49394 - DNA, 205 bp, Triticum aestivum
  Clone ID: PAT_TA_49394
cctaggcgtacgcgcgtgcccaagtatgacgagtgagaacacaaacatggcgacaatgaagcgagtacaagtagcaacaacacgaggggagcactaaccaagggggcacgtcgcgctgatcgtctggcgacgggcacagacggcgcccgtgggggatgtggcacgcaagcgttaggacctgtcccatgacctgggtgggcgtgct

SEQ ID NO: 49395 - DNA, 425 bp, Triticum aestivum
  Clone ID: PAT_TA_49395
gactcactccaggatacgcggggtcgccccacgcgtacgcgtgcacaagaattcctgccacccccaccgtctggccgccgacaccaccgtcgcagctagataagatgaaaaaaagagagagaagaactcgtcggtagggctcgagatctgtgtcgggagacagggaattcttgcgatcggaatcggaacaagcggacgcgctcgggatcagcgttaccataccatgcttccccgcaacctttcgggaatgcgctactggagtcaacgggtgccaaaaaggctagcactagtggttccctgaggtacgaaacaccctctcgctacagcattgaagacgttcgacctgctggaggcgccaagaagttctctgctgcatactccaactgggcccaaaaaccatcctgatatctgctttggcatcccct

SEQ ID NO: 49396 - DNA, 456 bp, Triticum aestivum
  Clone ID: PAT_TA_49396
aggcgtacgcgcacccgtactcccacgcgtacgcacacgcgtgcgaaacagttcaaattaaccctcgagaaggcttacgagacacatctgaccacacgatgggatggctgaccagggatagactgactactggagggcgtgtttgtgcacggctgctccgctgctgtcacgggctgccacggagttcacatggagagctgtgaccgactcgccactcaattccaagcacagagcagggtatgattccccgtactcacattcacattgcatgtggtcatggactatttcgatgtccaccgtccacacgcggggtgagtgtacctatgcctacacgccgacactggagggcagtcttgatgcatgcaagctagctaattgttgcacgtacggacacaggcaactatatatattcttactaatacgcgctcgatcggctactagataataaaacttgag

SEQ ID NO: 49397 - DNA, 434 bp, Triticum aestivum
  Clone ID: PAT_TA_49397
agtctgtaccacacaccacgcctgcctgatctctcggagcagcagcacgaggagcttgcaggaacaatggcggcccagggtcttctctctgggaggcacctgcttgggaggcctctgcagtcttccatctccaggtcgtcttcctcccggaagtccgcctttgtcgtcagggcattgttcagccccgctgccaagcaaaatgacaacaggcagctgtggttcgcgtacaaacagtccctcacctacctggacggcacgctgcccggtgactttggcttcgaccccttggggctggccgacccgcagggcaccggccggttcatcgatcccaggtggctggcctacggcgagatcttcaacggccggacggctatgataggcgtggagggcatgatcgccccggaggcccttggccaagtgggcctggtgccccc

SEQ ID NO: 49398 - DNA, 372 bp, Triticum aestivum
  Clone ID: PAT_TA_49398
aagctatatacctacatagggcagccatggtccccaccgtgatggccttgtaggccacctacgtcgctccttacacaggggctcaagtacaccgccggcctacccgttagccgccgtttcaacggagctagcctgggtagcgtgagcaacgggggaaggatcaagcgcatgcaggggtggcccatggaggtcatcaagaagttagagaccctgtactacttggcaccggtcagcaccgaggccctgcttaagcaggacgactacctggtccggtgcaagcgggtgccttgactggagtccagcaaggccgggttcatatttcgcgagcacaacgcatggcctgggtactatgatggcccaacctgaacaatg

SEQ ID NO: 49399 - DNA, 404 bp, Triticum aestivum
  Clone ID: PAT_TA_49399
tcgcaccaggcgtaccgtacacctgtcaagggacgaggaaaatcatggggttacatgggacgagcaacatgcttgagaacggcgcgacatggtacatgcaagagcactgtgatcgcggcagcgcgcggcttgggcacgcaactctggcgctcgtgcgggacgctggcccatccgaccctggcaatgggcaggtactcaagaccttccaagactggcacggcacacttgttaaagacgatctataactccaccgtaaccttcttaacgcccgaaatgtacgacaactggtgatttctacgctgcgctaaaggcagataggtgaccatatcaagcttatggtcgacataaatgaggccccgaaccaaaataagttcttccatgaaggatgccggctgcacgtagac

SEQ ID NO: 49400 - DNA, 450 bp, Triticum aestivum
  Clone ID: PAT_TA_49400
acgagaagagaagaggagccctccaccccggcgtcgcagcgccaaccaaaccctcgtcgtcgtgccggatcccgccgtagccgacgctggcggaggcatgccgttcacccggggaccctactgcggcaagagcacccttgacctcggggccagggtctccgcggacggcgttggcgttgtttaccggtgcatcaagctcgggattctgaagatgaccaagcccaaggaggaggcagcagctcatcactgaggacaagtaggtgcagggggttgacgccgaatattcacaatgtaccttccatatgtgcattcggttatgtgatttgtgtcttgaaacccaaaaaaccccagaccggtgtgggagctgaaacttaagattttgcttgtggaagataatatcgctcgttgaatcggcttggaatgaggaaagagtgaaacttaaaatccttt

SEQ ID NO: 49401 - DNA, 350 bp, Triticum aestivum
  unsure (1)..(350): unsure at all n locations
  Clone ID: PAT_TA_49401
gtcgaccacgcgtacgcccacgcgtacgttccagccgaaccatcacccccgaccacctccaaccccgtggcggcgcacccgttcccgaccacctnccacgtcgcggcggcgcccccacccccgaccaccttccacaccgcagcggctacctctccgcttccaagtggctcccggtggcggggagctgctctgaccagcctgctcgcgccgnccgnccctagccaccaccacgcgccgnctgccccctgttgtgcgccgtcgnccgccccgaccaccacccagcttcatctcccaggtcgcgaccatgccttgaccccagctggatccaaactccccgatggcctggatcg

SEQ ID NO: 49402 - DNA, 368 bp, Triticum aestivum
  Clone ID: PAT_TA_49402
gatggaggcactaattaacttagtgctactatgaacattcttatacgagattttggatattagagttaagaagtttgttcaggccttagggatgcattccatcatcactggccatcaacaaggtcaactccgacaatggttcaccgataatgtgggccggtgcaccacgtcagcaacgtcgacggcctgacaggccattttccaactgggcctattgtaaatgaccagaccatgaggatgtaatcagtaatggtgctcctgaaaatgaagatgtactttgccggtccactaatctcggcaaaagagtagattatggtgcttcttgggctataggggaattgaatcaccaaaaattctataaattcatc

SEQ ID NO: 49403 - DNA, 425 bp, Triticum aestivum
  Clone ID: PAT_TA_49403
tcgacccacgcccacgctcacttatggattgattctaggaatatgcacaaactaaattcagattcagagtaagtactgaatcggagtgagttctccctttctgggacttagtcttctgtcatgtgattttatcttgaaagaacagaaaaaattattccatgtgagagaaatagcccggtgatgtgtgattcatcgactgaacatctgttagaacagttggctagatttcttttccgcttagctacaacattagttcgatttgtcccttattgtgaaaaacaaagggtttggtttctttgtgttggattggtgcttctgaaagagaatggggaagaatggcctgttcattggcctctattgttcgatttggtctccctaacttattatgatggtgtcagggctggcttagttttgttcatccttgc

SEQ ID NO: 49404 - DNA, 188 bp, Triticum aestivum
  Clone ID: PAT_TA_49404
gcttattggtgccgatatggattcagccggaacatccgaagcagctcactgctatattcagaaatctgtccgatgtgtcccttctggtatcttccatgagtgtgatctgagctggaccctatttatccttaagctgcacctgcctgcaagttacagaagcagtactttctttttgattaatcacatta

SEQ ID NO: 49405 - DNA, 246 bp, Triticum aestivum
  Clone ID: PAT_TA_49405
cctacgcggtctgaaagagctgctctcggttaacccagtgttgacatttgcatctgggctcacgttgcttgcatgtcgccaccatggtatctcgttcttgactactgcccactggtttttacttgccggacagcttgcacttaactggatggattgattgctgtagaatctttttttgagatctgataatattaaacatgttggcgcgcttgcatcagtgtatattaggatttagaggcgtattgt

SEQ ID NO: 49406 - DNA, 479 bp, Triticum aestivum
  Clone ID: PAT_TA_49406
cccacgcgtccgcgacgaccaaagcgatgaacctgcagaggtcgtctccttgccagctgctgctccgagcaccggtgaggcagccatgcagctcgaggagaaatgcgacatttccagggggaaatgggtgcgggagccgaatggcccggtgtatactaacctgacgtgccccatgctgccggacttcaagaactgccagaagttcggcaaggacgatgcccacctctactggcggtggcagccggacggctgcgagctgccgcggttcgtgccggagcggttcctcgacgtcgtccgcgggaagcggctcgccttcatcggcgactcgctggcccgcaaccagattgactccctgctttgcctcctgtcccaggccgaggcgcccgtggacgtgtactcggacgcgttcgacaagtaccggacatggcacttcccggcgcacaacttcacgctcatggtgatgtggaccgagttctacg

SEQ ID NO: 49407 - DNA, 408 bp, Triticum aestivum
  Clone ID: PAT_TA_49407
cttgcctaacaaatcacaagataatgagcgttgtagtgaccaagtcctcgccggcggtggtcgccggccctttcgacgccggcatcgtccatctctcctcgttcgacaggtgcatgggccctactgaggtcacgctgctcctcgtcttcgaccaaccaatcgaccaacccgtcaagaccatcaaaaacgccctgtcgcaggcgctggcgcactatcccccgatggccggccgcctcgccgccaccggcggcgacggggagctccacatcgcgtgcaccggcgagggcgtgtccttcgtgggcgcgtcagctagctgtgccctggacgacgacgatgtcacgagatcggcgctgctccacggcgaccctgccgtcggctaccccgccgaatactgcagcctcatcgacc

SEQ ID NO: 49408 - DNA, 371 bp, Triticum aestivum
  Clone ID: PAT_TA_49408
gactcccgtatgtctgcctatggatatttgagcacgcttatggccccagaatgtctgcaatttgcatggctcaagagagtggttgcctcgcaccatttgcaggtccaattcatatgtcgaatctggctgcacataaaatcccaaagaagcatggcatgggtccaaggaggttgaagtggttcaaaacactaacttgcggccttgcaacttctaggatgcacagatctgtaactgaagcagctgcaatgttgatagacatctggaattaggaagagcagcgcaaagtctgtgtatatgcagttccatgatatgatcacgctatatgctctgaagcaacgaggcacatgtacggctcatgcttgactcaatca

SEQ ID NO: 49409 - DNA, 369 bp, Triticum aestivum
  Clone ID: PAT_TA_49409
gctatagcgagagctattaatcaatgacagatcaggaggtgcttatgtcacctcaaacagcatcttaagcaggtgtcgcattcaaagctgctcctaaagattataaattgacttactacacttcatagtatgaaactaacgatactgatttcttgtcaaaattcccagtaagccctcatgctgcggttgcgacccaagtagcacgacctgcagtagctggcgaatctgatactggtacacggacaactgttgggactgatggacttaccaatctcgatcgttacaatggacaatgctatcacatcgagcctgctgctggtgaagacagccaatggatctgctatgtagcttatccattagacctatttg

SEQ ID NO: 49410 - DNA, 432 bp, Triticum aestivum
  Clone ID: PAT_TA_49410
aaaactcgatctgtacatattcaatgcatagcagctaccgtgatagcctctttggtcacatccggctctgagttcgagatcgtaaaggccacggaccaaccacgaacgagccaggcgttccaacggcgctagcgctggacgcctcagcaacgagcgaaggatcacgtgcatgcatgtgtggcccatagagggcattaaagaagtcgagaccctgtcttacctgccaccgttcagcacggaggccctcctcaagcaggtggactacctgatccgctccaagtgggtgccttgccttgagttcagcaaggtcgggttcatcttccgtgagcacaatgcgtgtcccgggtactacaacgggcggttctggacaatgtggaagctgcctatgttcgggtgcaccgacgccacacaggtgatcaacgagggggggga

SEQ ID NO: 49411 - DNA, 402 bp, Triticum aestivum
  Clone ID: PAT_TA_49411
gcttcgccgtgtatacctactctcgattagacctggaatgcctctccaagccacgcaagacctgagctcctggcatggccgcctcgatccagtccttcaaggcccggcagatcttctacagtcgctgctaccccaccgtgcaggctgatgtctgctggtcaaacggaaccttctccagggccggtggtaccagcggcgcatgcactgccgtctatgacgctttgcagcttgggaacagcctataccgctacttcggcatgggggttgagcagtgcaggcacagtgctgactgcattatcgcacctgctccgaccgtatatgccttaccgttctaaccgagctcgtcacctgtttacgctatcaccttgatggcaccaagcacgtgtgatgccggggcaagca

SEQ ID NO: 49412 - DNA, 478 bp, Triticum aestivum
  Clone ID: PAT_TA_49412
cccggcggcgtctcgtagcacaggagaaggagcaggcggcggcggtgcccgaagaggagtagcacggcgacctatcccgagctcgcaaccatggctaggggtttgatgaagcatctgaagaggctcaatgccccgtctaatgggacgcttgacaagcttgggggagcttttgcccccaagccatcatctggtcctcacaaggccagggagtgcctgcctctgatcctcatcctgaggaacagactgaaatatgctctcacctaccgagaagagcaatctatccttatgcagcgtcatatcatgggtgatggaaaggtccgcactgtcaagacctaccctggtgggttcatggacatcatttgcattcccaagactggtgagaactacaggcttctgtatgacaccaagggccgcttccggcttcactctggcaaggatgaggatgctatagctcaagctctgcatagtcaggtctgtg

SEQ ID NO: 49413 - DNA, 478 bp, Triticum aestivum
  Clone ID: PAT_TA_49413
gcagagaaaatcaagaagcagaaatggcagttcttggtctatctactgccttctctcccccaagaggttcttggatagccgtgaggctcaagaatggcgccgccgccgtggccgtccgcgcggaggtgagcttcgtggacggcgacgaggcgaagcggctggtggcggaggaggggtacacggtgctggacgtccgggaccggcggcagtacgagagggcgcacgtcagggcctccgcccacgtcccgctctacatcgagaacgaagacaacgacattgggacgatcatcaagcggcaggcgcacaacaacttcgccggcctgttctacggcctgtccttcaccaagctaaaccgggacttcaccaagacggtgaggagcaagttctcgccggagagcaagctgctggttgtctgccaggaaggcctcaggtccacagcggctgcagatgcattggagcgagagggcttccagaacct

SEQ ID NO: 49414 - DNA, 438 bp, Triticum aestivum
  Clone ID: PAT_TA_49414
ccgtgccactgggagaatcattaattcaagagttattgggagggacttatgttaccacaaacagaaactaacgctggtgcttggatttaaatgctgttgcataaatgatctatcataatctgagcttgacctaactaccagcagcaggtactgacaagcttaagtgactatctgactattgccgggaagcattgcctagtatgtgctatccatgaggctgccctctaagaagcatgtggtgttggagctgccgattattgtactgttacatgtacaactgcttggactgttggacttaccaactttgatcggttcaaacgacgatgctatctcatcttgcctggtgctggagcacacagaacatgcatctgcattgctgcttattcattagaacaatcctgagagggttccgcgtctaacatacccacttgcattgta

SEQ ID NO: 49415 - DNA, 439 bp, Triticum aestivum
  Clone ID: PAT_TA_49415
atcatgtactgcatctctgccgctctctgctagctaggcacggagccctgtaacatgatgaagcatggcccacatgtccagtgcatagcacagagcgggagctacatgcttcgcggatgaaaaatcataggaatcgcttatgcactgcaagcgcacatgctttgaaccatttgtcatggcactggactattatcatctgctctggattccttgggatctgtacttcagcatgcctgcattgctgactaggctctgccataacctctgaaacacgggcatttcttggcatcatgaactaatacgagtgaaggtggtgcacgtatagatcactgagtttatggaagtcatgcatggcttcgatcgtcttggtcgccccatggcatatatctatggcgcacgccactttcccgcccggcgaggccctgacggtttaaaggag

SEQ ID NO: 49416 - DNA, 485 bp, Triticum aestivum
  Clone ID: PAT_TA_49416
aagaaagccccctgcacaggaatagtaaagaaatacgtgaacagaattctgatgcactggccaatggcacaaaacatgcttctgttgaacgaggccatatcaatggcagtggcacaaaaggggatactgtggtgggctgtggctggggcattctatttatagaaaagcttgtgccaatcatggtcaaccttttcctggaggctccaccaaatgaaaggtgtagtgcctcaccacaagttattcaaggtgttggaaggtgcatgaacacaaggagagacaatcccaggggtaccctttggagggtttctgctgaatgcttcaatcgtgttgtgacagatgaggtgaggcaggaaaatgctgaatgtggaagtgacatgaattcatatagactttctagagctcgcttctggaaggaggttgcagatgtatacgaaacctttcttgttggatcttgtgggcgtgtgttgtcttcagatgttccttca

SEQ ID NO: 49417 - DNA, 140 bp, Triticum aestivum
  Clone ID: PAT_TA_49417
tccgcccacgcgttcgaggacgcgttattcggacgcgaagagtgattcgcatctcctggtccggtcaggtgcaggatctttggggagggtatcacacatagctagtggtaaagattatgaattgtcttactacaccccag

SEQ ID NO: 49418 - DNA, 498 bp, Triticum aestivum
  Clone ID: PAT_TA_49418
ggctttcatgcgctcgccgtcctcatccatggctctggctccgctgccgctactggtggcagccgcattcctcatcccctccatggcttcatcagcttcacataccctggaccatggcttggatggtgaggcactgctgatgctggggaggttccatgggtggatggcggcgcacggtcggtcgtaccccaccatggaggagaagctgcgccggttcgaggtgtaccggagcaacatggagttcatcgaggcggcgaaccgggacagccggatgagctaccgccttggcgagaccccgttcaccgacctcacccacgacgagttcatggccatgtacagcagcaacaacgagtcgtcatgggagtcggaggagacgacggtgatcacaactcgcgctggccccgtccacgagggcaacgccgccgtcgaagagccacctcgtcgtaccaataccaatctgacggcggtgttgcctgcgagcgtggatgggagggagaa

SEQ ID NO: 49419 - DNA, 348 bp, Triticum aestivum
  Clone ID: PAT_TA_49419
cgtagcagcagcagcaacttgttcatctcatatcacccaggccaaagacatagtcgttctgtaacacgacacacttaattaagcaaccgatggctgctgcgcatgtctccttccccttctcagttcagccactgcaccattcggcttcaccgctggccggaaatggtggccggagcggacgcaaccgtgccttcttccgcccatcaacggtgatatgtcccgggcgggagcctgcgtcacatgtgctgtccgatgattttgacttcgaggaaagcataacgaatgttcaagcactgctgcatcaccatcggacgagtcgacgaggcttattgacccactgtgatcacc

SEQ ID NO: 49420 - DNA, 480 bp, Triticum aestivum
  Clone ID: PAT_TA_49420
atggcaagcacctacctctcaagcttccaggccaccgcccgtagcggcggcgcgtcaccgaggccgaggccaagagtggtgacatgccacgcctccgagccgtcgggccggcgatcagcttgcctcagtctaggtctcggccttgccaccgccgctcagctccacacagcgcccgcccgcgccaccgctgacgccgacgaggacccggagccggccaacaacggctggtggctcaccgagttccccctgccagtgcccaagatccgcaacaaggagatcaacaatggcgagacagggacgcgatcctttgtgaagaacggcatctacatggcggacatcgggccaagctttcgggcgcacgcctaccgggtgcgcagctccgccttcgacctgctggcgctggaggacctgctcggcaaggaggcctccaactatgtcaacaagtaccttcgcctcaaggccaccttcatatactacgac

SEQ ID NO: 49421 - DNA, 339 bp, Triticum aestivum
  Clone ID: PAT_TA_49421
gacagagttggcaagcaagctcagacagacagagcttgagagagcgcgcgcgagatggcagccttcatgatcacctagccaattgtggcgccgacgagcctgccgtacctctctcgactgagctcctccttcgccgtcctttgcagcggtggcaagaagatcaaggccgacacgcccctcggactcggaggcggcttgacagtcgtcatcgacgccaacgacaggcaagccggcaaagaaggcgtgtaccagcttggtgacaatgtccgcgccaacgttgacggctacaggccaatctacacgccggaggaatggtctgaatctggcgaccggttcccc

SEQ ID NO: 49422 - DNA, 392 bp, Triticum aestivum
  Clone ID: PAT_TA_49422
cggacgcgtgggcggacgcgtgggttccgctgacaaccgcagcaacccccacccccaccgtggtggcgcagcagcactgggcaccgtggctggtggccggggattgagaccaacgcgagaaaagtctggtgccgtccagcttccaggattctccaccattttaggtgacctgtgactcaaatcttggcctggtctttgctatctgaagacctgatattcctcatcaatttcaagtgtacctggactcctggagaggggtctaccagattttgcaagaacaagatcttgcagttttgtatactttgccactggatttggggatggagaggcagtctaagctccggttcggcgcgctggagaagctcaagagcttccggggcatagagaagcag

SEQ ID NO: 49423 - DNA, 406 bp, Triticum aestivum
  Clone ID: PAT_TA_49423
cccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtgaccttcgcgttggacgaggtgatgcgccaggcgatcgaggccatgaacggtcaggacctggacggccgcaacatcaccgtcaacgaggtgcaggccgttagctccggtggacgatgctgcgctaggtcatgcagacgctcgtgctgatgccgacagctttagcaagtgctgtctggaggttgtaggccacttt

SEQ ID NO: 49424 - DNA, 481 bp, Triticum aestivum
  Clone ID: PAT_TA_49424
gacccacgcgtccggtgccgcagccggagagccggcaccggcgggcgtgcatgccgtgccctcccgcaggctgatcgccggcttcatctcgggcacgctcaatggcctcttcgctctcgctggagcactaaccggagcagtcaccggcgcgctggcgggcagagcctccgatagcggcgttctccggggagctagatctggagctatcaccggggctgtcctctccatcctggttctccaggcatctcgcgcctactggtgctcagaccggctcggcgcgtcatccatgtccatgacagatttcatagagcagctccttcatgcccggtttgagcaacagcggcttggattttcagcacatacatcacaccagtcacaggatatggtagctggcgagacagcaaggaggttgccgaattgctcccatgcttttcaccagccctgcgtggacaaatggctctttacccacggttcatgccct

SEQ ID NO: 49425 - DNA, 172 bp, Triticum aestivum
  Clone ID: PAT_TA_49425
ctcgagtcggatatcggcggcggatatctttggtgaacgcaacgcatgttcgaggtactacatgcgccaggcatgaacgcccaccttacctgcgtcagtcttaaaacacgtgtcttgactcaggatgccaacgaggatctggctgtcatgtctaccagccctgtccagattg

SEQ ID NO: 49426 - DNA, 99 bp, Triticum aestivum
  Clone ID: PAT_TA_49426
cagaaagagatctacaagcacgccacgctatgcccacgccgaccatgtacatgggcccgtatggtgctccactaggttaccactgcgacattaatgctc

SEQ ID NO: 49427 - DNA, 374 bp, Triticum aestivum
  unsure (1)..(374): unsure at all n locations
  Clone ID: PAT_TA_49427
nccacgcgtccgtcatagtttggttaccacaccagctccattattttaacgcacatcgagaagaacctggagggcctcaccgtgcatcagtgaatgagaccgtccaaggctgggtgtgggagttcgcctaggcctacttagccgtcaatgactccgggtggcaccagctcgtcagccactggctgaacactcacgccgtgatggagccgcacgtgatctcgtcgaaccggcacctcaaagtgacgcacccggtgcacaagctgctgagcccggactaccgcgacaccatgaccatgcagacgctcatgaacgccggcgtcatcttcgagattacagatcgcgctgtggatgtatatggtggtgtacacagactg

SEQ ID NO: 49428 - DNA, 445 bp, Triticum aestivum
  unsure (1)..(445): unsure at all n locations
  Clone ID: PAT_TA_49428
cgttgcgagaattcttaattcaagagttatagggagggacttttncaccacaaacagaaactaaagcaggtgttggatttaaagctggtgttaaagattataaattgacttactacaccccagagtatgaaactaaggatactgatatcttggcagcattccgagtgagtccttagcctggggttccgcccgaagaagcaagggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgttt

SEQ ID NO: 49429 - DNA, 326 bp, Triticum aestivum
  Clone ID: PAT_TA_49429
atgagggctacagcgcgcgcgctgaacttaaagctggtgtgtaaagattataacatggacttactagcaccccagagtatgaaactaaagatactgatatataggcagcatcacgagtaagtcctgacactggggttccaaccaaagaagcaggcgctgcaggagctgccgaatcttctactggtacatggacaactgcttggactgatggacttaccagtcttgatcgctacaaaggacgatgctatcacatacagcctgttgctggggaagacagccaatggatctgctatggagcttatacattagacctaaatgaagagggt

SEQ ID NO: 49430 - DNA, 372 bp, Triticum aestivum
  unsure (1)..(372): unsure at all n locations
  Clone ID: PAT_TA_49430
cccacgcgtccggccacgcgtccggcctccttctagcaagctnttacctacataggacagggatgggccccaccgtggtggcctggggggccacctccgtcgatcctttccaggggctcaagtccaccgagggcctgcacgtgagacgccggtacaacggcgctaggctcgggagcgtcagaaacggtggaagggtcaggtgcatgcaggtgtggcccatcgagggcatgaagaagttcgagaccctgttctacctgccaccgttcagcacgggggccctactcaagcaagtcgactacctggatccggtccaaatgggggccttgcctcgaggtcagcaagggtgggttcattttccgggagcacaacgca

SEQ ID NO: 49431 - DNA, 407 bp, Triticum aestivum
  Clone ID: PAT_TA_49431
cgacccggcggcgtgggaggacccgctggagttccggccggagcggttcctgtccgggccggcggccaagatcgacccgatgggtaacaacttcgagctaatcccgttcggcgccggcaggaggatatgcgccgggaagctggctggaatggtgtttgtgcagtacttcctcggaatgctggtgcactcgttcgagtggcggctgccggacggcgaggagaaggtggacatggccgagaccttcgggctggcactgcccaaggccatcccgctcaaggccgtcgttacgccgcggctcgtgccggccgcctacgcatgattgttcgtgtttcttgagttcaggacgatcagtgtagtgttttatgttgggtgtgacccaagctttgtgtgctgcatgcttcgtacat

SEQ ID NO: 49432 - DNA, 419 bp, Triticum aestivum
  Clone ID: PAT_TA_49432
cccccgccctctcgccggcggcgtatttcccctttcccagaccaggtatgaagagggccgcgccgtcggaggagccggtggagctctcttcgggcgacgacctgagctcggattccgacgatgaggccgggaacgggaaaggcgagaactccttccggctgcccatgtcctccaaatctacagctgcagcaaaagcatctatgttgaagaagaagaaacctggtggtgtggatttcagtgctttgagccggcacgggtatcgtggcggaccatctatactgacagttgctcctccaaaggttgaacctaactggacttggtccactgggaaagatcgcaacgagaaggaagttctaaccgagtcttttgaagagcgggaacgcacaagggctgcagtaactgaaggagagaagcttatc

SEQ ID NO: 49433 - DNA, 446 bp, Triticum aestivum
  unsure (1)..(446): unsure at all n locations
  Clone ID: PAT_TA_49433
tccacgcgttcaaccacgcgttcgtcgacccattcnttgattgaagatcaacccgtagggtctcattgaggtgaccctttatatatacacaattcaatctttacaataacaatcatagtcatacaatcaccaatgtgccatcactctgattatcttcatgatgcttaaattatatgctctacacaacctgcccgcgcattattgatgcttctgttctatagaacttacgtggtgtcccactacattcagctatgtaagcgttgtctatctgcagtaacccaggcgctatcatattggatacagcactattttggtgctgttacacgattagattgtttgatctactattacaggtatggtatgttaatatggatcctgttacaggggcaccgttccaggatcacgagtgcctaatgcctaactgatgagatgtatatgaaaatgac

SEQ ID NO: 49434 - DNA, 405 bp, Triticum aestivum
  Clone ID: PAT_TA_49434
cgagatccccgccccactcccccgaacaaccgccgccgactcgccggccctcgccgccttccccgtcgccggcgctcccgctgtagtacgttgcaggacttcgtgtgctcttcttcaccagtgccgtctaagatggtgtcctttgagatgaatgaccttaagaagatagggctaggcctgacaggctttggagtattcttctccttcctgggaatcgttttcttctttgacaaggggcttattgctatgggcaatatactcttcctgtcaggtttgggtttgacaatcggtctgaaatcaacaatgcagttcttcacaaagcctaagaattacaagggtaccatctcatttggcgcaggctttttcctggttctcattggatggcctttctttggcatgctctta

SEQ ID NO: 49435 - DNA, 164 bp, Triticum aestivum
  Clone ID: PAT_TA_49435
cgtggaaatagacttctggccctctctcgatctggcaggcctccctcccccgatgtccagcagccgcggcgacgctcttcttgactcggcgccgctgctcggcgccggcgccggctgcgagggccagcgcctggtcaacgcgctccgccggccgtccttgagcg

SEQ ID NO: 49436 - DNA, 411 bp, Triticum aestivum
  Clone ID: PAT_TA_49436
ggccgtgggctcaggccccggcgcaagcccacctccctcccgcaccaacccccaccgccgccgccgccgccgccgttccccacccccggcctccactacgagctccacgaccgaagggggcgtaacaccggcacccttcctcgcccctcctcccagtcctaggctagctccctcacacacactctccttccatggcggatcggcacggcgagggcggcgtggcctcggcgcggcggccggggcacacagagttggacgacccatcgacaacacgctgctgcagcgcgtgcaggcgcacctcccgacctcgacgcaggtggtgggcctcctgaccctgctcatcgccggcgcggcgctgctgcctgctggtgctggcggggctgaccctcatgggcgcagtggtggcggtcg

SEQ ID NO: 49437 - DNA, 415 bp, Triticum aestivum
  Clone ID: PAT_TA_49437
acacgcgtccgcttatccgttcttcctccacgtgcgagggaccttgtcttaggaccggtgcacatgcaacattttgctcacgaagcaacacaaaccgtcggacgacgcggcggccgtgcctaccccggggacggactactggcatgctccacccgagggggcgtcacacaaccactcttcattaacacatcctcagaggatgggattgatcactcacacacactgcccattaatgggagatcgccactgacagggcggtgtggcactcccgcgcgggccggagcacacagagttggacgacccatcgacaacacgctgctgcaacgcgtgcaggcgcacctaacgacctcgacgcaggtggagggccttctgacactgcttatcgccggctcgacactgatgactgctggagctg

SEQ ID NO: 49438 - DNA, 294 bp, Triticum aestivum
  Clone ID: PAT_TA_49438
gcaagaagatggggtccgtctccttcgtgatcgactgtaccatgcccggggaggacaagatcatggagatcgcgtgcgtggagaagtgtcccccaggagcgcatcaaggtcgtcgggagcatggccgagtacctcggggtactccgtgaccgtcacgctcgacaagagcaaggtcaccgtcacctccgactgcgccctttgcatgaggttcctcaaggtcttgtccatgaagcacgtgcagaagcacaacgtgcgggactggcttggggtgatcgcagccatcaaggagcgcaa

SEQ ID NO: 49439 - DNA, 329 bp, Triticum aestivum
  Clone ID: PAT_TA_49439
tttaggcacgggcagatgcaaactataagcaggtaacaagacaaacaggcatccaccatggcgacccttatccagctcgagaacaactatgaaaagcatgactcaaccaagcttaaaaatgcctactgtctcaatacaattggagaataagataatgactacagtacatctgagtctgatcatgaagaaatcactcctgaagcaaagaactatactatgcgactagaataatacatagactttgactaagaaacaagaatggaattttcctggcacacaaaaccaccgatcaaaacttccatgatctgtagaacacaatacctaatcaa

SEQ ID NO: 49440 - DNA, 280 bp, Triticum aestivum
  Clone ID: PAT_TA_49440
ctccgttctggggcggctccggtgctctcgtgcgcgcgttcgtccgagaccaccacctagtcgaccaagaagagatggagatgaagaagatcgcctgcgccgtccttgtcgccgcctacgccaccgaggccctcgccgccgacgccccggccatggccccggcccccggcgccgccagcgccggctacgccgccgaacacgtgccggtcggcggcgcaatgctcggggcctccgggctatccttcttagtctactgcctggagggagcgcgccctggccc

SEQ ID NO: 49441 - DNA, 251 bp, Triticum aestivum
  Clone ID: PAT_TA_49441
agaacaagatggccatctggagggtggacaggcggaaaggggtcctcatccttctgtccggtgccatggatgagttcaggcaagagcacaaggaggagcaccccgaggcaaacggcatcgtgctcgcttcacataggggatcgacgagaagaggaacaagacgatcgatgagaagaaggcagagtatctacgagcgatggcatactcctactacggccaggtggccatcatgaacgacagggccttctaca

SEQ ID NO: 49442 - DNA, 373 bp, Triticum aestivum
  Clone ID: PAT_TA_49442
catgccactgagtgagctgcagaccgacgccctcaaggaggccatcacccacgtggcggcacaccccaaggagaagaacaggaagttcaccgagactgttgagctccagatcggcctcaacaactatgatccgcaaaatgacaagcgtttcagcggctctgtcaagctgccccatgtgcctcgccccaagatgagggtctgcatgctcggcgacgcccatcatgtggaagaggctgaaaagattggtcttgattccatggatgttgaaactcttaagaagacgaacaagaacacgaagcttgtcaagaggcttgtcaagaagtaccatgctttcttggcgctaaaggctatcatgaagcagattccacgtgtt

SEQ ID NO: 49443 - DNA, 320 bp, Triticum aestivum
  Clone ID: PAT_TA_49443
cctgcacgccgcgtggtcgcgctacggccggctgccgtggaagtccctctttgcgccggcgatcgcgctcgcgcgtgacggctacaccatcgtgtcatacgtggccaatgcgctcaaggacgaggaggtcgacgtgcttgccgaccccggcctgcgcgccgtgtttgcgcccggcgggcgtctcctgcgcgacggcgagctctgccgcaacccggcgctggccgacgtgctggaggccctggcggaggacggcatcgcggcgttctatggcggcgccgtcggggagaggctcttggaggacgtgaggcgggcggtgggca

SEQ ID NO: 49444 - DNA, 259 bp, Triticum aestivum
  Clone ID: PAT_TA_49444
tggcagacgccaacgagaggaacgagatattcagcgaacctggggagcgccaaatcgtgctacacaactattatccagaacatggcaagcgtctcatctgctatggctagctgaccaatgtacttattgacatgcagagggtgtgcatgctctgatacgcacagcaccttggtgtagcgggacatattggtgtagactgcatgcatgttgaagctcttaagaagagcaacaaggacaaaaggcgtgtcacgaagcttgt

SEQ ID NO: 49445 - DNA, 381 bp, Triticum aestivum
  Clone ID: PAT_TA_49445
ggatttaaagctggtgttaaagattataaattgacttactacaccccagagtatgaaactaaggatactgatatcttggcagcattccgagtaagtcctcaacctggggttccgcccgaagaagcaggggctgcagtagctgccgaatcttctactggtacatggacaactgtttggactgatggacttaccagtcttgatcgttacaaaggacgatgctatcacatcgagcctggtgctggggaagacagccaatggatcttgtatgtagcttatccattagacctaatttgagagggttccgctactaacatgtttactttcattgtaggttacgtatttgggttcaaagccctacgtgctctacctttggaggatcta

SEQ ID NO: 49446 - DNA, 355 bp, Triticum aestivum
  Clone ID: PAT_TA_49446
atccgatggccgtcacgttctacgaccttcacaccgccgacgggctcaaggccctcgaggcgcacctcgccggcaagacctacatctccggcgatgggatcaccaaggacgacgtcaaggtgttcgcggtggtgcccgtgaagccacacgccgagttactgaacgctgcccggtggtacgacgccgcttccgaggccgtattttaaaggttacctgaccaggcctatgaggcgagtgcatactcagatgctgctgcagctgctcctgctgctttcaaggatgaagatgatgacgatgacatggatctgttcgatgatgagaccgaggaggacatgaaagcatcagctgagcgtga

SEQ ID NO: 49447 - DNA, 300 bp, Triticum aestivum
  Clone ID: PAT_TA_49447
gaagtgcgcccgtgacgaggcgggctgcgccgtccacgaggcaggcggcggcggagaggatgcaggcggcgccggccggcaagaggaggtggccggcggagacgaggcgtggaggcctcaaatagcaagcagcggtcgatttggggggcggagcggcggacgatttgggagcggaggtcaccggcggcgtccccatgggtgtatgaggatctggccttcgtcgtctgcttacatacaagacgccgcaagcgcggagcttgggccagagcagcgttgctcggggaggagctgcagcaggag

SEQ ID NO: 49448 - DNA, 490 bp, Triticum aestivum
  Clone ID: PAT_TA_49448
cctccttttccgttccttttttcccttttcgacccacgttatttattatcttaagagtttattttattttactttttattccataatacagaaactaagggagggggtggatttaaagctggtgttaaagattataaattgacttactacaccccaaattttgaaactaatgatactgatatcttggcagcatttcgagtaagtcctcatcctgggggtccccccgaagaagcaggggctgcagtagctgccgaatcttctactggtacatggacaactgtttggactgatggacttaccagtcttgatcgttacaaaggacgatgctatcacatcgtgcctgttgcttgggaagacagccaatggatctgttatgtaacttatccattagacctatttgaagagggtttcgtttctaacatgtttactttcatttgtagtaacgtatttgtattcaaaaccctacgtgccctacgtttggaggatctac

SEQ ID NO: 49449 - DNA, 458 bp, Triticum aestivum
  Clone ID: PAT_TA_49449
ctcttaatcttctgcgcctcatcctcttcctccactaaaaactaatactacaagagtaaaagggatggatcttttctccccttcaaacatctaatccattcttttcccgtagtctccaccccgtgtccccgatcgccgacctacacggccgccggccggttcctcctcctctaatgagattagagtccagaaggaacacgtccgtgcgactccaggcagggtctcaaccatggcatggactggagggcctttcgttttggcctgcaaggaatgaggtggtggcgacactgcggcaaggtctctgttggcagcaacaacttagaggagtgctcgatccagctcctccgacgagcaatcaatggggtgcgtgtgccaagctgatggattttcttctccaatgctaccagataggtgtctgtgcgactaggccctgctccagatacgttgatttctgcaac

SEQ ID NO: 49450 - DNA, 448 bp, Triticum aestivum
  unsure (1)..(448): unsure at all n locations
  Clone ID: PAT_TA_49450
cgcacgcgtgcgctgacacttggaccatcaccaacggtccaaccaccgactcttattcataggggcacacacacatactaacacagtgctttccatcaaacatttcatcaatatagatcaacagatttactacaatcgagcgtatataacttattatactcacatcctagcacgattacaagaatgccctaaagctcttgatcaatcctaataagcatgcactcgcagancttgtcgaatgttctactggtacatggacaactgttaggactgatggacttaccagtcttgatcgttacaaatgacgttgttatgacatcgagcctgttgctggataagacagccaatggatctgttatgtagcttatccattagacctatttgaagagggttccgttactaacatgtttacttccattgtaagtaacctattgatattcaaaaccct

SEQ ID NO: 49451 - DNA, 458 bp, Triticum aestivum
  Clone ID: PAT_TA_49451
gtcgacccggccggcctccccacctgaatccagaattccagatccctctccgctccgctctcctcacctacctacctcgtcgccacgggcaaaacccccggccgctctccaccctgagccgccgagccgaggcgccgatgcagtcgccggagtcctcctcctccgccgcgccggtcctcctcaacatcggggggacgaagtacgcgaccaccgccgagacgctcacgcagcgggagcccgactccatgctcgccgccatgttcagcggcaggcacacgctcccgcaccaccccaccacgggggcggtgttcgtggacagggatgggaagcatttcaggcacatcctcaattggctaagggacggtgccatcccggcgctctcggagtccgaacaccaccaactcctgcgagaggcggagtactaccagttgctcggtttggctgattacattaatgag

SEQ ID NO: 49452 - DNA, 467 bp, Triticum aestivum
  Clone ID: PAT_TA_49452
atgtatgggagttcctgcacgcttgtcctgagcactggaaatggtgtcaacggcttcacgcttgacccctctctcggggagttcataatgactcatccagatatcaagataccgccgaaaggaaagatctattcggttaatgaagggaacgccaagaactgggacacgcctactgcaaagtacgtggagaagtgcaagtaccccacggatggttcatcacctaaatcccttagatacatcggcagcatggttgctgatgtgcaccgcaccttgctatacggcggcatatttctgtaccccgcggacaagaagagcccaagcggaaagctccgtgtgatgtatgaggtgttccccatgtcattcctgatggaggaggctggaggccagtctttcacaggcaaaggacggtcgctcgacctgatccccaccgacatccacgagagatcgccgatattcctcggcagcag

SEQ ID NO: 49453 - DNA, 473 bp, Triticum aestivum
  Clone ID: PAT_TA_49453
cccagagcgacgcatcggtgctcaccagcgctgtcattcatagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtgctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctc

SEQ ID NO: 49454 - DNA, 174 bp, Triticum aestivum
  Clone ID: PAT_TA_49454
atcatgcgttcgctcccatgttcatttaccctaccggtacacattctagaccagcggtgaggcgagaatcagttagcaagacatctaagacttactcctatgcaccacgtggtgactctaacgggcttgccagatcactagacccgcggactacgcaagcacctgtagacctag

SEQ ID NO: 49455 - DNA, 351 bp, Triticum aestivum
  Clone ID: PAT_TA_49455
cccacgcgtccggcacgcattatatatgcttcttcggcttcggcttgttcttctactacctgttcttctacttctccttgaaggtggcagcgcctaccaagctctattccggcgatgaccattccagcagtgcataacatggggcaagacgagcgccagcatccacagctgccggacatggagaaggagctctatcacgacgcggtagccggcgagcactgcagcagcccacaggcgggggtgtactgtcgggccgacagccacaggctctgactgcacgtgcgaccaggacgtgcacgccagcaacagggtctggtgcaagcacctgcacgcccagttatgcaccgcatg

SEQ ID NO: 49456 - DNA, 469 bp, Triticum aestivum
  Clone ID: PAT_TA_49456
cggacgcgtggggctgtttgggccctccacgggaaggggaagccggcgacgccatggacggtgttaagctcaaggtcaccagcagatacgttataattaaaaatgacatattcgagctgacgctgtccaaccccgacggtattgtgactggcgtgcgctacaacggtgtggacaatcttatggagattcttaacaaagaagacaaccgagggtactgggacattgtatggaatccaccaggacagcgaactggaatatttgatgtgatcaaaggcacagagttccgcatcatacatcatgatgaaaaccaggctgaggtctccttcactagatcatgggatccttctcaggaagggaaagctgttccgctcatcatcgacaagaggttcatcgtgcttcgcggctcctcgggattctacacatatggaatctatgaacacaaggaagggtggcctggtttggcattggg

SEQ ID NO: 49457 - DNA, 347 bp, Triticum aestivum
  Clone ID: PAT_TA_49457
acagactaaagcactcgctggatcacaggctctagaccgggccgcaaaaccagaggatgagggagcttttctgcttctacttctccgtgagtaccgtccgagtcatctcaaacaccgtggccaggagcgtcatcaagccgggacaccgacctcgactctaccaccggcggctccaaagggacagcactgtgcatgcgatcagggccgactatctgcctgtgaaacgacattcggccagccacggggaccgttggcgacacatgtctgctgacaaagcagactatcaggccggcgatctggatgagcctcgtcgctttgccggaggcctgcttggacatggccgctga

SEQ ID NO: 49458 - DNA, 437 bp, Triticum aestivum
  Clone ID: PAT_TA_49458
cccacgcgtccgcccacgcgtccgcccacgcgtccggcagatcttcgtcaagaccctgacgggcaagaccatcacgctcgaggtcgagagcagcgacaccatcgacaatgtcaaggccaagatccaggacaaggaggggatcccgccggaccagcagcggctgatcttcgcggggaagcagctggaggacgggcgcacgctggccgactacaacatccagaaggagtcgacgctgcacctcgtgctccgcctgcgcgggggcatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagagctcgtaagact

SEQ ID NO: 49459 - DNA, 404 bp, Triticum aestivum
  Clone ID: PAT_TA_49459
caaagccaagctattgcttcaaaacagtttggatctatgtaatctagccaaccaacaatcttcgaaagctcgatttctttgtgtattgtatgaattatatgccttcctttccccgttcattaataagttgatatggatctttatgcagggcattagactcttaagatggaaaatcacgctagagctacacatatagttttgctcttacaatcgtacaatagtataatagggaaaaggggcattgatgaaatgtcttgctgtcataacatatgaatgcaataggttcttgaaacttgggggagtaggtgtagaaatcatcaggacgatatttgatgcctgtagtatgcacaggctgtagtcaatggctcgacaaaacagaacgcacaaataccttttttcagact

SEQ ID NO: 49460 - DNA, 223 bp, Triticum aestivum
  Clone ID: PAT_TA_49460
ggcgctgctgagcccgcgtgttccgcggctgcccctcgtcatccactgcgacggagccggggccggatccatgagaagcagggtacggtttgctgcctccgatgcagcgatgccaaatgaccacgtcgggaagcgtgtctgaggccttcttgacgtagtcagatctcgaggccatccggcggggcaaacgccaatctgaaggtagctagcacaggagatggag

SEQ ID NO: 49461 - DNA, 411 bp, Triticum aestivum
  Clone ID: PAT_TA_49461
cccacgcgtccgcccacgcgtacggcaagctatatacctacataggacagacatgggcctcaccgagatggccttgtcggccacctccggaggtacttttcaggggctaaagtgcaccgccggactatcagtcaggcggcggtgcaacggggctagactcagaagggtcaggaacggaggaaggatcaggagcatgcaggtgtggaccatcgagggcataaagaagttcgagaccatgtgttacctggcaccgctcagcacggatgccctactcaagcaggtggactacctgatccggtccaagtgggtgccttgcctagagatcagcaaggtcagactcatattgcgagagcacaaagcgtgtacggggtactacgacggccgatactggacaatgaggaagctgtctat

SEQ ID NO: 49462 - DNA, 445 bp, Triticum aestivum
  Clone ID: PAT_TA_49462
cccacgcgtccgattttttcttacgacggcgttgctcttttttcttacgatggctccatgaagggatgaggtgatatgggttccctcttccctccatggccgctgccttccaccgttcgtcctctcccggccgctcgtcgccgaccccgggagcaccaccacgcgcccctcgccgttccgtcctcctcgtctcatcacgtccgtctccctcctccctcttcttcgcgcagtgagctccgtctcacccaaactgacctagcccgggcgcacacgccggcgtcgaggcgtgccgtgctccgtccaagaactgccccggaagccgatgccgcggcggccctcatggtcgtccgcgcggaggccggcgacttcgcgcgggctcagtccatctgggcgcagctcctgctcagctccgcccggccgtgcctggccgccgcagcgcccagcc

SEQ ID NO: 49463 - DNA, 369 bp, Triticum aestivum
  Clone ID: PAT_TA_49463
ggacgacgtgcgacttacacaactagcgaaatcagctcacagcctactgacctatcccgcgcgcgaccaagcaggcgaggactacactgaaccaagatatcgattggcatggccgccatcgagtgatgtttagcttcctccgctagtcattgtcctgtcgcgaacagcctcgccagggatatactctactgcggtgtcggcctatgacctctgactctgactgcaggaggtgggctggatcacatgtctgggctcggttccttatgtaataagtgctcgtgaagcacgcggcgttaatactccaagtggagcaggccgctcaagtgcaacctatactactactggccaagctacttaatggcgagcatc

SEQ ID NO: 49464 - DNA, 364 bp, Triticum aestivum
  Clone ID: PAT_TA_49464
gttcaaggtgaaggttgggtgactgatatgattgggtcactagtatactactctcgcagtcacaagttcgtagatgtgtgttctgtgagctaaaaggatctatttctagcatctaaagaagttatggacattttagtatctatctgatgaagtagcactctaggatggatcagtttcttactgagacatgatggtatatatctagtgatgtaatactggacatatgaacctacaaatgtatgcctatgtatatatctagacacgatggattgttgtccttttggatgtgatgtagtactggacttgtgaacctacaaagtgtataccaatgtatgtatgcagacatgatgtattgttgagatat

SEQ ID NO: 49465 - DNA, 345 bp, Triticum aestivum
  Clone ID: PAT_TA_49465
aaccaaaaaaaaggttccttggttacattgccacttggaattttggtcccggtggggaaaaaacttggcacccccggcaggcttgaaaaattaccttacttgttttggctggaacccttggccccccaaaaaatgggggaaaatggagggggaccggggttttgccgttggcgatttccaatttgaggtttggcccttccaaggggggaggtggggttccattttccacggtttattctttttcaacttcaaatggacttattccttcttttcttttggcccattctttatttttcaaggccggttccaaaattaccccgccggatggccggttcacccccattt

SEQ ID NO: 49466 - DNA, 212 bp, Triticum aestivum
  Clone ID: PAT_TA_49466
ctcgcgcgcgcatatacctcggtccttgtgatgcacgtatatgatgagacgctcgttcgtgaccatacatatgatgtatgccttgtatagtgctccacgttcgactagcgaagcatacaaggctccaagaggatcgcggcgtgcacataccgcctgatgcgcttgcgccatgaagaacgtctcctatgagtgacatgcggactagtttatac

SEQ ID NO: 49467 - DNA, 198 bp, Triticum aestivum
  Clone ID: PAT_TA_49467
atttttgtagcttctgttgtctgtcataaatctaccaagaagtcttgagtaatagttgtgctggtttgtatcatgggagcgaggactacatattcactcctatatttggcatcaagttactatttactgcttttcctgttttctgctagttgttttgccatcttccattcatgtcatgaaagatgtttttttccgagc

SEQ ID NO: 49468 - DNA, 370 bp, Triticum aestivum
  Clone ID: PAT_TA_49468
ctgacattgtgagaattcttaattgaagagttatagggagggacttatgtcaccacagacagaaactaacgcaggtgttggatttaaagctggtgttaaagattataaattgacttactacaccccagagtatgaaactaaggatactgatatcttggcagcattccgagtaagtactcagcctgaggttccgcccgatgaagcaggagctgcagtagctgccgaatcttctactggtacatggacaactgattggactgatggacttaccagtcttgatcgttacataggacgatgctatcacatcgagcctgatgctgaggaagacagccaatggatcttgtatgtagcttatccattagacctattt

SEQ ID NO: 49469 - DNA, 424 bp, Triticum aestivum
  Clone ID: PAT_TA_49469
attaagtttcagcttcacgaccagctcaacactagtcagggttaatttacttccatccttggtttttaattttcggtgtccctgaagccgctgttattgacagtgaactatggcactcttaattagcaaaacaatgagcatgcattcttgatgaacattgaagctcttaattagcgacaatattgagatgacatccacctatttctttatttttgtgaatggacagagtgatctatattttttcttcctcacgcaggtcgtcgtcaagccctcgcgcggctcatgggcataggctggtccatgcacgctggtgatggcggctcaaccaagttgtcgtcgtcgcctgcacgcacgaggcacctgacgacctcctccatcgccagccacgaggaccgggcacgagcctgagtacaggtctcgtaca

SEQ ID NO: 49470 - DNA, 388 bp, Triticum aestivum
  Clone ID: PAT_TA_49470
cctcaccaagctcgctctcgctctctcgccggcgatggacgtggcgggggcacaggcgcgcgcgctgccgctcctcctcggccgcccggccgtctccctccggtgctccgtctcgttctcctgcggcggcgcgcggcggagctgggtgtcctccgccacggcggatggggaggacggcggccccgggtacgagcgggtggccatggacacccccggcgcgtaccggctcgtggaccggagcaccgggaagagcgtcatcgtgtggggcggcgtcgacgacggcggagagcccggcgtgccgtccctcggggtcctctccagggtcaccggcgaccgctccgtcttcaaaggtgcagcaaatggggggactactgcaagtgtcgggagc

SEQ ID NO: 49471 - DNA, 412 bp, Triticum aestivum
  Clone ID: PAT_TA_49471
gtctattctgtttcaaatctgcataggaagccgtagctgctctcgcagaggtgtgcagtatgcgctttgtccatggagtacgttctcggacaggattgatgggaatagattaccctactgccgcatggctttccaggtgagcatgacactgcgtctagccattgacctgtaaattttatccaaacaattatggtgaggtgattgtggaatctgagtagaacctcaacttttgaacgatattgcttgccctgacaaacctgaaactctttgctttaccagttatccttgctttacttattattttgtccttacacacgatagctgaatctgaactacagttttggcatacacggtttcatacaaatatatttggtgatccaattacaaaatgtaacgcatgaattcttttgat

SEQ ID NO: 49472 - DNA, 246 bp, Triticum aestivum
  Clone ID: PAT_TA_49472
ctaaagcgtgcgctcacgcgtgcgctcacgccttcgttcacgcgactgtcgctgtgttcgtagatgcgtgcctgcttgctctgagcccgcgtgtcggtttagcagtcatgtggtatcagcttaccgtgtaccagatcgcccagtttaaggaggcctatgcactattcaacgaggaccgagacggcttcttaagcatcgaggagctcatgactagaaggctctcgctgcggcatagccacactgacg

SEQ ID NO: 49473 - DNA, 343 bp, Triticum aestivum
  Clone ID: PAT_TA_49473
cgccggtaagctcagctgatcgccccctcttcttccgttcatcatctcgccggtgatcggatattctgatctcggtggtcgatcccaacgttctttcggtgttgctcttgataatccaaggggatggaggtcatccgcgggccgatcctgccgcgctgcgctgcgcctgctctcacctccggctctcggatcggcgggcagctgctgaagcgcgtgcgcatgcggaggagggcttcttgcggtggcggcgtctcgccaggtgacggctacgacggcgtgtcgcccaggttcttcggcgccccgacccagcagcacatgcacggcacaagctcctggcctggtc

SEQ ID NO: 49474 - DNA, 461 bp, Triticum aestivum
  Clone ID: PAT_TA_49474
cccacgcgtccgccaaggtgaaggggcaatttactcgctcatcccctctttgattcggttcccggccatcatttcgtctcttcaaagctgcaggctaggtgtttgtggaattgcctgcctgcctgcctcctttgcaactgcagcggcagcggcagtggcagcgccagcggagcaaggaaggctaaggctagggggagcagcaagggaaggacgaccatgccgcgggggctggcggcgtacatggtggacatggtgtgggcggtgctcgccgggtgggtgtcggcgtgcctgctggtcgccaacgagatcgcccgcggcatgcgtgccggggagatcggccccttcgttgtggggtgaaaaaatctcgtttcggctcatcacttctgattcattccttcatgcagatagttttttgacgaatccgtccatggatacaccgcattataatgtacatagtccat

SEQ ID NO: 49475 - DNA, 422 bp, Triticum aestivum
  Clone ID: PAT_TA_49475
cgtctctcgcagccagcatggatccagcttcactatgaggatgctagcgaccttgtcttccccaagcgcgcaggccatacgcatcgtcgttgttcccactcgaggcagcccaacacatcatcaccatcgtccacagcgtcagtattcttcgacctgcagaggatatttgggcgcttgcaactattggaggaagatgtccaagcgtcgatccctggaggaagacgatgttgaaggtgggttctgatgtgcggcacgtgctaaacctgatttgatgctagcttgcacgtctcacctttccccgattgctcaagatagcaaccgccgctggtgatacattggaggtagtttgatctcttattatgtgcacatggtacctactgggggtggtgtgatcgcttcatagagaagatgacaatcgagga

SEQ ID NO: 49476 - DNA, 421 bp, Triticum aestivum
  Clone ID: PAT_TA_49476
cccacgcgtacgtttttttttttttttttttttttttttttttttttttttttttttttttatttttttttttttttattttttaataacagcatggtgtattggtgttatagtgcaataagaggagtaatgttattaattgggcgatggcctgtggtgcaggtgcagatggagatgaaggagagacagcggtggcggcctgaggaagacgccatcctccgttcctacgtccggcagtatggcacgcgagagaggaaccatgggacacaactttttaacagacctaaaaaaagatatgacgagttcatttaagaaattacaaaaaatcaaaaatagttggtataccaagaatgggtttaagctaacaggaacaataaaacccattttagctttttatgacaaagaaaaaaataggaagaag

SEQ ID NO: 49477 - DNA, 426 bp, Triticum aestivum
  Clone ID: PAT_TA_49477
gccacgcgtgcgaacgagcttccgagccacacacttttgtctgaggacattcagaaccttgcagcatagacaatatggcaaagtcgtatcgccgtcgcgctcctgctactggtgctgctcgcgtactgtgatgtaagggagctgaatcagaaggaccaggcactagtaactgaacgcggagctggtgccggagtacgtgccggacaccgcgtcgctctggagaaggctctggagcttccagaggagccgctagctggaaccgatacagtgaccaggacacatactggtcccgctgtggtggttcttgcccttgctggtatccctgaacaccgatgagcatgtccagttcatgtgctggatgacacgctgcaacatatctagtaagctcatgacttattacttgcaccagccgagagataaacatgc

SEQ ID NO: 49478 - DNA, 430 bp, Triticum aestivum
  Clone ID: PAT_TA_49478
cagaagccgcccatcttgctcagttccagctcaggcgagcagcgaccaccttccggcgagggcagcagcgatggagggcaaggaggaggacgtgcggctcggggcgaacaagtactcggagcggcagcccatcggcacggcggcgcaggggtccgaggacaaggactacaaggagcccccgccacctccaagtgcgccagcgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtggtgaaggggttccagcagggcctgtacatgggca

SEQ ID NO: 49479 - DNA, 425 bp, Triticum aestivum
  Clone ID: PAT_TA_49479
aacatatggcgcctgtaaaggagactgttgccatgtgtgtaaagattgtcattgtgatacacctacacacgccgaatgtctgcacacgaaataccataccaacagtggaggccggaatgcgcccatgcgttcaatgatgaggaacggtacttctgcaataattgctgtaacatctttcaaactctgatgatatactgtttgatgatgcaatattggttgtgcattgcgcagtgcccatacttgtgcggggtcaactgcgagggatcgatcatgctgtatcgcattgacatgcatggatcttgagctgtcgatgaccctgcctgcgtggtcatggttatattagatgatgtatgtacaataggtcgattccacttaggctagatgcatgtattgaggaggagtgcatcgacttaacatgtgatacc

SEQ ID NO: 49480 - DNA, 426 bp, Triticum aestivum
  Clone ID: PAT_TA_49480
agttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctggggtaatcactcgtccagtcagtaccctgatgttaaccacg

SEQ ID NO: 49481 - DNA, 254 bp, Triticum aestivum
  Clone ID: PAT_TA_49481
gtttctcttggtcaccagtcccatccccaagatgaggaaaggcgctctcgctctctacctcctcctcctactcacctttgcttccatggcggaggaggatgcagctcatcatcgtctgaggcctcatcaacatgaaacccaaggggagaggatgcaaactgccaggaaggttgggcgcatggcaggtggctctggagaaggcagcggtaggaacactggtggtggcgccgcagacacagggccgcgccggacca

SEQ ID NO: 49482 - DNA, 276 bp, Triticum aestivum
  Clone ID: PAT_TA_49482
ggtgcccgacgtcgagcacaaagtcatcgaggcataagatagcgacctcctgccagagacgatggtatgcgacggggccctaatggagtacgccaaactgcaactcacctgtaaggacctcaaccaccaccacaagactatgttctatcagtaaccatacatgatcgagtgggtatactgcaaaaaagtgatcgtatcgtgagtcgccgatatggacagcgaggctcatgacacgaatgagacagcagagtatggagacaatgttacttctgacta

SEQ ID NO: 49483 - DNA, 415 bp, Triticum aestivum
  Clone ID: PAT_TA_49483
cacacgccaagggagagtggcatgcatggcctgcatgaataccttgcccagctgctccatgttcaaaggggccaaggaattaagccagtaggggcaaagccaccggcacaccgagctcctgatgccggtcgttcacgttcatggacgggagcgggctccggctcggactcgacaagaacccaaacgccatcatctccagcgagtggcccaagaacttatccatactcagctacgacaacctgcgggcttacctccagtcccagcatgtagagcagcagctgtcaccttaccacgctgcccatcagcagctgaggccgcttctgcgcgcggccatgtctacacccgcgctgatggtcactgcggagcaggcactagtggaggttgaaggccactttcactttgtgtcaagtctccc

SEQ ID NO: 49484 - DNA, 429 bp, Triticum aestivum
  Clone ID: PAT_TA_49484
cacagacgcagccaatggccatgcagtcagctactcagagtggtattcaacagaatcaattgaattccgtacaacaatctgtgcaatcattgctccagcaacctcagcaatctgttgggaggcagcagcaacaagcacagccctccatgcatcaacagccttctttgcagagtccgcagcccaatattcctttacaacagcagcatcaacagttgatgggacagcaaccaaatgcacaacaaaatcagctaattggacaacagaatggtgctatggagatgcagcagcaacagaggctaccagttcagtcaaataatctcttgaatgtgcagcaaacacagcagatgttgaaccagacgtctatgcctttgcatcagccgcaacaattgggctctcagtcaaacatgtcgagtctacagcagcagcaac

SEQ ID NO: 49485 - DNA, 431 bp, Triticum aestivum
  Clone ID: PAT_TA_49485
gggccccgcgcagtcgctcccgcggcagccgcgggcggagagcaagaacatggggaccgcggcggcctcgtcgttcctctccccggcggcaaagttcgcgctccagagccggtgcccaggcgccaaaactgcgccacgtagcgtccggttccccccggtgcgagcccagcaggaggtgaaagaggaggagcccgcggcgaccgtgcccccgctgcaggaggagcaggcgacggcggcggcggcggcggcgaagggccccgcgcagtcgctcccgcggcagccgcgggcggagagcaagaacatggggcgggagtacggcagccagtggctgagctgcacgacgcggcacgtgcgcatctacgccgcgtacatcgacccggagaccaacgcgttcgaccagacgcagacggacaagctcacgctcatgctcg

SEQ ID NO: 49486 - DNA, 431 bp, Triticum aestivum
  Clone ID: PAT_TA_49486
cctcctcatcgagggggccgctctcgcccttccccggcggcgcgggcccgttcctccggcatcaacctcctcccggcggcgactccgatggcggcgcctccatggacgagttcgacgaagatgacgaggacgaggacgaggaagaggatgatggggaggatcaggacgccgagctggcggcccgcagctcgcagcagcgacgcgcctcctctccagcaggaatcgggcggcctgtggcgaatggggagaatggaacgaggcaaatccaggaggggcagcaatggcagctgtacagctgtggaaccgagcagcacggtcgcagttcatctagaggggacgaagagcctggatctgttcccagggagatgaggtgtgaggatggatatggagtcattgggaggagagaggcaggccctgcttctagctactgg

SEQ ID NO: 49487 - DNA, 424 bp, Triticum aestivum
  Clone ID: PAT_TA_49487
cccacgcgtccgaaaaaaaaaaaaaaaaaaaaaaaaaaaaaaaaaaaaaaaaaaaggacggccaataataaggaaccaagacaccatactcatgacatgggaggccaaagttggtgtttcgggtcacctaactcgatttcccgggccgtcgttttcattggggtgcctggaatacccttacctgtccccactttattgcccttgtgctcgtccccctgttgcgcgctgccttatgcgctgggccacaccccttttccttccatcattttctccccctgagtgccgaacgggccgccccttgtacctggacctttaaccggggtggtggttgtgtccccccctatcgttccccttttatttcgcggggcctgagggccccgccctttggtttctttccatttgtttggggccaatggccccgttt

SEQ ID NO: 49488 - DNA, 258 bp, Triticum aestivum
  Clone ID: PAT_TA_49488
cggagaggcgcgctctttttagctaagtttagctacctggaggaaacgtgcgtaacggcaacactggcaatgctggcgggtttggcgctcatggcgcctccggcacgggggctacaactggccatgttatctacagggttgcatgtttggacacgcacgtgttctaaccagatcaggggcacgtccctggaagacacaaggggccttagaagctgggatggctgcacgaccagccagactacggaaatgagaggggga

SEQ ID NO: 49489 - DNA, 393 bp, Triticum aestivum
  Clone ID: PAT_TA_49489
atcggtgtaatgtaattccagagatgacgagaagactatggcttatagcatgaggccggcgggctcctcgtcatatggttcgcatgcacccctttgagactctccgactcgtgactagtatgaatcaattatccaacgtaaatttcacgcacgcataaaaaaaaagaaattatttaaacaccaatatatattaatcaaatttcttaaatttttagtactagtgatcattattttaataactttctgtactaaatatatacttgcaatttataaattatagggggcctcctattatttgatattaattttatttccggcgtttttaacctaattacttttttttatgctattctaacattcattaagtggttctgttttaaacaaaatttagtc

SEQ ID NO: 49490 - DNA, 402 bp, Triticum aestivum
  Clone ID: PAT_TA_49490
gcaatttagatttcaagatgaaaatcttaagttattactttagggaggtgtttgtgtttgattgtagtttaacatgttcggactactactatgtgcagatgttatcggtacacatgcttctagtatcggaattttcggtgctcttgcaaaacggttgcaactttggttttctgtaaatgcaaatttaggtgtgatgatgaaaatttaaaattatgcctttagggaggtattctgctttacttgtagtttgaaaccttatacttgtactatgtgcagatgtaatggctatctatttgtatgtatgtaatcatgctcggactatctaattatctattgctattgaacaatgactacaagttttgttgctcttgaaaaaggactactagtttatttgtgtgtaga

SEQ ID NO: 49491 - DNA, 321 bp, Triticum aestivum
  Clone ID: PAT_TA_49491
ggggctaaaaaaaaaccaggtaaagggccccccccagaaaaaatattaaaaatatggggggggtccagcacccaaaagtcaccctggtgatttggccaaataaattttggggaaaaaaaaaaaaacaacccccccgggttttatacaacccctaaagagatccccagggttccactggaaggggaaaagcaaacccttttttgtttttaaataaaaaatccccaaccgggggcggtgatcgcctcgggaatccaccccccccctaaaaacctttttaaaaaccattgggggacgttaatcgccctgcccaaaacaggcctt

SEQ ID NO: 49492 - DNA, 402 bp, Triticum aestivum
  Clone ID: PAT_TA_49492
gccacgcgttcgttcgcgcgtacgaagctgtagctgctgtacacatatacatggacaaccgtggatatacctatgcccacgctgctgctggtgaagtgcatggctgtggtcgacggcttattcaactctatcaacatcatatatgaagcatgggggcctcatgttaaggaagttatcatatgagtggtgcgcggtcagtccattctactccctgtgacgaggggtcgtaaggtggaagggataacacgactcagccagtagctatctcttggagaatggctgttgacttattaatgtcagatcgtgcggtatgcttgtgcaccctcaccttgtgaagactgtcgagacctcttctggtggagtgctgcatgtagtgcacctccgaactgcatggatgcacga

SEQ ID NO: 49493 - DNA, 436 bp, Triticum aestivum
  Clone ID: PAT_TA_49493
tgcagagcatcatccatcccatccccaggtcataaacccaagtcggactcgccttcctcctcgccaactactcctctcctctcctccgcgcatcgcaccggggtcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggtgatcttggaaatgtgacagctggagtggatggtgttgctagcatcaatattactgactgccatatcccc

SEQ ID NO: 49494 - DNA, 436 bp, Triticum aestivum
  Clone ID: PAT_TA_49494
cccacgcgtccgcggacgcgtgggaagagagcacactggagagcaaactcatctcatcccatgactcagcctccaggtaaactgatggacacaatcagaaggccggtcgcagcagcttcatctcttcatcattccgcgggaaagcatctggtcaccttggctcagaggaatggagttaacagaaggtgcctcctcactctactggcatccgccgcagccatacccgaggctagcgaatctagaaaggcgctattgcaaggtatgtaagcatctggtccaatttcggggtctagtatttgtggtcagtttgctgttcaccttggatagataactggttctgcctgcatatgggtagattatgtgaagaggtcaaaggaaaacaaagagaagaatgacaaggaggtatgtggccttccttcaattgtttccttggtat

SEQ ID NO: 49495 - DNA, 433 bp, Triticum aestivum
  Clone ID: PAT_TA_49495
cacgcacgccccgcgcgcggccaggctgtgctggtgctgggagcttcgtccccctccactctcgccagctccccgggcctgccccgccccgcccccactccgccgccgacgtaagcacacccagcaccctcccctcccctcaagatccaaggcacgctcgctcgccccccacccgccccgcgcaatgccccgctcctgaccatgtcctcgctctcgatcccgcctccgctcctgcgctcctcgcactccccatctccgccggcggcggcagcggcgaaggcgaattggaggaagcgcgcggcgcgcgtgcgcgtgcgcgctccggtggcggcgctggccggcgacggcgggtgcgcggggaccgggatggagcagcagcatctccaggcggggagcgcctccggcagcccagtgcgagagaagcctttcatgt

SEQ ID NO: 49496 - DNA, 438 bp, Triticum aestivum
  Clone ID: PAT_TA_49496
gtcgcaggaatcaaagacacacggccgccgcgccggccccgccgcttctagaagcttctggatcccgcggggagggagggaggcccgtcgttcttcgcccgctggcctccgatggcgtcgggcgccgccaggtcgtcgcggtcgcgcccggccggccactccggcgtgctcccggcgggcggcgtcggcgggggcgccggggtgcagctcgccgacaagctcaagatcttcaagaccgacaagttcgaccccgactcgtacgtgcagtccaagtgccagaccatgaccgagaaggaaataaggcacctgtgttcttatctgcaagacctaaagaaggcttccgctgaagagatgcgtacaagtgtatatgctaattatgctgcgttcatcagaacatcgaaggagatatctgaacttgaaagggagctgctatctatc

SEQ ID NO: 49497 - DNA, 433 bp, Triticum aestivum
  Clone ID: PAT_TA_49497
gcgacggggtgatttggaagggtgacaagctgatcgacggcgtgccagagacgctcgacctgctcagatcaaagggcaagaggctggtgttcgtgaccaacaattccaccaagtcgaggaagcactacgggaagaagttcgagacgctcgggctcagtgtcaatgaggaagagatatttgcttcgtccttcgcagctgctgcgtacctgcagtccatcgatttccctaaagacaagaaggtttacgtgattggagaggaagggattctcaaggagctggagctggctggctttcagtacctcggtggacctacagacggtgacaagaagattgagctgaagcctggcttctacatggagcatgacaaagatgttggagcagtggtagtgggatttgatcgctattttaactactacaaagttcagtacgggac

SEQ ID NO: 49498 - DNA, 430 bp, Triticum aestivum
  Clone ID: PAT_TA_49498
tggggatgtggtccatctggatgttcagtaagtaagacatgtgttttccagcaaattagttctttgttgaagatgatttttggtgcttatctctcgatgaagtgaatatgtggtgcttactgctgttcaattgctaagaattttgttgctagcagcaaagtcctgtaagaactagtatgtcttaggcctaggatctgttcttggcaggctttgcaaataggaacatgatgttatctcgtatatcttattttgtgcgaaggatgtatcttgtatatctagttcactacaaatttataaatgattatcatccagcagaatcaaaatagacaagcagcctcaagctgatgttgcaacaacttgaaacgatatgtctaaattatggagaatatgttttttttattcagtattgatgcacagaaacattttctgc

SEQ ID NO: 49499 - DNA, 422 bp, Triticum aestivum
  Clone ID: PAT_TA_49499
ccggcatgctcctatgctccagataatacattaccatggcccccgtcgggatggctttctcggctaccaccgccgcacccttccaggggctcaagaccacagacggactaccagtgggccgtcgctccagcggaagactcagcagccacagcaatggcggatggatcaagagcatgcaggtgtgggcaacagagggcatcaagaggctggagaccctgtattacctgccaccactatccacggcggccatcctgaaacagggcgactacctgatccgttcaaagagggtgccctggctcgagtatcagaaaggctggcttcgtattccgtgagcacaacagctgcatcggatactaccacgggctgtactggacaatgtgagagctgcctatgttggggtgcactgacgccacacaagtgct

SEQ ID NO: 49500 - DNA, 435 bp, Triticum aestivum
  Clone ID: PAT_TA_49500
cgaaagagtttcttagcgtgtaactggagaacagggaatgaacccgaacatagctcccggttctttctacaaacttgtggataccataaccccaacctaacaggaaaccatgcgtgatgcgaaacgaaaccaaacgtttccgtgatgtttactactggatgttccttgcccgcatcaatgcttctattttctcgacatcttcgggcgcatccacgccatgggcatcatggtccaccttgataaccttcatcttgtagccgttctcaagaactttaagttgttccaggtcctcttctagttgcaatggggttggtgcaagctgtggatagatcttcagaaacttcgaatcaaagcccgaaatcccaagatgaagaagatatgggaagtgaggattgactttccctgatttgttaaatgggatcagccctcttgaga

SEQ ID NO: 49501 - DNA, 413 bp, Triticum aestivum
  Clone ID: PAT_TA_49501
cgcacacgtgcagatattgtaagaatagttagtcaaacagagatagtgcgggccttatgttgcctcaaacagaaactagggcaccggtggtgttcaaagcctggcggacagactatcagtggacgcactacacccgaaaacatgaaactacggctactgggctcttgacaccgttgagggtcagtccccagcctggggctacggccaggcaagcgggcgctgcaggatctggcgaatattgtagtaggcgcatggacacctgtgtacactggtggacttaccaaccttgatcgctactgaggacgatcctgtcgcatagggcctgaaagtgccaaaggacccacaacggatctggtaagagactaatgcagtcgacctatatgacgaggctgccgttgctaacgtggtgactg

SEQ ID NO: 49502 - DNA, 423 bp, Triticum aestivum
  Clone ID: PAT_TA_49502
cccacgcgtccgcggacgcgtgggcaaccatggccatggacaagttcgcgtgagagggaccgctctacaccgtttttccccatgaccagtccacgcgttccaacccaacgcgtcgggggtgagacaggcagagcccctttgcccccgacagcggcctacttcccggccctctagtccgatcaaatgcgcgtgacgccgacgccgaagccgatgaactacaggggagcgccttccagcgcgtgcattcagacttcatgtgcctaagcagaggcttgaccactgacatccgaaacagggcggagtgcatctacgtgcagaagttcgtgctctagaacttcctccacaagcacaccaagaccgtgatcctgtacatggacaaccccgtgcccaacaccaacagcttccagttgttcatctgcaccc

SEQ ID NO: 49503 - DNA, 365 bp, Triticum aestivum
  unsure (1)..(365): unsure at all n locations
  Clone ID: PAT_TA_49503
atctacgtgtgctgaatcttcgatagttctgatcgggggcaaggtggtgcgcatctccacggcgtcttcgaaccggttatgcggcttgctccatgggaacaagacatgcaaggacgagggggcaaggatacccgcggcgcctagaatggcggacgccccgcctatgccagagactacaccagatctgtcctcccatacgagcgtgtccgagacagaagaccacagtgaacacagcgatgcaatgagctgatccacacgagacgagaccggcagggaacactgacactgcaagccaaacgctgagagacgatccgacgttgcaacaatagangaacgtgatcaacgacctacaggagtaccactag

SEQ ID NO: 49504 - DNA, 333 bp, Triticum aestivum
  Clone ID: PAT_TA_49504
ctccatttttcttgcccacagttccatccctttctggggagatattgtttgagcctccttccagtaaagaaacagacggcaacactactgaggacataggtcataaaaagatggctgatctctcctcctacttcagtcggctgttacaatcctgtggagaacttgagagctattcagcgttcactgactacctaaaaggcctatctccgtcatctctagacatggaactacggatgctacagttaatagatgatgacgaggtggaagagtcggaggaaccaagacccgagctccagtccatctcgttgctgctggactacttcattcacgagc

SEQ ID NO: 49505 - DNA, 246 bp, Triticum aestivum
  Clone ID: PAT_TA_49505
tagattgctggacacagtaaccatcggatcggacagaggaatgaacactgacacacgcatgacacagtgtgagacaaccaatatctatagctccaggcgtgatgctcgaggagacagcgacttattcaagaaaatgatctctgttatctcccacgttttctataactgcgtcatcttggactggagcactagtaacaacgacggtagtagtctaaacacacacacacacacgtgagagctgatata

SEQ ID NO: 49506 - DNA, 405 bp, Triticum aestivum
  Clone ID: PAT_TA_49506
agaagcagagcgatcactccccaggatccacatactcaagagcaagagcgctcggcacatcaagtacgcgaccatggcggccccggtggctctcaccatcttcctgctgatcctcctcccagagcaccatgctctcgccacgtcggccggcgacgcgcacccaggctacgcggacgcggagaccgacacctgtgggccggcgctggacctgggcggctcctcctcctcctcctctgccgcaggcgcggccggccggcgctacggcccggggctggaggagtacggcggcgggcgcatcgtggacatcacgcacgcgttccggcccggcatgccggcgtacgcgccgggcgcgacggtggggcccatcgtgcggctcaaggagtcgatggagaacgggtcagacta

SEQ ID NO: 49507 - DNA, 412 bp, Triticum aestivum
  Clone ID: PAT_TA_49507
gatatttttcgactagatagaaatagtaaatttgaattgagacacctattccatgacggatttaaacttaccttctattttcgtgcctttagtaggcttagtatttccggcaattgcaatgacttctttatttctttatgtgcaaaaaaataagattgtctagtattttttagtgtaagtaatataatatggtagggtatgtggctttttctacacacactttctacacacaaatgaaaaacggttatggatgcggatataggctacgagcataaatgcatgaatatgcagagccaggtatagcgagttttattttatttattttaattgaatcaacgaatattttttgaatagaaagtcaatgtatctaacctattatttcacaggagtactagttgctgaaggcgatttc

SEQ ID NO: 49508 - DNA, 399 bp, Triticum aestivum
  Clone ID: PAT_TA_49508
ctcaaaccccagaaaccagctggtcgccctccacagaaaagaaaaagaaaaaagcactgttgagtgagagagagagaggaaagcatggaggtcctcttctccacaaccgcggcctccgctcccttatcctcagcccgcgtacaccgccggccgatccctgcctccgtgaccttccgcgccccggcccgacgaggctggcgctgccacttcgtcgcgccgaccagacctgacccgatgccggacgaggagcccgagttggcatcggggtctgccactactaccgacggtaccttcaaccccgtcccgccgaacaccgaggaattcgaagaattatacttgactgctctacatgatctgcaaccctttggaaaaaaatttttttgagggaagttcaagttc

SEQ ID NO: 49509 - DNA, 239 bp, Triticum aestivum
  Clone ID: PAT_TA_49509
acgcaaaaaatagcagcctgagccgttctgcacaacaaggatcggatattcatgtctccatcggtccgcttgacccggtgcggcggctcttcatctagctatggagttcctggggccggtggaggtcacgggaagcaccgtcgcctgatgtagatctgccttcatttcttgcctgggctgcgttgatttcagctctgggcgttcacatgtttcggaaagctttcccaatctgtcaattg

SEQ ID NO: 49510 - DNA, 395 bp, Triticum aestivum
  Clone ID: PAT_TA_49510
gtcaggtttcactaatttttttggctccgtcatgcagctggagggagatgggatactgacgattattgagagctattggattattgagagttagtattgtacataatttgctttataagaggtattgccactatactgacagaaattccgtgttacaattctccaaggttgccatttgtgaaaaaatacaatattttggagggcatctctgacaggatacacatacttccggatgcaatagtttctgaagcagcacccctgaagaaagatgatatggaatacgccttggatatctaccatcccaaccgtataatcagaagaataatacttaactgtcctacatttgctacaaccctctggaaaaaattctcttgaaaggaagtgcaagttatatg

SEQ ID NO: 49511 - DNA, 381 bp, Triticum aestivum
  Clone ID: PAT_TA_49511
cccacgcgtccgcggacgcgtggggcccccctccacgccatcagcgctggcgagcaagaaccagcaagaatcgcagctccagctacaagcacaaccatcaaacgagagcatagacgcggccatcggtgatgttttatccaaaccgtggctgccactgccgctggggctgaagcccccttcgttgggcagtgtcatgggcgagcttgaaaggcaaggcgtggccaatgtgccacaagcctgcgggtgagcgctggaggatgcatccgcctgcactccatgcatgactgctgctccgttcagagtaaccgctagcagcagcaccaacgacaacaacaacaaaatcgtcgacatgtcttttttccttaaaacgttttgtggacc

SEQ ID NO: 49512 - DNA, 263 bp, Triticum aestivum
  Clone ID: PAT_TA_49512
tcctctcattctaaacagcatgggctgggggcgcagcacttgccgtccaaggagcagcttgcatgctgtcatcagcatcatagcacgatccgtgctgacccgcctgttatgcatggtcctcgttttgatcgttagagttttcccaaggatggaagacacgctcgttgtgggggtcccggacggagcttgcactatcggcgctgtacttggacagggcatggggctgaaccaagagctgcctgggcattcagggcgggttgaag

SEQ ID NO: 49513 - DNA, 387 bp, Triticum aestivum
  Clone ID: PAT_TA_49513
gaggatcctgcctcatcctgtcctgctgccgcacttcgacattctactattgagatacgggtgcagggatgggcttgcacggaagctggtcttacctgcacctcttgatcatccccgccactatccaattacacatcatcaaggctgacagccatattacagactgactcagaaccaactgctagagtaagactgtcgtgactcttgacatcaagaacaaaatgtcacccaccagactggcatcattttgccatgtcacctacgctatgctcactgacccaaacagcacgacagaggttacatactgcgctaatcaagccgccaaaaggaccgtcagcatgaacagctttgtcgatctgtacacagtccattattcaacaaatgatc

SEQ ID NO: 49514 - DNA, 300 bp, Triticum aestivum
  Clone ID: PAT_TA_49514
gccactcctattagctatcaacgatggctctcactgtgatgtggtcagcagccaccgccgacgataccttccaggggctcaagttcaccgttggccttccagatacacgccgctccaacacagaggctggcctcatgggcgtcaagaacggcagaagaatccgttgcatagcaagtgtggcctattgaatgcctcaaaacagacgggaccttgtgttacctgccaccgctctacacagaagccctcctgaaacaagacgactacctgatgagctccaaacgggcgccgtgtatcgagttt

SEQ ID NO: 49515 - DNA, 416 bp, Triticum aestivum
  Clone ID: PAT_TA_49515
ccgcggatcaagatagaattgccatggtgttatttttgtgcagaaataaaagttctcggaatgacctcaaacttcacggagaatatttttggaatatataaaaaatactggcgaaagaatcaaggccaggggcccacaccctgtccacaagggtgggggcgcgcctaccccctgggcgtgccccctgcctcgtgggccctctggtgctccaccgacctcaactccaactctatatattcacgttcggggagaaaaaaatcgaagagaaggattcatcgcgttttacgatacggagccgccgccaagccctaatctctctcgggagggctgatctggagtccgttcggagctccggagaggggaatccgtcgtcatcgtcatcatcaaccttcctccatcaccaatttcgtgatgct

SEQ ID NO: 49516 - DNA, 349 bp, Triticum aestivum
  Clone ID: PAT_TA_49516
gtcaggcctacccgcatggtgaccaccccccccatcctcaagtgctacggcctactgcttgtcggcctctgctgcaccttctccgccgacgcgccctttctagtctcgcacaagaaggtggacctgttgcagcccaagcccgtctaacagcgcttcggcggttctctcgacctgtacaatcaaggatccgcaactacatatgacgtggccattaatgatgactcgtaggccaaggaaccatacaaacttgtctttagagaggtttacaagactttgaagaggcttgaaccaggtgccactgcctaatacgcgtttgtattgaagagccaaacacactgcaggtgccaag

SEQ ID NO: 49517 - DNA, 410 bp, Triticum aestivum
  Clone ID: PAT_TA_49517
cccacgcgtccgcccacgcgtccgcccacgcgtccgactagttctagatccaggcaagagagatggtgttgttttaccaggcctcagccagaatccggactcctcattgagttggctcctaggagcaagaggacgggctgtgctcacttcggagcgcccaaacaagaagaggaagctgctgggtgcagatgctgggcttgagcagcttgtggtcctgccacccttagaaggtgactctggttcaaagtgtgatgtatgttgtttgggagagagtgatgctgcatccaataggatgctccagtgcaatcgctgcaaggtgtcggtgcaccagaagtgttatggtgtgcaggtcgagccagatggctattagatgtgtgccttgtgtgaacggaggttgacacagagtgatg

SEQ ID NO: 49518 - DNA, 418 bp, Triticum aestivum
  Clone ID: PAT_TA_49518
cggacgcgtggggcgagctgcaatactgcgtattgagcacaatcttcattacagagagagctcgggtacaagctgaggctaaagctgccgaggaagctcgcaagagggctgaagcagtagctgttgctgaggctgctgcagaagctaaacgcctaagagaacgtgaaagagaagcatctcgtcaagccttgcagcagatggagaaaactgtagaaatcaatgaagggaacctcttcctgaaagattttgaaatgcttggaacagtcacaggtgaacagaatctcaacttggtcggtgcaatgagtccaagccatatgcctgagcccctcggatctcaacttgggggcaaccccctagaacagcttggattgtatatgaaaaatgatgacgaagaagacgaggaagtcgagtccgcaga

SEQ ID NO: 49519 - DNA, 335 bp, Triticum aestivum
  Clone ID: PAT_TA_49519
tccacgcgttcgcccacgcgtgcggtctcccgcctgcagtactgctctaagagtaggagaggggttcgtcgctgctagccaggccatcatggaggagacggtcaccaatgtatcaggataccagaccatcgtgaagcggaagctttccaagatggcctactactactacacgtacagagcggacgacaagtggaccctcaaggagaacagggaagcattctccaggatcctgttaagctctcgcatactgatcgacgtgtcgaccatcgacatgaccacatctgagctgggaataaagatatccatgcccatcatgattggccccaccgcctttc

SEQ ID NO: 49520 - DNA, 243 bp, Triticum aestivum
  Clone ID: PAT_TA_49520
ctcaagtgtgcgcccacgcagtcgatacacttccatgcgatctagcataagtgcgctcaggtgttgttgcatatatacactgacgtgagtaagttcatccttagatgcgtggatggctgtagcgctcaaagcgttcctctcgccgtatagctggcctctgacgagcccacagagaagccgcaccagggcgagagttgcagtggccacaccactgaggcctgtcgtcgtcagcgcactggtggt

SEQ ID NO: 49521 - DNA, 383 bp, Triticum aestivum
  Clone ID: PAT_TA_49521
gtcgcgacacagtcgtgaggatgtctgaagaggtcgttcccgtgactgacgatttgcctcatcagtacatgtctatcccttaagccaagttcgtctgagattttctggcgattcgcctgtgatggccgaatcagtcgttgatgggtcagattttctggcggttcgcctgtacatgtctatcccttaagccaagttgcgtaggatgttgtgccatccgaagaggtgcttcctgtggtgactctccagtagatgtctatcccttgatccaagttcgtctgaggttttctggcggtccgcttgtgacgcctgaatcagttgatgcgccagatccgtcagtttatgttgtatccgggcacgccgacagttcatgttcatcgtctggg

SEQ ID NO: 49522 - DNA, 273 bp, Triticum aestivum
  unsure (1)..(273): unsure at all n locations
  Clone ID: PAT_TA_49522
cgacctcctaccctttctcgtcaggggggagcgagggcacgatgcggattcctctcaggctggactaccaagattctctnccactctcctnctcttccgtcgcgcggcagtcgcgcgtggcgcggagctgatccggtcagagtcctcgatcgacacgggcagcgacccggatacccgggggggcttctcggaccagcgggtgtggctgagcgcgacctggattgcgcggagccttgtgtgctcggggccgcggggcagcgttctttatacttt

SEQ ID NO: 49523 - DNA, 393 bp, Triticum aestivum
  Clone ID: PAT_TA_49523
cccacgcgtccgcccacgcgtccgcccgcaacgaaccactccgcgagctgctggtgatgcacgaggggcggcgagttatgctacaagggggtaccggtgctgcactccagccacctcacggcgagccttctcttttccccaccgctgccacacccccacgcgcaagttcgacaagcatgatgaggcggcagccgccatggatgttgtgctgcaaacggcagcgagatgctacaaccactcgcgagaaatgctacatcccacgacaattgagctttcgtttgctgagattttttgctggaaccggcattaatttttgctactaccggcgaactttttgctacatccatcaagacggagctgcgacctcgcgacggcggcgacagcgtttttgct

SEQ ID NO: 49524 - DNA, 423 bp, Triticum aestivum
  Clone ID: PAT_TA_49524
ccagcctacgaggtcagtcacggccagatcctccacgaccacaccgggccttccggatccccatccccaaccccatcgacgcccgtctctcccccaatccagccgccaccgccgccaaaatccacgaggaccgcccctacgtggagctctggatgggcacgcacccggccgcgccgtccgtcgtgccccccggtggcgagccactcggtgtctggcttgcgcgcaaccccacggtcgccgtgctgggccggcgacctcccgttcctcttcaaggtgccacttcctttccttcgctcgcttgcccgttctgttcctcaaccatgacgtgttcgtgaagctgactcttttatgtgcccgcgtccttggcgcgtgatttttctgcaggtgttgtcagtggccaagccgctgtcgatccaggcgcac

SEQ ID NO: 49525 - DNA, 393 bp, Triticum aestivum
  Clone ID: PAT_TA_49525
gcgagcccaatggtggcgactccaatccgcctcagcagcctcagatacgcccctccttgcccagcacccagaggacgattcgcggcggcgagggtgaaggcggaggcggtggcgatggccacggagaagctcggcgtcagggtggagcgcatcccggccgagtcccgtctctccgagctcggcgttcgtcagtggcccaagtgggggtgcgagaagagcaagttcctggggacctactcggccaaggagacgtgctacctgctgcaggggaaggtgaaggtgtacctcaacgtgcaggaaggggtcgtggagatctgcggtggggacctggtggtgttcctcaaggtgatgagctgcacctgtgacgtcaccgtggcgcgagacaagcactac

SEQ ID NO: 49526 - DNA, 410 bp, Triticum aestivum
  Clone ID: PAT_TA_49526
cttgaagacatgggcaggtaaagaggagaatgtcaaggcagctcaagaggcgttgtatgtgaggtgcaaggctaactctgaagccacactcggaacctacaagggtgacgctaagcttggtgatggagcagctgagagccttcacgtgaaggattacaagtactgagcatcgtccacgggttgaattgtgacgtttgtcatcttcctggatatatttctagggatttttcgtttttctacttgacattatcggattataagtgttttttcttcattttccttttggatttgtgttttgattttgattgggttttgttttttagaattgagtattttaaaaacacgcccaaataaaaaagtcatttgaggttatttctgttgaacctcttgtggaatttgaaaatcagttt

SEQ ID NO: 49527 - DNA, 420 bp, Triticum aestivum
  Clone ID: PAT_TA_49527
cccacgcgtccggcacgaacccccctccgccgccgacctcgcgtcttctcctgtgcatctcggaggtgcttcttggtttccacgatgaagctgatcgctgcctacctcctcgcctatctaggtgggaactcttccccaagtgccgctgatgtcaagaacatcctggactcagttggtgctgaggctgatgaagaaaagcttgagttccttcttgctgaactgaaaggcaaggacatcacagaagtgattgcatctggaagggagaagtttgccgctgtgccttcaggtgggggtgccattgctgtgggagctccagctgctgcatctggtggtggcgcagcacctgctgctgagtcaaagaaggaggagaaggttgaagagaaggaagaatctgatgaagacatgggtttcagtctgttc

SEQ ID NO: 49528 - DNA, 422 bp, Triticum aestivum
  Clone ID: PAT_TA_49528
aacaaagaaattgctactcatccactaacaatccaaagagccattgatctgcagattgcagaaaatggagggagcacttgtcacctccaacttcagcatgcctgatctctaccctgccaaagccaatgctgctcatgctgcgagatcgaggaggctctcctacatctcccccgctgcctcttctgctgctgctccgaaccccagctacagaaggaggaagggcacgtcgcccccgccgccgtgggctgccgccaccgccaccgtcctcacctcgccgcccaagccggtcgagcaacaagaaacggaagagcacctggtcgacacgtccgtgaacaatgcaactggtacacgagttgctaccgcgagaacgagcagggcatccgatgcgccgcgccaggcggctcggtcgtccaggcctcgcc

SEQ ID NO: 49529 - DNA, 421 bp, Triticum aestivum
  Clone ID: PAT_TA_49529
agccagtccaccggcgagagcgtggccgcgggaaggcgcgacagcgagaggcggaggagaccccgcgcggcgctccgctccgcctcaaacgcctccttatcttgttcccaacggatagctcccggctcccgagttcccgcgcgcgcacacccaccggacggcacgcgcctcgcctcccactgcatccaagccaactgctctggcgccatggcggcggcggcggtggcggggtgcttccccgcttgctgccgctgcgcgtcctcctcccggtcccgggtgacgcccgcgtccacgtcggtcgccgcctgcgtgctccagccgccgcgccggaggagcaggtcgcagtccctgccgcgcctggggctcggggaggcggcggcgaggatggcgatggtcaggacgacggcgaggagggggcggc

SEQ ID NO: 49530 - DNA, 414 bp, Triticum aestivum
  Clone ID: PAT_TA_49530
agtagatcgagtttttttgctgcagccacatccatggcgatgactacgtttttttgctgttagcaagtacaacatcgctcggttggccacggaggagatctcaccggagctcctgagctacgaccacaatggcgagggcatggaagcggcgtgccaggggagcgtggggatttccctttttctattgcgacctatgcgggaagaagatgactcaagggaaagccaaatctaatagttgtacatgaaggaatcagacaattgagcggtgcctggcccaaatttgggccggtcgacgggcgcctaccactagccaaagatgaatggacaaagactaatttttttgaacctaaacactcatgatcttttttcacgcagggaggggggagtgacccctggagtacacatagctccacc

SEQ ID NO: 49531 - DNA, 414 bp, Triticum aestivum
  Clone ID: PAT_TA_49531
gaactgaacccactgcaggaagcatctggtggaaagaagatatctaaagaccttgttagaaaggatgcagacaagacaggacttgctacaatcggtgaggaggtgaagcggttggctcaaagagcgagggataacagcttaaaaccacaagactatgaggcatttagtgattttccagattttgtctgtagtgataggggaggctaccctgggtctaataatggaaaatgcaattatatctcgaagatgaatttttatctcagggctggttccatgagtgatgatgtgatactagtttctgatggagatgaatcaagtaattattctcttcgatttgaagagttaaagggttttaagaattcctccaacagctcaaagggcctagtgcagaagatagacagcgactattatact

SEQ ID NO: 49532 - DNA, 417 bp, Triticum aestivum
  Clone ID: PAT_TA_49532
cctccgcctccccctcctccccgccgccccaccaccaccaccttcactcccctgctgccgcctccgggagctctcatctgccttctcccgccgcaggattccggactccggaggaggacggcagcggcggagatgatgcacggcaagtcggactcggacatcacgagcctggcggcgtcgtcgccgccgcggtcgccgaagcgtggcgcgggggccggcggcggcgcgtactacgtgcagagcccgtcgcgggactcggcgcacgacggcgggggcgccggcgggtacaagtcgtcgtcgatgcaggcgacgccggtgtacaacagccccaacgagtccccctcgcacccgtcctacggccgccactcccgggcctcctccgtcagccgcttctccggcatcctccgcggcagcagc

SEQ ID NO: 49533 - DNA, 352 bp, Triticum aestivum
  Clone ID: PAT_TA_49533
cccacgcgaactccccggagaactacacggggctctaagccgcgctctggtactggtgaagggaaaggttaaaggcacgtgctttgtcgcgttcttgctgctgctcgccgacgcccaggccgacgacgagaaccaggacgtccagctgctcgaccccctgatgcacgccaagaggctggacaagctcgcggacaagctgccgctcatcccgtacctgctcgcctacggcgtgaccctcgtcggcaggctcctcgccggcgagctctacgacaccatgtacgacacccagtggaaactacaccgcaacctagcgttcacctacgtgttcagctacggaacgagcaccgagacg

SEQ ID NO: 49534 - DNA, 320 bp, Triticum aestivum
  Clone ID: PAT_TA_49534
gaacaccgtataaaaatcaaggcttatataagtgttggcatgtacttgtacattctactagattatggtagatacatagtgtacagcttgaaatttaggccacttaaatacatggtatttctccatctgggctttagctgcattacatgaacatgtcgaacgtcgtcgacgctaaagcctacaaccttaataagatatggggcgctcgttctagaagttccatgctttctatccggtgcttacaacgtcatagctttatatatgcgtgacctaaattcatgtatttggccgactttttacaactttatatctggtaaaac

SEQ ID NO: 49535 - DNA, 418 bp, Triticum aestivum
  Clone ID: PAT_TA_49535
cccacgcgtccgcagcaaggtgcagtacaaggagccaatggaaccgccattgcaccacttagcattggacaagtactgcaatgtcgcgtacgctatgaagggcacacacctgtggaacatagttgctaacttgatggagcccttgcaggtctaggttgcgattcacactgacaccaaggagttattgcaggaactgtgcaatacttgtgatgagacatgcactctatagctctttgatgaggcgcaacgtggtctgacccgcacaagttacttctgcgcccatgaggtttatagtgtaatacctgacataaagacctagtcgaatccactgcccaacggccttcccattggcgtgctcttggtcaccgaaaaggttgctgcagccataaactacggtgaccatagtaccacattcggc

SEQ ID NO: 49536 - DNA, 415 bp, Triticum aestivum
  Clone ID: PAT_TA_49536
aaatatatttataatgaaaataatttggtaagtttgacttagaacaaacaggaaacttaagtaatttggaagagggagtagtatcgtttcatttgctcttgtggttaccgttcattcaaattactaatatatactataacacactcatggcaacttatgaacttgcatggtgtgatcaccaaaatttgttgtttgttgagatgaatgtccaactgttaaaagggttcgtgaggtctccgatttcaacaactcttccacaaatcactggaagattgtacatcacatggggcatcttgtggagctttcatgaggcgcaatctcatgttcttctaacttcattgatcataagttggtccatcactgaggtcattagatattttttctttgctatgaaggagacatttgggtttgcacc

SEQ ID NO: 49537 - DNA, 386 bp, Triticum aestivum
  Clone ID: PAT_TA_49537
cccacgcgtgcgcagactccaagaccgacttcaagatcattctgaccatggggggcaccaggttcatcggcaggtaacttttcaagaaactacaccaggacgcacaccacaccacatggatgaccccaataacggaacccatgccccatgaatcacctgcagaatctgctgcatagtatgccaaggtgttttataaggagcgggattggaaaggcgataggaaagactagaccagcctcaagactaaggtctctaatgagggctataatgttaatgatcatatggacgcccgagtggccaccatactatacgcgatactagacacggagccgaacctggatcagtcaatgtatggagtatacgttggagtatacctgatatcacac

SEQ ID NO: 49538 - DNA, 224 bp, Triticum aestivum
  Clone ID: PAT_TA_49538
cagacacgtggggctagatccttttctccatggggaatttggtgtagggacttagacacgataagtagggacctgagctgagaagatctactctagtaagtaaaacagggcagaaggatgactggctgcgcagagagtaaaatagggcactctttgacagggtgtaaaacagggcactagcctacacatgtcctggagagagattaaacaaaaagagcaaacat

SEQ ID NO: 49539 - DNA, 314 bp, Triticum aestivum
  Clone ID: PAT_TA_49539
cggacgcgcgggtttgactttctgatgggtgcgtctatggttcctttacaataaactcggaacacgcgatcagcactgatggcgagagcgattccgatgtgaagaagcggaagaacaggcacacggtgcgaagaaaaaagcctgccttgctagattgtctcttcttcggctgactcgcgacgccagccgaacggcgccgcttcatagcacgcaactgtcgccacggagagggccgacgtggccgatcccaccgccgagtgcgcgaacttcggcgttgacagcgaggaggtcgaaaccagcgccacctggatctc

SEQ ID NO: 49540 - DNA, 412 bp, Triticum aestivum
  Clone ID: PAT_TA_49540
gatgatgagaagctcatgtctgagacgggtctagaggcctataggttctccatctcctggtcaaggctcattccaaaaggacgtggagctgtcaatcccaaagggctacagtactacaataacctcattgatgagctagagaatcatggaattcaagtccacatcacacttcaccatctagatcttccccagattcttgaagatgagtatggaggatggttaagccccagaattatcgaagatttcacagcatatgcagatgtttgcttcatggagttaggagatagggttgcatcttggacgacagagaatgagccaaacattggtatattggcctcttatgatgttgctatattccctcctggccgtagctcgaatccatttggagcaacaaagagcaccgctggggact

SEQ ID NO: 49541 - DNA, 315 bp, Triticum aestivum
  Clone ID: PAT_TA_49541
cccaatccttcgccagtggcagggaacgtcagaagaatcctgaggcaccccagagatagcagagagatgtagtgcgcgggaggaatccaggtcgacccccgaggactacagcggctcctcggacctggcagccgcgagagggcggcgcccgtgctgtcggaggaggccgcgatggcgtaccaagagcgggtggtctaccactgcaacatcccgcggaacgccgggtatttccacaaggacgaccccaacgtgggcacagagccgggcggcgcgcaggcctgtggcgacgtgatgcatctgcaaattcgcgtcgac

SEQ ID NO: 49542 - DNA, 330 bp, Triticum aestivum
  unsure (1)..(330): unsure at all n locations
  Clone ID: PAT_TA_49542
cccacgcgtccgagaccctgttatagagagtattcttaattcaagtgttatagggagggacttatgtcaccacaaacagaaactaaagcaggtgtaggatttaaagctggagttaaagattataaatagacttactacaccccagagtatgaaactaaagatactgatatcttggcagcattccgagtaagtcctcagcctggggttccgcccgaatatgcaagggctgcagtagctgccgaatcttctattggtacatggacaactgtttggactgatggacttaccagncttgatcgttacaaaggacgatgctatcacatcgagcct

SEQ ID NO: 49543 - DNA, 448 bp, Triticum aestivum
  Clone ID: PAT_TA_49543
ggcatggactagggcggatggccggacacttgcgcctgcctccctcatccatccgcatctctctctgtccccgtagcaatcaaccctagtcttagctaggctgactcctcctacctggcgggcatagcttattagctccttccttcagccccactctaccagctcccagcgcagcgctgctcgtcggccggttgctccgatagctcagtcgatcggctacctcgggtcttgctcacaggagccgactgcatggctcctcatgagcgagcctagcaagtagccgcggtgctactacttgtcccagcatcaggactcaaggagagaggcgtccccaccgcggctcggcgtgggtagggcaactgctgcatatctgctagcaccaccaccgcatgcagcagctgccgtgagggcaggctcacatgacctgatcgcccagccgcgagatctg

SEQ ID NO: 49544 - DNA, 322 bp, Triticum aestivum
  Clone ID: PAT_TA_49544
ggcagatcagagttgagcgcgagggcagtcgaatgagatcgtgatggcaactgcatatgctcctccgcaggcgtgccaggagatgaagtgcggctagaagagctcctagccgagggggctgtccggcgcctcactcaccaggaggccccgcttggccggctaggccggcaagtctgactaggggacgtaccaggagggccagcccttcaacggagacccgtgctttgactggctggcgacacccgtctcctgcagccccctggtcgcgtgggacctgtgcaacctacccgcgtaccggaccgacggcaggccgctcctgcgc

SEQ ID NO: 49545 - DNA, 226 bp, Triticum aestivum
  Clone ID: PAT_TA_49545
gccagcgccgccggaatccgggtcgccccgcccccacgcccccacctcgtgccgcgaaggagcgggaggggtgtcctgtctgttatttcagcccggggacatcgggtccttctccttcacggcgctgataatgctcgccacagagttcctcgctgcgccagggaactcgcagacacgcgatgaagaagcttgcgtgaggtctcgttcccggagccgcgcgcgcttt

SEQ ID NO: 49546 - DNA, 436 bp, Triticum aestivum
  unsure (1)..(436): unsure at all n locations
  Clone ID: PAT_TA_49546
ggatggacttatgtcaccacaaacagaaactaaagcaggagttaggattttatgctggtgttaaagattataaatagacttactacacccctgagtatgaaactaaagatactgatatcttggcagcattccgattttgtcctcatcctggggttccggccgatgatgcaagggctgcagtagctgccgaatcttcttctggtacatggacaactgtttggactgatggacttaccagtcttgatcgttacaaaggacgatgctatcacatcgagcctgtagctggggaagacagccaaaggatctgttatgtagcttatccattagacctatttgaagatggttccgntactaacatgtttacttccattggaggtaacgtatttggtttcattgccctacgagctctatgttaggatgatctacgaattccccc

SEQ ID NO: 49547 - DNA, 421 bp, Triticum aestivum
  unsure (1)..(421): unsure at all n locations
  Clone ID: PAT_TA_49547
ctcttccctcccccacccccgcgcgcagcctggagcgatcttcctctcccagccatccaatccccaaatccgcctaatccaatcttatcaccaaatcattcgccactactagcatgctgccagcgcgcggcgacgcagtaatcgccgtcgctgcacgcgggagcgatcttgttgctccggccatataaatatcctgacttcctggtcgctgtctcccggggatttgcttccggtccagcctgattgcggggcgagagataggagaaactgttaggtagagaggaaggattaggaggagttagggagggtctccgaggcgggatacgtacggagccgggagtccgaggaggaagggaaggggtntgccttcggaggccgncatggcgccaacgacgcacttnacgccgtcgcaggcgcacgc

SEQ ID NO: 49548 - DNA, 399 bp, Triticum aestivum
  unsure (1)..(399): unsure at all n locations
  Clone ID: PAT_TA_49548
cccacgcgtccgcgaatgttaaaccagcctcgctcgcacccgaacggccgaacggtccgcagcgcagccactcactcactcgccaagaaagcaggagcgcgacgcgggccgcagccatgagcggcgcggagcacatggagatcgccgtcgtcgccgccaagagggcggagggacggcaaggaggaggctgcggcggcggcggatgatgcggaaccgctgtcggcgctatgcggcgacgagctgctgcagatcctgggccgcctcgagggggacccgcgcgactgggcgcgcgcgtnctgcgcgtccccgcgcctcgccgcgctcctccgagccggctgcttcccgccgagagtctcccgggcgctccctgccgtgctgctccccgcggtcggggcgccc

SEQ ID NO: 49549 - DNA, 396 bp, Triticum aestivum
  unsure (1)..(396): unsure at all n locations
  Clone ID: PAT_TA_49549
gagagaattcttaattcaagagttatagggagggacttatgtcaccacaaacagaaactaaagcaggtgtaggatttaaagctggtgttaaagattataaattgacttactacaccccagagtatgaaactaaagatactgatatcttggcagcattccgagtaagtcctcagcctggggttccgcccgaataatctggggctgcagtagctgccgaatcttctactggtacatggacaactgtttggactgatggacttaccagtcttgatcgttacaaatgacgatgctatcacatcgtgcctagtgctggggaatacagccaatggatctagtatgtagcttatccattagacctatttgaagatggttccgntactaacatgtttacttcca

SEQ ID NO: 49550 - DNA, 248 bp, Triticum aestivum
  Clone ID: PAT_TA_49550
cccacgcgtccgccccaaatcaatcacgccgctcgccgtctccaagattagattttgcttctaaatctttatggaggggaggggatccagggagagaagatggatcagcaggtggaggaagcgtccgtctccgtcagcagcgtcccgccggaggtggaggaggagctggatgtagaagaagaagatcttgatgttgatgaggaggacatgggtgcggagaagatggcgctgggccctcaagttcccct

SEQ ID NO: 49551 - DNA, 388 bp, Triticum aestivum
  Clone ID: PAT_TA_49551
ccttaacgcatgagttattgggagggacttatggcagcacttacagaaactcaagcaggtgctgaatctaaagctggagttaaagatgataaattgacttactacacgcctgagtatgcatctaaggatgctgctatcgtggctgctttccgagtaagttctcaagctggggctccgcccgaagtagcaggggctgcagcagctgccgaatctgctactggttcttggactgctgcttggactgatggactgaccagtggtgttcgctacattggacgatgctatcacatcgagcctgacactgaggcagacagccaatgaatctgccatggaacctatccattagacctatcagaagagggatccgaagctaacatggttacttaca

SEQ ID NO: 49552 - DNA, 296 bp, Triticum aestivum
  Clone ID: PAT_TA_49552
gaagcagtgcgggtagcgcgagctaaggcatggacggtgaggagcccgcacggaggtacagcacgagagaactcggacaaagagcgaccttaggcaggaggcagattctatcgcagggaccaagggtatggaggaggaggcggctcgggagggctcggcaagctcggaggtggaggccgtatagacgagacctatggcgggcaccgagaagctttctaaggagagcgcaaactatcaaatttaaaataatgcgcttttaggacagagtcttgattatgtggaacctatgtcacgtc

SEQ ID NO: 49553 - DNA, 333 bp, Triticum aestivum
  unsure (1)..(333): unsure at all n locations
  Clone ID: PAT_TA_49553
cccacgcgtccgctcctgtctctgaatcttgttgccggacgtgtggctccaaattcttaagcttagcgaacccgagacccacaaaccaccgggctcactgctccggtccgcagctcctgtccaagaaaagctcgtcgttgccatggcaccggttccgctgagcaccttcgagtcctcccctgcgcgtcacccttgttccgattcgtatcaaggccgncgccggggagccgtctctgcgtcgtcgtcctcctcctctgctaatgcggatgaagtggncatcgagggtgcgggcatcgagggtctggccaccgagctctccctgcgccggctcgg

SEQ ID NO: 49554 - DNA, 280 bp, Triticum aestivum
  unsure (1)..(280): unsure at all n locations
  Clone ID: PAT_TA_49554
gtcgtggtatgttgcagctgccgctgcgcgaccccgcgtgattccctaccgccgccgccgctgttgcagccatgggtatcgacctcgttgccggcgggtggttcttgatgaccttgcgcgtcgcgcccttgtccgacgatgtctacctcatgctcctcgtcatgctctaccgtttcctggagaggaggaccttgatctagttctacgccgtcatcctcttgatgctcttcatgagcatgaccaaccgcccgccgctctccatgcgccgnctctccaactt

SEQ ID NO: 49555 - DNA, 146 bp, Triticum aestivum
  Clone ID: PAT_TA_49555
catcttttcccttcctgctgctgatcggcgctcgtgcgttctgctgcacgatggtccttggcatgtggatcctgagcgtcgcgtgcgatggcgcggcagcgacagtggtgtgctgcgcggacgtggcggcgctgagcgcgcgctgc

SEQ ID NO: 49556 - DNA, 453 bp, Triticum aestivum
  Clone ID: PAT_TA_49556
catttgtgtttcagccaatggtgcatccacaaatagaacttcgccaagccgcttgggatagttctatttgtggatgcaccatttgcggttcagccaatgcggccgcttgttaaacctcggctgaaacaatatgcctccttgggacgatcttgcgatgcctagaccgagagaaaagagtacttcacagaagaaaccgtgcctcccgatttccgccgttaggcgtcatggtttctgaatcctgagctgtcatactgttaatggctggtggccagattctgtggaagcagtataaacaaatccagacatgaactgtgagctggaccatgagtaatgtgtgccaaggccgattcgatggggtcacagtctcacagaatatagaatgctagctgatgttacagcgttgcaaccatggtggtgacgagagctgttatcttcaatcaccgtttgaccact

SEQ ID NO: 49557 - DNA, 457 bp, Triticum aestivum
  Clone ID: PAT_TA_49557
cccacgcgtccgggcacctggagttcatgtatgaccaggcgccagagagcatgcgcagcacggcgaccgcgctcttctggctgtccatctccctgggcagctacgtcagcacgctgctcatcaccatcgtgcaccggtggagcgctggcccagacgggtccaactggctcccggacaacatcaaccgcggcaagctggactacttctactgggtcgtgacacttctgcaggtcatgaacctggtgtactacctgatatgtgctaggcagtacacgtacaagcccgtgcagcactacaaggaagaggagggggaggacaagtccatggtggagctgcaacagaaggtttgagcgagtaacactatgcaatgtagtgtgatggatatcagtatatgcaggtactggcctagctagctaggtagacagatctgtgaagatggtggtgaatgtatatgtca

SEQ ID NO: 49558 - DNA, 191 bp, Triticum aestivum
  Clone ID: PAT_TA_49558
gaccgacgcgacccaatcggtctttcacccaatgaggcaataacaaaaataacttggccaagccgcttgggataggggggtttgtgaatactccaatataagttcaaccaatgtgattgcattgttatccccagctattaactatatgcctttttgcgacgatatagtgttgctaataactgttttaaatg

SEQ ID NO: 49559 - DNA, 331 bp, Triticum aestivum
  Clone ID: PAT_TA_49559
atcacggtcacgcgttgagccttcacatgacgaagacacaaccgtgacagcactcatagggggaccgagggtaccttctgctgaggcactttagtctgcaaaatctcatcactgtctcgcctagcacagcatggacggctgttctagtggctatggaggtgctgtaatataatgcatcacgtggcgagtgatactctctgcgtgatcttatgtgaactgttcggtagtgcatgtgttcatccgtatgtctagctgttcaaatacttccactgaattcaataccgaccttttttaagttgttgtgacatttttggtagaagccaccatatta

SEQ ID NO: 49560 - DNA, 191 bp, Triticum aestivum
  Clone ID: PAT_TA_49560
cttgcggagagcgcaggggccagacgaccaggggagcgttgcacaagtattctttgtagagtttgatttgattggcgtgctgcgttgttgtaatagcactttgtaagagcactcgtgtgatcgattactggaacaatggttgtatcttcttgaatagaccaagatagtacagtagtctatggaacatgcac

SEQ ID NO: 49561 - DNA, 472 bp, Triticum aestivum
  Clone ID: PAT_TA_49561
cccacgcgtccgactactgctaccccttctgctcctgcacctccatcccagtaatgcttagcttgtagacagtgcacctacctcatcccagctgcctctctccttaccttagctgattgcttgggaaattgaccttccattttgcttcctcaggccatcggtacatccttgccggtgtactgtcaagagcagctgagcgcaaggccatcagtgggaatcttctgctgagcttgctcgccttttggcgcgtgtatggcgcccaagagcaagcgtggcaaggccaagggcgagaagaagaagaaagatgagaaagtgctccctgtggccattgacatcaccgtcaacctcccagatcagtccgatgtcattctcaaggggatttccacggacaggatcatcgatgtgaggaggctgctctgcgtccacactgccacatgtgcaatcacaaactactctctctcgcatgagactc

SEQ ID NO: 49562 - DNA, 374 bp, Triticum aestivum
  Clone ID: PAT_TA_49562
aatttggtcgcggtaggaatcaacagcgggtgctagagcgatcttgaataatgtctgcccctgtggcaatgcaaagatgcaaacggattttgctcgaaacagaagcatattacctaaaaaggtaaactaaccatgtttaggtcagcagtaaacgaaattgcatggcgtatataatgtaaccgttgtacaacagatcatggtgcatataagtatgatggattatatattgagaggtatattatagaacatatcttgatatgacgtggtcatctgatctacgaagagaacttgaatttaccaaatatgatgagggcgtgcgctctcaacgatccatgctcacgtacgactgcatgctattttatacctaatctata

SEQ ID NO: 49563 - DNA, 408 bp, Triticum aestivum
  Clone ID: PAT_TA_49563
gccacgcttgcggcgcttgaaacctacttcaaaagcccacgcgaccacaagatgcgaaaccgcccgcaggctacgcacgaagcaaaccgcccgtactggcaccggcagcaaggcccaccagacgatgatggcctccaagtgggggcggaagaaggtgccgaccaccaagggactgaagaagtaccaccggtacacgcccagggccgtcaacatcaactggatcctgcagtaccacaagatcaccgacctgtttatctgcaagatgacgatccagccgctggttcgcaagatcgggcgcgactttaagactgtcatgcgttcgcagtcccactatgagctggacctctaggaggtgggcgaggtgtacctgatgatgctgatggacgacaccaacctgtacgccatgca

SEQ ID NO: 49564 - DNA, 159 bp, Triticum aestivum
  Clone ID: PAT_TA_49564
gttatagtgtgttggtaaaaagagacattataacttacaaactctttcccatatctctgatgtcacggtcactgaaatggtaaagagtttgtaagttatagtgtgttggtaaaaagagacattatcatccaccaacaaatcatcatatataactactct

SEQ ID NO: 49565 - DNA, 424 bp, Triticum aestivum
  Clone ID: PAT_TA_49565
ggccaccgcaatcttgtttgtcccaggtgtataataagcgcccggccaccacctcgccaaaggaccatccatctaacccagcgctagctctctctgcaaagctcccttgtctaccataagctcggaagaagacgccgggaagctcggctggaggtgaggggcggtgaagaggtgtataatgccgtacacggcgtcgaggccgtcggcgccgcagagggcgcgggtggcggcggggggcggggggtggaaggcggcggcgcacgcggcgtcgtgcggggcggtgccgggggaggtggcgcggcaccacgagcacgcggcgggggccgggcagtgctgctcggcggtggtgcaggcgatcgaggcgcccgtgggcgcggtgtgggccgtggtgcggcgcttcgaccgcccgcaggcgtacaagcac

SEQ ID NO: 49566 - DNA, 392 bp, Triticum aestivum
  Clone ID: PAT_TA_49566
cggctcacgccttggtcgcccgcttctcctccctaggttttcttcgcgctgctcctccccggctacgcctccgcgcgcgctcgtcgtctccatccgcctccgtctccgtctccctggccgagctcgtcgccgtcctccgtagcggctcgcccggtcgtcgtcgcagctccccccgccggaggttctccgccgtcctgatccggccggcttcgctcgtctccccggctcaagccaaaacttgtaaggatggcggacgaggaacatgctcaaacttctaggaagagggttgcagacaaacaaatcaacaaggatcatcctgagcctgatgatgactcatcggaacaagagacaggaacatttaagaaagctagtgaagaagtgatggcaacccg

SEQ ID NO: 49567 - DNA, 157 bp, Triticum aestivum
  unsure (1)..(157): unsure at all n locations
  Clone ID: PAT_TA_49567
ggaanggccggggcgacccacgcatccattcattctgaaaattcaaaacctaagacttataagcaggccctcatcttacaccgggctggggctcatataagcgtgacctacaacttagaagtttcacaacaatgcttgaaataacaccccttttagt

SEQ ID NO: 49568 - DNA, 391 bp, Triticum aestivum
  Clone ID: PAT_TA_49568
cccacgcgtccgcccacgcgtacgaaaatcgtcttctgacgttatcggctcggagtcccctggcgtcagacgctgcccctgtacctggaccgctcccatggcgtacctcttcagggctagtcggcggccatcgccgaaggacgaggcagacgacggcgacggatccggatccgggcggtgcaagcgccgtcgcctctcgccggaggagggcgcgctggagccgcaagaggctgggaggagcccctggtggctctacaccatcgcgaccggcgccaaacggagcatatacatcgtgctcttctcctcggccgaggagcacgactccggacactaggaggaggaggaggaggaggacgaatccaaacaggactccgaaggaaatgaagatacc

SEQ ID NO: 49569 - DNA, 322 bp, Triticum aestivum
  Clone ID: PAT_TA_49569
cacatgcgtagctctgacgggtgcgcatcaacttcattgcctactgttgatgaacaggatgctcacattgtccacgctaaggtgatcagaaacaaatggtgctgctctttatgccgtcacatatacctacgcagtctgctagggtattttccagaccaacaatgccaaatacacacccaaataaaaggaggtcttcgccgtacactgatactactttgaataattgctggctaatgaagcggcgagcatcgacgacatgcagcgccagtttgcgtcctatacaggtattacactcattctgaggatacacaacaacttattg

SEQ ID NO: 49570 - DNA, 459 bp, Triticum aestivum
  Clone ID: PAT_TA_49570
gtctcttcctcctccctcccactacccgtctctcccctctccccccaagcgagacacaacaccgaccagagagggaggaaaattcccgatcaaaccctcgaatcctccgcggcctcgtggaatcccagcccgccgcagcctcgccctccccgcgccgcggttcgggatcaggaaggttcggacggcggattccggtcgcatggagcgcgtcttctccgtcgaggagatccccgaccccttctggggccagccgtcgccgcggccggcgggggcgtcggccgctggccccgcgtcttccggagggggcggcgcggagggcgcgatgaaccggtgcccgtccgagtggtacttccagaagttcctcgaggaggccgtgctcgacagccccgccgccgaccctggcccgatggccggtgctagcggaggcggagtgggggccgcggaggtgaagcggaccgc

SEQ ID NO: 49571 - DNA, 248 bp, Triticum aestivum
  Clone ID: PAT_TA_49571
cagatttctgaggagtgtaggccaaccacacatcacatggcctacctagccatactaacaggcgacacagtgggtgtacatatattaagtgacccaacaaatcactgcacacgttcaatggtttaggaataaacaagagtacactctgattcaaagggatactgactggcctcatgactgacccagtttagggagccctggacccaaggatgcatactactatgccatgggatcagacaggcaatttg

SEQ ID NO: 49572 - DNA, 467 bp, Triticum aestivum
  Clone ID: PAT_TA_49572
gtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagaagctgccgaatcttctactgctacatggacaactgtttggactgatggacttaccagtctcgatcgttacaaaggacgatgctatcacatcgagcctgttgctggggaagacagccaatggatctgttatgtagctaatccattagacctatttgaagagggtaccgtgactaacatgttaacttccattgaaggtaacgtattgggtttcaaagccctacgtgctctacgtttgcaggatctacgaattccccctact

SEQ ID NO: 49573 - DNA, 410 bp, Triticum aestivum
  Clone ID: PAT_TA_49573
ataggagaaccaaccaactgtccattttttgctcacactatcgcaattatgtctggggcagggaggctaccgagcatatatataaccactcgtacttgtagcggctacgagctaactggctaagcttcgatgtaacactaccacggaggagccggatatatatagcttgacgcgctgctgtcggtgctgtgacagttgtcaagatgctgatgaggctgttggtgctggtggctatcgccaaggcagcggcggccgcggatcacccctccacgtacatactacacatggccaagtctgccatgccggccgtgtacgccgaccacggaaagtgaaacggtttctccctccgatcggtgtgcacagagggcgccagcgatggcaagatgctatacttctacaacaccgtcctg

SEQ ID NO: 49574 - DNA, 457 bp, Triticum aestivum
  unsure (1)..(457): unsure at all n locations
  Clone ID: PAT_TA_49574
ctctctctctctctctctctctggttggtagtgcggtgctgcgaaaggagacgacgatggaggaggaggaggggcgggccggcctgcgggagctcgcgcgctttccggacgtgatggtggtgtgctcttctgccggatggacggaccagaagcacatgctctacctaggcttgctgcaggagtcgttcgtgaaccggttgcacgacggcgaaatcagcttcagggggctcttcgatctctccccaggagcttctgggcccaagcaaccgtccaaggttgacagagcaaaggttgagcggaccagaccaccttgctgcgggaatcagggagatggagaggcgctttgtgtggaagaagaagaagatgatgatgatgatgcgtcgtccactgagacggtgcgacagtcctactcccaagcaagcgcgacgagctcttngcgatcttccccatgccattc

SEQ ID NO: 49575 - DNA, 472 bp, Triticum aestivum
  Clone ID: PAT_TA_49575
agaattcttaattcaagagttatagggagggacttatgtcaccacaaacagaaactaatgcaggtgttggatttaaagctggcgttaaagattataaattgacttactacaccccaaagtatgaaactaaggatactgatatcttggcagcataccgagtaagtcctcagcctggggttacaccctaagaagcaggggctgtagtagctgccaaatattttactggtacatggacaactgattggactgatggacttaccactcttgatcgttacaaaggacgatgctatcacatcaagcctgttgctgcagaagacagccaatggatctgctatgtaccttatgcattagacctatttgaagagggctcccgttctaacacgtttacttccattgtatgtaacgtgattagtttcaaagccctacctgctctacgtgggtaggatctactagattccgctacttattcaaa

SEQ ID NO: 49576 - DNA, 376 bp, Triticum aestivum
  Clone ID: PAT_TA_49576
accacgcgtaggagcacgcgtccgtcgtctagtaaaagcacgatggactacatgaatgggccaggccggaaccagctgttcgtgcctgggccggtgaacatcccggaccaagagatccgaggcatgagcctgctgaacgaggactaccgcttgacggtgatccctgctctgaccaagaccctgctgggggacgtgatgaagatgtttaagaccaccaccggatcgctgttctttttgccgaccacaggcacgggagcctgggagagcgcgctaaccaacactctcgtagcgtgggaccggatcgtgttcttcttgctggggtagtacatcattgtgctgatcgaccaggagaagggcctccgctttaacgtggacg

SEQ ID NO: 49577 - DNA, 384 bp, Triticum aestivum
  Clone ID: PAT_TA_49577
tcgtccacacgtacgcccactcgtccatcctctacaacaaccactattacctacatgagtgggtcgggtcctaaccggctgttcttccctcccccgttcaacatctcactctaagtcatcctatccatgagccattttaactaggactaccttttgatgctaatcaatgctctgaccaagactctgaagtaggtcctaatcaaaatctttaagaccaccaccatctcttctttccttttcttaccatctcctctcgatcctggaagagtacgctcaccaacttctcattatcttggaccctcatccttttcatctttcttaaaaattacattcttatttctgatcaattaagtataaagttctttctttttattcgttttcatt

SEQ ID NO: 49578 - DNA, 294 bp, Triticum aestivum
  Clone ID: PAT_TA_49578
tgtgcagataaggctctgtgctgcggaccatcttattccggtcttgtatcctctaggattcagccaagttagacctgaccgggccaatggtggctattgagacagctgttcgtgagaacttgcgcgagcctggcgccgggcagagctgtgctttctcgatcccgggcacaggctgacgaggtgctctgctggactgggagcacaggcttttcttggagttggcggtcgtcgcgctttaagagcctgtgccatggcatcatgcggatgatactccgcacaggttggcgggtgcct

SEQ ID NO: 49579 - DNA, 119 bp, Triticum aestivum
  Clone ID: PAT_TA_49579
cccacgcgtccgattatatctatagaattggaagatattcttgctggtgatatgacctgagcctttgaagacagtgataaagctactttgaatatcgagctagcaggggtcctatcatc

SEQ ID NO: 49580 - DNA, 398 bp, Triticum aestivum
  Clone ID: PAT_TA_49580
gccattcgtgctggcattactgattgcaggacatatggcccgaaggacaatctaattgagcctaatactgggcttactagccggggtagtacctgccaatgcaaccagctatgcttcctattaccttgtcctaatgcggcctgtagcatactgtgtggccagctagttcggctgttgcttccccagttacgtgtacccgtgcggggacttcttcgtgcagagcttcacgaccttctactcgacgttgaacaaagccatggacagatgcattagcagcagcccattcgacattaacaagctggagtccatggtgaacaccttggaccactactggaaccacatccattgcaccatcacttgcgggaccagcaactggacgagcgagtggaatagctact

SEQ ID NO: 49581 - DNA, 405 bp, Triticum aestivum
  Clone ID: PAT_TA_49581
gggggcagaaatctttgcaagttgcaacgaccttatcacttatcatctttgtttgcatcagatcgatcgatggcttcagagaagttcccaacccctgtggccgacctgtgcgacgcgaacgcctcactgatcctcgccggcgagctgcggatcctggagcccgtcttccagccgtacggccagtgcaggtccttctcgggccgggtggtcaccatgcgcgtcctcgagcacaacgcgggcctgcgcgcgctcctggagacccccggcgagggccgcgtcctggtgctcgacggcggtggcagcaagcggtgcgcgctcatcggcggcacgctggcggaggtggcgcgcggcagcggctgggcgggcgctgtcgtgaacggctgcgtccgcgacgtggatgacgtg

SEQ ID NO: 49582 - DNA, 434 bp, Triticum aestivum
  Clone ID: PAT_TA_49582
ggagcgagcggagaagaggagaggagcagccaccatggcgaccactctctggttatctcctcccctcttgctggccggtaccaccacagctagaggaggagtgctttcatgcggtccatcatggagcactgccaatctttcgtgcaagggacctttggttcttatcaggagacgtgcccggaagcaacaaccaagcacaccaatagtatctctgtttggaagaaagaccccaaagaagaccactagagaaacgaggcggccggacccagactatctagtaccgaccgctatacttgcgatatctggcgtgtttgcatatgcagacaaatttgttgccgatgcaactgtacgcctactggggctgtttctcttgattcatactactagacggaggttcgactttgatgatgatgcccttgaagggaaagtgggca

SEQ ID NO: 49583 - DNA, 484 bp, Triticum aestivum
  Clone ID: PAT_TA_49583
cgtccgctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccagttctctagtctttctccctctgttcctctct

SEQ ID NO: 49584 - DNA, 392 bp, Triticum aestivum
  unsure (1)..(392): unsure at all n locations
  Clone ID: PAT_TA_49584
cgtccgcggacgcgtggggtgggctcgccggcgtcggagaagatgccgttgtgcggggtgtttagagggatggtcgggctggcgacgccggccgcgggtggccggaaacggcggttgggccagtgccagcgggcacgcctgtcgcctagtggtggtggaggcgggcggagatggacggcagtgggtggggtcgggtgggctcgagcgcgacagcggctacctcgcatctcattcaggtttctttcagcttcatggtgaaaaatattgctgcacattcctaagttttttttgcacaattgttgggcttgacatatatatgtagagaccacanaggattagtcaaactgtatttatttcattntgtgtccagatggtatgcagaccttaagttt

SEQ ID NO: 49585 - DNA, 245 bp, Triticum aestivum
  Clone ID: PAT_TA_49585
cgtccgcctcgcgccgagccacgggaagccgcgcccctcaccgtcgcctcgcgccgccggagccacgggaagccccgcatgtctccgggagcccgtccccgccgcgccattagacacctatccagcctacgaagcacaccccccgcaagtgtaccggcctcaaggggccccggaagcagctttccaccaaggaggtgaggaaattagcgccgaccacgttcgaggtaaaaaatccccaccgttac

SEQ ID NO: 49586 - DNA, 488 bp, Triticum aestivum
  Clone ID: PAT_TA_49586
cgtccgtctcactccactttggttcctcactctcacgctgactgacctaccaaaccaatctctcctgctccgtccctacaaaccacccgccgccgccgccgccgcccagaggctcccccctgccgtctccaccccgcccctcccctccccttgtattggattggattggattgggttgggccttcttggatcggatcggattcgattgaggtcattggcaagcaaggaagcatgagaccgaccgcacatcttgtcttctagaataataatagtaatgtccatgctcgcgtgtgcgcttcaaaccatgggctcatcctgcagcagacctcactcagtaaatgaggcagacgcagctgacaacacaagatctgcagacatcgaccgccgcattctgcacgagacaaaggcggaccagcacatccacaagctcttgcttcttggtgccggagaatcaggaaagtccacgatatttaaacagatcaagcttt

SEQ ID NO: 49587 - DNA, 453 bp, Triticum aestivum
  unsure (1)..(453): unsure at all n locations
  Clone ID: PAT_TA_49587
cgtccgcggacgcgtgggcacgataatcacgaagcgcgacgcaggcgccacaactcaactcccccactgactgcctctgtctcctgactcctccccaaaccccgcgccgcccaagcgcctcctcgccgccgccgccgccgccagacccagctagggttccggcgagctcgcggcctcgccgccccgccgcgcctccttcctcgagggctccgctccccggtgagggcgcccgcccctgcgcccccttgctggatttgatagcagctatgcaaaaggatacaggctctggtgatgtttctccttctcatgtaggacgtgttagacatcggaggcgcccgaatgagactgccaccgatgggaatagagccaatggggacggttntgcttgtcagcgaccagaacaagtacaagtcaatgcttatccgtacatattcaactttgtggatgattgga

SEQ ID NO: 49588 - DNA, 492 bp, Triticum aestivum
  Clone ID: PAT_TA_49588
cgtccgcggacgcgtgggcagcgctgaagtatgagccccgtggactagcgattgcttctccacgaggctcataccaggcgctacggcgctgaagtatgtaactgatgccatactcccaggaaaagctcgaacgaccttcaacaaaagggtacctgtacccgaaaccgacacaggtgggtaggtattctaaccacactccccaccttcttgcgccacaagccggagcagacgatccgccgtcgacgcgacctcctccgcccgccgggatcggagacgactatatagacggtctagaggttgaagcaacttaacaatgagtagcataggaactgggtatgatctgtccgtcaccactttctccccggacggacgtgtcttccaggtcgagtatgctggcaaggccgtcgacaacagcgggacgatcgttgggatcaaatgcaaagatggaattgtccctggtgtggagaagctgataacatcaaagatgatact

SEQ ID NO: 49589 - DNA, 495 bp, Triticum aestivum
  Clone ID: PAT_TA_49589
acgcgtccggaaccaactcctgctcatgagactgctggtaaaggatcggtacttgctggaaaccgcaaaggcgatcgtcagagttgacgctcccgtcagtttcatcgacgctgacgccggtgcaccgaactggtcggtcgacaaaggcaacaacctcctctccgatgtggcccgggaggtggtcagaaggaaaggcaagaggagcgaggccatggaggaggtcagcgtggcgcgcaccgccaacctgaggctgcaataccttgacgatctcgtcagagagctggacggcgacgtcgagagcctggacatgtcaaagtccaagagaactcagcagcagggtgacaatcgcgcggccgaaaatctgcgtaggatacttgagagtgacattcagaatgaccaccccgacgccaactcgacgtgggatttcgggtggaacccggtgtgggaactgccgatggagaaggggcgacgttgtccaggatctggagaagaaca

SEQ ID NO: 49590 - DNA, 461 bp, Triticum aestivum
  Clone ID: PAT_TA_49590
cgtccgcccacgcgtccgggacgtgaggctggagcgggtgctccgggcggcggcgatgcccaacgacacggtgatcctgacgacgctcaactcggcctgggcggagccggggtccatgctggacgtgttcctcgagagcttccgggtgggcgagcacacccgggagctgctcgaccacctcgtcatcgtctcgctcgacctcgccgcgcaccgccgctgcaagcagatccacccgcactgcctcgccgtggccaccgagggcgtcgacttctccggccagaagaacttcatgacggacgggtacctgcggatgatgtggcgccggatcgacttcctccggcaggtcctggagaagggctacagtttcattttcacggacacggacatcgtgtggctgcgcagcccgctgccgcgcctctacgccgagggggacttccagatcgcctgcgaccacttcaccg

SEQ ID NO: 49591 - DNA, 475 bp, Triticum aestivum
  Clone ID: PAT_TA_49591
cgtccgcggacgcgtgggttttgatctgcgtatggtggacatgatctgtttatctcaccgtttatctgaagtgatgggatatattactggtgaaaaaaaaaaaaaaaaaaaaaaaaaaaaaaaagccgcctcggccgctggcacggccacgcctgagaacgagccggagtccttcgacccgctcgtgtttttccagaactacatccacaccctcatggaggggggcgccaacatccaggtgctcctcgacgacgccagcgtcaacctcgcccccggcctaggcggccgtgccggtgggacaagctacggggactacttcgtcggcccgggactggagcaactcatcgagcagctcgccgagaacgatcccaaccgctatggcacgccgccggctgccaagtccgccctgaccactcttcctgacgtcgttgcaccgatgccatggtgcggcggcagagggcgcccagtgtgctgg

SEQ ID NO: 49592 - DNA, 461 bp, Triticum aestivum
  Clone ID: PAT_TA_49592
cgtccgggaacatggcatcatctttgtgatgctcctggccatggcggccaccgtcggagcgcggtcaggagccacggcgcagccatcctgcatccccactgcagatggcgcccctcgcatgcacgggtttctttgtacagccggagcagtgcccccgtcggtcgccgccaactcgtccccggcgcttcatcgtctgcatcgtcctgccagaggactgccaacgcacccagctccggcggatcatgaaccgcggtcactcgcccggccgcttcctcgtctgcctcgtccggccagaggactaccgacaacaccaactcccgtggatcatgagccgtggtcaccaccgccgcccgccatgcaagggtgattagtttatgaaagtgcagccgtgcctgtttctcagtacgttgcttgtgatcacctggcaaaaagaaaagacccagtgtcgtcgctttaatatt

SEQ ID NO: 49593 - DNA, 490 bp, Triticum aestivum
  Clone ID: PAT_TA_49593
cgtccgcggacgcgtgggacgagattcacaacaactaaacgtagcaaattttcaactaaacctgagcattcacctgcaactccccatcaactaatcaacgggcatttccaacactttagtcaagatgtctggtgacatatgcatagcaatgttggatgtctgctagttggagtttgtgctcttcattaagtatttccttcctccttggtccgttaatgcagggtgtatatccgctgatctcacgcagaggccgcccaaggacgcctactcctgggagctatctgggccatcgctatgagcgcagagagatgcagcgtggaggtagattccgcagaggaggctatggtcgtgacgactactatggcaacagctaccgcaggtctccgcctcccatgtaccgagaatacagggacacccgggactaccctccctacagggacacccgcgactactccccaccccacagggatgcccgagactactatgacgg

SEQ ID NO: 49594 - DNA, 395 bp, Triticum aestivum
  Clone ID: PAT_TA_49594
cgtccgagggaagcaaccaggcaagaacaggggagggaggctcagatctcttccctccaatccatccatcaatccatccacccccagcgatccatctgcctcgccgggatcctcgtcgacccctgctccggcggagcatacgggccttctcggccccgcccgaccaaatcgcgccaagaaccgagatttccgtgagatttccgcggcggcggcgggcgtcattcgccaatgccggccgggttcccgtgaggtctctccggctcggacggcggggggtcggtcttcgcccccttgtgcggaatcccgccttcttggaggaggggattgggcggaaatctccattttttcccccgtttcccccctaatctcggcgtcggcggaggaaggatttcttt

SEQ ID NO: 49595 - DNA, 417 bp, Triticum aestivum
  Clone ID: PAT_TA_49595
cgtccgcccctcgtcttctcccccctccactccaactcctccctccctccccacccccgtccaaaccccccggccctgctccaccaccaccgctcctgcctaccggtggagggattaatcgggggcttccgcagcaaccaccggcggcggcggcggttcaccgattcgcttgcgaggcgctgccgtctgaccctctccgtggcggcgatgggccagggcgtcgtcgagatccagccccgcgagctccagttcacctttgagctgaagaagcagagttcatgttctgtccatcttgtcaacaaatccgatgaatatgtcgctttcaaggttaagacaacttcccctaaaagatattgcgtccgaccaaatattggagttatccttccaagggcaacatgtgatttcacagttaccatg

SEQ ID NO: 49596 - DNA, 411 bp, Triticum aestivum
  unsure (1)..(411): unsure at all n locations
  Clone ID: PAT_TA_49596
cgtccgctagctttgcccagttgcaccgcgagcgagggagagaaagagggcgcgctcgagctggcggagggcgtgacgggacggcgacgtacggccgacggactcctcccgtcgtcgcctcgaaatcatgggcgcggcctggcgcttgtcggggccgcgtccagccagcgggccttgtgccgtccgcacgctcgatccagcacgggctctggtgcgcggcgcggtccctgaagcaaagccgtgcgtctcatggagtcgtggtgatcacgtggcacgccggaaaaacttacggcatggtccctgtccgtccgtccgcccgccgcgtgatgtgaatgtgatccgcccgccgtgcggtccgcggcggaggggtncgcccacactctacggcgagctgacatggcgctacccgag

SEQ ID NO: 49597 - DNA, 469 bp, Triticum aestivum
  Clone ID: PAT_TA_49597
cgtccgcaaaaccaaacacaccctgtgaaatggaggaagtactatgttgagccgaacccatttccatttcattttgcgaatcaccctcggcgagacccggacccggaccggagcatcatccgtctccggcatcttaacccgccgtccgtgccccgtcgcccaccgctcatccccgccgcgatggggagcgtagacctggtgctgaagccggcgtgcgagggctgcggctccacgtcggacctctacggcactgggtgcaagcacaccacgctctgtagctcctgcggcaagtccatggcgctttcccgcgcccgatgcctcgtctgctctgcgcccatcacgaacctcatccgggaatacaatgtgcgggcaaatgccagcacagataaggcattctctattggaagatttgtaactggtttgccgccattctcaaagaaaaagaatgctgagaacaaatggtctcttc

SEQ ID NO: 49598 - DNA, 494 bp, Triticum aestivum
  Clone ID: PAT_TA_49598
cgtccgcccacgcgtccgcccacgcgtccgcggacgcgtgggttctcctctgcgacacgcaacctttttccgtcccgctatacactagatcagatccttgatatagagaagaacccgcctcctcctcccaaccacaactacctccatctcggcaaggtgagcccgtgagtctggctaccatgatttttcccgcgaaacccccgtgtgctctctggttcgcaggttcctcgtcgatcgacgggctgggcttgcggcgatcttggagcgagttgcgaggcggctgcatcttccggtctgcccgtccggcgagtcagatctgttacctatctgatggcccgcggcggatctgggggttcccggtggtctcgggttgaccctgcggcgaggaaggcgtcttctccggcatgcacgtggggatcccgtcttctccgcctcgcgcgacggcggctcttgtattgataattatccgatgatatctcgataattattagatc

SEQ ID NO: 49599 - DNA, 379 bp, Triticum aestivum
  Clone ID: PAT_TA_49599
cgtccgcccacgcgtccgctttgaagccccgccctccttccacaggcccatgacgaagccaacctagctagcttgcaccacgtaccgtgtggcattatatatacgcccaccggccctccgtgccatcccggtctccatcgccatggcgacgacggggagggtgaggccttctcctctcctcgcggcgtggctggctctcggctttgcgtggcattgcgcgcttcaccatgctccggcggcggccgtgacgctgtcgacggcgtcccggtgggtcgtggacgaggccggggaccgcgtgaagctggcgtgcgtgaactggccgtcgcacctggagccgatgctggcggaggggctgggcatgcgggccgtgggcgccatc

SEQ ID NO: 49600 - DNA, 408 bp, Triticum aestivum
  unsure (1)..(408): unsure at all n locations
  Clone ID: PAT_TA_49600
cgtccgcggacgcgtgggtttgcatctccgatcgtctcgccggcgtcagcgagaatgcagggcggatccagcggcatcgtctacggcggcctcaagtaccaggcaagcgacaccaccttctcgaagcttctagaacactctcccgtggcgccctcttccgtctccttcctcctcatattctttttcccctcttccaggcgcggtgcatcaccgacgtgcgcgcggatgccggttccaccaccttcctcgccggaaccctcagcctcaaggaggagaacgaggtgcacctgatccggctgctgccgggggagaacgagctcgtgtgcgacgggctgttctaccatcccaacgagatctgggacctcaagttctgccccttcgaccacaagctcttctncacggtctaca

SEQ ID NO: 49601 - DNA, 395 bp, Triticum aestivum
  unsure (1)..(395): unsure at all n locations
  Clone ID: PAT_TA_49601
cgtccgatgagatatggaaagagccggctcaatcctgagaagtggaagacaatgcaggaaattgtttgtggacgctcggggaaacctttgcatgagaacaggtgcgagtgtacatgaggttgtagtttgatcgccagtccgatgagagctacgaggagaaaagaaccaagattggtggcgacgtcctcaaaacgaactcgtcaattgaaatacatgccagcaaggtgtacactcgggcgagcaattcggccaaattttgtactagtcgggtgggtatcgggtcgaacaggctgagaacaatgaattatacagggcaacacacactcggcctgaaaagaagggagaaatggagcanggttgttttcctggtgaagatgattgacaattgagcaaaa

SEQ ID NO: 49602 - DNA, 471 bp, Triticum aestivum
  Clone ID: PAT_TA_49602
taccggaccggagttccgggctacgacgcacgcacacgtccaggctgtccggggcacgcttggggctctgctttctaaacatctcaggacatatctggtggactcttgagcggatcaaacactgtactctgaaaggctcaatacaccatcgcggatagcatcgggatggatgtcgctggttcatagcatcactatttcacggcacgagatctatgaccatcacacttcaggatggctacctggacggtcctcataagatatcataggctcaccgtgtgaacgtatgcgagctatctgctagtgagcaccaccaccgttctgttgacgaaccatctgtcctgggtctgcaggttcaccatgccatgtcactggcgaagtgcttgtgctagttaacattgacacgaattaccttttactctccatcccaacctgagttagcctggcaatgcacgtgaatttattcaatgctcc

SEQ ID NO: 49603 - DNA, 487 bp, Triticum aestivum
  Clone ID: PAT_TA_49603
cgtccgcccacgcgtgcgcccacactagccagtgcacctgcatcttcctctgctagatgtaatctttactgggcgggcgatgaacgcgatcgaaggccccatctatagagtaacccggctcgcgctggaaccactggtaccggcatctgcgcaaggtgagcacgcgagtgtgactaccatgatttcccacgaaaacccgctgtgtgctctgtggttcgcaggctgctggccgatcgaccgtctgttcttgcgggtatcttggagcaagttgccaggcggctgaatgttccggtctagaccgtccgtcgagtcagatctgttacctatctgatggcccgcggcggatctgagtgttcccggaggtctcggtttgaccctgcggcgaggaatgcgtcttttccggcatgcacgttgtgatcccgtcttctccgcctcgcgcgacggcggctcttgtattgataattatccgatgatatctcgataatta

SEQ ID NO: 49604 - DNA, 478 bp, Triticum aestivum
  Clone ID: PAT_TA_49604
cgtccgctcgaacgaccttcaacaaaagggtacctgtacccgaaaccgacacaggtgggtaggtagaggtggcaggagacggaggcgcaggggttcgcgtgggacgcggcggcggcagaccccgggcggctctacgcggcggcgtcgctcaacctattcgacggcgccgggggaagcggctccggcgagccgttcctggcgggagtgcaggaggatggcgcggcgggcgtggggtggcagtacgcggcagagagcagcgagccgccgtcgacggtggcgcaggagcatcagcagctgcacggctcgggcgtggggagggcagattcggggtcggaggggagcgatatgcagctgggagaccccgacgacgaagtcgacggcgagacgcagaggggctccggcaaagacggctgcgggaagcggcagagtgcaagaacctcgaggcggagcggaagcggcggaagaagctcaacgaacg

SEQ ID NO: 49605 - DNA, 390 bp, Triticum aestivum
  Clone ID: PAT_TA_49605
cgtccgcccacgcgtccgcccccatcccgtcggggccggcggattcggtctgccctagccctagcgccgggggcggctcccccatccggttggggccgccggactcggcctgcgctagccctagcgccgccgcctcccccatcccgtcggggccgccggattcggcctgccctagccctaccaccgccgcctcccccatcccgttggggccgccggattcggcctgccctagccctaccgccgccgccggcatggacgacttcgtgctccggtccggcgtgcgcgtggggctgaagcgcgagttcgccttcgccatcgcctcccaggccgccctcgccccctccttcggccgcacccgctcctcccgttaatccgccgccggcgccgtcc

SEQ ID NO: 49606 - DNA, 466 bp, Triticum aestivum
  Clone ID: PAT_TA_49606
cgtccgggatacagacgcaagccttgccaggattgcaagaagtaatgggaagacagttttgcattcagcagcaagaatgggtcatgtggaggtggtagcgtcgttgttgaataaagatccggatattggtttcagaacagacaggaagggacagacagcgctgcacatggcttccaaaggccagaatgctgaaattctgcttgagctattgaagcctgatgtctcagtaatccatttggaggataacaaggggaacagagcactgcatgttgcaacgcgcaagggcaacaccattagaaacaaggcaatgaagagcttgttaacatcctgcgggaggttggtggaataactgcaaaagagcaagcaaatcctccgaaatcagccaagcagcttaagcaaacagtcagcgatatcaagcaatgcgtccaatcacagatcaagcaaacgcgtcagaccaagatgcatg

SEQ ID NO: 49607 - DNA, 426 bp, Triticum aestivum
  Clone ID: PAT_TA_49607
cgtccgcccacgcgtccgcggacgcgtgggtggcagcctgcctgcagcctgcttgttgatttctacataattattacagctttgcctaccgtgttcttattccgctttgaaatttgtgatttttgttttatttcgctggtcgagctgcgtgagtttcagtcgctgtgctccttcttgacttgcctgtgagatttcccattcgaggcatcttttcttttcggttcagttgatgtgttctttcttcgtggtttgatccatttcggcgtgccgatgatgatgcaaaagcatcggtgaattctggatgagtgtgcccgcgcacgaccagtgtgcggctctggtgatatccacagcgtaatactctgaggcacccatgtggaaattaaagcatggattcatttctttgggggggggtatattctgattttc

SEQ ID NO: 49608 - DNA, 444 bp, Triticum aestivum
  unsure (1)..(444): unsure at all n locations
  Clone ID: PAT_TA_49608
cgaattccggttcgagcacgcgtcacgcgcaccgcggacgcgtaggatcggcatgctcgacgctactaagcacacgagctaccattgaagtcaatatctcgaagggaccgagttgagtctcaagagttgctgcctggactaccaagaatgatgagtatagtacggatctttacaacagcggtggtgaagcagcagcagagattgaggcaggagggaccgttcccttgagtcgtcgcgttgtagctgtcccacttggtagaaagttggtgctccttgtcaccggtcgtagcgttggtgatgtttttgataaaaacgtcatcgcacctttaggacgatcaactgagttgatgcattataaattaggctccgcacttgtggaggtgaaacttgtctggacagctgntatgatcaaaggacgtgggagacgagagccttttgatgtga

SEQ ID NO: 49609 - DNA, 416 bp, Triticum aestivum
  Clone ID: PAT_TA_49609
tcacattccttctcgacccaccgctccggccggcagccatggaggagtacctggcaaacatgaggaccctacgctgctacatgaacgatctggaagaggaggcagcgaagcggtcagcggaggagcagaggcagcgcacggccatagatgctcacgacagcgacatcgccttagtgagggcgcaggcgaaacaggtgagcgacgaggccgagcaccttgcaaaggcgagggcgcatgtctgtgtggagatggccgagaagcagggtaggatcgcctcactggaggtcgtgggtgccacgctgaagcagacgttagacctcctccagctggaaatcacaagtacatctgcaaaactcggccagaaaagattattttacacgaagacaatagaaactttgagtgtcaaactacaagag

SEQ ID NO: 49610 - DNA, 364 bp, Triticum aestivum
  Clone ID: PAT_TA_49610
ccctcgcatacactcttccagacccttctcctgcccagtccagctcccatctaaccttccatgtgcggctcgcgttccagtggctgttccactccatcatcatgagcaagatcaacatcttaatcagcatcttcaggcggatcggcaggctcgccctccggagcgaccttcagagcctcgatgtcgagctcgaccccttcatcaccaccttgatcatcacctacttcatgacctacatctccaagtacgacacctgtcaccgccactgcatgcacatcgacgtcaacctgactgtcgtctagactctgatgtctggcgcggagtcaggtaccaggtaccctgacaggaaccctgaggagaaccc

SEQ ID NO: 49611 - DNA, 304 bp, Triticum aestivum
  Clone ID: PAT_TA_49611
tccttttttttatttttttctttatatttgtttattttttttttaaaaaaactcaccaagggggtctatttttcatggggacatacacattactatacacagtattacataacccacaagctgttggggcactaacacccaactaaatctgttagctttccagctcatggaacttacattaccattacacaacacaatggaacctccttatcccactcatgaaacttaacaagaacatacttcaatattctggggagccttctttcactcaataacgtctactactttttacttttttttttgc

SEQ ID NO: 49612 - DNA, 375 bp, Triticum aestivum
  Clone ID: PAT_TA_49612
ttcccgggtgggcggacgcgtacgtccataccatacactctcatcttgaggtttttccacgcccgacatgagagagcccctggtcttgacacacacacggagcgatttgctcgccgacttcggattaaggatccgtcacctcaagatacgcagataaaggaacaatatcttgggacgcgagatgcacaaccatgtcccactccttgactcacgcttgatcaatgacatacaaaaccacgtcctacatcggttgtcactgatactacacttacacggcagacacgtagccaacggctgacacactaatgacaggctacatagtctacacctcctgcgtaaaggttgttgcaccgaacatgcccaccttttacacgc

SEQ ID NO: 49613 - DNA, 415 bp, Triticum aestivum
  Clone ID: PAT_TA_49613
cgtccgcccacgcgtccgggagggcactactgaaccagacaaactgtgttcagctgcctccttggtgcctgtgagctgctgctgctcacttcttcttccccggacatgaattccagccggagcctgctctcgtcgccgctcttccccacctcctctccaaacttcaggtcctccccatccccctcccgcacctcagttccgatgatacatgacagcaccggcggccgggcatccaccgcctgccactactcgccatcgctggtggccgaggagcagcaagcccacagctccgtatccctcaagggcgaaaaggccttgctggagttcctgctggacatggctttggagcagcacacagaagggaagagcctcaccggccaagatggtgcggagggcgagttcgagagctatttgc

SEQ ID NO: 49614 - DNA, 431 bp, Triticum aestivum
  Clone ID: PAT_TA_49614
cggcgaacccaccgcggagtcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaagacaagatcaggccactgtggaggcattacttccagaacacacagggtcttatctttgttgtggacagcaacgattgggaccgggttgttgaagcaagggatgagctccacaggatgctgaatgaggatgagt

SEQ ID NO: 49615 - DNA, 473 bp, Triticum aestivum
  Clone ID: PAT_TA_49615
cgatccagaattcgggggggggcgacgcgtccgctgcgtgctatgctattgtggatggttgatgatcctcgtgtggtgcttatcaacctgggggaccgcttgcacagtgtgcgaacaatctatgctcttcccattccaaaagcagaggctgttgctcaagagacattagctgtctggtgctcacttgcttctcgattgggagtctgggctttgaaagctgagctagaagacttatgctttgctgtccttcagccccaagttttcatgaaaatacgatctgaacttacttcgatgtggaattctaccagcaaggataaaagcatgagaaggtcatcaattagaaggggtttgcttgccttcacgaaggaagtgcacgcgacttccacccatgatctacttagttcgaacgaccaataacaatcaaatttggaggatttatttgcaagctttttttgccattttacctctttttt

SEQ ID NO: 49616 - DNA, 391 bp, Triticum aestivum
  Clone ID: PAT_TA_49616
cgtccgcccacgcgtccggaccaaagcagctgtggccgaagctttggccaatgcaggattgtccaatgctgaattggttcagaggaccaatgcagctgtggccaaagccttggccgatgcagccaaagttgtggccaatacagctgcggccaaagcgacaaagagcatactggcacgcagggatccgggtggatgcaccatccgcctcttgagcatgacgttctacttgaaagacgatgcccccatatcagttgggcattctgttgccagtgccatggcaacatgcaagactgaaaaggccgaattcatagttctgacagagaaggaacgcctagagtgcgacgtttatgacgtggaaaactatgggacacggtttgggtcgttttttaat

SEQ ID NO: 49617 - DNA, 331 bp, Triticum aestivum
  Clone ID: PAT_TA_49617
gccacgcttgcatccacgcatacgccaccaccaactactcacatctgctgaccgcgagggaccggcggatctgccaccctggtgctttgctatcccaccatggtcctggttgcgcttggatgcatgcccgcggtgttcggcgacttgttcttccaggacaggaataccatgatgctagctacttgttagcaatgccgtgatggacctcataggcgaccatcccatgacactgctaccatacatttcaaccatggccttgctgggcggaggacataagattctactcctgacatggctacaggttgtacgtgatgtgcgctgcataccatca

SEQ ID NO: 49618 - DNA, 447 bp, Triticum aestivum
  Clone ID: PAT_TA_49618
cgcccacgcgtccgaggcaaaacaactcaatggaaatggtgaattatttacacataaatatccagggttgggagttcgacttggtgatggaagtggcttatcaacagcagttgttctcaagagcattccttcagatacaaagcatgtttttctctgtggaggcagttctaaggtagaacgtgcaatagctacagctttatgcgaaagaggtgtccaggtaatcatgaatcaaaaggagtatgacatgctcaagttgcgagtttcagagagcagtattgcctatctgaaattctccagtgatgaaacaccacagatctggataggagatatcatacatgataagcaacaaatgggggcaccaaaaggagcaacatttattcctacatcacagattccccttaaaaggatgcgcaaggattgcacttatttgagcagccttgcaatgaa

SEQ ID NO: 49619 - DNA, 425 bp, Triticum aestivum
  Clone ID: PAT_TA_49619
cccgggcaggctccagggaaggtggcggcggggcatctctcggggggtctcgccggaggatctggcgagcaggcgctccgcgcgggcatggttctggtgcttgcaggcgcggaggagggcggcacaagggcgggctcgcggcggctgcaggcagcgcgcttgcaggagggcggtgaggcgtggatctggcgcgagtgggcgtgcacggcggcgtccgtgcggcgaggctgtgcgggcaggggtcccaacggctgaaggggtggcgaggcgtgcgagcgcgcaggcttggcgcgggccgcgattcggccatgaggggcgctgtggctgcgggtgccgcacggatctggcgtcgcgtgggtgccagggtggtgctcctgccgttctggtgtggagctcgctacgggtgcggagaggcctggtttgcg

SEQ ID NO: 49620 - DNA, 446 bp, Triticum aestivum
  unsure (1)..(446): unsure at all n locations
  Clone ID: PAT_TA_49620
gaggcaggccgccgccgcggctaaacggacgcgcggcgccggcgacgtcgtgcacgactaccggtccggcgtgtttcccttctacgagaagtggaggaacgagtacggcccggtgttcacctactccgtgggcaacatggtgttcctgcacgcgagcgacccggccgtggtccgcgacgtttgcctctccgtctcgccggacgagctcggcaagagcacctacatgaaggtcacgcaccacccgctcttcggcgatggcatcctcaagtccaacggcgacgcctgggcacgccagcggaagctcatcgcccctgagttcttccccgacaagatcaagggtatggtggatctgatggtggactcggcgcgggcgctggtacggtcgtgggaggccagggtggccgagagcgnacggcgggcgttggagcttacggtcgacgacgact

SEQ ID NO: 49621 - DNA, 445 bp, Triticum aestivum
  Clone ID: PAT_TA_49621
cgtccgaatcccgggtgggcgacgcgtccacacaaagcttgcgaacctgccgccgatcataggcctatattcgagcttcgtgccgccgctggggtacgcggtgctggggagttcgcgggacctggcggtggggccggtgtcgatcgcgtcgctgatcatggggtcgatgctgcggcaggcggtgagcccgtcggcggagcccatgctgttcctgcagctggccttcacgtccaccttcttcggcggcctcgtgcaggcctcgctcggcatcctcaggctggggttcatcatcgacttcctgtccaaggcgacgctggtggggttcatggcgggcgcggccatcattctgtcgctgcatcaactcaaggcgctgctgggcaatcgtgcactttaccacccagatgggcatcggtcccgtcatgggcttcgtctttcagcacaccaa

SEQ ID NO: 49622 - DNA, 408 bp, Triticum aestivum
  Clone ID: PAT_TA_49622
gttgtatgagtggtttcttgcgtatttacgagctgtacatgtatataccgccccgccccccaggaaatacaagttccatatttgctaacaaaattaattcattggctgtggctacctatccatttaactggcgcgcacgtgatcatacaaatagacacatatatggcctctacacaagctagggaagtattggaagcttcgttcgatacacacgttcaacataaatctttgttctggttaacaagtcccctatccagtacaaaatcaaatgtatgttttacaatcttaccaatccagttttaaatctggttagtcaaatacactgtgtgattcatgccttttggaagaaaaaagggaaagtattgctcaaaaaatatatttttttaaacttggttctacatttcttat

SEQ ID NO: 49623 - DNA, 403 bp, Triticum aestivum
  Clone ID: PAT_TA_49623
ataatacaataccatggcccccaccgtgatggcttttacggctaccaccatctcactgttgggggggctcaaggccaggagccgggctgcccttcagcctcctttccaacggcagcctcttccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagaatgggtgagcttcatcttccgtgagcacaacaactctcccgggtactactacggtcgatactggacaatgtagaatctgcctatgttcgggtgcacctactccattcaggtgctca

SEQ ID NO: 49624 - DNA, 383 bp, Triticum aestivum
  Clone ID: PAT_TA_49624
gctgccgaccgcatctaggacggcctcgacctcctgctgctagctgcaggtgctggctatagcttggactggagcaggaaaattgcatcaagggcctcactaaattctcaaatgatgtcaaagcaacattttcgaggttttgtgcacacgcccaagcaagaggcttcaacatacacttccaggaatacttccttcctacgccgcccttttattgccagcaaaaagttttaccagcaacttccagggatcagggcatagtggcacacccccaagttgtccagatagagaggtggcgcacggaaggttcaagtgctgatggttggggggatggatcctgcaaaagatggaggaggaaggggttgatggggaagaaagggtggagg

SEQ ID NO: 49625 - DNA, 409 bp, Triticum aestivum
  Clone ID: PAT_TA_49625
gctagtctcaagtcattacactgaagcatacattcgtcaaccagactcttctaaacttgaaggggtgataaaggaaggggcacagagaatttgcatcgaaactcctgggcaacatgagctttatttagttaattcttgcatttcctttgggacctcgcctattgtgtttgatacacacaacccagtgttggttcacatcagtgcaaagaagtatcttgtaagaggtgaaatccatgtggacataagctcccctctggaagagatcgatttattagaagatatcggtggtgatgccttcaagagtaatgggagctctatcgacaaaatatctaccatgcctggttttgaaagagttatcaaaatggtattactggcttttggtactctacttggactgatcttgggggag

SEQ ID NO: 49626 - DNA, 366 bp, Triticum aestivum
  Clone ID: PAT_TA_49626
ggccacgtttcctgtaatccatccacggagcgggccccacccatggcgacggcagccaccaccggcgcggccgttcccgtcggccggcaccagcaccgccaccacctaggcctgcgcccatgccccaacccgcgttgcctgcaccgactgcgtctccctgccttagttgctttttcttccccatccgccccgtccacctccttctcctcgtcgctatcggccccggcgacgccgtcgacggagggaggagggaggctgttggcggatcttgtgggcgtgttcaacgagctcacgggtaggatgggagagagcctttctttttatttacgttattaccagaaaattattgcgttaaaaattttttat

SEQ ID NO: 49627 - DNA, 394 bp, Triticum aestivum
  unsure (1)..(394): unsure at all n locations
  Clone ID: PAT_TA_49627
cggaccgaccggattctctntcggcccagcggcctcatatatatttactaagatctataaagtgccttattttactttgaagtataaacgaacatgaggaatgggggataatggcctgctactagggtaataacagcaaaaatgatcaatgcaatgcaccaaagcaacattttcgaggttttgtgcacacacccaagcatgaggcttcaacatacactttcaggaatacttccttcctacggcgccctttcattgtcagctaaaagttgttaccaacaacttccaaggatcatggcattgggcctacaccctcatattgtacacatagagatgtggcgcacggaaagttcaaggcatcaaaatgggtttaaaagggatttttttaagaacttaa

SEQ ID NO: 49628 - DNA, 317 bp, Triticum aestivum
  Clone ID: PAT_TA_49628
acgcttacacagtggtgagggcgtcgcctctcatgccgcgtaaaactgggcgtaaaggtcggcctgatcgccgtcgtcaccgaagccgattcttaaccccatgccgtggtccacggccggcaacatggccgacaagagcgcccagatgactgcccagatccgtggccagcacctcagcagccaccatattatccggaagattgagagggatcttgatggcgatatgtgcgggttcaagtactggttggcgcatcacacaatggattacacaagcattatcgtgaacaataatgataactatcattctgacgcacagg

SEQ ID NO: 49629 - DNA, 391 bp, Triticum aestivum
  Clone ID: PAT_TA_49629
cactcgtacgcccacgcgtacggtctgtaccacacaccacgcctgccttatctctcggagcagcaacaggaggagcttgcaggaacaatggctgcccagggtcttctctctgggaggcagctgcttgggaggcctctgcagtcttccatctccaggtcgtcttcctcccggaagtccgccttcgtcgtcagggcatcgttcagcccccctgccaagcaaaatgacatcaggcagctgtggttcgcgtacaagcaatccctcacctacctggacggcacgctgcccggtgactttggctttaacccctatggggctgtacgacccggagggcaccgtgtgggttattgagcccaggtggctggcctacggcgagatcttaaacggccggacg

SEQ ID NO: 49630 - DNA, 250 bp, Triticum aestivum
  Clone ID: PAT_TA_49630
ttaaacattccaataaggatccgtgttaagttatagttagacaaattgttgcatgtagagtcgggaaatcttgatcatagtgattcctgtgagcccagcaatggcaaggttcttgaacttttataagctgctttctgttcctacgaaaagggggtttgcgtatgggtggacattggacttatgccagttttaaaggtctaacaagatgccttgttggttattttggagtgtactttaaggtaactttttg

SEQ ID NO: 49631 - DNA, 170 bp, Triticum aestivum
  Clone ID: PAT_TA_49631
ggcataacctaccaaatatgggtttattggtggggagcacgcctgtatctatggataattggacaatgttgagatactaagtacactgtgagattcaattcacagttatgctggatggcaaccttgcttactctagaaattcacacaggaggttttttacccaaggatag

SEQ ID NO: 49632 - DNA, 263 bp, Triticum aestivum
  Clone ID: PAT_TA_49632
acggattggttttcattgtcagattaggtatacctaatatactccccttgtactacatggaatcaggtggaggtattaaggtagagatggaagtgttctattctggacaacaggaagtcgcaagacaacgttaataggtgcattggtttagcatgttgaacgtgttgaatgggaaataattatagactttgtgagcatcagtaatataggcttacatgacctgtgttcacggtgggcattattccacaagatgcaacactttt

SEQ ID NO: 49633 - DNA, 375 bp, Triticum aestivum
  Clone ID: PAT_TA_49633
acgctaccttacacattcgaattaagagccgatctaggacaaacttatgactcagatagtacgttgagccggtatgagatgaattcgggaaaaggacaagcggttctgtttgtaggagacttgtcttacgcggatcgctaccctaaccacgacaacaatagatgggatacttggggaaggttcgttgagcgaagtggtgcttatcaaccttggatatggactgctggcaaccacgaaatcgacttcgttcctgacattggtgaaatagaaccattcaagccttttatgaatcggaatcattcgccacataaggcattaggaaggttctttttttttgtggttttacatcaaaagggccgtagtttatatttttgt

SEQ ID NO: 49634 - DNA, 110 bp, Triticum aestivum
  Clone ID: PAT_TA_49634
acgaccacacgtatgcccgtatcgaactaggtaagcggacacgccgaccccagtacgtcacaaggcaacacgcctcgagcctagttgatcatacgatctcaaacgagcat

SEQ ID NO: 49635 - DNA, 411 bp, Triticum aestivum
  Clone ID: PAT_TA_49635
acgcgccacgcgtacgcaagaagttagagacgctgtcctacttgccaccgctcaaaacggaggacctggtcatgcatgtcaactacctgatccgatgcaagtgtgtgccttgcctagagttcaatacggttgaattgatcttccgggagcacaacgaatacggtgggtactatgatggccgagactggacaatgtggaagctgcttatgttcgggtgcacggacgccacacaagctatcaacgaggtggaggaggtcaagaacgaataccatgacccgtatgtacgaattatcgaatgcgacaacatgcgcgaggtgcagtgcgatagctttatagaccttaagccaccgggctggcaggagttcgataaggtctaaacagctgacttacgacaggccatatatggagtga

SEQ ID NO: 49636 - DNA, 387 bp, Triticum aestivum
  Clone ID: PAT_TA_49636
gcgtaccccacccgtacggcagaaaaagcatagtcttgccgaggaaccaacagccatggacggatgcaacgcgcaaaagttcaagatggctaggcagaggaacctcgcgaagctgcagggcggcaaggggagccagctcgaggccaacaagagggccatgaacatgcagtgcaagatatgcatgcagactctcatccgcaccacctatgatgcacattgcaaggagcatgctgaggcgatgcatacgaagagcgacctcgcacagtgcttccaccacctcaagcagcgatatctgcccaatcagatggcgagagagacaaaagagagtgagaagctgtcataatccagctagtattatcatgttccggattgactgattgatgacct

SEQ ID NO: 49637 - DNA, 441 bp, Triticum aestivum
  Clone ID: PAT_TA_49637
acgcggacccgtgtttccggcgcgaaatgaacgccatgggcggcaccggcaccgcctacacgtagctccctgcgaggaccttctaaagcgcccgccccgttgcatggatcgacgtccggtgcctcccaagacgggcagtaggagggagcatgctgcctccctatactgtccggtcatgcgacgatagaacgctgctagcggatgcagttatcgcgtccgagaacggcgcgagcggagcgacctctgcagtcctgccggcgcgcctgctgttcgactgctacagcgtgctcggggacaccgataatgacgtgcaccgcatttccttcaaccagacgttcggccagagggaatattgtgtgaaccgagacgttgaactgtacggaaaattgcttaagataggctgtgggaatgaaaggatgacagcttattttaacaagacag

SEQ ID NO: 49638 - DNA, 387 bp, Triticum aestivum
  Clone ID: PAT_TA_49638
aaaaaaaaaaaaaaaaaaaaaaattctaagggagggggtaaaaatgaaaagaagaaaaaaaaaaataaaataaaaaaaaaatggggcggcgagttatagggagtccatacttacgaaccggggcttgcttctaaatgacctctacttttgggccccctaattctaattcattgcccttctttttacaacctgttgtctaggaaaacccgggggttctccaacttattgcctttgaaactacattccttttcccccttttggggtattacgaaaaaggccctttccattggcccttgcataatgttggggcccctaactggggattgtgcccccctctttgccggcccatttggcgcttgggacttggtggttttcgccccctttaac

SEQ ID NO: 49639 - DNA, 334 bp, Triticum aestivum
  Clone ID: PAT_TA_49639
acgattaacttggcttccgttgctggaagaacactcgattttgacctgtcattgtaccaacagatggctacagtggggcatttgatgctccatgtcttatcatcatactaagggccagttcttttcggcgatatctatgatactaagggccaggaactgaccctaatggtatgctgaagtgaggcattaccagtctagttgtgctgtcatcgtaccaacggatggctgcaaggatgcatttggagcttgcttcatctgaccaatggacgactgcagcaaggcattcaaagttgcgtgtcctctaattgtaccaacagttgatagcaacgagaca

SEQ ID NO: 49640 - DNA, 397 bp, Triticum aestivum
  Clone ID: PAT_TA_49640
acgcttgtcagatcacaactaagacacacaccacaggggcgtgaaacaccaggaggtacgacaatcggatccggttatggcacccagcagagaggcatgcgcgatcgccatgggcgcggcagcgccagtcatcggaatggcaagcaacatcagcaccgacaacgtggagaagcggcgcaagacctagtacgacatgctccagcgcaccgtctacgacgtcttcttacatgttcaccaccacggtctcggcaaggaggaggaagaggcagcagcagaggcggagataaagctgctacaaccggtctcggaggtggaggacgccaattgcgagtgctgcctcatgtgtggaggacgcacaccgcgattcatccgcggtgtgcgcggacggctctcgggg

SEQ ID NO: 49641 - DNA, 389 bp, Triticum aestivum
  Clone ID: PAT_TA_49641
cgcgtacgcgcacgcgttcgccgataccttactaggtgagttaacccaccaccaccagcgcatcggggggggacgcacggcgggcctagttgatcgtacgttcttagccgagctttgtgcaacaggcagccaagatgaagtcgagcagcggcggacatgtcaggggagacccagtgacccccaaggcgtactggatagaggggaaggcgcgcgtggacagggaccggcattcattcaagagggccgacggccatcaccttgctgtctccttgacaagtcctaggccatacacgtgttttggctacaagcacagctacaagggtcacgttgttcactgggtgagccagctgaacagaaagggtcatggcttgcgtgagcatgcgaccctg

SEQ ID NO: 49642 - DNA, 322 bp, Triticum aestivum
  Clone ID: PAT_TA_49642
acgatactctggattaccaagccaaccaacaacatggaagcacttgtataagccgcgaccactctggttccgaccatgatcggcggcctggactactcctctcacgcatattatcagcttgcatgagctttcgtcgttgacgctgtagcaaggatcacctgctctctgcattcgcacatgagggaggtcgcaaggatgtgcgccgacgcacgaaataggtgcggcatggcctgtaacaagtctgtcatgctaatctctagctcgagcgcggacgtggcgcccaataggctgacgttcgacgagatccacagcaacaactaca

SEQ ID NO: 49643 - DNA, 310 bp, Triticum aestivum
  Clone ID: PAT_TA_49643
cgactcactatagggttagcgggtcgagcccaggcgtacgcgctacccgtattcacatgcagacacactcacacacatacacatgggactttctgcttatgcaggtgcatagttatgcttacggttgatccacgtggagaagcttgataccgtctaaaggggctcaactatagaggttatctaccatgcactaggagaactagcgattcttccatctgctaaaccatggcatctcggccgatctaattgaccaggtggatcgcctgagcaaggcacactatgcaggtcggcgagtggatcagtttaggga

SEQ ID NO: 49644 - DNA, 348 bp, Triticum aestivum
  Clone ID: PAT_TA_49644
acgggtatcgtgagaatccttaattcacgagctatcgggagggacttatgtcaccacaaacagaagctaaagcaggtgctggatttaaagctgacgttaacgattataaatggacttactacaccccagagtatgaaactaaggatactgatatacaggcagcattccgagtcagtcctcagcctgatgttccgaccgaagaagcaagggctgcagtatctgccgaatcttctactggtacatggacaactgtctggactgatggacttaccagccttgatcgctacaaaggacgatgctatcacatcgagccttgtgctgaggaagacagccaatggatctgtgatg

SEQ ID NO: 49645 - DNA, 256 bp, Triticum aestivum
  Clone ID: PAT_TA_49645
ccatcatcatcagttcaccgcaagaacgaatccccgtcagccactaatcgaccagctgggcttggtgtgccgagcatggagggcgccactacgctggcgactgaactgtactgactgctcggccatggctagggagctagaggcgcgtgttgacggctaccagggtgcaccagtcgccgccagggatctctgtcccgagctggccaatctcagtcaccgtgccgtgcgccttgccggtagcgaatgttatgccttg

SEQ ID NO: 49646 - DNA, 405 bp, Triticum aestivum
  Clone ID: PAT_TA_49646
gcgtacgtgatgatttacagaagaacatatctgtgctgaccgaataattcaacgaagtccatgctgagggggacagggagattaaagtgacacaagaagagaaggatacgggtttaacccatctcacgcaggcagagtgttctatcaagaaccttgaatctgcgatagctcagttaaaggaggatctttcaattcagctagaatacaattccagctggaacatacattttgaggaatcacggaccaatctgcagggggatattctagcacttcgggacgagaaagaaacaggtctgtcagagtctcatcagtctgaagcgttcgggacgaactttgagacggagctagaaaagcaaagtcagagcatttcagctgtgcatcgagcagatgatgaatcacatcaga

SEQ ID NO: 49647 - DNA, 447 bp, Triticum aestivum
  Clone ID: PAT_TA_49647
acgcccacgcgtacgatgaggccataaccctcgggctctatcatcaaggcttactgccttactcatggggtggatccgctccgttttctgcctcctgaggaagatcattgtccgcgcacattcggcgcgcaaataccggagggggatgaggatcctgtacaaggacatcaagtcctgcgaggacgaagatgtgcacgtactgtggtccatgctgggacactcgcaccgacacccggccatggagaatctgaagctctaagacggacatggcgagggcacgcggttttctccatggagccgagggccatcatatttcgtgtggaactgcacagcttcaatggcaatgccgtgcgtgaaaagacgagcagatactgtccttgtgtgtgtgcgtgtgtgacaccggtctgatgcgtgcatcttgtgactttgaggacgaggctgagacgt

SEQ ID NO: 49648 - DNA, 461 bp, Triticum aestivum
  Clone ID: PAT_TA_49648
cgactcactacagggttagcgggtcgccccaggcgtacgcatcgctgatcaccaggacagacgcacatgcaccgttgctagcaaggtcgaccaagcagcaccgagatggctgttgccttgtcctccaccgtcggcgcccatgcttgtacgccgaccatcttcctcgggaagaagctcaagaagcaggtgaccttggccgtgaactaccatggcaagagctccgaggccaacaggttcacagtcatggcagcggtaaacatcgacgagaagaggaacacagacaagtggaagggtcttgcctacgatatctacgaccaccagcaggacatcaccagagggtagggcatagtggactccctctttcaggcgccgacaggcgacggtacacacgatgtcgtactcagctactacgagtacgtcagacagggactcaagaagttcgacttcgacagcaccatggg

SEQ ID NO: 49649 - DNA, 392 bp, Triticum aestivum
  Clone ID: PAT_TA_49649
tccaggtgttctgcctcctcttgtgactttatcagagcgcgggctccggtgcaggtgggcactccatgacaacttcatgcgcctgcctcagtctgcaacggcgtgaccaacttctgcctgcccacgtttccaagctacgccgggctgctcaactcctacatcttcaacctacggttcaatcttcagagcgtccatgggcctgccgccgttgtactgccggagtcgagggatgaactgaggcgagccatcctgggcgcgcgcgccagatctgtggcgatccatgtgcgcagcgggcggcacagctacgaggggctgttctacaccactgagaaccacgtgccaggggcggtgatcgacctctggaaaccaaaccccgtgcgggtcgagccagg

SEQ ID NO: 49650 - DNA, 189 bp, Triticum aestivum
  Clone ID: PAT_TA_49650
cgacgtaccgtgcactgagagtgagtgagctcccacacactcccgcgaacttagcggagctaccttgggcaagggaggaaggatggatccgtgctagttccgtccggttagcatctttttcacctagactactactaccatctcctggcagcctgtttggaacgacaactaggctctcatcgtctgccc

SEQ ID NO: 49651 - DNA, 527 bp, Triticum aestivum
  Clone ID: PAT_TA_49651
acgtactcactccaggattagctggtcgccccacgcgtacgcgaaggcggatagagagagagagagagacagagagagagggagagcgagatagggaaatcgtgactgaccaccggagagagagaagaagaagaggctgccaacgtccacggcgggaaagaagaagaggcattggcgtgcgggtggggcatcaacggaaacaagggccggtgctacgacttgtgtctggactatcactggtgcatgatccgatgcctgcatcccttcgactgcgggctcctgccggtggactacctcgtgtgcctgcaccactccaaggaggtactacgcagggtcaggatctacatggaggggcaacctcagataagacgctgctgctcgcagggccacggcagaagccgaaggatcttcttctgttgcacctcaccactagcatacgttctcaattttttgttatgcttctgtttgctgcaagtgctttcatgttcagctatgagcaaggcaataattacctaaacattctaccc

SEQ ID NO: 49652 - DNA, 476 bp, Triticum aestivum
  Clone ID: PAT_TA_49652
acgcgccgcgatggcttcgtcggctaccacccgtgcacccttccaggggctcaagtccacggacggtctgaccgtcagacggcgttacagcgacagcctctgtagcgtcagcaatggcgtaaggatcaggtgcatgcaggtgtggccgattgagggcatcaagaagcttgagaccctgtcttacttgccacccctatacacggaggcccttctgaagcatgtcgactacctgatccgatgcaagtgggtgccctgcctacagctcagcacggttgacttcgtctttcttgagcacatcaactacggcgggttctacgactgccgatactggacaatgcggaagctgcctatgttggggtgcaccgacaccacgcaagttctcaacgtggtggaggaggtcaagaaggagtaccctgaccgctatgtacgaggtatcggattagacaacctgcgccaggtgcagtgcgttagcttta

SEQ ID NO: 49653 - DNA, 206 bp, Triticum aestivum
  Clone ID: PAT_TA_49653
acggtctgcatcatttatcttgaacaaattgaaggagcaatctaggatacagtgttctcagggacgaaatcagggtaaatccattaacagatctactacaaataacgtatgcaacagatgcctgtgagatgatagggaggtggaaattgtatcgcatgatgaatgagactaaatgatgcttcagtcaatgtactatatgatgtttt

SEQ ID NO: 49654 - DNA, 270 bp, Triticum aestivum
  Clone ID: PAT_TA_49654
acggcacccgtacttccgcgggtacgcacgcattctctctcacgtacagcttgtgaaagagagggggagattcatggcgaccgaccgtgaggacagcaactccctcctggcggacgactcgatcgtggagtacgtgcttcagacggcgctataccctcgtgagcacaagctcctggacgagctcctcctcatcacgccgcagctctccgagcgaccaatggcatctgactcggaacacatccaagtgttctacggcctgctcgtggtgat

SEQ ID NO: 49655 - DNA, 310 bp, Triticum aestivum
  Clone ID: PAT_TA_49655
acggtgcgagcggcttccgaggaccccaaaccctatccttcaggcggcccgatctgactcccccgggcgttgtcgatgccggcgcctgtggttgcggccacccccgacgagtgatggacgcgctccctgacgtgcactttagcacggaggcgggtcgtccctggcgaggcctttgtggcgggtgtccgtcggcacgagtctggcttggcttctgcggcgcacggcggacatctgtgaggagaggtgggctttggtgaggctggcaccacgacaatagatcaggtctgctcagtaacgcaacttggaggca

SEQ ID NO: 49656 - DNA, 412 bp, Triticum aestivum
  Clone ID: PAT_TA_49656
ggcgtacgccacccgtacggatctggccgagaaatcttctgcgatcgaagcgaaaccaaggctctatagggcccctgctcaagatgcagatctttgtgaataccctcaccggcaagaccataacccttgaggtcgagtcctacgacaccatcgacaacgttaagggtaaaatccaggacaaggagggcatccgtccagaccagcatcgcttgatctgcggtggcaagcagctagaggatggccgcaccctggcatactacaacattcagaaggagtccacccttcacctggtgctcaagctccagggtggcatgcatatatttgtgaagacacttaccgggaagaccatcactcctggaggttgagtcctcggacaccatcgacaacgttaagggtaagatccatgacaagg

SEQ ID NO: 49657 - DNA, 471 bp, Triticum aestivum
  Clone ID: PAT_TA_49657
ctagcacgactcgctacagggttagcgggtcgccccaggcgtacgcgcatgggtagtcgactctggacgcctgccttgcgtgcttgtctcgctggccgtcgcgcggagggcgcatcctcgtctccctggcctaaaccctaaggccgccgctctgcttcgtccctcatactcctagacgccgacgccctccttgcccgtcttcctccgcctcttctactccttattcgcaggcgattccaggatggtggtcgtcggctcgggggactacttcgaggacatccacgccaaggtgcaaggggagaagctccgccacgcattctactacacagggggctgatgcgggccgcgtctggcgatggcacctgtgatcgagaagatcagcacgcacgaccccaagagaccagtctacaaggtggacatcgacatggagggacctgggaccagacgttagaacctggaaatatggtctgg

SEQ ID NO: 49658 - DNA, 395 bp, Triticum aestivum
  Clone ID: PAT_TA_49658
tacgactcactacaggattagcggtcgagccaggcgtaccgtaaaaccctagccacgacgctctacgcttccgacttaaactctacgctccaagacttactggggcgcattgtgaccgccggtctctgtcggtaccacacggagtaccaccagaggagagggctagggcgccctacctgaaccggcaaccatagggttatgtgtgcttaacgccacgcggacggatcacgaggacctcgatcggttgcagccccccggggcacgagaacttcaagcggaccgagcgaaatgcggtgaccgagttttacagtgacaccgcgtacgtcacatgctggatctcgtagtctccacgtgcgacaagcttgcggaaatttatgaagacaacgaccgtgctg

SEQ ID NO: 49659 - DNA, 120 bp, Triticum aestivum
  Clone ID: PAT_TA_49659
acgcggagaattcttaattcaagagccatagcgagggacttatgtcaccacatacagaaactaaggggaggtgctgaatttaaagctggcgttaacgattataaattgacttactacacc

SEQ ID NO: 49660 - DNA, 325 bp, Triticum aestivum
  Clone ID: PAT_TA_49660
acgctctaagagtggcgaggggtgacccactcgtagccagtcaatgatgggagagactggaaccagtgtatcagactaccatgccatagacaatcaccaacttaccaagatggcctaccactactatgcatacggtgcggaagacgagcggaccctactggagatcagggaggcatgactaaggatcctgtttggagctcacgtactgatcgtcgtgtataccatcgacatgaccacatctgttctgcgaatgaacatatccatgcacatcatgatttccgcgaccgactttcaaaatacggatcacgctgtaggagagtgcgca

SEQ ID NO: 49661 - DNA, 288 bp, Triticum aestivum
  Clone ID: PAT_TA_49661
actcactatagggttagcgggtcgccccaggcgtgcgcatccatatctatcggcgtcgagaatcgcctagaaatccatgagagccagtggctagcattggcgtggggggggttcgagagcggcgtggcggctcgtcgcgcctgcgtcttcgacggcggggaggacgagcctctccccgcagcggacgcggctggcggtgccgccttcgaccaggggctcgccggcttcggcctacaaggagaacagcatgctcgacttcattcgcagtgccatcgtcaaggacgagca

SEQ ID NO: 49662 - DNA, 167 bp, Triticum aestivum
  Clone ID: PAT_TA_49662
ccacgcgtacgcccacgcgtacgtacacggccgacagctcttacaactgcgaactctggcgcgcacctcggtggttagaaacatgaattagatattgcacctctatacatacgaagaaagcgtaaccctcctgctaaaatacatacgaagaaagcgtatacctcctg

SEQ ID NO: 49663 - DNA, 377 bp, Triticum aestivum
  Clone ID: PAT_TA_49663
tcgccaggcgtgcgagtccgagcggcaggttcctcccttcccgttcgtactctgtgctactgcttcccctttctaggtcagtgacgcgtcctacttcttgtcttcctttccccttccccctcccgtcgtcgtcgtcttcctccgccgttgctggttcagctactaaccgctgccggggggaggagaaaggccgcctcttgcccggccacctttcgggtggttcagcccacgcgggagccgcatcgagagatggagtcagccgacgccggcggcctgttcagcatgcgagccgtgcttgccatgctgcagtggtggggcttcaacgtcaccggcattatcatcaacaagtggatcttacagaagctggattttaagtt

SEQ ID NO: 49664 - DNA, 423 bp, Triticum aestivum
  Clone ID: PAT_TA_49664
cccacgcgtacgacccgctatactatcatggctgctcacgccgctgtcctgctatcccttcttgtgttgaccacctgctcggcggacacgcaccttcactttttcctccacgacgtggtctacggaagtaacctgactgctgcgcaagtcatcaagggtcctgcctcgtactgcaacgccctccatgacgtggccttcgtcgacacgaccgtcattgacgacgcgctgactgagtcctagtacccgacttcagcacccgctgagcgcgcgcaggggttctacatgatgtcctctcaggcgcgcatagtgctgatgatgtgcgtgaacctgctgctcaccacggctgactacaacggcagcacgctggccgtcatcgggcgcgtacacgtgatgaccactacgcgggatctctccgtagtaggc

SEQ ID NO: 49665 - DNA, 420 bp, Triticum aestivum
  Clone ID: PAT_TA_49665
ggtcggccaggcgtaccccacccgtacgattgcgtgtggccacccatcgaaccctacccgagattagactaccataccgaatctagcgtaggaggactaggactaccccgaccagattctgaggggtgcacgaaggaggctctcgtcttatctctcctggcgccccgtggcgaccgtcgtatccagtgtcccggtcgccggcgccggccgccctgggagagaccacgaccaccgttccgcctaccagcggcggatacccatacagtccctcttcttaaccgccgcgagaggcttttctttggctgaaacacttggtccacggaaccaagatgctgggtgggacgaacgtccaaccactgctgcttgactgaataaccccaactcaaaaatcctttatgaccaggacaaccatgaaagata

SEQ ID NO: 49666 - DNA, 413 bp, Triticum aestivum
  Clone ID: PAT_TA_49666
cacgtcctgcagcccaactggatgctggacccccacagcctgtgcggcgagaagggcggggacctgccagacagtgtgcggccagtcgggctgctcctcatggcctacggcgacatgcatgagcacactggcgatttcttcagggtgctcaggcagaaccacaagtacatggtgctcatgtgcaccgacctgtcacggtcgcgcaccactgacggggtctacaatccgacgtacggggccttcgtggacatggacatcgacgcgcaccgggggatcatttgacttagaacgctaggtgaacactcggtggttgagagctatagcggtggtggccaagcgtgcattacagagagggtgtacccggaccacgtcttgaacggcaacaaggacctgttcgtgctcaacaacggaac

SEQ ID NO: 49667 - DNA, 344 bp, Triticum aestivum
  Clone ID: PAT_TA_49667
ccctgctattgtgagaattcttaattcacgagctatagggagggacttatgtcaccacaaacagagactaaagcaggtgttggatttaaagctggcgttaaagattataaatggacttactacacccgagagtatgaaactaaggatgctgatatataggcagcattccgagtctgtccttaccctggggttccgaccgaagaagcaggggctgcagtctctgccgaatcttctactggcacatggacaactgtttggactgatggactcaccagcctggaccgctacaaaggacgatgctatcacatcgagcctgttgctggggaagacaggcaatggatctg

SEQ ID NO: 49668 - DNA, 448 bp, Triticum aestivum
  Clone ID: PAT_TA_49668
acgggcgacggctcacctgagcccggcgctggctgtctcatagtggtgccacccaacctgcaatcacggtcagacgcccgtgttggcgcacccagacagaacagcggtgctgcggttttgctcacttaccttgtactcgagactcgccgcgtcggttcgtggcgtgtggctgctcactgcggcagtggagcccaggaccgcgcagcatgaagaggccgaggccgacgactactggacgctggtactaggcctcggccgaaccgtcggcgtaggtcattcgctggtagcatctttgctgagcaggaaaattaagactgggctgatcataagaaaccctaaaaagacttatatggatgaacagaagaatacttatttatactgatgctgaagacatgcataattgttcgaccatctatgtatgcataaatgcataaatgaaaaaacatgg

SEQ ID NO: 49669 - DNA, 377 bp, Triticum aestivum
  Clone ID: PAT_TA_49669
cgactcactatagggttagcgtggtcgccccacgcgtccggtcatggtcttgggcgagatcaccaccacggccaccgatgactatgagaagatcgtgcgcgacagctgccgcaacatctgtttcatctgtgatgacctcggtctcgaccccgaccgttgcatggtgctacgtaacattgaacaccaatcccctgacattgcccatggtgttcacggacacttcaccaagcgttctgaagagggtggagccggtgtccagggcatgatgttcagatatgccacccacgagacccctgatcttgtgcccctcagccacctgcttgacaccaagcttggagctcgtctcaccgatgctcgcaagaatggcacctgctcct

SEQ ID NO: 49670 - DNA, 303 bp, Triticum aestivum
  Clone ID: PAT_TA_49670
ctcagtacagggttagcggtcgaccaggcgtacgcgtccctatattctaggttgtgacggacgcgtcctccttagctgcgtgtccttgcaacggcagggtgcgtccgtcgcgccgcggcaggccatgtacctcttgtgcgtctgcgctgcgtcgcataccagggtggttgtggagcagatgtactccgtgggggacgtttgcggcagctacgatggctgctgccggctgaccaaggaagctgttgccaccgtagtcaaatttctctgcttacctggggtctactccttcatagtatccatggt

SEQ ID NO: 49671 - DNA, 223 bp, Triticum aestivum
  Clone ID: PAT_TA_49671
catcggtggcagcctcgggagcccggtgctctacaactgctgctagtttcggcacaagctcatcatgaacaccctcgtccaggccgcccaacgtgaacccggattgatggacgccggcctggagcgcctcaagaccgggttcgggaagttcaagaccgaggcctacgaccagaagcccgatttcttagagccccttaagggccgacaggcgcccaagttcatg

SEQ ID NO: 49672 - DNA, 419 bp, Triticum aestivum
  Clone ID: PAT_TA_49672
acgaccttctgtactccaacaccatggcccgcactgtgatggctttcttggacaactatcgtcgcacactgtgagggtttcaagtggaccgtcggcctgaccgttagacggcgttacatcagccccggccttagcagcgtgagcaacggcggaaggatcaggtgcatgcaggtgtggccgattgagggcatcaagaagctcgagactgtgtcttacttgccacctctatacacggaggcccttctgaagcaggtcgactacttgatccgatgcaagtgggtgccctgcctacagctcagcaaggttgacttggttgtccgggagcacaacaactacggcgggttctacgatggtcgagtccggacaatgtggaagctgcctatgttcgggtgcaccgacactgcacaagtgctcaacga

SEQ ID NO: 49673 - DNA, 428 bp, Triticum aestivum
  Clone ID: PAT_TA_49673
gcacgactcactacagggttcgcgggtcgccccaggcgtacgcgattcttaattcaagagtcatcgggagggacttatgtcaccacaaacagaaactaaagcaggggctggagttaacgctggcggtaacgattataaatggacttactacaccccagagtatgaaactaaggatgctgatctccaggcagcattccgagtctgtccttagcctggggttccgcccgaagaagcaggggctgcagtcgctggcgaatcttctactggcacatggacaactgtctggactgatggactctaccagcctggaccgctacaaaggacgatgctctcacatcgagcctgttgctggagaagacagccaatggatctgtgatggaggctatccatgacacccattggaagagggttgcgctcttacatgttta

SEQ ID NO: 49674 - DNA, 335 bp, Triticum aestivum
  Clone ID: PAT_TA_49674
ctgtcacatacacacacacaagcgctagctagctaatcgatcagccagccatggcgtgcgagaagcaccggcaccacctgttccaccacaagaaggagggccaggacttacaggccgccgctgacggaggagtccacatgcacggatactcgacctagacggtggtgacccacacccggatccagggccagtacgagcggatcaccaaggtggagaagcaccacatgcacacggagcacctcggcgagatgggcgcacacgcccacggagcccttcgcctagtacgctctctctcatcataactagtggagtcgtaatcaccatacgcatatata

SEQ ID NO: 49675 - DNA, 169 bp, Triticum aestivum
  Clone ID: PAT_TA_49675
ctcgtgaaacaatcaagagtcacacatgccctatgcactgtttatcacaatccagagccaaacatgagcggcgtgaagaacgtaaccgacgttgctgccaaggccggtaaggcaatcgactgacacggcctgcccaagatgctcgtctacgacgaggcccggaaggagt

SEQ ID NO: 49676 - DNA, 388 bp, Triticum aestivum
  Clone ID: PAT_TA_49676
ggctcctcgggaacgcctctgcatcaaatccatcggacacaacccaaccaccatgcgtcggacggacatcacctagtcttctatcgccatccatctccaccatccttgatccattggttgaatccaccattggaggcaccagactaatcaccattcctactctgacataccctcaacgtgaagctggtgagataccagtcttacaggctgagcccatgaatatagaatcaggtgtcatagggggagacagcgaatataatgaaacataagcggaagaaaatgaaccagaagaagtagtcgttcgccctaggaggaagatgacatctactgttcggaaggactataagaaagtaaacatgatctacagagtgagagcctaaggtaactg

SEQ ID NO: 49677 - DNA, 407 bp, Triticum aestivum
  Clone ID: PAT_TA_49677
gactcactacaggataagcgggtcgagcccaggcgtacgcagtccggaattaccggagctgcccacacgtgcgatggaacgggaggagctatctaccgagagggtgaaccgtggcgtggaagcgacggacccagacgctgaatcgctcgaccttatccgtagcgcgtgcgccgccggctgccggactttctggaatcagggaacctaaagtacgtgcggctgggagaccactacgtgctgaaacacggtatgtacatggcacacaatccctagtaacgagctgctatgcagagcctacgagcgcagtcatagacgtgacatgctgcagcgacatggcgtaggacgagacgacctacgagctgtgaaacggaattggcatactagacatactagctttgaacataaca

SEQ ID NO: 49678 - DNA, 233 bp, Triticum aestivum
  Clone ID: PAT_TA_49678
gggcttgcgtcaccacaaacagagactaatgctgggggtgggggtaaagctgacgttaaggagtataaatcgtctaactacaccccaaattatgaatcttaggatgctgttatgcaggcatcatttcaagtatgtgctgactctggtgtacctacctatgaatcttgggcatgctgcctctgttctaatctacaactggtacatgtacaactgtctaggactgtcggattcac

SEQ ID NO: 49679 - DNA, 499 bp, Triticum aestivum
  Clone ID: PAT_TA_49679
cgtccggaaaacaccgggaagctctggaatcagactatgtatctgagaatctgcatcattggattgatcttatttttggatataagcagagaggaaaggcagctgaagatgccgtcaatgttttctatcactacacatatgaaggcaatgttgacatagatgcagtatcagatcctaccatgaaggcttcgatactggcacagatcaatcactttggccagacccccaaacagttattccaaaaagcccatccacagcggcggactgacaggaaaattcctcctcatcctctacggtacagcacctatctcacacaccaagagatccgcaagacagcatcgtcagtgtcccagatcgtgacctacaatgacaagatcctaattgccgcatcaaacagcttgctcaagccagttgcttacagtgagtacatctcatggggatttcctgaccgcagcttgagaatattgacatatgatcaggatagacttcaatcaacaca

SEQ ID NO: 49680 - DNA, 191 bp, Triticum aestivum
  Clone ID: PAT_TA_49680
cgtccgcggacgcgtgggtcggcctgttcatactactaaaatatgccgtggcgcggggtgtttagaggggggggggggttttttactcctgccgctgttccccacaaacttctattgaaccagtgccagctgtcacgcctgtctcctagtggtggtggaggcggtcgaatatggactgctctagttgtggt

SEQ ID NO: 49681 - DNA, 431 bp, Triticum aestivum
  Clone ID: PAT_TA_49681
cgtccgcggacgcgtgggcgcgcctcctccccgactcccgctccgcctccgcctccgcctcctggacctgttccctctcgagcgacctcgcaactgccgccgccaccgctgccaccgcaacctcctcctccgcgatgccgctcacggccccattccccggactcggcgtgccgctctccgacgccgacctccgcaccaccgcctacgaggtcctcgtcgccgcctcccgcgccaccggcggcaggcccctcatctacatcccccagtccgccccctcctccgccagcgcccgttccacctcctccacatccacctcgacctcctcctcgtcgtcgtcctccggcctgcagcgttcgcggacgtcgacggcggccagcaaggtgaagaggtcgctcgggctcagccccttcggcgtcatctaaggccgggac

SEQ ID NO: 49682 - DNA, 289 bp, Triticum aestivum
  Clone ID: PAT_TA_49682
cgtccgcggacgcgtgggcggcggcgtcgtgggtggaacccgctccaggcattcttccaccgaagaatcgggacgatttcttttctagttttccgcgtctagatttggcgtcgggagaggaaattcgatctgaaaatggggttgttccgggccgcgtcgggcttagcccgggtggcgctgcggaggagcctgtcgcgcgctccggcgagcccgttcgccggccccgcgccgcggtacttccactcgacgctcccccggcggtacgcggcgcctgagccccgcgccgtgc

SEQ ID NO: 49683 - DNA, 334 bp, Triticum aestivum
  Clone ID: PAT_TA_49683
cgtccgcggacgcgtgggtgtgtttcgttagcgcatgcatcatttgctctgttttcgagtcgaaccactagtcgcgactagtcgacgtcggcgagtcggtaaatgaaggtcgactcaacctgtcgactcgaatcattggatgagtcaagcgactcgatcgactagttgcggtttttgagtcgagcgactcgatcaatctgtcatggaagaggtgctggcaaaggaaaccgagcctgcaacgaggggtggttctatggaaggagggccgaggcggcgacggcgcgctgtcgctcaccacccctgatgaccgtgccgctccgaggtatttgacgct

SEQ ID NO: 49684 - DNA, 391 bp, Triticum aestivum
  Clone ID: PAT_TA_49684
cgtccgattccggtcgaccacgcgtccgatcattacatccccaaagtaataaaccaaagtgggactggctttcttcttcccaaataactcttgtttgggcgcataggatatcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatcccccatgctggtgatcttg

SEQ ID NO: 49685 - DNA, 337 bp, Triticum aestivum
  Clone ID: PAT_TA_49685
cgtccgccgcccccctccaatccaatccccaaccccaaccccaacccgacgagcgccaccgccgcaggacgagtcggaggccgccgccccgccctgttccgctcgggagctcgccggagtagcagcgcctcgccggttctcggggtcttagaacggagccggaacaagcgcgacccatggcgaccaggcacaaccagcagaacgcggctgccgctccgcagccggcggccaacagaggtgccgcagggaagcagaagggcgccgccgccggccgccccgctcccggaggaaacaggcgggcgctcggggacatcggcaacgtcgtccacgcccacgt

SEQ ID NO: 49686 - DNA, 418 bp, Triticum aestivum
  Clone ID: PAT_TA_49686
cgtccgtttagagatttcaatacgaactacatacagatgtatatagacttcttttatagtgtagattcactcattttactctgtatttagtccatattggaatctctaaaaaggcttatatttaggaacggagggagtaattatcaaaatccctggtgggtaagaaggttttaagtcgtttaacttggttccagtttgactagttgttcatctgttgttgcacagttgcttttccttgttagatactcccttcgtcccaaaataagtgtcttaaccttagtacaattttgtactactaaagttataacaaagttgagacacttattttggtacggagggagtatcacatactgtacattaatgttgtcctggaaaatgattatgcatgtgctttttaatttttttattattgctgcac

SEQ ID NO: 49687 - DNA, 431 bp, Triticum aestivum
  Clone ID: PAT_TA_49687
cgtccgcggacgcgtgggtcacaatcaactatgctctctggtgaggagacttttgctatagcagttcaagatccactgcttgcttcatatggaatagttgaaccgattggggaggagtcaatgaatgctgatttgtcaatgaacatgggaagccttgtgccaggaagtaatcagaagttgtccataagaagggcacaagttaagaattctgaataccttgatcaagctggaacatcagtgaatgggtattatgttcagaaccaaactccaggggatgcaaacattaatttcagtcatatgaatgaattttccatgtcagaggctgatggtgtggacgcttcggagctatttgggttgggattttacccaaagaaacggatatgctgttggtcctgatcagggcactaatttccagtggaatgacacctagc

SEQ ID NO: 49688 - DNA, 404 bp, Triticum aestivum
  Clone ID: PAT_TA_49688
cgtccggaaaagacccggcaatctgtactacaagtgtatcctttgcagttctgggcaatgctccatgaacgtgagggtggccctttgtacgaagcaggtgcttaccgagtagaagaggtggagaagaatgtgatgtacagagcaacgcacactcgagcggagcgcaggctcgttgacctgtcccgcagcggccgagacagccacatcgtcgtcttcgtgaccgggacaccagcccatgctgaggtgcggtacgcgatgtcgatgcagtgtagagaaagaccagagcaggactcctgactgttgcttcacggttcgcttgttgttgccttggccatgtgaatcccaattttcttgcaataagataggggttctggaaaacccagtagttcttctatttctgctag

SEQ ID NO: 49689 - DNA, 396 bp, Triticum aestivum
  Clone ID: PAT_TA_49689
cgtccgcggacgcgtgggaaattccccaccttcttccagcactcacgagtcacagcccaccagcgaagcccccaaccccgatcagcctcagcagcgatggcccccaaggcggagaagaagccggcggcgaagaagcccgcggaggaggagccgacgacggagaaggccgagaaggccccggcggcgaagaagcccaaggccgagaagcggctgccggcgggcaagaccgcctccaaggagggcggcgagaagaggggccgcaagatgggcaagaagagcgtcgagacctacaagatatacatcttcaaggttctcaagcaggtccaccccgacatcggcatctccttcaagccatgtcatcatgaactcttcataacgacatttcgagaagctcgc

SEQ ID NO: 49690 - DNA, 257 bp, Triticum aestivum
  Clone ID: PAT_TA_49690
aggcacgacgctcacgcttcactgtgacgcgtaacctgaacaagaaagattacagacctatagtacaatatgctcaagagttgcagccgagataaaaaccgatataaacctacatggagtaaaggtgacttgaccggcatatcgaggacggaagaaaccaaaggcccgagcttatccaaagagaggaataccttgaggactactgcatgatggatatttcaaaggcactgcgaatccacaaaggaggggggaaccgg

SEQ ID NO: 49691 - DNA, 225 bp, Triticum aestivum
  Clone ID: PAT_TA_49691
cgtccgacgaccaccatctttacaggctgatgtccttcctgagcatcgctcacaggggcatgctccttatgatctacccgactctgctgcccgagtacgccaacaaggccgcctataaggccgtgaagaccgtcaccaagtcaggcagtaaggccaccaattgccgacagaaggccaccgccgcgtagatctgactacttgcgcccgtgccgaggatactgcact

SEQ ID NO: 49692 - DNA, 301 bp, Triticum aestivum
  Clone ID: PAT_TA_49692
cgttcgttgtctcgtgttctgaacaagaaagattacagacctgttatacaaaatgctcaagagttgaagcgagtcatatatctatataaacctacatggacaaaaggttactcgaccggaatatcgagaacggaagaaatcaaagccacagcttatccaaagagagatatactgtgagcactcctgcatgatgcatattccaaaggcactgcaaatccaccaagaacgacagaacagattgttgccctagcaggcgaagcaagcactagggcccaggcttcaccaaccgttcggacacctg

SEQ ID NO: 49693 - DNA, 166 bp, Triticum aestivum
  unsure (1)..(166): unsure at all n locations
  Clone ID: PAT_TA_49693
cgtccgggacggcgtggtgaacgcgcggtcgcgggtgctgggcggcgggagctgcctcaacgccgggttgtacacgcgggccagcaacgagtacgtgcgcacggccgggtgggacgccttccttgttaactcttngttccggtgggtggagtgcttctctggtgtt

SEQ ID NO: 49694 - DNA, 375 bp, Triticum aestivum
  Clone ID: PAT_TA_49694
cgtccgcccacgcgtccgctcaaacgcacgcagagggagaggcgaaatcgatgccatggtgatccggctgcgttgtcttctctgcttcgcttgacttcgcgccactcctcatcttcctcgtgtggatctgcgaaccctgtgtacccctcctcatcctccatccatggttggttttgatttgttaatgctataagagagacatacattgaggaacttagcttcatcatgttcgaggcaggggagagagatctgtctaaatcatacttagtatgtggtgattgcaaagttggggctgtttacctgtgtttagtcatcttcagcagagtggatcatcttcaggtttctgtcccagatcatggaggaatcgccctcttg

SEQ ID NO: 49695 - DNA, 469 bp, Triticum aestivum
  unsure (1)..(469): unsure at all n locations
  Clone ID: PAT_TA_49695
cgtccgcgcacgcgcgcgccctccgcccggaaggccgtagacctcgccttccgtagaggtgccccccgggcctctaggaataacccctcgccgggatcgggggagccgccgccgcgtcttcatcccatccagacacagnctcctaggccactcgctcagcgctcgagagcccagatcccccgctatatagagtccccgtcgacccttcgccgccgcgcaggccatggatttcatgaaggccttcgatcagaccgtaagggagataaagagggaggtcaatctcaaggtgctcaaggtccccgagctcgaacagaaggtccttgacgcgacaagtgatgaaccttggggtccacacgggtctgctctttcagagctagctcaggccaccaagaaatactctgagtgtcagatggtgatgggtgtcctctgggccaggctgggtgagcgagatgcaaactggcgtcatgtg

SEQ ID NO: 49696 - DNA, 377 bp, Triticum aestivum
  Clone ID: PAT_TA_49696
cgtccgcccacgcgtccgcccacgcgtccgcccacgcgtccgccaaccctagcctccgaggtcgagtctccggcgacccttcggcagcaccgcgagcctctcctggagctgtcccgctgcaaatcggaagcgcgagcgttgaggaggaggaggtgttggtcggcgatttactgattttgggaagcgggggaggatggggtcgtcgtccaaggtggtgcggccggaggaggtgctggagtcgctgaagaacgacggcaccgtcgacgcgctccgcatgaagatcatcgcccagctcaaggccgacgaggacatgaagaaaaatactatgatgatggtggagcaaaagaaagttctgaagactcctggagctgagaaaa

SEQ ID NO: 49697 - DNA, 440 bp, Triticum aestivum
  Clone ID: PAT_TA_49697
cgtccgatcgcaggcagcgggtgggggcagtccgctcgctttcttccccgttctcgtcgcctggacttccgacgccgcctctgttttgccatctgtcctccgtcgcccccctctgtcctataaatccaccaccaccaaacagcctgttctccacgcgatccatcccatcctgaaaaccccagcgcacggcaacgcctctccaaaaccccaaaccctagcccatcggcgatcgccggcggcgaccgcgccttcgtcctccgcggagccatcgggcgcttcgccgtgcatcggcttcgtctccttgggcggctggcgtaggagggttcggaggcgctccgccgctgggtaagcttgcgacgggccgcggttgtccagatcctcgctgcgaattcctcgcgctggttttgcattgaggaggatgtcgtcttcaaacattttcg

SEQ ID NO: 49698 - DNA, 404 bp, Triticum aestivum
  Clone ID: PAT_TA_49698
cgtccgcttgtggaagcggagcatgccggaacctgaaccaaagccaaggtaatggttaggcaggggcagagggaggtgatgggcagggtggatccatagatgggttgtggaagggggcacggccatactggtgtaaggaatcagttggtggctggaggcgtgaaggcggtcaaggcggcagagatctgcgcctggtgatggtagagctgttgttagtaggtgggcgacaaaattggggcgggatttggggtaggatttgagttgtaaggtgagggtgcgaagtggcccaaattgatgttaggaggcagctggtgagtaaggagatggctggaggtggtaaaaggggaatggttgctggtggtggttagcaggagttagcacagggttgtgttgcgacagcaagc

SEQ ID NO: 49699 - DNA, 331 bp, Triticum aestivum
  Clone ID: PAT_TA_49699
cgtccgccgacgcgtgcgccgacgcgtgcgcccacgcgtgcgcccaaatcttctcaaccttcccggggcagtgttcgacgacatggcccgcaccatgcagacggacaggaagtccagcggcggcaaggctccgatgtagcaatttgacagcaaaggccgcccgcatgtccgccccgcccaccggcggggtaaagatgccgcaccgatttcgaccaggcaccgttgcgcttggtgagatccgcctgtgccagaagagcaccgagctgctcatccgaaagctccccttacagagcctcgtacgcgagatcgatcaggacttttagaccgacct

SEQ ID NO: 49700 - DNA, 210 bp, Triticum aestivum
  unsure (1)..(210): unsure at all n locations
  Clone ID: PAT_TA_49700
cgtccgctcgccgccaccgacaccgacaccaatgttctcgttaaggacgagccctccggcgggccgagcgggcnagtcgcgctgttgctccactccagggacttcctcccggaggagcaggggcggcacgagagctaccggtcgctggtgctggcccgtctgcgccgcgactcggtccgggccgtcgcgctgtcggcgcgcgcgttcttg

SEQ ID NO: 49701 - DNA, 377 bp, Triticum aestivum
  unsure (1)..(377): unsure at all n locations
  Clone ID: PAT_TA_49701
cgtccgcccacgcgtccgcggacgcgtgggcgtccccgcggtggtgttctccgtcgccgggtacacggacaactggttccacgacaacacggacgcgctgatcccgttgttcctcacgacggcgcacctgaaaggcgaggtgcagctgctgatcaccaactacaagccgtggtgggtgcagaagtacacgccgttgctgcgcaagctctccaactacgacgtgatcaacttcgacgccgacgccgacgtgcactgcttctcccgcgggtacctcggcctgtaccgcgaccgcgacctcatcatcgcccctcacccgacccgcaacccgcgcaactacaccatggtggactacatcgcgcttcttcgagccgngtacg

SEQ ID NO: 49702 - DNA, 304 bp, Triticum aestivum
  Clone ID: PAT_TA_49702
cgtccgccgaccgatcggtctgaccccaaacccctccgccgccgcccgcctccccatggccggccggcgctgtccgcacgtcatgagcctccacgactccggcccgccgctgctcggccgcgcgccgcagcacccgcagcccggcgacgaccgcgacgagcccccgcacggcgccctcctccaccacccgcgcgggggccccgcgcagcaccccgtcgtggcggtcctcgaggaccgcatcgtcgcccgggaccgggacatccatgagttccttgttaactaccagcgtgacgccgtcacccac

SEQ ID NO: 49703 - DNA, 210 bp, Triticum aestivum
  unsure (1)..(210): unsure at all n locations
  Clone ID: PAT_TA_49703
cgtccgctgccgccaccagtccactgcatctcccacctcgggatcctcccattccccaccgggccaatcactagcctcacccgcccccgatccaaaattctatcggcctcctctttcctcaatcctcgagctcccgcaaccagcaccccattcgatccacctcgccggtgcctcctnctncaaatccgatcggcagaggagctcccgatc

SEQ ID NO: 49704 - DNA, 376 bp, Triticum aestivum
  Clone ID: PAT_TA_49704
acgcgtccggttggtttaagcttcgtggaagatgattgtaggtaatctttatatatatgaaaagctaaaattttctgatccattactgttccaatagcaaggaagggtaaccttactctaattatggtcaataggtggactgttgagttgccgatgtgtgaatgtgagtaattttttgcctatgtgcttggttcatgaactgattggataattgtctttccactgttattccgaacaattgttttaaatcaacgaaattgcttttctaaggtagttgatatttatgcagcttcaactttgtttttttgcgaacaagagatatagttgtttgtctagcttcaaggtttatttgcttgtgcttgatgatagcatggat

SEQ ID NO: 49705 - DNA, 196 bp, Triticum aestivum
  Clone ID: PAT_TA_49705
cgtccgaaggtattcaacccaccgaccgtcgggaagggagcttcgaggccggcgatcgacgcacttgggtcgtaccgccttatccaatggcacgggtccttggggtgtcgggacaagtacggcgccgtgggcaccttcatgagcggctactacaagagcaagaaggggcgcatgttcgagaaggaggtgcaggatg

SEQ ID NO: 49706 - DNA, 269 bp, Triticum aestivum
  Clone ID: PAT_TA_49706
cgtccgcccacgcgtacgcctccttccgccactggcgttggcaaccttgccggggtagctgacacctccctaaggtcaatgcgacggatattcttgagaggagcccgaaccgcccgattggggttcgtcggggactcaatgggccgaacccaggggaagtcaatgtggggaatgctcgccgcacgacgccttttctgggttgcttatttgccaggtgatcgataggtgtccgcgggaggacaagcgatgtatagccatgacttgggggg

SEQ ID NO: 49707 - DNA, 334 bp, Triticum aestivum
  Clone ID: PAT_TA_49707
cgtccgggggccagctgggcacgagatccctcccccccgctcctttcctttccccagtttccctcctcccctcgtcgccgttccattctcggatctgcccccacccctcccattcccctcccgctcggcccggcgagcagcgccgcgtcccgtcccatcccggtaagcgaagcgtcgacgaggccttttctgggttgctcattggccgggtgatcgatcggggtccgcgggaggagaggcgaggcgaggcggcgactgggagggaggaagggaggcggagatggcgcaccgggtggacaatgagtacgactacctcttcaagatcgtgctcatc

SEQ ID NO: 49708 - DNA, 420 bp, Triticum aestivum
  Clone ID: PAT_TA_49708
cgtccgaaaaaccccatcgtcgggcatggggacagcagtgctgcccgtcgcccacaagctctcgctcgcctcccccttcctcccgtgccaccggcggccctgccgtccccccgcccagcagcactgccggcgccggcgccatggggcggtggtggcctacatggagccggacccgaactcgccggcggccatcctgggccgcatcgtcggggccctccccgtggtgggcctggtggcgcgcatcctgagcgacgacggcggcgtcggcggcgacaccgtcgacttcgccgagttccgccgccgcgtcagcaagaagtgcaccgtcatggactcccaggccttctacgacttcaacgaccgccgcggcaaggtgggagaccccttctacgtcctgctctgctgctggctggccgccattgg

SEQ ID NO: 49709 - DNA, 410 bp, Triticum aestivum
  Clone ID: PAT_TA_49709
cgtccgcggacgcgtgggaaaagatgacatccatggattgactgggttacataacctgggtaatacatgcttcatgaatagcgccatacagtctttggtccatacgcctccactggtggagtattttttgaaggagtacactcaggagataaacacggaaaatccgcttgggctgcagggtgaacttgcagtagcatttgctgaactactgagaaaactttggaccgctggtcgcacttctgtacctccacgtgcatttaagtcaaaactttctcgttttgctcctcagtttagtggatataatcagcatgattctcaggagttgcttgcatttctgttggatggtctgcatgaagatctcaatcgcgtgaagaagaaaccatatattgaagcaaaggatgctgatgacc

SEQ ID NO: 49710 - DNA, 385 bp, Triticum aestivum
  unsure (1)..(385): unsure at all n locations
  Clone ID: PAT_TA_49710
ttttgtttaatacagtactttacaagatcatgttgctaatacatatgaccatgtttaatacgatgatgtggctgaatgtacatgtgtaacgagctctacaagtgtgatacaatactgctttacaagaaaatgacaacatgccagactcgctggacaaccatagtcaaggctgggaacaaacaaaatggcaacatgacttcctctgtcaggactgccggtgctgccccttgcncaccgccaccgnacaggtgaatttcctgcacaagtgaaattggactgaatctgtaaacttgtttatactcctggactgggtttggaatgaatttggagtagaagagttgcagcaccctccgttttaagtccacaaaaataagaaggtttcaat

SEQ ID NO: 49711 - DNA, 358 bp, Triticum aestivum
  unsure (1)..(358): unsure at all n locations
  Clone ID: PAT_TA_49711
cgtccgcccacgcgtncgcggacgcgtgggcacgaccgtctagggtgttccttgaggtgacgctagctcgtctacccctgggatttggtgagaccatggaagatgcgggcatggagttcctcctcgattccgttgaaaggtttcccctgcttgaggaattcgcagacagccatgagcagccggatccagttcctctggctttgttggcgaatggagtaaaacgagcggcagtccaggcagattccaatgctggctctgattgtggtcagcagatcggcggcgacagaaatgatgaagcgcgttctggcgttcgccgacgacaggagatgtcccccttgggtctgcgcagtctaccaac

SEQ ID NO: 49712 - DNA, 234 bp, Triticum aestivum
  unsure (1)..(234): unsure at all n locations
  Clone ID: PAT_TA_49712
cgtccgcccacgcgtncgcccacgcgtncgcccacgcgtccgcctaaacccaccctccaccattgtatgcgaagtataaaccctagcccagccccttatcctttcgtctcccccttccagacaccgggccggaacccaaaccattcatgcggacgaccaaccaccagcgggcgccgtgacaagaccccgccccttgacgccgtctggctctcccatggcgcccgcgctgagcag

SEQ ID NO: 49713 - DNA, 391 bp, Triticum aestivum
  Clone ID: PAT_TA_49713
cgtccggttaccttcgtctctccaccacccacccccgtccgcacgaggagctcctcctccgccgccgccgacgcaccacgcgcgtcgccgctccccttctcgtcgcgtccctacctccgcaatctccggaaccccggtcttcgagatttcatcatgctctccttgaggtgttgggcgcccgcattcggtttagcgttcgagagaaccgtcgctctgcgcccgcgaaagttcaactctctagtggtttgcggtgccaggggtccgaggccgagatatcctcgcgtgtgggaaacggataagagaatcgggaccggttccaagtcgcagaagcttggcaaatgtattaaggggttggctaacgtaaaggaggagggttatggtgctcttgatt

SEQ ID NO: 49714 - DNA, 220 bp, Triticum aestivum
  Clone ID: PAT_TA_49714
cgtccggtcccttcctcctcttcgagcctctcctcggctgccattcccttccgccccccgccaccccagcccgccgccggctatccccggtggccaagctgtctcgccgccgccccgcctggcactggcaccttcggcgtggaccccagcgaaaccacgtggccgcctaacccgctataaattccacacccaggtccggctacccaccgcagatcacaca

SEQ ID NO: 49715 - DNA, 410 bp, Triticum aestivum
  Clone ID: PAT_TA_49715
cgtccgcctcccccgtcgtcgcggctccagcttagggtttctcgcccccgccctcccgcctcaccgccggccccgtacgccatgtcgaagcaaggagggaaggccaagccgctcaagcaagccaaggtcgccgagaaggactacgacgagaatgacctggcatacctccagaagaagaaggatgagcaaaaggccctgaaggagctgaaggccaaagcaggccagaagggtgcgctgggaggatctggtctcaagaagagggggaagaaatgagtctgcccacccttacgtaatgcccaaaaaatgataatctatctatctacctatctggggcgcgcttcactatctgggggtggaaaaaacaaccttcaagtgtggtgagcattaaacattggcgcaagcggttgctg

SEQ ID NO: 49716 - DNA, 248 bp, Triticum aestivum
  Clone ID: PAT_TA_49716
cgtccgagcacacacaaaaataatctttttaccatgggcatggccaccgcagccgccgcgacgacggccgctccggacaggctccggcagccgtgcaggacgaggccggcggcgcagatctcctcctccaagaaccgcgcgcccaaggcgcccgtggtgatcgcgcacgagtgccccagcgcgatgcgcgcccacgtcctggaggtgcccgccgggcgcgacgttctgtcgtgcgtcgcggcgttttg

SEQ ID NO: 49717 - DNA, 422 bp, Triticum aestivum
  Clone ID: PAT_TA_49717
cgtccgcggacgcgtgggctctggccaagtccctgcacagattggtaacctgaagcaattgtcatacctgcatttggaacagaatgcactggaagggtcaataccaccagaaattggtttgtgcaacagcctagttgaccttgatcttgcagagaattctttgtctggcaaaattcctgacacagttggctcccttttgatgctggattcactcaatctatcccataacatgatctctggtggaatccctgatgcattgcagtcactgaggctaagctatgctgatttctctcacaacaatttgtctggaccaatccccccacaacttctgatgactgccggagatgatgcattctctgaaaactctgacctatgtgtcactgacacttcaaaaggctggaggcaatcaggcaccagtttac

SEQ ID NO: 49718 - DNA, 405 bp, Triticum aestivum
  Clone ID: PAT_TA_49718
cgtccgcccacgcgtccgctcctctggcgctcccacgggcggcaggggaggaaaccctagccgccgccgaaccgcgaccctctccccatccctcccctcgccgccgccagggcgtgtcggcgggcgaagcccgcccggcatgggcggcggcggggctttctctccttctcgcgaggcgggatcgccgtggggcgatttaccctggccggaacgcggcgttgtgcgggacgctgcgacgctgggctgccacggtggctggcatggagggctgcacgaggcgggctgcgtgatggcggcgcccgtcggcgggatctggcgctcgtcgtcggcgttcgtcggcggcggcggcgggactggcgctcgcgctggtcgggctcgcccctcgtggggagcctcggatccatg

SEQ ID NO: 49719 - DNA, 262 bp, Triticum aestivum
  Clone ID: PAT_TA_49719
cgtccgcccacgcgtccgccctcccaacctccgcgtcgtcgcaaacccaaatcctcctcccacggcgaaccccccctcatcagatcacgcgagcagggggcgccggaaccggatcgggcgcggcggaggaggggggacggcgatgatgcacggcgtggggcagtcggacgacgcggcggcggcggcggcgctggagctgcaggagtccgggtgggaggagctgcggcgggaggctctgaaactggatgggaacctggacgtg

SEQ ID NO: 49720 - DNA, 409 bp, Triticum aestivum
  Clone ID: PAT_TA_49720
cgtccggtggaatccaaacttggagactgtattagcctcccatgctgcagacaaaagggtgatgatatgggacgttagcaggatcggcgaggagcaggcggacgaggacgcgggcgacgggccaccggagctgcttttcgtccacggcgggcacacggccaagatctcggagctgtcgtggaaccccagcgagaagtgggtggtggccagcgtggcggaggacaacgtgctgcagatctgggaggtggcagagagcatatacagcgacgacaacggcagcaacagcaacgcccaacctcttccctgatgtgtggacgatggggacatggatcgctcgtagtctttgggtgagtggacgcgtcgcgtgcggtttacttgtagtgcctcgtacggtttcgtcgcttaatta

SEQ ID NO: 49721 - DNA, 415 bp, Triticum aestivum
  Clone ID: PAT_TA_49721
cgtccgcccacgcgtccgaggactacttcaacggcaaggagcccaacaagggggtcaaccccgacgaggccgtcgcgtacggcgccgccgtgcaagccagcatcgtgagcggacacgtcgacgagaacaccaaaaccatgatcctgctcgacgtcgcgccgcttacactcggcatggagacggtcggcggcgtgatgacgaagctgatcccgaggaacacggtggtgccgacgaagaagacgcaggtgttcaccacgtaccaggacaagcagaccaccgtgtccatcaaggtctacgagggcgagaggagcatgaccaaggataacaggctcctcggcaagttcgatctctctggaatcccgccggcaccgaggggcacgccgcaaatcgaggtgacgttcgaagtggacgtgaa

SEQ ID NO: 49722 - DNA, 139 bp, Triticum aestivum
  Clone ID: PAT_TA_49722
cgtccgcttggcaactgtgataaactcgtatatgtaggcagagtggagagggtattgatcgatttgccattgacgttgccctactccatggatgtttgtattgcctctagatcattatagttcgtgtttgttctaaaaa

SEQ ID NO: 49723 - DNA, 321 bp, Triticum aestivum
  unsure (1)..(321): unsure at all n locations
  Clone ID: PAT_TA_49723
cgtccggtgtgagatcacataggatccacaccatgtcgctcaaaggctattacgaagcctcgttgcgtccgccggccgaggatgatgtgtttacggcggcggcggcggcgacaaagtgggactggggggaagccctcctggaccgcgccgcttacatggtcgacaaggtaaaccacacctccgcccgctgtcgattcaagcgggacgtcctggacgagagggaggtggaaatgcgggtcaccttgtgcctcgccccggcggctttcgtatnctatttctgctgccacgcctactacaccgacgacaaaaggagaagacaac

SEQ ID NO: 49724 - DNA, 177 bp, Triticum aestivum
  unsure (1)..(177): unsure at all n locations
  Clone ID: PAT_TA_49724
cgtccgcggacgcgtgggtgacaggcaatatgatactgcactggatggcaaaacatggaagggtgactgttgganaggaaaaaggaaatcctaacttttgcaccaaaagaaaaaggagggaaccacctaatggggaagattagaatttaagaatgctcttccccaattcttccaaaa

SEQ ID NO: 49725 - DNA, 402 bp, Triticum aestivum
  Clone ID: PAT_TA_49725
aaaaaaaaaaaaaaaaaaaaaaaaaaaaaaaatgtgggggaaaaaaaaaaaaaaaaaaaaaaaaaaaaaaaaaaaaaaaaaaaaaaaaaaaaaaaaaaaatgggggcggccgttttaaaggacccaagtttacttccgcgtgctggcaacggtttagtttttttttagggtaacctaattcaattgcccgggccggggttttaaaacggggggattgaaaaacccttgccgttcccaaattaaatggcttggcgggacatccccttttggccagtttggggaaaaacgaaagggcccgccccgtttgcccttccaaacatttgcccaacttgaatgggaaatgggcccccccctttagcggacctttaagcggggggggtgggggggttccccccaagggga

SEQ ID NO: 49726 - DNA, 363 bp, Triticum aestivum
  Clone ID: PAT_TA_49726
cgtccgcgcacacgcgcggaaagaaacgcggaacgagccgaacctaacgctaaaccaatccctagcccatggcgaagttcatggaggacgacgcacactgcatcgcacactagctcgcccacgatcccaacgtccacaactaccactacacctagcactactgtgtgcactactgtctcgcgcttttttgcaagcttctctcgaagctcctcgtgctcttcggagaggtctgcctaaaggtcggcatcaccatccgtaacaagattgttgacaaggtctacgtcaacatctacatgaacatggtcatgcgaagggacatgctatggttcacgctcgcctggaaggtcgattgcacaaccgatt

SEQ ID NO: 49727 - DNA, 145 bp, Triticum aestivum
  Clone ID: PAT_TA_49727
cgtccgttttcatgggctgaatatgatatcatggcacctgtgcctccaaagactgaagaagccctagctgcagtctttatttgcaactgcggtgcacgcaacttccgtttgcaagcccttgagatgcttgtaagcttagatgtta

SEQ ID NO: 49728 - DNA, 567 bp, Triticum aestivum
  Clone ID: PAT_TA_49728
gtcattcatcaccgatcaccagcacgggcgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacataagatccactcatcttgggtatctggggaggcaagggtcaaggaaaatcattccagggcga

SEQ ID NO: 49729 - DNA, 452 bp, Triticum aestivum
  Clone ID: PAT_TA_49729
agcgtccgatacgcagaaccgacagtcctccgcgtactcgtcctatacgcatacaggagagcagctagctagctagtcccgttgatctactacagcgctagtatcagcagcagacccggccgtttattgcgcgcatggctcctcgcgaggccctgctcgctcctcctcgtcagggccgctctggtgctgtgctctgtcgtcctgggcggcgcgcgcctgcacctaggaggtggacgccctcgccgcgctgccgatccacgtggaggaccacacgctggacctgcagagctggcatctgaccctcctcaacggctggatctagagctaggatacctgcgacaccaacagccgcgtctggcgccaggatataggcaacaccaacagctgcggctccatcgtgccttaagtcagctgcctcgtgaatggttggaacctgcagctgcacaggagca

SEQ ID NO: 49730 - DNA, 302 bp, Triticum aestivum
  unsure (1)..(302): unsure at all n locations
  Clone ID: PAT_TA_49730
tactgatatattgagaggattccgagtaagtactacaccagggggggtgtccacacaaccaggggcctcaaccacttccgaatcttccactcgtacatgaacacctgctctggactgatggacttactaacctagatcgttacaaaggacaatgctatcacatacagcctggacctcacgaagacagcaaatggatcttgtatgtaacttatccattacacctatttcaagaggctnccggnactaacatgtntacttgcattgnacgtaacccatttggtttaaaagccctacgngctcta

SEQ ID NO: 49731 - DNA, 405 bp, Triticum aestivum
  Clone ID: PAT_TA_49731
gccgcctcacgcagtccgagtgtatttgctctcaggaatttcttgggttagggatcttagtgctccatgtgcttgatcaagtgatctagttctccaggagttagaaggtagtgtaaatgaaagcagatttaggcacatgtacattcagtacaataacacaggttgtgagctttattacattgatcatcacatggatgctgatatgatgatacaggacaacaagaccgagcctgctgttgttactgatgaaggcaggtcttacagtgctacggttaatcattgagcacatctagcaagctgtatggcaatgcttgagtgagctaactatgactatgggcggactgctgcagaccggatagtgttctatctggaccatatgacctttgatctgaaagaggacactta

SEQ ID NO: 49732 - DNA, 431 bp, Triticum aestivum
  Clone ID: PAT_TA_49732
ctcacgtcccccctgctgttgctcttcttgcaccgatctgaagctgctctctctccagcgcccctttctgcttctcctcttgctactgctgctgcccccaacctcctgctggtatctctctctactccccctgctacatttcttctctgaacctacctgctgcttctctctctctctgaaattgttgtagtactatgatgtgcaagacagtgtactgcaacctgttaattgttcagttcagatgtttgcttgtttagtattattctgttgatctgtgagtactaatcttgtggctagtataatttcgtttctgttgttacttgtgtaacctgaaccgtggggtagtatcctattcgcatatgtgtgttttgtgtgttgtgtagtccctatgttagttttgtacctgtgatatatatcttcacaatataatt

SEQ ID NO: 49733 - DNA, 494 bp, Triticum aestivum
  Clone ID: PAT_TA_49733
gacccacgcgtccggacggcccagcgtggcgaccacgatgagggctctccccatggccgtcagccgcggcgccgtcgcctgcgccaccccggccgccgccgccgcagccgtcccccggagatccatgctcctctccaccgctgccgcaggcgcagcgctgcagtccgaccccatcaggcgtgggagcacgcccaagctcaagctccgcgcctccgccggcgccgcgcaggccgcggccacctcattctccagcaatgacgaggccttcacctgggccaagaaggacaacaggaggctcctccacgtcgtctaccgcgtcggcgacatcgacaggaccatcaagttctatacagagtgcctgggcatgaagctgctgaggaagcgtgacatacccgaagagaagtacaccaatgccttcctcggatacggccccgaggaaaccaactttgccatcgagctcacctacaactaccgggttgattcgtacgatatcg

SEQ ID NO: 49734 - DNA, 502 bp, Triticum aestivum
  Clone ID: PAT_TA_49734
gtgtcttctcctctccctgccgatggtgggggttaatggatgttcttgctagatctgctccctctccttattcttatccctgtggttgttcttatgcttttataaggtgcttttttgtgcttttttctgttcacaggatttgggaatcaggggattcttggcagagggattagtttggtgcatctatccccttcttcagccgatgaagtccctgaagttttcgatgtcgtccttgatgaatattgctttaggaggatgatctgctgctgttggtttggtggatcgaaggagaaggtagctgcctgcaagaatcgtctggacaagttgttcagaaacatcagaaggcaaggggagatctgagctttctttcttctcccatggtggcggctgtgtgggtgttgagcaagaaagaagaggaggcaagggagaagacctagtgagcagggccggccctgagggggcaggggggggcgggcgccccgggcccacgagtaggaagggc

SEQ ID NO: 49735 - DNA, 447 bp, Triticum aestivum
  Clone ID: PAT_TA_49735
ccccagtcactacgttggatcctaccttgcgactgtacgcgggagcgtgacgctgatagagtccatcacaatggatcagttgatccaccacttctaggagacggtgcacgttgtcatgaccatgaggtgcttcaggtaggtcgatggcttcttccaggagatcctcaatcgcctcaactctagcctgcggatggacttccacaacaatggcgtcaacgagtggctcgagttgcgcgtgaggctggccgttagcttcactgtttgcttcactgcctcgctcatgatcactttgaccaaaagctacatccaggcagaatttgttgggctatcgctatcgtatggcttatccttgaactcagtcttgttctgtgccggatggatgagtagcttcatggagaacaaaatgaggatagaggagaggataaacctgctgttaaacatacagtg

SEQ ID NO: 49736 - DNA, 435 bp, Triticum aestivum
  Clone ID: PAT_TA_49736
cggacgcgtgggcggacgcgtgggtttccgagctgctcgcctcccctcccctcccctccccgctcagccgagcctccccaattcccgtcaccgccgccttctctgacccggtcgtatttatacaggcccattcaaaatccacgccgcaaaatattatccacaaatccatccggggttagggtgctgccagctgaggctgctgctctgcttcactgctcttccctggtgacttccggcctcggctctcgcgtggtaatttggcggctgcttggttccggcggtgtctcaggttgggatccggcgatctggtcctgtttcgtggtgatttggtgtgtaggtaggtatgggcacgggagagggcaggggccggcggcggcggaagctcgagggggacgacagcgacgaggagtatgtgttggaggaagaggaggagga

SEQ ID NO: 49737 - DNA, 433 bp, Triticum aestivum
  unsure (1)..(433): unsure at all n locations
  Clone ID: PAT_TA_49737
cggacgcgtggggtgaaagtgcagaggccattcgtacttgagactgtcaccatagatctattcatcattagaaacttggggttggttctcaagaggtttccacaggtcgcccttgatgttgttggcctagtagatgagtgggctgcccggttttttgaagaacttgattatgtcaacggaggggaaaatggcaccctcttcgctgaaatgatgagagaagatcttcctcaggttgttgtaccaaggacataccctgaatatacgtctagaaaagttcttaccacagggtgggtagatggtgagaagctttcacagagtactgaggatgatgttgggtcattgggtaatgttggtgttatatgctatctaaagcagntacttgatactggattcttncatgctgaccctcatcctggaaatatgattaggacac

SEQ ID NO: 49738 - DNA, 330 bp, Triticum aestivum
  Clone ID: PAT_TA_49738
aacgcccgcacggccgccatggcgcgctcccgtcgtctgccgtcggggctgcctctgccgggctagggatcgcgccgcctcgctgcgacgtatggcattgcctgatgccccaggccggacaaggccatctccaccgcgccgaagggccaccgctgacagacaccgctgctccaccgttcacgcagcgggaaccgctccgcgccgaggcgggagttgcccggagccggcagccgctgagggcgccgtttccgcagggagcagcggcgccagcgaggacgacgtccgccgcccaccgcttggagacgagccagagggcgctctggggtcgtg

SEQ ID NO: 49739 - DNA, 600 bp, Triticum aestivum
  unsure (1)..(600): unsure at all n locations
  Clone ID: PAT_TA_49739
taatttgctacaaccagtttcaatgggtgctaccaccggtgtctttgattttgctagaacatccttccacaaaggctcctttttttgcatttttgcttccactgtttttggttttgctggaactaaaacaaagatttgctactactgctgttggctttgagccatggttttctgctactgagcattttttgctggaactatcatttaattgtgctggaagtgacattttttgttgcaaccgccttcgcgttttgctacgaccagggaagttttttgctacatccatgcatggctccagagtcggcgagaaacaccggagacgacgacggcgaggggcggcaaccggcggcgaggggcggcaaccggcggcaagggcggggaccggcgaggggcggcaaccggcggcaagggcgcggncggcggcaagcgcgatccgccatggacgcgggctgttggtcaacgcacgagaggaggcatgaggacgaagccggacgtctagaggatgccgcatccagcggctgggcataaacagatcgagcggctacgcgctgaccgggccaaatttgggccggcgcaccggcgcctataagcgcccatact

SEQ ID NO: 49740 - DNA, 426 bp, Triticum aestivum
  Clone ID: PAT_TA_49740
cgtacgtgccgtcggcaagcgaccgggtccaccaggtcagcttgatgatgcttatatatggaaagcagtctggcacaagaggtataatctaatattactatgattctcgctggctagtacagggccgaatctatagcgacctcaacatacgcttatatcgcctggagctgccaactttgaaggcagcctgcaataatcacgaggctctgttgtttaaccgctacctggtgcaagctatttcgcagcatggatccttgtcaaatatatgcagtgtgccttgtcttctgcggatcacaatatatatatgtgtctttagtagtagttgatgcattgtattatcaagctttttgtggaccttaaataatacaaagagggcccgctcgtggagctggaggaggagggcgccgtgcggggcgacatgatcaa

SEQ ID NO: 49741 - DNA, 450 bp, Triticum aestivum
  unsure (1)..(450): unsure at all n locations
  Clone ID: PAT_TA_49741
cccacgcgtccgcgagcgacgtgcgggagaccgtgggcttcgccgtttccccactcgtctccgcctccgcctccgccaccactagcgatggagacttccgctgtccctgaggcgactgaggcctggcctcctatggaaaatgatgaaaatcagaagccatttccgttgaccggaccggggggactgtcgtttctaaaggcagtttcagatgtatcagtcacaccaatcacaggtctcaatgtatacagtgccgcttgcgtcctcacgcgggcagaaacttctgtaaacatcgtactgaaggctgcatttctgggacttccattctcgattctaccaattttgttgatcacacgccgcatcattagggtggttgagcaagggggctgcagtatggatattggagccttacttggtttatctcaanttatatatatctatgtgcttgggggc

SEQ ID NO: 49742 - DNA, 432 bp, Triticum aestivum
  unsure (1)..(432): unsure at all n locations
  Clone ID: PAT_TA_49742
tggttttgcggtgtctgtaggttctggtnncttggtggattttgttagctcttgtagatgcaattgctggttctgctgcggggtatgtgtagattccgctggttccccctctactctttttgtagatgtatgaactggtctgttgtactgggttatggtgtcgttgtcaggggggtgtgggcatnttttgaacccatctctntangcantnntangtntcataagagggttgcttttgtggttagggttcggagatttctgctaaatagataggctatgtgtttgcttcagctggttgggtcatggcagttctactccaaccctgatttctgttgtagttgtttgtatttgggtagtattaattggttncccgtgttaggctttggctttnttcagtgcttaatcatgtatgagatttttgcagaggtgagc

SEQ ID NO: 49743 - DNA, 344 bp, Triticum aestivum
  Clone ID: PAT_TA_49743
gacagtcgtcgcaccagctatatacttacgtagtgcagacatagatcctactgtgctgtgtctggtattgcaccttcgtatctgatttttcatgtgctcaagtgcacctctgactagtctgagcctactctatatcgtttcttgcatcgtatgcatcgatcactgttgcacgctctaatgcatgcaagtgtgatcccatgctgggcattcagtagtgcgagaccctgtcctacctgccaccgctcagcacggaggccctcctcaagcaggtcgactacctgatccgctccaagtgggtgccttgcctagagttcagcaaggttaggtatatcttccgtgagcac

SEQ ID NO: 49744 - DNA, 462 bp, Triticum aestivum
  Clone ID: PAT_TA_49744
cccacgcgtcctgtgctacaagcgtagtgacactagttcttgcaccgatcagatccaatttctgcacaggatgctggacaagctgtaagacgacagtgctggctcgccctcagccgcagtccagcctcggcacgctcccgcgtgagcgacggcacccagcctctggtccttaccacagctgcacgttaggcgattaaacaggctccagacattccgtcactcgccaccactctgcagacaggccctgctaaagacggtagactacctgatccgctccaagtggatgccctgcctcgagttcagcaaggttggcttcgtcttccgtgagcacaacagctctcccgggtactacgacggtcgatactggacaatgtgtaagctgactatgttcggatgcaccgacgccacgcaggtgctcaactaggtgcaggaggtcaagaaggagtacgctgatgcctatgt

SEQ ID NO: 49745 - DNA, 455 bp, Triticum aestivum
  Clone ID: PAT_TA_49745
gcagcagtcattcatcactgatcaccggcacgaggcgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgagggccgcctcagctcatacgagtacgtcagccagggactcaagaagtacgacttcgacacaccatgggaggcttctacatcgctcctgc

SEQ ID NO: 49746 - DNA, 413 bp, Triticum aestivum
  unsure (1)..(413): unsure at all n locations
  Clone ID: PAT_TA_49746
tcatgcatccatttttttctcgctggggcgagggtcgtgtagatatctctgtctcttacatacgtcgctgctgtgctgtcgcgccacttgtgactcggagggacacatctctcatgtaggcgggggtgtcgtcggncctctcgcgaggaatgctggatcgaggcagggccaagctggatgagcgtgctcagatgaagatgagcgaccggttcttcatcgaggaggaggaggaagaggaggctgatgaggtgctgacggagagctcctacatcggngcgccgtcgccgtcgagctcttccaacggggaggactcctcgtcggaggttggtggcgaaggggaagccaaggaggtggagagcaagctcaaggaggagcccgggctcgggtgcctggacgccctgaaggactccttg

SEQ ID NO: 49747 - DNA, 402 bp, Triticum aestivum
  Clone ID: PAT_TA_49747
ctctaagagaggatgaggaggctgcgcggctgcgtgcctggcacttatccttgcagatcgggaccaatgtatccgagtaccaggccatctcgaaatacaagctttccaagatgtcctactgactactatacattcggggcgcaggacgagtggaccatcatggagaacagggcggcatactgcaggattctggtctgccctcgcatactgatcgacgttgcaaccatcgacatgaccacacactggctgacagtgtagatatcgatgcctatcatgattatcctaaccggctttcacatgatgattcacccgggacggagagtactgcaacagatacgggacgaactcagcagcaaggactgcgatgacactggcatcgggggctacatccagcgcggagga

SEQ ID NO: 49748 - DNA, 514 bp, Triticum aestivum
  Clone ID: PAT_TA_49748
acctcaccgatcccgaccggagcccgcgaccccgtcgccatggcggtgcgcgcgacggtctcccgcttccccgtgacgcagggggcgctggacgagtgcggcatccagtggggcatctccgtgacgcccttcgccgccgacgacgagaccggccagccgcccgccaccgccggccgcggcgaccgcctcccgcgctgcgagcgctgctgggcctacttcaacacctactgcgacgtggagcgctggggctgggcctgtgcgctctgcagcaccctcaacggcttcgatgacgacgccctccaccgcttccagcgcccagaagcttgccccgagctcaacgcctccttcatcgacttcgagatgccagtggatgacgcggatggtgcaggtgacggtgtgaaggcgcggcctgtctatgtggcggcggtggatctcgcttgttctgaagaattcctggaactcatcaagagtgcgcttctggcggcgctagaagctctgattccaggctccctgt
